United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 18

SEQ ID NO: 483 - DNA, 40001 bp, Homo sapiens
ctctatttcttcctgctctctctaagaatgtaaattccacgaggccagggatattcaccagttttgtttgctgttgtatctactccaagtacctaggtggaagactgcctggccctcaattaatctttcttgaatgaagggaacaactgaatgactcctgagtctcatagccgcccacatggggtaagaaccccacatcccaagaaaagtcaataaaaccccttaccaaagaaagcattcccttcagtttcatagtttgaaggaataggggctattagggaagagtctctgactcaaaggaaggcagtattttgggctttctagaagtactaatgatacatcaaaggaagtgaaattgtcattaaaatcaatgcctttcagcaagtccagcagatgtgggtggggctgctgtcctgtgggttttgaaaggggtgtgtactgggagagcccccacggtcacctgctggctgtgatttctacctccctgttgggttgggaagttgtagttacttttactaagtgcctgctaagtaccaggggcttcctacagattagttcatttattcctcaaaacagctaaatgttggctgagcaggcatggtggcttatgcctgtaattccagtgctttgggagaccgaggcaagagaatcattcgagcccaggattcaagaccagcctggacaatatagagagaccccatgtctacaaaaataaaaaaattagccaggtgccatgacgcccacctatagtcccagctactagggaggctgaagcagggggaccgcttgagcccagtagttcaaggctgtagtgagctctgatggcgccactgtactccagccttggcaacagagtgaagacccgtctctaaaaaaccaaccaaaaaacaaaaatacaaataaatgtagtggtagaattatgcctattgtacagatgaggaaagaaggatgaaaaaaggagtgagttgcccagggtcacccagctaactgattagtagcagagtctggctggaaccctggcctgctcaggcttaggcttatggtcccagtctatagctcctgctcatggcgctcccagaccctccctcccactgcttgcctctgacgtgtggatcttgggcttccctgaaacaggactgaaatgagcctccttagatgctgatgtggaagtatatctattcaccatggaaagatggttacagcatcacttgaaacccagaccttgctttctgagcccaaaggaatgtcccatctcatctactaggctggtctccaagaaatcttggctgtttccagagggatcaaaggagcctgctggccaggtgcggtggctcacgcctataatcccagcactttgggaggctgaggtgggaagactgcttgagcccaggagtttgagaccagccttggcaacatagtgagactgtttctacaaaaacaaaaaacaaaaaacaaaaaacaaaaacacaaaacaaaacaaaaaaagaagaaagaaagaaagaaagaaagaaaagaaaaaaaatagttgggtgtggtggcacatgcctgtggttccagcgactataccatatgactatattacctattcaaaaacaataaaactggccgggcacagtggctcacccctgtaatctcagcactttgggaggcgaaggtgagcgaatcacctgaggtcaggagtttgagaccagcctggacaacatggtgaaaccccgtctttactaaaaatacaaaaattagcggagcatggtggcgggcacctgtagtcccagttactcaggaggctgaggcaggagaaacccttgaacccaggaggtggaggttgcagtgagccaagatcgtgccactgcactccagcctgggcgacagagtgagactccatctcaaataaataaataaataaataaataataaaataaaactaaaaatggttaatgttaaaaaataaaaatgatgaccgtctgtgattggggagagggaaagttgcaaagtagcttgtttaatataagctaactgtttttgtgttttaaaaatgtatgtatgtcaccagtaatgggacaaactgacatcacacacctctcagcaggatggactgaggacatagcatcatttctgttgctgacaaaaatgcagaacctgttgtatctaattttaagaaagtatcaggcaaaccttgaggggcactctacataataactggcctatactcttcaaaactgtcaaggtcagcctggcttggtggctctcgcctgtaatcccagcatttcgggaggccaaggcaggcggatcgcttgagcccaggagttccagaccagcctgggcaacaggtgaaaccccatctctatttaaaaaaaaaagaaacctgtcaaggtcatgaggaaaaagaaaagctgaggaattatttcacgtgaacagagaataaaacacaggacaactaaatgtaattgttggtactgggttagatcctgaatgagaaaaacaattgctgtacaggccacgagtgagacaattgtggaaatttaagtaaggtctgtagactagatggtagtatcatatcaaagttagatttcctgatattgttaattgcgttatggttgtataaattaatatccttgcctttaggaaatatataatgatgtatttagtagtaaaggggcaatgtactctcaaatagttcagagggaaatataatatatatgtatatatatgtactgtatatatctacatatatgtagagagtgaaatgggaaagaggaatgacaaagcagatgtggccaggcacacatgtgagtaaagagatctttttattgttattgccagttttctttaagtttgaaattaattccaaaacaacagaaaattctgagtcaaaatcttaccagggcttatttctgggtgatgttatattttcttttatttttgctttttttttatcttttttttcgcttacttttttttttgaaaacgttaatacaagcatatagtaaaaataatccaaatgctaaaaaaaaaaaacacctccagtgtaagtttccctcccagctgagtgtgccttcagctccctagtcctctcagaggcactaccactacctgtttggttcagaagtacacctctattctgccaggttctgcatttattttccttttttttttttttttgagatggagtcttgctctgtttccctggctggagtgcagtggtgcgatctcggctcactgcaacctccacctctcaagttcaagcaattcccctgcttcagcctcccaagtagctgggattacaggcatgcaccaccacctccggataatttttgtatttttagtagagatggggtttcaccatgttgcccaggctggtctcgaacccctgacctcaggtgatccgcccaccttggcctcccaaagtgctgggattacaggcgtgagccacagcacctggctggttctgcgtttctgtactaaacaggtagtggtctcccagtagatatattctgttcataaacaaacacatatggttaggttgcctcttcccacttccctcatccccccagcaaaaatagtggtatcctgatccataccaatctacactttgtttttcctctaacataatatcttcatgatccttccatttggtgacacatagagctactgtgtatttgcagttgatgttgttgttttgttttatttctgggacagggtcttgctctgttgccaaggctggagtgcagtggtgtgatcatggctcactgcagcctcaacctcctggcttcacgcaatcctcccacctcaacctcccaagtagcggggatcacaggtatgtgccaccacacccagctaatttttatttatttttattttttgtggagattggatctcactctgatgccaagctggtctcgaactcctgggctcaaacggtcctcccatctcagcctcccaaggtgctgagattacagttgtgacccaccgtggccagcataccttatatttttatgggctatttagaattccaccatacggacgtatcataactcattgaacccattcccgttgtcatgaacatttaagcctattccagtctcttacaaacaagattgcaatgaatgacagccacttttttgtgcacaatgtgtaaagaaatatacagaataatctcccacaagtggagctgctttgtgaacatacatgtgccttttacattttgaaagctacagtggtcaccctccagttagcacatcaccatcagcacttgatcacacataccttctcacagccaccctgcacagtacagttcacattttttgatctttgctaatcacgtggaatttttttcttttttttttttttttgagacagaattttgctcttgttgcccaggctggagtgcaatggcacgatctcggctcactgcaacctccatctcctgagttcaagtgattctcctgcctcagcctcctgagtagctgggattacaggcatgcgccaccacacccagctaatttcatattttcagtagagatggggttttgccatgttgggcaggctggtctgaaactcctggcctcaggtgatctgcccgcctcagcctcccaaaccgctgggattacagatgtgagccactgagcccgggtcacatgtgttttttaatgctatctgttcgtagttttaattctcatttctatcattaaaagtgcaggtgaaaatcttatcatttgctctaaaagtcacttgtattatttttttcctctgtgatctcttcctgagcttataggaatggtctgattttctaccgtggacccagcccttctacagggaaacccaccgtattaatgccaggctgagcctttctggtcctctctgggtgctggaaagaggaggatctgtatcttctggtacatttggaccaatgtgtgtctcaacatgtccagtgactcacgtctcctttcaggttttctagctataagcccaacagcgataatttaccaaaggtgctgggtacatgatggcagcccatgccaagggcagcctccctatcccacggcaggcctgtcccgggacgttgcagggcgtctatctgcccatccctgagaagcagcacttcttagtcactctgggtttgttttctccccacgtctttcaaagcttcgatgggaacagaacacttcgttcaacaggaggccctgaaaagcccctttgtgctgcatccgtcccaggaaccagctcagtgttctctgaaagaaaaaagccttggataaaagctggcattttaagaaccctggaggtcaggcccttggtaatgagcctcattagtatgcaaacacacacagagcaaagcttcagctcctcctgaacctagctctttgcagatgctgattttagaggtgggattttttttttcccttcagcatctgtggggttgcggcacaggtaggagatttttttctacctggaaatgtagctgagacaggtcacttcccaagcattctgccaggttctgcatttctgtactaaacaggaagtggtctcctggcagatgtattctatttataaacagatgagtatggttagcttgcctcctcccactttcctcatccccctacaaacgtagtggtaacctgatccattatcttgaccatccctgcattgttcacagagcctgggttttggaaccagatagactgaggttcaaatcctcactctgcctcttcctggctgggagacctttgcagatgacttctttgagccagtgttcatctcaaatacagatttacaatagtacctattttgcaagtgaggtgccggtgtcttaggatgcagaaaagatgcaaaaatgagatttggtgaccagagaagaatacaattagaagcaattcattggccaagattttcctgtaaggagatgaaatcaaggaagtaaccactgagctctgaaaaaaatgcaatcaaatcctaacatttccttttgggttgaaactcagaaacttcctattaccctcaaggtaaaaacacacacacgcaacaacaacaaaacaaaacaaaaacaaaaacacccttactctggctccgaaggctctgggagtgtgtgattcacttcctagctgccagtctatggcttggccttgggctctggggctctgccagtgtagacatctctgaggtctgagactccttaagctccctcatcctccctccaacctctgatcctggaagctccctctccctgggatattctcccatcctctcctccccgctggctaactcctgctcaatgttcagatttcaactgtagcataacttacccaggactagggggtatgaagcccctaaaagggttatttgcttctgtggcttctagggcccctacaagttccaccttgtaacacacactatacatggattttttttttttttttttttttttttttttttgagacagagtctcgctttgtcggccaggctggagtgcagtggctcaatctcggctcactgcaaactctgcctcccaggttcaagggattctcatgcctcagcctcccaagtagttgagattacaggcacatgccaccatgcctggctaattttatttgtttgtttgtttttgtatttttagtggagacagggtttagtcaagttggccaggctggtctcgaaatcctgacctcatgtgatccacccgccttgggctcccaaagtgctgggattacagatgtgagccaccgcacccagccatgcatgtggaatttctgactccctattttccttgctgggtttgcaagctccgtggggatgtatttctgcctggtactgtggctggcacacagaaggggctcactgagtacctgggtgagaaagaaaagggaaactaaaggaaaagatagggtgataggagagatgtgaatacactggtgtgctccccaggttcccacagcagagtgcagccacttgttcatataccctctggatcaggtcccctggacatgggatgagatgaagcatatggtagcactttaaggaacaagcctttgaaatccccttctgagctttactgggtacttagctctttcttctgctttggaaagcttcaaagttatttccaagccctaattaccccacacaccatagccccaggcagctgccaaacttggccaaacttggcctcaacactcccagttgcaaattagaaaactaagcaccaaagtaaaagcttgcctgggtcccaaagagaaaatccacctgaaatgttccttgttcctcaggaaaccacctatggaacaagggctgagggctgagaattctttgggcctcagtttcctcacatgagtgtgagacgttccctgctgtacaattccttgattctcccctgtggatttacccagttcaggggctgcaaggaggtagcacccaggctgtcagatgtgttgtgaggttctcaatgttgtttttttaattggagattttgtgtaaaactacctatttagaggttcttttgaaaaatcaatatatctggcaacactggactcactgtttccatctccatatgtgtaaaactggctgcagttgaacagtagctgcctcttttctacaggtcatgttttctccagtttgccacagtccccactcctccctgttgtctctgacctggctcacattactcatttgtgaaacctgctaaaccctgtgggcattcgattcatagctcttgcagtaaatgctttccccttagtcactacttctagctacactggtgttctctcagtttctcaaagccaaactttttccagccgccgggcccttgcatatactgttccctctgccaggaacgctccttcctccacaagttgcagctgaagggtcacctcctttgtctgaattgggtttccctttatgcatctgtattcttccatgtcacatgtcacactttgtgattactcatgggtgtgatgattcgtctgtcttctctctcctctattagaattaggagggcaaggacttgcttagtttaaaggattgctacctctgaagcatacagtctagaacccagtacatcttaggaccttggtaaatatttgtgaaataaatgaatgaatgaatacatgagtgggtctctgccaggcatccattctgtgagaagtggctcctaggtgcagtggctcacacctataatcccagcactttgggaggccaaggtgggtggatcacttgaggtcaggaatttgagaccaccctggccaacatggtgaaaccatgtctctaccaaaaaaaataaattacaaaaaatcagctgggcgcggtggcatgcctgtaatcccagctacttgggaggctgaggcagaattgcttgaacctgggaggtggaggatgcagtgagccaagattgcgccactgcactccagcctgacactgcactccagtaacagagcgagactccgtctcaaacaaacaaacaacaacaaaaaagaagtgtccagtcatcccatcttcctgcttcctgtggggttggtaaaaggatgccactctctggcctccctatgtcctcgggcccgtgtcagcaggtacatgtgttctacttttccagaagccctgggatgaaaggtgggtgaagacactttaggagcatttgcattcaaacctgggtatatttgtcaggcaactgcagatgcctacagagatgacaaagctatgaaatgaggcctcttccacgtggagaaaaggaggtttggcttgaattagatctataaagtcccaaagtggatgcagagggatggaagctttgacaattagaaggattcgaggtctcccttgaagtttaaaagcgttcaaggcaaagaaacatctcctccaactgacttgactcagaaggatcttatgaagtgttctgctcctgaagtgtcaaatcccagaaggaacagctccttgtcattgtttaaaacttgtccatgtttaaaaattgcaatattaccctgcccccctgccccggcacacacacagtcctgattttcaatttctctataaaatcagaagagctaagcggggcatggtggttcacaactgtaatctcagcactctgggaggctgaagtgggcagatcacttgaggttaggagttcaagaccaccctaggcaacatggtgaaaccccatctctactaaaaatacaaaaattagccaggtgtggtggcatccacctgtaatcccagctactccggaggctgaggcaggagaatcgcttgaaccccagcgatggaggttgcagtgagttgagattacgccactgtactccttcttgggagacagagtgagactccatccctgccccaatcccctcccccacccccaaaaactcagaagagccagcaaaattcgatccttattcccaaatcccaatattcaactgaagctcagacagtttgccatagtccccgccacccccttttacctacaatcagcctacttcactcttgtgtattaaccacctagcccctgaatgcacctcagtttgaaatctttaattcaaagtttcccaagaattcatcagctctggatattgttgactctaaggtgattcccaaattgagacggggccgtttgctcctggctgagctgggaactgaggggcctaaggtctacactttccccagccccctgcctcccaaccgctgacctctaggtcctgtaattctagcactggggccaagcacttcaaagccaaacaagatctaaatttagttggcacacatcctctttggcctcgacctgttttcttctgccaagcagaggcttctggactctgctcacttcctattaaaattaacaagcgttgcaggcaggcatcaaaggctgggttgtgcctttaatattctaggcaggcccaggctgtgatcacagcccctcccgcttcctctcttccaactgaactggggaaagtggttcggctgggagtgccagaatcagaacattggccatccttgtctgtttgatatctgcacgaaggaaaattccagggccagtagaacatccccacagcaattttcttcaaagtgccctgcaaaaactggccaattattcttaagaagcacccttaaagggatatgttattaccctattttattggcagagaaactgaggacaagtagcttgcccaaggctacagagagagagagagagaaagagagagagagagaaagaaaaagagagagagagagaatcaaagcagtgacagcatatatctgtgtccatcccaggctccctcagacctgtatctggcccaggaattctagcacacccaggccttcatgcccagccagggttgtcgtggccaccctgcctcattctcaggctgggcttcccagatccaatctgtgtgaggacattaggtcagtaacccacaggcactactgatgggggcaacaagctctgtcagcccctttacaacacacgaaatgaaagctgtgggtaattcttctccttctattaatgctcaaactgtcgcctttgttttttctacctaacattaattggagattatctgatttttttaatttgttttatttttttgagactgagtctcactctgtcgctcaggctggagtgcagtgatgctatctcggctcactgcaacctccaccttccaggtcaagcgattctcctgcctcagcctcctgagtagctgagattacaggcacatgccaccacgcctggctaatttttttgtatttttagtagagatggggttgttaccatgttggccaggctggtcttgaactcctgacctcaggtcatctcagcctcccaaagtgctgggattactggcatgagccaccacacccagcctgagatatatattttaagaaagggtctcattctgtcacccactgaactgcagtggcatgatcatggctcgctgcagccttgacctcctgggctgaggtggacctcctgcctcaaccttccaagtagctgggaccacaggtgcacaccacaatggcctggctaattttttaaactcatttgtggagatgggggtcttgttatgttgcccaggctggtcttagactcctgggctcaagctatcctctggcctcagcctcccgaaatgttgggattacaggcgtgagccacctcacccagccaatgatcttattattttcagagaactatatattcatactggagaaatcaacacacaaccagtgtacaatggtctgggtttgtagtgaaatccctgctaggtgggtaaggactctctggtttgagccttggtgccgctacctgagggttgttcaaacagaagctcacagaccccagggatttcagaacaggaggaaatggtggaaatctggcaaacccactctgtgtcgagcaccctgcaagggctgcagggcctgagctgctgaattcacacccatatctttgggggaaaagcatgggcaaaaagtgcctagggacaaggaacaatcagtgaagtttctcccaagagggtctatgatcccaatgcctcctatacaaactggttttggggaacattggctggggggttgcccctctggaaatcttaggaacaggcatcctccaaacggttgttttcttactccagcaacagtgctgggaggggcctgagcagtcttccaggtgtgaacccctcattctttcaaggaaatcgaggccggggcagggaagtgaactcgtgagtgagcgatgccaatgggtaagtctggaggatttagatgctctgagtcccaggctggtgttcttgcactaggagagagaaaagaagagacaggagacaaatgagaggtgagagggtaaaggaggaatgagagaaaaggaggaggagagaaaagggagaagaaggaaaagaagaagagatgaggccagatgcagtggctcatgcatgtaattctagtactttgggaggccgaggcgggcagatcacctcaggtcaggagttcgagaccagtctggccaacatggtgaaaccccatctctactaaaaatacaaagttagccaggtgtggtggcgggtgcctgtaatcccagctacttgggaggctgaggcaggagaattgcttgaacccaggaggtggaggttgcagtgagccaagattgcaccattgcaccccatcctgggcaacgagagcaaaactcagtctcaaaaaaacaaaaacagaaacaaacaaacaaaagacagatggagtgcaagagaagagatagagactctttttaaggtgcacaggggtgccttagttaatttcacatctgagcgcacggttctgtgatgcccgccaatggcttcttctctgggtatctgaactcttcaatgacatcataaaaccttcttctttttaccatgggttgagccatatggcactttgtggggtcctcgcggttgcttcatccaagaagttggttctgcgaggggccacactccatagccgcctaagaggtttcaaaggcacctggagtttcctccccaattcgccagcccactcagctgggtcgcactggggtggaatgacaggcaagacacttcccctgtagggcctcaggctcccaatctgcaaatggggttgagactaagagaaagtttggaccacgttcctgctcttagagctctggcattctagaattatgtcaattccaagttattctgctttcctctttcttcttcaagtatttgtgagaggcattacagactgtgtccagaactccttgctatgaattaattacaaccggaaggaaaaggttctaaatgaacgggggataaagtgccaggagcctaataccgaccttgctcaagtcagtaagaccatcccccatggggttagcaactgctttcagtggacatgaaggccaagggtgctgatccaggctgccacctccctccactccccagctaccttggacgacctccctggggatataccagtatgttcagcatcttcatcttccaatggcatttttgagcttcctgaactggaaagttattaaaagtcagaagcgtggaaagacagaaacacccagtgtgtctgagaaaatgatataaattggtcctaaagtgggattggtgagtgctgtatccgactaagcaatcatggggtgcagcatgttagaaacaacactggaccacagagaggaggtccacatggccagagaatttacgatagcatgctcagcctcagtagtaattagggaaatgtaaatccacaaccaaagaactgacatttcatatctgttgtatctggttgggctaacccaaaacctagcacactatgtaactggcaaaaattagaatccgggcatggtggctcacacctgtaatcccagtactttgggaagttgaaatgggaggatcacttgagcccaggattttgagcacaacctggccaacatagtgagacccccatttctgcaaaaaaaaaaaaaaattagaaagtctgattataccaagtgttgacaaggatgtagagaaatggatacttgagtactttgcttatgggagtgtcaacatccacagtgagcgatttgggaatatctagtaaagtagaataagcacattcccttcaaaccagcaagtccactcctaggcatgccccctagagaaactgatgcatttcaaataaggaaatatgtctatgtggacattcattgcaacagtgttcatcataatgaaaaagcagaaatgtctacatgcccatcaacagggaaaaggataaactgtgaaatagttctacagtagaataccataaagcagttaaaatcatgggtaaattttgaaatttcacactgttgtaagatctctggccacgcggggctcctctcccctgtggtccagcgttctttctaacatgctgatgctgcagcctctgattgctcagtgggacacagcactcgccagtcccactttgggaccagtttatatcattttctcagacacacgggatgcctctgtctttccacacctctgatttttaataacttcccagtttaggaacaaaaaagacaaaaaaaaaaaggtaataagctacatggagaatgatgccattttatacaaggtttataaacctgtaacacaagactatgtaatttttatagatacatacatatgcagtaaaagcagaaaactgtgcatggtctggagacagtataggtcataaaaataaaagaaaactatgtgtgggcatgataaacatataatttgtaaaattggttccctggtttggtggtgggataagaacgagatcaggaaagattacgcagggggtttccacagtctttgactttttccaactgtttaaaacattgaaatgaatagaacttaatgctaatatttgataatgtgagaaggtttcatatttaattctcaattctggtctgttttaaaaatagttgagaataaaaaaataatttctattctattaaaaaatttcttagagacatggtctccctctgtcacccagactagagtgcagtggcacaatcatggcttgctgcagcctcttggctggacctcctaggctcaagcaatcctcctgcctcagcctccaaagtagctgggactacaggtatgtgccaccatgcccggctcatttaatttttttaattttttttttttgagatggaatatcgctttgttgcccaggctggagtgcagtggcatggctcatgcaacctccacctcccaggttcaagagattctcctgcctcagcctcccaagtaactggcattacaggcgggtgccactgtgtccggctaattttttttttatttttagtagagacgggatttcaccatgttggccaggctggtctcgaactcctgaccttgtgatctgcctgcctcggcctcccaaagtgttgggattacaggcatgagccaccacgcccggccatcattttaaaaatttcttatagagacaagttctccctatgttgcccaggctggtctggaagtcctgggctcaagtgatcctcctgcctcggcctcccaaattactgggattataggcatgagccaccacattggccgaaaaaataatttgaaaaagaagaaaaaacatagaaaagcactgggccatgagctccctccacttgggactgcaggtgcagatctgctacaatccctctgttgtcctgggcaagtccactaaccttgctaggcagggcttgtattcagcagttttccaactggttctcactcagcactatctcccctggtaccataaaagcattatgtgtgagggggggaaaggtgggatgtacaggataaaatggatttttgaaagaggagttgcctgtgtaaatagggaaagtgggggacagatggacctagcatcccatccgcagcagcccctaccattctccatgaacccctggggctctgagcatgcacagcttgaatacccctagtccagccccaacatcccatgaggaacctggaggctacctagactggcagaaatgaagggacaagattagagtgagatgggtgaggtgcctatgaaacagcatttcaggaggtgctcactcttggggtagttcaagtgcctacttgcccttgtgtgccctcacagaaatcctgcctgtgttctccttttctgatggtcatggacatactcatcacccctactaaaaaagcaagctcctaaggaccacggctcagctctgtgtctgattcattcaccccatccagagggcaagctcaaagcctggcatgcagtaggtcttaaatattgttgctgaaagattgattaaagaaggatagaagaaaaaagaaagaaaggaaaaaaatggctgggcaaggtggctaacacatataatcccaacattttgagagaccaagacaggaggatcatttcaggccgggagtttaagaccagcctgaacaacacagcaagactctgtctctacaaagaatttaaaaacaaaattggctgggcccagtggagcacacctgtagtttcagctattccagaagccaaggcaggaggatcccctgagctcaggagtttgaggctgcagtgagctctgattgtgccactgtactccaacctgtgtgacagagtgagaccctgtctttaaaagaaagaaagaaaagaaagaaaaaaaaaacagaggaaggagaaagcaagcaaggaagaaaagaacaaagaaaagaaagaaaagaggagggaaggaggaaaggacggacagggagactcctcaccctctccgaagcctgcatctgggctgccagccaacctggaccagtcactttgctgctgggggcaatgagtgtgggtaattgttggcttcagccttactcatccttcctgggggccgtgtgcaaagcagaggatttcacttgcccagtgggtactgaattatagctgtggagccgagtcccatgtaattaaccagcagccgcaagccccggagagtctgtgaaggttgccaagtgcacaggtggtttgggccctgagcaaggcaactcctaattagccttggcctggtttttacaatccacagcgctgagacccacctcctgggaggctggctacacattggctatggagttccttactggggctcccagagtggaataggggcccagaaaagcagaattttgtgtgtgtgtgtgtgtgtgtgcatatatttgggttggggagagaggctttcttagaactactctaagacagtagttcttccatttataatcatcttccttttaaagatgacacactgtgtttagaaaggtgatgtgccttgttgagagcattggggctgaactccaaatatatgtgactccatatcaagttgccttatccctccgctataaacatgaaaccttaatatcatctgccattccttgaacacttggtgtgttaaacgtcagacctttattttctcaattctcaccataacttcatgagtagacccacttatccccattttgtagttgaagttcacagagacaagggggcgtgtctgaggttgtacagcaaacagagagaggagccaggatgaaaaccaagtctgaaggtctgcagcccatgatcttcactgtgctgtctcttgctagggagtgaagggctgacgagatacgcacagtcagcatggggaagactggaccatggctcactctccagatgttaatggttgatgaagctgggaggcagaaacacacacattgtacctcagttagataccattgcacttcttcacactgattagatgggcacacttttcaaagtctgaataaaggaagtatcggaggaggtactggggaaatagggactctcagaaattgctagaaggagcataaattggcataggatctttggagatcaattgccccatacaacctagccatccttctagggaggaatgaacactcatctgcgtggcgtgaacgaggctactccttgcagcatttttgtaatagaggatacgtggaagcaagttaaatgtcagtaggggaatggataagtaaaatatggcatattcatacaatatgatattataatcaggcatcagcatagatagatctcaaaaacataatgatggggctgggcatggtggctcacgcctgtaatcccagcactttgtggggctgaagcgggcggatcacctgaggtcaggcattcaagacaagcctggcaaacatggtgaaaccccgtctctactaaaaatacaaaaattaactgggcatggtggctggagtctgtaatcccagctacttgggaggctgaagtaggagaatcgctcgaacctgggaggtggaggttgcagcgagccgggattgcgccactgcactccagcctgggcaacagagcgagactccacctcaaaaaagcaaaaaacaaaaaaaccataatgatggaaggaaaaaacagttgtggaacaatatttatgttatggtaccacttatgtactttttaaaaacctataaagcaatactgtatatatgtatacacatatataagaaaataataaaaacaagaatggggagaatacacatgaattttatcattggcttcctttggagagagaggggagtagtctgggaagaaatataaaaggaacttcaatatattacattcaacaaattgagcccctgcttttttccaggtacttttctggacactgagtgtatggcagtgagcaaaacagacccaaatccctgcacatgtgaagctcacattttggaaaaggagtcagacaataaacaaggaaaataagcaaaatatatagtatgtttcatggtgataagtaccaaagaggaaaaagaaagcaaaatgccatgcacatagtgtggacattttagataaggtggccagagattacctcacctgaaggagaggaaaaatatcttcagatagctcaagcagatatctaggggaagatgttttagagatgtgcaaaggccctggggctgaggcatgattgacaagttcaaggactaagcaggcagagaggctgggaagtgccaaaggcagagagggaacaggggctgacccggtggccaagagcttttttgtttactgagtgagatggaaagcttctaatggattctgagcagagcagtgacacaatgtaacttttttttcttttatttttcttttttttgagacagagtctcgctctgttgcccaggctggagtgcagtggcaggatctcagctcaccacaacttccgcctccaagattcaagcggttctcctgcctcagcctccagagtagctgggactacaggcacacggcaccatgcccagctaatttttgtgtttttagcagagacggggtttcgctatgttggccaggctggtctcgaactcctgacctcatgttccacccacctcggcctcccaaaatgctgggattacaggcatgagccaccatgcctggctgtaacttttattttaatagaatcactctgagtgttgtgtggctaattagagggtttggagagaggtaaaaaggacagaaaaaagggcagaggtgggcaggccaattaggaaacaagtgctgagtctaggggggatgatggtggctggaatcaggtggcagccatggaggcagacaagactgtgggaggatctagcaggaggtaagcaggagcaggagctcagttggggacaggaggaatttgagatgctgtttgacattcacatggaggtgtggagtagcagccaggctatgagattggagatcggaagagaggctgggttgaaagcataagttgggggcaaccagcccataggtggtgtttagagccattagcctgttaatttatttatttagttatttatttttgagatagagccttgctctgtcacccaggctgaagtgcagtggtgcaatcatagttcactgcagccttgaattcctgggctcaagcaatcttctcacctcagcctcccaagtagctacgactacagtcacacgccatcacacctggctttttttcttttttttttttttttttttttttttttttatttagtagagacaacgtcttgctatgttggccagggtggtctcgaactcttgagctcaagtgatcctgccgtcatggcctccccaagtgctgggattacaggcatgagccaccgtcctcagccctgttaaatttttatttcttataattaaaagagctgaagtaaatagggcagtgtcaacatctgttaattctgggtggtagatacagtggtgtttggaatacttttctttgtactttttagtatctttgaacttttttctaacaaaaaattaattaataaacagcttataaagccacagaggctttaatgtgctgaaccattctgtcacgagggcttcggacgtaaggcatgactgccagcaacaagttgagaagtcaaattcaaatatcccctgtcaccaacctaagctcagtggcagggcttggccccatctctctgggctcctgttttcctatttggacaacaaggggctgacttccgacttatcagggttcttctagtgctgatcatctaggagtcaagctggtgccccacaggccactctgcccactctgattttacccccacgctctcctgcctaatcctatatataaggccagaaatacccccaagagaggcctctgtaggtgaaaggtcaactttgcctccaaacaaacagaaactgcagcaaagagaatcagaaaggacagtgccccgtgctctcttggccctgggacccaaaagttaagttgagtgtaaaagctgggagccccgagactaaaaacgccacagtatttatggctgatgaatgcatcctgctcaggactgcagaaccatgtggggatctacgagcctgaaacatacaaatgggtgggtggccaaaccaaactaccaatttgtattagacacagattgtgataatcatattaatagtaataatgttggtgataataatgttgcgccagattttgaactcagtgcttaatatatgttctctcatttgacctccacaacaacagtgctgtagggttgtcatttgcacgagctagattttgcagatcaggaaactgagactcagagaagtcaagcagcttgaactcctgggctcaagcaatccttccgcttcagcctcccaaggtgctgggattacagatatgagacaccacatctggcctggttttgatattatcatttagttggggccttaagcaacttcacactgtccatcatccaaggaaaaagcgattcctggcctaggcagaggagggagaaagatggcttcaataagggtgaagggaaatcgcttcctctctctggtctcacttggttaggccagaccctctaaaccattaatacttgctggagggcagcccaagaggtggaggaggctgggcctgccacgagagatgtgccggaactgggctgggggtgcaagcccgggaagatggatccagcttcaagactctgggagcagccacacctggtcatgggtctcctggactgagatgtcctcccaaacttctgaaccataaactacttttactcatcattggctccccagtgcccagcacagtgcctggcccttggagggtgataaatgaatacatgtcccctactaggctgtgaactcctttaagggaggcaccacttggggatcactacagtattgccccctcctcccctccccagtgcctgccacagtgacctgctgatgaccatggatccaaatccctttctcctcgttagaagctctcagtccaaaatccgtggttccatgggtcagactgaggcccaggtggtccttatgggtgaatgatggagaccccaccaagctgagaactgggaggaatgatctccactgtttatggccaggccggttttttgcctttctgaatggcaacggcatatttcagcagaggtcctcagtagagccacatgcaggagatacatgcatttgtccactcgtcactcacttagtcatttgttcacttatatatccactctctcactcatgccttcagtcatttgattactcatctgattaattcatccattcatccaacattgtgcagaacattgaacaggtttagagatgcttcaggcacagtttttttacctgagagctcccagattggggcgagaaaggtaagagccatgaagacaaataatcatacagcagcttagcaagtagtaaatgtcatgagaaatgtacagacacatcagccaagggatacagagagagagatttctcccaactaagaaagggagtgatcagaggtagcttcctggaggaagtataatcagcaccagctccagaatttctccatggcgattgggtacggatggcagcttgtcagggaagctagtagctgcatcctctacagggcactttacaaaagactgaaagataggccgggcacaatggctcacgcctgtaatcccagcactttggaaggccgaggtgggcagatcacttgagctcaggagttcaagaccaggctgggcaacatggcagaaccccatctctaatacacaaaaaaattagccaggtgtgggggcttgtgcctgtggtttcagctattcaggaggctgaggtaggaggatcctttgaacccgggaggtagaggttgcagtgagccgagatcgtgccactgcactctagcctgggcaacagaatgcaaccccaactcaaaacaaacaaacaaactgaaaagtagtcagctgcccataccaaagattggggttataatggagatgaagaggtggttaaatctctcccaagtcccctcttgctgcttctgctttgtgtgtggtctagaaggaaaggttgcatgttctggatgggcacaactccctgattttccaccctctcactcatggggagggtgcagtcagtagaggttcttggtgggaacttctaaatctcagggccaaggatagaggcccctgcctgcccatagtaagggcttttacagtcaaccagggagataggatgaggccccgagccgaggcaggaggagcccctgtgaaggagggaacagaaatggcagataatagaatgcataggacttggagacagggtggacgtagctgccaacctgagctccatgtgtgcatttcagcctgagcctggttccctgaaaccttgccaggcgggcaggtgaggtgggtgcagccacctgcacccctggtgaaaagccacccaaatgaccgtactgctcggcctctcctctgccctcctccgcctgctcttcccaactcccagcccaaggcatctggctgggccgtgtgcagggcgtctggccccagggagaggtggggtgagctgcagactacacccacatggctataaatggggagcctctggctgctgctcactcagcctcccttccccagccgtgacagcactggagcctttcggacacctggaccatggaccccagggaatgtgtctgcatgtctggtgagtaaagaagccctccctggggtctgggaaccttggaccagcttcctacagggagcctgcaggtccctgatgaaaacttctcttccctctaattaggagccaccaatggggttcgtcctgggagccgacaggtggactggccacctctggggcagctcccactctctgttggctcccagcctgattttctagaatcgatatcctagctcagggaatggctgagagggggacttgcaaactttggtctttctagcgttggcccctaagggcagtcaccagggtgaggagaagagctctaaaccagaatctggcaacctggtttgggtccattgctgcggtcccctccctggcgcttattctttctggtcctcagtttcctcacctgtagactgaggttccttattcccagccaaccacatcccagagctgctatgaaagtgctaaaaccattaagcacctgcagatgtcaggggagttgtggactcccctaacttatgtggactcttgagtctctgaaactgcttaattccacggagcatgttagccagaaggagagaaatcagggttcaaagccatcctgggcttttacaatcatggaaatggtatgaagaagtctcacaagtctgggtggtgtggctcacaactgtagtcccagcactttgaggctgaggcaggagaatcacttgaggccaggagttcaataccagcctgggcaacatagcgagactccatgtctacaaattttttttaaacttagctgggcgtagtagggtgcaccttagtcccagctactcaggacgctgagaagggaggatcacttgagcccaggagttcgaggctgcagcaaactaggaatgcaccactgcactccagcctaggtaatagagcaagaccctttctcaaaaaaaaagaagaaaagaaaaagaaagaaagaaaatgaagtctcacaagactcccttgtccttaacaggatgtctctgtaccaaaaacttgcaaaagaggcagaagcttccagcattttgaaactcaaaatgaaaaatgggataatttttttaagtgtagatgatcattatgatataaaaacaaggtgctggctcccatctgtaatcctggcacttggggagtccaaggcaggatgatcacttatgcccaaggaatttgagaccagcctgggcaatataacaaggccctgtttctacaaaaactttaaacaattagccaggtgtggtggtgcgtgcctgtggtcccagctactcaggaagctgaggcaagagcttgaggctacagtgagctgtgttcccaccatggtgctccagcctgggtgacagggcaagaccctgtcaaaagaaaggaagaaagaacggaaggaaagaaggaaagaaggaaagaaacaaggagagagaaagggagaaagggagaaaggaagagagagagagagaaagagagaaagagaaagggagaaagggggagagagagagagaaagagaaaagagagagaaagacagggagaaagagaaaaagaaaagaaagaaagaaagagaaagaaagaaagaaagaaagaaagaaagaaagaaagaaagaaagaaggaaggaaggaaggaaggaaggaaagaaagaaagaaagaaagaaagaaagaaagaaagaaagaaagaaagaaaagaaagaaagaaagaaagaaagaaagaaagaaagaaatgagggagagaggaaggaaggaagaaaggaaaggaagaaacaaacaaaacaaggtgtggctctgtggctcttgttttgagttcactgacgttccttgacctttcttaaaccattcacagttttcatcttgacttgtgaaggtgacacgggtgtgaaaggggtttttgtttgtttgtttgttttaaggcagagtctcactccatcacccaggctggagtgcagaggtgtgatctcggctcactgcaacctccatctcccaagttcaagagattctcgtgtctcagcctccctagtagctgagattacaggtgtgtgccaccacgcctggctaatttttttttttctcgtagagatggggtttctccatgttggccaagctgatctcaaactccaggcctcatgtgattcacctgtcttggcctcccaaagtgctgggattacagacgtgagccactgtgcctagccaagagggtgtgaaaggctttgatagttcttagaggaaccttgggcttggaaacgctggcctcgtctgttggttctcattgtacataagaattatttgggttgcttttcaaaaatatggactccatttccccaccaagacttatgaatcagaacatctcaagggttggtcccaggaatctgcattttcacagttatcccaggcatgattgatgcagccatgccagttcccatccatggcctgtgactgtggactattgcagagtccttgacactgggtcgatgctcagcagccttgtcaccctcttgtccagccagtccccaaggatatagcccaggagccttgccactctgacagtcggcatcatgccttatgttccccactccatctccatcctcacgtttgtggtggctctgtcctgtcttctaggaggaatctgcatgtgtggagacaactgcaaatgcacaacctgcaactgtaaaacatattggaagagtgagtatggtgactgggggcaccatgggctgggagttagaaaagtccaatccaggccaggtgcagtggctcacgtctgtaatcccagcactttgggaggccgaggcgggtggattacctgaggtcaggagttcaagaccagcctggccaacatggtgaaaccccatctctactaaaaatacaataattagctgggcatggtggtgggcacctgtaatcccagctactcaggaggctgaggcaggagaattgcttgaacccaggaggcagaggttgcagtgagcagagatcacaccattgcactccagccttggtgacaagagtgaaactcagtcaaaaaagaaaaggaaggaaggaagaaaggaaggaaggaaggaaggaagagagagagagagagagaaagaaagaaagaaagaaagaaagaaagaaagaaagaaagaaagagagagagagagagaaagaaagaaagaaagaaagaaagaaagaaagaaagaaagaaagaaagaaagaaagaaagaaagatcccatccccaccctcaatcctccagccatggtggattggggcttgtggggagggggtctagatgccttttacccatctgggagagatctgaaatgagaactatgtagagacctatggcaggtctctacccagggataagggcatccacagtgtttggagcaggaagaggactgaggggaagttctgtcctgcccagtggtaacagggatagagcactggcctggagtcatgagccctaggttctagtcttgcttttgccactgtctcatgaccttggcaaaccccctcccttctgtgggcttctgatggactctagatggtccctgggatcccttccagttctaacatgcctcaacctcctatctcagcatttttgctaatgtggattgaaacctcatgcacacacccctcttttcctacttcctctaagtagtgggaggggcagtggtgagatggaagtgttgacccacagcggatctgcgcatctcctgactctttcaggctgctgtccctgctgccccccgggctgtgccaaatgtgcccggggctgcatctgcaaaggaggctcagacaagtgcagctgctgcccatgaaagccatccatcgtgcccaccccttccaaggagagaaacctgggaagtgtctgtacagtgcatgaatcgagaaggtggaataattgtacaataggttgtgctttttatatatttgcccaaatgtggtgttggtcacattcatgtaaagtacttggggcaataaagttttcactcttggttgcctggtggctcagagcattgttttaccctaacccagcaggaccaaaaggtgctgcttctgttgcagatcctgtaaccaccacccacatgtacctgtgacaggtggctgcctactgcaaggtcctatgactctgcctgggggctttctcctcctgcacaagcttgcttgacccatgcacagggcaggccaggagtacggaggagctaaagtcactgggaacagcccttagccaatgacaactgtaggtcggtgggtaaatatcccagcatctttacccctcaaaaggaacaactctgagactcattctatgctgtctcccagaagtctctagaagcactgagcttcaaaagctcacagcagtaacctgctcattaatgtaacctacggtggcctccttccttgcctcacctccccagttccccaccattgctttctgggatctccacccaaagaaactacttgtacagggtccgctttctgggtaacctaatcttggccaggctctcctggcatagcccagaatgcctcattgtgcaaatgtggctgtttaatgggcttgagcatggaatcagtcatgaacggaggctgtgtgtatctaaaggaaatctccaaggtcaagacattgagggcattagctgccctggtttggttatttggatcagtctttaggactggatgacctggaaggcatgaaccaggaagaagatggtggtggaggtgcagaaacagcatcctaagcagaccccctaggagatgactttttggctaaacagctgagaaagctgaagtccctggaggttggcactggggactgggggtgatccccagctctcacccacaccaccatcctcaacacagctgaagacaaacccaagctctgagatcattttcattcatgccatcaagggcctgaactagggcccatcagagaccagagcggcctcctcctccaccagcctctgtcaagcaaccatcagatacaggagtgggtgagaatagagcctttgccaaggtcacagagcagccccaggttgggctgggctcagctagcaggatttactgcatgcttcctggaactgatcactttcataatccacactgtcattatccctgtttggaacttagctggggcttccctaggaagattttcaccctctgtccatgagttgtgccttagacacagaatcatagtgcagtggaaacagcttggccctgggagtcagacactctacccctccctggcaacatgaccttgaccaagtcatttaaccttttgaggctcagtttcctaatctgtgaaatgcgtctccttcacagagttgtagagagaaactgtagcacagaatctgtgcacatagcagtgccccattaacatagattttagcagagctacagcctgtcctagccttctgtttattgatctctgaaaaggcccctaccaagccattctctgtcattgcagagctcttaagcaccttgagaaggacacaacgcaagggattataccttccagcggacagaacagtcccttgtgcctccagcaagcaggttggacactcaccctgcaacctcggcctcggtacccactgggatgccaactcatctcatccaaatgcctttagagttggtacttctgcacgatctcacttactcccatcacaaccttgaaaaggagattcagccttcagattcttatattaataataataatattaacaactaatagttattgagcacttaatatggattcaacacctaataagtgccaagcattgtcctaagcagtttataaacatcatttcatggactctgcactatcaggaccacttcagagccagacaaccagggccctgctctgggccctctgccttagaggacctggtcttcctgtccccacaggagaggagtccgagggtcccacgagatctgtccaactagaactcatgctcattcctcccccaagtcccccatctagcaccatctagacaatgctttgggtacctgggaccccaaaggctagttctagggtctgcgtaggccccctctcccagcagtctgtccttccctaaggtgcaccatgtcatcagtctgtacactcctgggcccgaacgatggccaagggtagaggtattcagagacgggaggatgtgtgaatagagattggacacatgagtttttatgtctacatagagtggagaagtcagtgtgggaagagcagggggtgaagtgcacctaggcctccattcttgcttttgccccaggctctgcaagtgttaggggcaggcctgcactaacaaccctagaagacaatcctgttacataataggatcctgttagatcccccactttgcagatggagatgctgaggctccaggaaagtcaatggctgaaagtcacaagacttccagggggcagaactgggaactgagctcaggtctgcctgacccagaggccatgctcttgtctatgcgatatggatgaggcagagaggaggctgcaggcaatgctgccccagacccaggggcgaagagtctttgcctggggccttgtactttagagagcacacacaccacaagcacacaaatgtgttaaggcagcggcccccgacctttttggcaccagggaccagtttcggtggaagacaacttttccacggacagtgcagtggggcagcgcgagatggttttcggatgaaactgtagttagattctgataagtagctcaaacctagattcctcgcacgtgcagttcacaataaggttctcattccaatggaattccaatgccacttctgatctgacaggaggcagagctcagacggtaacattcacttgccccgcggcctggttcctaacaggtcacagagcagtactgcagtcagggatttggggaagcccatattaaataatacttggggcccctgtcactcaggatcttgtatttgccgttacagtgtgatcaagtaatcctaaacatcttctctggttactaacactgttcaggccctggggaaacacttctccatctcttgctctgtgtcctcaaaacaaagagtgacgatatttgaatggcaggatggttttatagattgtcccaatgctgatgtcagagatagacacagtcttcaaagtacagggaggatttaagtgtagaaattagaaaaaagacaaattaacaaactcatcaaatcctcctcaaaaagcatgaacgcaacagactctcatgtcacaccatcatttcccatgagtgtgacttgtccattttcttgcttttctttgtgttccaatttgtgtttccagaatatttatgattttatgctaattgcagaagctgcacaaggcaactgaggaatgttttgtaatattaagcaattcatattattcatataaattcatattactcttaaattggtgtagatagagctatagctacagataaatatacagatatacatactatggactgaatgtctgtgtgccctcaaaattcgtatgttgaagcctaaatccccaatgtgatggtatttggaggaggggcttttaggaggtaattaggttgtaaggcagagtcctcatgaatagaatcagtgcccttataagaagagatgggccaggcccagtggctcatgcttataatctcagcactttggaaggccaaggcaggcagattgcttgagcccaggagttcgggaccagcctgggcaacatctctaaaaaatctctaaaaaaaatacaaaaattagccaggcatggtggcacacacctgtagtctcagctactcaggaggctggggtggaaggattgcttaagtccaggaggcagaggaggaggttgcagtgagctgtgtttttgccactgcactccaggctgggcaatagagtgagaccctgtctcaaaaaaaaaaaaaaaaaaagaggcatgaagtgatctctctgtctttcttttcactgtatgtgaggatacaaacagaaaacggccacctataaacaagaaagtgggctctcaccagacaccagatatgtctgtgccttgatcttggattttccaacctccagaaccatgagaaataaatttctgttgcttaagccacctagtctatagcattctgttatagcagcctgaattgactaagacatacataaatatgtgagctatacctttctatatgtagatagaatttttaaatatttcaactggatgaacatcaagttctagaacaatgaatcattttattttaataaaaatatttaataaaatttcattaaatccttaagaaattaaataggccaggcgtggtggctcaagccggtaatcccagcagtttgggaggtcaaggtgggcagatcacctgaggtcaggaattgaataccagcctggccaacatggtgaaaccccatctctactaataatataaaaattagctgggcatggtggtgcatgcctgtaatcccagcaccttgggaggccaaggttggcgcatcacttgagatcaggagctcaagaccagcctgggcaacatggtgaaaccctgtctctacaaaaatacaaagcttagctgggcatggtggcacgtgcctgtaatcccagctactcaggaggctgaggcaggagaatcgcttgaacctggaaggcagaggttgcagtgagctgagatctcgccattgcactccagtcatagcgacaagagtgaaactccgtctcaaaaaaaaaaaaaggaagaaagagaaagaaagaaagaaattaaataatacaggacattgaagctggatggagaaacgtagatgatcttggcggctttcttaagcacgtgcatctctgggatgaccacttcggctgcctcataacagtagaaaaataaacccctatttagggtttcagccactgttcagctaaaagcaatctgatatattgtacaaacatgagtaagtcttccatgctctgtctcttaagttgttatgaaatttggaataaaataaaatttgaaataaaatgtcaaataaaattttaaagccagatgtggtggctcatgcctgtaatctcagcactttgggaggctaaggcaagaggatcgcttgagcctaggagtttgaggctgtagcaagctatgatcatgccactgcactccagcctgacgcagtaagagcctgtctctaaaaaataataataaaaaaattaataaatcatttttacaatattatgattatgtaagtactgtttactggagagccaaggataaatggatccacaaagaagaatatgtaactcaataaacgtgggccgcttagagaaagaagttaaggtctttcagaatttgtctagcagattttctgcttctcaccagaaaacccataaaaaaatagaaataaaagaaagaagaatattctcttctgagacttgctcagaatcaggtcacattttagtttgcttacaatttggactattatttccttacgggacttttatgtttttcctggcatttcaactgtcttttttcccccttgtataggcacatgggcagatatgtcttttttactctatcattaagataattccatttttaatcacgctatttgttgagtgatctaatattcactgacttgtttccagatctgctatacaactgtcattctgagatgtattttcattgctctcctagtttagaaccattgcttcttggattcccctatcatgctctattttggactccttttcattttgctggagtacatcctcaagcaattttttaccaaaaggatgaattaggagaaacttcagagtccctaaatgtcagaaaatatctttatttttctctcatgccttactgacagtttgattggatatcagtttaagttcaatatcattttctcttagcacttttgaaggcattgctccatgtcttctgagagtcagtgttgctgttgtgaacaccaacattacccgccttttatttctcactggaagcttttgggtgtttaacttatcattggcactctaggatatgtagtatgggtccaaatttgaatgttctttttttcattcaacctgctctgtgtttgctaggccttttcattctgaagactgactttttccccctaaagtcttggaaaacgattatttctttagtaattttcacccctccattccattttctcttccaaaactcctatcagtggttactggttttcctggatcaatcctctatgtctcaaaatattttcctttagtatgcatctatttctgtctttctgtgtgtatgtgtctctctctctttcacctctttaagtgggacattagaaaagtactttttgtagtactttcactgatgtttaaaaattttgtcaactatacttaaatatataagggcctcttcttctttgaatgtctcttcatcataatattctgtttttattttatgagtggagtttttgtttttgtttttgtttttgttttgagacagagtgttgttcttgttgctcaggctggagtgcaatggtgcgatcttggctcactgaaacctccgcctcctggtttcaagcgattctcctgcctcagcctcccgagcagctgggactacaggcatgtgccaccactcctggctaattttgcatttcttttttagtaaagacggggtttctccatgttggtcaggctggtctcgaactcccgacctcagatgatccacccgcctctgcctcccaaagtgttgggattacaagcctgagccaccgcacccagcctggagttatttcttgaatcactctgatgagttaaacggttttaatttcttattgttttctctttttttggaggtccaaacaaatatttattaaattcctattataagccagattttatactctgacctagggataatatattgttaagttttccttgaattatttctgcttctttgagctgaaagcagactctgtgggtgagtggagtttgctgactggcaagcttggttttagcatgcccaggtggggagatggtagccaagtttggccaccccttggggtcaaaacaagaagggtcatcttctgtggagttgacccacctctggaagccctggctcctcctaggctggttattcgatttcttcagagaaaatcttgcagtctcagaccgggggaaaatggtggggctgcccaaactagggtacaggaggtaagtgtgacaaacacatgtcagttctacagccagaccttccattagctgccatcttggtttttactcctccttcctcttctgctttcttagcctcacctcaccccaccaaaataaaacaaagcaccccaaaatctcctatagacttccgcacttcttgatttgagctgtggctttctctactcccatttacccataaatgtgatttaactcattccagtattccagaaatggtaaaatctctgatctcttgatgtactgtccaagccatctcccccaacacagctcttttattggtttttcttttttcctctttatccttccttactttctttcagtgtatactcaggaggaggagaggaaaatccatgtgctcggcctctcatctttagccaaaaatctgagccagacttttcattggtaggattttgaatctttacaataactctgcaggatagagattattgtccattccacaggtgaggaaaactgagactcaaggaagtgagagaccttgtcccaagctcaagcagaactagctggtagagaagcttgaaggccatgagggaaggtgagatggaggggaagaaaggccacagggataagtgagcagagcggctacgtgtggccctgagggataacacttgagcattaagaggaaacaccaaggaaacagattttaggtcaagaaaaagaagagctctctcatgtcagagcagcctagagcaggaaagtgctgtgtcaggaggctgacacgtcatggcttgtgttcctgtactgcctaaggcacaatggcaacctcagaaaggctgtgacccactctgcacctgctcaggccatacctggactggggtggaggccagaagagggtgtggtgaggagggaggaggagcccagatcacaggacaggaaggcaaagtcctcaggtgggctgtagggggcgctccaggcccagagacggggcagcaggaatcatctgcgttttgagggcggatgttctcacttcactctggctgctgttggggcccaagagagcctagaaaagtcctgggaccttcagacatggctgctgggaggacaaatcaggacaagctctccaagggctcaccaggccataacaacgtgcaaatcacccagattcacaaggcatgggcttttaaaataatttggcaatatgagcacatcaaagaaccataaaaacattcttcttgcttgaccccgtcgttttacttctagaaacctattctaaggagttcaccacaaattcagaaaagaaggaaaaagaaggctgggcacagtggctcacgcctgtaatccagcactttgggaggccaaggcaggtggatcgtttgagcccagggagtttgagaccagtctgggcaacagagccccatccctacaaaaaatacaaaaattggccaggcatggtggctcatgcctgcaatcccagcactttgggaggccgaggtgggaggatcgcttgagcccaggagttcaagaccagcctgggcaacataacaagactccatctcaattgtcaaaatatttattaaaaaaaaaattttaatacaaaaattagctggatgtggtggcgcgcacctcgctacttgcgaggatcaggcaggaggatcactcgagcccaggaagtcaggaagtcagggctgctgtgaatgtttgcaccactgcactccagcatgggcgacaaagtgagactctgtctgaaaaaagagaaagacaaccttactcacaaaaagattcattgcagtactatttacatttgtgaaaaactggaaacaacctaaagtccaagtccatgaaaacgttcaagtaagctaagactataaaaaaaacaaaaacaggccgggtgctatggctcatgcctgtaatcctagcactttcagaggccgaagcgggcagatcacttaaggtcaggagttcgagatccacctggccaacatggtgaaacacctgtttctaccaaaaaataccaaaaaaaagtagccaggagtggtggtgcacacctgctactcggggatgctgaggtgggagaatcgcttgaaccctgggacagaggttgcagtgagccgagatcgtgccactgcactccagcctgggcgacagagtgagaccttgtctcaaaaaaaaaaaaacaaaaacacagaaaatggttatagcaaaacctaaacagataataggccataaattagttatgcagtagtttttcaaaaagaagccacatagaatacaaaatatactatcctaaatgtcaacagggattgtgttcagatcacagtaaaagataatttttacttttccttctttctgtgttttagaattccccaaaattttctgaagtagcatgttttaaaataaataaatacattctgaaaaggaaaaaaaatagtgtgtattctttgagccagaaattttactttaagaaatgttgtatggaaaggaaaaaaacaaccatgaatatacacatacaaatgctcccaagatgtttatcatggcatggattataatagtgaagatttggaaacaatcaaaatgtctcaaagtagggtactgggtaagtcaattatggaataaatctattaaaataaaattatagaagtgaaattcatgtcatggatgttcataatctactgataagcaagaaataaagtcatttataaatcagcgtgtactgtgggcttctaattttatatttaaaggggttatatatgtacttttcattttttccagaattttctacaatcaacaaagaaggaggaggagttgaggagaagagctagatccaggtggagacccaggtgtttttaaaatctgaggcacagatgacatgaattatcaaatttaattttgaagacaaggaaaggatagaatatttggaattgaaaccttcttggaaaagttgggccatttgacgacaagagatataggctaaatggaggattcccccttctctgtgcccagccttactgtccaccttcccttgaaaattacttcccctatgcaaaggatataaacagacacttctcaaaagaagacatttatgcagccaaaagacacatgaaaaaatgctcatcatcactggccatcagagaaatacaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggctattcctcagggatccacaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaaaatgatgagttcctgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtgggggcaggggggagggatagcattaggagatatatctgatgctaaatgacgagttaatgggtgcagcacaccagcatggcacatgtatacatatgtaactaacctgcacattgtgcacatgtaccctaaaacttaaagtataataataaaaaaaagaaaagaaaagaaaattacttccccaagtgtcctccttcgatttgacatatttgagcccccaaacacctttgggggcaggggcagctcatgacactctgcatttgacagaggccaaacatgcaagttggccataaggccgggattgcgaagcaggtcttttgatttccctggctcttttccctacatgtttgagctgctaaaaatcaagacagggttgttacaggaaaaagtggagcaggatttctcagctttggcaatattgacatttggggccagatgagtcttggttttgggggattatcctgtgcattttaggatatttggcagtatccctggcttctatccattagacaccagtagcaccactgtccccaaaacgctaccactatcaaaaatgtttccagacattgccaaatgacccctgggggcaaaaccacccactgctgagaaccactgagataaatgaggtgtgagagggatctttgatgccccgaagtcattcctgggagaagggaatgctgcctgttcctgcatctgggaagctaataattaggaaggcagagaggggatactggtttatgtaaaatggcgtgggtgctaccaatctactatgcagactcctagcagcattttgatcttttcttttcttttcttttttcttttcttttctcttttcttttctttttgcagactcctagcagcattttgatcttttcttttcttttttcttttcttttctcttttcttttcttttctttctttctttctctctctttctttccctccctcccttccttccttccctccttccttccctctttcctttcttcttttttttttttttttgagacagggtctcactttgtcactcaggctggagtgcagtgtcatgatccccgctcactgcagcctcgacctcccgggctgaagggatcctcctgcctcagcctcccaaatgcctgggaccacaggcacgtgccaccacacagctaattttttgtagagacggggtttcaccatgttgcccaggctggtcttgaactcctgagttcaaacaatccacccgcctcagcttccccaagtgctaggattacaggcgtgagacaccacacctggcccatgtgttgatcttttattaagcagctttctctttacccaggctgtgggttcttgaagaaggacattcttactaatcttcgtatctggcattcctaacacaaagtctggattaaggtgatgctcaacagatgtttgtggtctgaaatgaaattcaccaccatgttactcttttaagccaagcaggatggtgggggctacagggtaacttcatggctctgtatttaactaagcctgactcttcatgactcaaccttcaaggggtcccacaaaaataattagcccaaagtcagactcactcaattctcacaggcattcattcactcaacattcaaaggacatttcaggtactcagggaactttgctaagcacaggagtggggaagggaaggaatcatccctcttagtccccaacttcagggacctcagagtctgtcttggagatgtcagaatgtcttgtctcctctcctgtaggggagaatatatctagacaagaccccacagaagtgccaaggaggggaggttacagctggctgcaggcaggagtgaagacttcctggaggacatggtatttgagcagggcctaaaaggatatgtagtgtttttttttttgttttgttgttttgagacagggtctcactccgtctcccaggctggagggcagtggcaagatctcagctcgacgcaacctctgcctcccaggttcaagtgactctcctgcctcagcatcctgagtagctgggatcacaggcatgcgccaccacacccagctaatttttgtattttttgtagagacagggtttcaccatattggccaggctggtctcaaactcctgatcaaggcggtgatctgcccgccttggcctcccaaagtgctgggattacaggcatcagccaatgcgcctggcctgaaatttcttttaaaaggaaatctcatatcactactgtagaagagatgctgaatcatttgccataaacaggaggtaaccatggagacaaatac

SEQ ID NO: 484 - DNA, 40001 bp, Homo sapiens
aaaccaaggagtctgcaggaatgtgttcctttgtaaaggctataggagacaatgtgtctccctatctttttagcttctagaaactttattcatcccttagctcttgaacatctttcaaaaccagaacaattgcatctctctgattactcttctgtagtcatcttcctctggcgaaagctgggaaagattttctgattttaaagattaatttgattatattattaccatttggataatccatgatactcttcccatctcaagatcttttaacttccatcacatctacaaagtccctttagccacatcaggtaacaatttgcaggttcagggattagatcatggacatcttctgtgggcccgtgttctgcctcccacagctgctaaaacaagacaatgttttgggtaaccatttattttttttctcgcacatgtcagttttgatcccatttctctgtctttttgttgttgttgttgttgttgttttgaggcagggttttgctctgcctgtcacccagctggagtgcaatggtgcaattatggctcactgcagcctcgacctctccggctcaagcgatcctcccacttcagcctcccaagtacttgggattacaggcatgcaccaccatgccaggctaatttttaaatttaaaatttttaaaatttaaatttaaaattctaaaaatttaaaatttttaaagtttaaattttaaattttaaaaatttaaatttttaaattaaattttgtagagacagagtttcaccatgttgcccaggttgatcttgaactcctgagttcaagccatctttccttcttgcttcccaaagtgctgggattacaggcatgagccaccacacctggcctttaaaaaaaaaaaaaaaaaaaaaaaaaaaaaaaaaaaaaaagcttttttgaggtatattgatatacaagaaactgtatatatttgaagtatataatttaatgacttttgacatgtgtatacatctgtgaaactatcaacctcaatcaaggtaatgactctactcattacctccactattttcttcattttcctcctacttcccctccattttctttgtagtaagaacacttaacatgagatctaccctattagcacatttttaagtacatatcataggattgttaattataggcacaacgctgtacagcagatctctagaactggttcactttgcctaactgaaacctgatacccatcttatagaaacccctcatttctttctcccagcccccactccccgcccccggttcctggcaaccaccattctactctgtatgagtttctatgagattggctattttaataccttacataagtggagttgtgcagtatttgtcgttctgtgactgattatttcacttggcatgatgtcctccgcattcatctacgttgcaacatagggcaagatttcttcctttttcatctttttttccttttccctccctccttccttcctttcttccttccttccttccttccttcctctattagaccagttcttgttatgttgcccaggcttgtcttgagctcctggtctcaagctatcctcccgcctcagccttctgagtagctggaattacacgcatataccactgtgcacagcttcttccattttaaaggctgagcaatattctattgcacatatacacagaattttccttatccattcatccactgatggatatataggttgtttccatatcttgaatactgtgaataatgctgcagtgaacatgggagagctgatatctcttcaagattctgattttaattcttttggatatatacccagaagtgcgattgctggatcatatggtaggtcacttttaatattttgaggaggttctgttagtggctagaccactttacattcctcctaacagtgcacagggtacgccaatttcaccacatgcttgccaacagtgttatcttttgtttttgttttgttttggtaatagctatcttaacaggtgtgaggtgttatttcattgtggttttgatttgtttccccggtgattagggatattgagaaacttttcctattcctgttggctatttgtatgtcttctttagagaagtgcttattcaagcattaactcattttaattagattattatcaatattattaattgattattaatttttattgagttgtatgaatttttcatatagtttggacatttttcagatatatggtttgcaatattttctaccattttgtaggctgccatttcactctgctaattttttttctgtaccaatgcttcttagtttgatacaggcacccctgcctatttttgcatttgttgcctgtgcttttggtgtcatatccaagatataattgccaagatcaatgccaagattttcctctatgttttcttctgttttatagtttcagctcttatatttaaaactttagttgttttgagtttactttttttgtgcatggtgtaagataaattctaattgtattctctttcatgtagatatccagtttttccaacagcatttgttgaagagactatccttgcccaattgtatatccttggcatcctgttctaagaccagacaaccatgtatatgtgggtttatttctggtctttccattctgttccacttgtctatttgtccgtctttatactggtactatactgttgtatttatgcagctttggaatatattttgaaatcaggaagagtgatgcctccaggtttgtccttcattctccagattgctttggctgttctaggtcttttgtggttccatatacattttagaatttatttttcgtttatgtaaaaaatgccattgggattttgatgaggattgcattgaatctatatattgcttttagtagtgtggaccttttaacaatattaagtttgccaatccgtgaaggcataatattgtttcatttatttgtgtctttaatttatcatttgtacttttcagtgtacaaatttttctccttttggttaagtttattcttaagtttctctgtgatattatcgtggttgggattctctaaaatttcctttttgaatagtttgctcttagtatgtggaaacacaactgatttttgtatattaattttatatcctgcaactgtactaaatgaattttttaattctaactttttttgtgtgtgtggagtcctttgagttttctacatataagattatgtcatctgcaaatggataattttccttcttgttttctgatttgtataccatttatttattcttcttgcccaatttgtctggctaggacttccagtactatattgcatagaaacagcaagagtgagcatccttgtcttattcctgatcttagaggaaaactttcggtttttttactactatgtattagctatgggtttttcatatgtggcctttattatgttgaggtatattccttccaaacctagtttcttgagggtttttgttatcatgagtgttgaatcttgtgaaacactttttcttcatctattaagggattatgttctgcttatgctttattctgtgaatgtggtgtaacattgaatatatatataaccaaaagagaatagtggtggatatatatatatatatatataacatatatatgttcaatgtatatatattcaatgtgtgtgcatatatattctatatataaatatatgtatatatatttgtccaccactactctctttggttataatatatatatttggttacatatatatatgtgtatatatacacacacacacacacacacacacacagacgcacacgcacacacacacacacatacatacttatatgttgaccactactctcttttggttaccatttgcatggaatatctttttacgtccctccaatttgaccttatgtgtatctttaattctaaagtgactctattgtagacagaatatagttggatcttatcttttccaccatccagccacaatatgtatttgactggggagtttaatccatttgtgtttaaattatttattgatagagaagaacttactatttccattttgttaaatttttttcctgtcttttagctctttttccccttttatttttctttcttgctatctttctttgataatctctgatttctttctctttttctttcatgtatctcttataggtatttcctttgtggttaccatgcagcttccgtaaaccatcttaaaacactctatttctagctctgtacaacttacctttaatcccatatgaaaaccagacgcttttattttccctcatcccatgtcttatgtttttgatgtcacaatttgtatctttttatattctgtgtccattagcaaattactgtaactataatcatttttaatactttttttaatctttatgagtgatgtacacagcaccattacactgttagaatatgcccctaggcatctaaactatgccaatttcatcagcactgcaaatgaggcaagatagaaactggtcccttgggcagcactccaaaaggccaagggatgttggacacaaactcctttcattctctccaagggagaagttttgggctaagataatctctcagaactgagctgtgccagcttatgggagaggttgacttgagtaaagagaagttcctcttcttatctatttcagtaccactgttattagctctgtgtgcactgggggcattgcaacctcttaacagggtgcttgactccttgtaaaggtattctggtggtctgtgtatcactattaaattgttatttctgcggaggggacgaggactttgactttctattccaccatcttgctctaccatttcaccattcatgttttcatatttaaatattctcattacaaaacaatcatcagaaaacatggttagtcattaatttataatgttatttttttgtttggatctttcaggtattatcatctgcttatacatttcttataagtaagcaacagatttgatcttctgaagataattaaataaattttgttgatgcatttaatttagtttagatgaaaaaatgggtttgctttactctgactatgctatatttatagttcttgactttcccccctcttggggctaaccatccacttacagtgttaaagctgggtcaagctcctttgtggctctacacatgtacacattttatacccactactttggaagtcactcttttctttctcattgcctcctctctcaaaatcttctactcatcaacttctgaatagtcctatcacaagtaaagaaactgaattaataattaaatatcttcctacagacgaaagctccaagtcagatgacttcactggtgagctctttcaaataaataataaataataatcctttacaaaatctttcaggaaaaacacttccctattagtactatgaggtcagtattaccctgataccaaatccagacaaaaccatcaccctaaattaaaaaccaatatttctaatgatataaatgcaaaaatctttaacaaatgtgtacaaacaataacaactatggtagaggatgtgaagaaacagaaacttacatgcattgccgttggggttgtaaaataatgcagacattataaaaaatagtttgggcagtttttccaaaaataagttgagttcaccatgtgactcaacaatcctgctcttaggatgtaacaaagagaattaaaaatatatgtccacacaatgacttgtatgcaagtattcatagcagcaatattcataagagccaaaaagtgaaaacgactcaaacatcaactgatgattggatcaacaaaatgttgtatgtttattcaatgaaatacgatatgacaatataaatgaataaaccacctatacatgctacatgtattagtcagggttctctagagggacagaactaataggatatgtatatttatatataaaggggagtttattaaggagtattaactcacacgatcacaaggtcctacagtaggctgtctgcaagctgagaagcaaggaagccagtttgagtcccaaagctgaagaacttggagtcccatgttcaaaggcaggaagcatgcagcacggaaaaatgatgtaggccagaagacaaaaccaatctagcctttccacattcttctgcctgctttaattctggccatgctggcagctgattagatggtgcccactcagattgtgggtgggtctgcctttcccagtccactaaaaatggtaatcctgttggcaacaccgtcatagccacacccaggaacaatactttgcatccttcaacccaatcaagttgacactcaatattaaccatcacactacaatatgcatgatttcaaaaccatgctaagtgaaaaatccagacattaaagactacatatgttataagttaatttacaagaaatatctggagagcaaataagtgtttgtctgagcctgagggagagaaaagagattgcaaaggtcatcggaagatttaaagtattataaaacttgatagttataattgcttaactctataaatatactaaatttcaatgaattatatacttacataactctataagtatactaaatttcaatgaattatatacttatataactctataaatgtactaaatttcaatgattatatacttacataagttaattttatgataacttaaattataccccaataaaatgtataaaacaatctgcaagagatgaggtcagaaggtgtagatgaaacaattttaaaaatgggctgacaattattaaatctaagtgatgcctattatagattcgttatactattctctctactgttgtgtatgtttgaaaatttaacaaaatgttaaaataggaaaatgatgacagtaaccttatggcttagaaatattcaggacaagattagtagttcttgtgaaagtttctttaaaagctataagaagaacataatttttccaaatctttattttattcttccaaagctgtgttttatataacataattaagtttaagtattcagactcacgcagaaagcaaaatttcattgatatattacatcataggcaagttacttgtggttttcctgaagcaaatatttatatagaacttagataatttttttaagaaaagtcaaaaaagagaataaaagcatttgtgtcttctggaagtacaggaattagaaagtttcaatttttttaagaatctttctatcaattatattttgttctcattctctttcttttctctcctctcttttcttctcttttccttcttttttccttccctcccatcccatccctccctcccttccctccttccctgccttcctccctccttccctcctttccttccttccttccttcctttcctccttccttccttcgcacctcaaaagagaagctaggaatgtttttcctcttatcaaaagcatgttatgaataacagcacaatacacaaatacattttcagcatggggaaaatccctgccttttaatgaaattttgtattggaacatattttttaaaccaaatagaatctattaaaaacagcatggatacatgctctccaactttctatcggctgatttttttcataatctgttcctggattatctcaagttgctatttctttgtgtaccttcagtaatgggagtagacatagttagaattgtgacttactttaataaaacagttttactaggagaagcaggtgacagtcagattgtaatggatgtgtgcactttctgatcatggcacatcacactcttttctgttagaaagtggttccgcgctaatgtactaaacttgatgatttgaaaagacatgtctctcaagttgccattatgtataaatctcatatttagaggtatagtggaaaagctacatgtattctgacacattaggtctaatcctaggtggcatcacagctattagatgcatttttggccaaaatgtttatcctccctgatactcaattgatatgtttgtcaatggtaacattaatgctcatttccaagctgattgtaggagattaaataaattaatacatgtccaatgcctaccatacagtagaaattcagtaagtggttatgtttttcattgtgtgggtactgttctatattatatattatcctattatatatatttgtttaatatgatgatgttcagaaagtactaaatataaatattgttgtggaagaacgtagtcattgcttttgggaaatgtattctttttaacatggttaggttaagcaattggtagaaataacatttactgaatgcttactctatggcactcttctaaactctttataatcagtattttatttcggaaatagatgctattctgatctacattttataaattagggaaggccgagagtggttaagtaacatgaccagtgttgtttcaataataaagtggcatagctcagaaatgaacatcagcagtcttgtaatggttaaaaacgaggttcctctgtcaatttccttgttcaaggaacttcagagtattaaatgagtgagtccatagaaagcatatatctgccaggttctatgctgaaaattggatttgaatagtctcatttaatcttcataactactttttgaggcaggttctattattatcttcattttaaagattcagaaaccgaaactcagcaatgtaaaggttgtttgcttgagcataaaatcacacacacaaaaagattatttgacaaattacctagataatagataagtccctatttgtattaattgaaaagtagagggctgcaaaatgctgtgtgcaaaaagggatcttgtggtcatttaaaattttttttccttgtggaatatcttttcttaccaattcatgaaatgttgatttctcaacgggtccttaaagttttagagtgaagaattgtatcaaacattgtttttaccaagatttttaaaaacattttggctatgaaatttcttgatttttttggtggttgttatttctggcatgctgtagaacaagcatttcatggaacatgcttccaaatatattgttttcatagcagtaggtgtccttaaagccatgcttacaggtagcgttgtgacatttaggtgatggataccctgaatgataatgctatgctccatattcacagggatgaaataagaataaggaggcccaatgaattcctgaatattccatgatgaattgttagcttttaaaaattatcaaaccgggccgggcgcggtggctcacgtctgtaatcccagcactttgggaggccgaggcgggtggatcacgaggtcacgaggcaccatcctggctaacatggtgaaacctcgtctctactaaaaatgcaaaaattagccgggcatggtggcaggcgcctatagtcccagctgctcaagaggctgaggcaggagaatggcgtgaacccggaaggcggagcttgcagtgagccgagatcacgccactgcactccagcctgggcgatagagcgagactccgtctcaaaaaaaaaaaaaaaaaattatcaaaccagtttttttttttttctgcactcatcttaatcgatcccatgaatatgtggctagtttatggattaagtaaaccagtcctagatgcgtagagtttatcctctggatggcgttgctaaaggaaatatactcaaatctattgtataatcgttgaacacttcttgagtgggcactgataatttcaaccgctgtgtcattttttatctacttcatttagttatcttctacgttttattttattatagtaaaattatgtttatcctcactccctgagaaacgttatttgggtttacaagattctgtttaaatacattacatgtacattttacagtttcattgttagaaaactttaattcaataattgttattgtttttattgtcacgtataggctgccaggggctatttcaacttacttaaaagccgtaaggttttcaaaggctatttaatgcttcacatatagctaaatgaactcataagctaagtggaaggaaagcatgctaaagattatacatatgtaaaatttaagattattaaagaagttaaatatgtaaataatcaaaggtgatttattttgaaatttacctacatgctaatagaatttgtttatttatttattcatttagttatctgtgtattgtatttgtcaactttgttagagtaatggaggacttcacaaatctaaatggcttaccacaacaaatatttattttctgctcatgctatttgtctgcgacggatatgggccaaatagcagtccctatttcagatatgacattgtagtggtagaagaaaaagtacaagagttggaataaacatatacggcattttagaccctggttaagtatggtgtatattgtttctgcttacatttcattatgaaaagcaagttcagatggacagggcagtattgtcctcccacagaggatactgaaagcccattgtgatgagaggaagaagcacatgctctcatggaaaccagaaatgaatgattagaattcttggcaacaatatttgtaatttaccatatttactgtcatcttttattattgttattatatttaccactttcattactttttttttttttttttttttttgagactgagtctcactctgtcgcccaggctggagtgcagtggcgggatctcagctcactgcaacctctgccatctgggttcaagcagttctcatgcctcagcctcctgaggagctgggactacaggcgactctaggcgcacgccatcacacccagctaatttttgtatttttagtagagatggaatttcaccatgttggccaggctggtctcaaactcctgagctcaagtgatccacctgcctcggcctcccaaagtgctgggattacaggcatgagccaccacgcctggcctttcattgctcttatgatatgtttggtactgctgtaagcactttcaaatattaacttatttagacttaataacagtcctaaaaggtaggtgctattattaaccccagtttacaggtgcgaaaatgttgacacagtgaaattaagtaaagttaccagaggttagtaagtttgcaagtggccaagatttgctccagcctaaggaatctggctccaagttctatgctgttcaggttctcacccagagacagccagagaggcagcatattataatagtaatagatgatttctgttttcttctttataatttttaatagttttagaattctttaaaaaaaaagacaatagcaaagacttggaaccaacccaaatgtccaacaatgatagactggattaagaaaatgtggcacatatacaccatgagatactatgcagccataaaaaatgatgacttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggttgggggaggggggagggatagcactgggagatatacctaatgctagatgacgagttagggggtgcagcgcaccagcatgtcacatgtatacatatgtaactaacctgcacattgtgcacatgtaccttaaaacttaaagtataattaaaaaaaaaaaaaaaaggacagagtctcgctctgtcatccagcctggaatgcagtggtgcaatctcggctcacctcaaacttcgccttccaggttcaagagattcttgtacctcagcctcctgagtagctgggattacaggcatgtaccaccatgcccagcaaatttttgtatttttagtagagacagtgtttcaccacgttggccaggctggtctcaaactcctaatctcaggtgatccacctgcctcggcctcccaaactgttgaggttacaggcgtgagccactgtgcccagcctagaaatctttacaaggtttttttatttctttgctattctaaattaaatgaaatcatcaaaatggtgagaagacacaacctgttaaaatgttttatttttgtgtctcaggggaaaacattttcaaacgcatttgatttaatcttctgatagtatctcattatctctctttttccccacaaccccgaaatataaaagatggctttgccattttcccctatttcagcatcgtggaaagaaagttctgattttcagtgtcctaaactgaatcatttaacctaagtccttaatgccaagatattaatagacctcttattatattgtcaccagccaaggacttataaaaagttgacaagtattcactaactatgaatatgtcctttgtgtcaggcacggtgcatgttaaatcaataacgtgggattttcatgctgtgtaacatgtcatattgtggggtttttttttcttaaacaatagaaatatattgccacatggtctaggaggctagaagtcccaaatcaaggtgtcacagagattgatttcttctgagggatatgaaggaaggctctgttctagactcttctctttggcttgtagatagccattttgtgcttctcttttcatgtcatattcctgtacactctgcctatctaaatctaaatttttcctttcataaggacactagtcatattggattagaaaaccatgctgctctaggatgaccttttcttaactaattacatcttcaattactctatttcaaatacaattacattctgaggcactgggagttaggacttcaatatatgaatttttgagaaacaccattcgatctataacatctggtctttttctcttttgagaagtttcggtatgttctatgtatagtgttattttttgtctccacttgcttttaagtttttcttttaatatttggtaattttgcagtttattacaatatttacaggtatgaatttattcttatttatcctgcttgagacccaatgaattgttgtttttaatataaaagtgttcatgtcttttatcacttctgagaaattcccttcatgtattggctctaccacactgaaaaacaaatattgagtaatttcatcacttagttaacaatgttgttacttaattaacaaattactagttcatgtttgtatttggtgatctcactcttttcaagtgtccagtctctcttccgtgtttttaatctttttctgtctatgtgctggcattctgggtaattcctaaaatccatattctagttcagagattcttcctttagctgcacctactctgcctttaactggtcttttaaaaaaatcacattgttttccctgtggttttatttggttatttttcaaacatgcctattcttggccaggcacagtggctcatccatgcagacccagcactttgggaggcagaggcgggaagatcacctgaggtcagaagttcaagaccagcctggtcaacatggtgaaaccacgtctttatttaaaataaagaaaaaattagctgggcatagtggtgcacgcctgtaatcccaggtactcgggtggctgaggcaagagaatcgcttgaccccaggaggcagaggttgcagtgagcagagacctgccactgcattccagcccgggcgacagagcaagactctgtcaaaaaaaaaaaaaaaaaaaggctgttctttaaaaataacttattgtatgttttagctccttttgtgttgatatgattaatttaaacatattttctctacaatccttaaccataattctttaattctaattttattttagatttagagggtacatatgtaagtgtgttacatgggcacattatgtaatggtaatgtttgggcttctagtgaactcatcacctagatagtgaatttgtacctagtaggtaacttttaaccctcatctccctcccaccattcccttttggggtccccagcatttattattttgggactttttcttccatgcttacccactgtttagatcccatttataagtaagaacatgcagtatttgattttctgttcttgagttacttcacttagaataatgaactccagctccatccatgttgctgcgaatgacataatatcatgcttcattatggctgcatagtattctgtggtgtatatataccacattttctttatccagtcaaatgttggtaacacctagtttgatttcatgactttgctattgtgaataatgctgcaataaacataaaggtgcagatgtcttcgtgaagaagaaatttcttctcttcaggtagatactcatgagtggggcttctgcatgaaattgtagttctatttatagtgctttgagaaatatccatactgatttccatgggggttgaactaatttacattcccatcagccttgtataggtgtactcttttctccatagcctcaccagaatctgttatttttttggtcttttaataatagcctttctgactgctgtgagatgatatctcattgtggttttaatttgtatttctctcatgattagtgatagttagcgtttttttcattcttttcttggccacatgtgtgtcttcttttaagaagtgtctgttcgtgtcctttgcccactttttaatgtggttatttttgttgttgttgttaagttctttatgaattctggatattagtcctttgttttcaaacagtttctcccattctgtaagttgtctgtttactctgttgattgtttattttgctgtgcagaagctctttaagtctcatttatctatttttgtttttgttgcatttgcttgtgaggtcttagtcataaattctttacctaggccaatgttcagaagaggttttcttagattttctactaggatttttatagtttcaagtctcacatgtaagtctttaatctatattgagttaatttttgtatatggtcagagacaggggtctaacttcattcttctgcatatggctggccagtttccccagcatcatttattgaataagatatctttttttcccatggtttatttttgttgactttgttgaataccatttgattgtaggcatgtggctttatttctgaggtctatattctgtttaaacaattgatctgtgtgtctacttttgtgccagcatcatgctgttttggtttctatttccttgtagtatagtttgaaatcaggtgatgtgatgcctccagctttgtcctttttgtttaataatgctctgtctattcaggctctttttgagttgtatatgaattttagaattatttttcctaattctgtccaaaataacactggtaacttgataggaattgcattaaatcttcagattgctttgggaagtatagtcattttaacgatgttggttcttcctatagaatattttaccattggtttgtgtcatctaagatttccttcatcagtgctttgtagttcttcttgtaaatatctttcacctccctggttaaatatattcccggatattttaatttttgtttattataaattatattgagttcttgatgtggttctcagcttgagcattgttgatgtgtaagaatgcaactgatttttgtgtgttaattttgtatcctgaaactttactgaagttgtttgtcaggttcaagagtcttttgaagaaatctttaggatttttttgcatataagattatgtcatcagtgaacagagataattttgaactcttcttttccaatttggatgactttatttcttcctcttgactaattgctctggctagggcttccagtactgtgttgaatagaagttgtgagagtggaaacccttgtcttgaattcttagggaaaaagctttcaatgtttccccattccatatgatgatggctgtgggtttgtggtatacagctcaaataattgaggtacgttccttcaatgcctggtttcttgaaggtttatatcatgaagggatgttggattttatgaaattatttttctgcatccactgagatgttcatttaggttttatttatactttttgattatgtggtgaagcatatttattgatttgcgtattttgaaatattattacattcctgaaataaaatctactttattatgatgatttctcttttttgatgtgctgctggattctgtttgctagtgttttgctgaggttttcgtatctatgttcatcaggtgtattggcctgtagttttctttgtctgttgtgtccttgccagattttgatatcaggatgctactggtttcatggaacaatttaaggattcaatttcttttttgttcaatcttgggagattgtgttttcaagaatttatacattttccctaagttttctaggtcgtgtgcatagaggaattgatagtaatctctaatgattctttgtatttctgtggtatcagttgttatgtcacctttatcatttctgattgtgcttatttgaatcttctctctctctctctctctctctctccctctctctctctctctctatcttttgttaatctagttagtggtctatcaatcttgtttatcctttcaaagaacaaacttttgttttgttgacctttttatgatttttggtatcaatttcatttacttctctgttctttgttatttagtttattctgctagctttgggtttggcttgtccttgttttctagtttcttgaggtgtgatattacattgttaatttgtgatctttctatctttttgatgtaagtatttagcactataaactttcctctcaatgctatttttcatatgttgtgtttctatttttgtttatttcaaaaaatgttcttgatttttgccttaattttgttgtttacccaaagtcattcaggaggaggttaatttccatgtgcttgtgtgactttgagaattcctcttgatattgatttctaatattattccattgtggtctgagaggatacttgatatgatttttattgttttttgaatttattgagacttgctttatagtcaaccatgtgttcaattttgcagaatgttccatgtgcagatgagaaaatgtatattctgcaattgttgggtggaattttctatagatgtctgttaagtccatttggtcaagagaccagcttacttctagagttttgttgttgtttttgttgtcattgttagtttcctgcaatgatctgtttaatgctgtcagtagggtatcaaagttcaccatcattattttatggttgtctgtctgttttcttaaatgtagtagtatttgttttagaaacctgaatattccactattgagtgcgtatgtatttaggataactaaatcttcttgttgaattgaaccctttatcattatataatgcccttctttgtcttcttctccttttttggggggatttttgttctgggtttaaagtctgtggcgtctgacacaagaataccaaccctgctattttatgtttttcatttgcatgaaatattattttctatccctttattttgggcctgtgggtgtcattacacatcaggtgggtgtcttgaagggtgaagatggttgggtcttgcttttattccagtttgtcagcctatattatttcagtgaagtatttaggccatttacattcaaggttaataatgatatatgaggttttgttccttcttagtgtttttagctacttgctttgtactttcaattatgtagttgttttataggatctgggaactttatatttgcatatgctcttagggcagcaagtactactgttctttcatttttgcggttaaaactcctttcagcatttcttgtaggaccagtttattggtgactaattccctttgcacttgcatgtctcagaaaaactttatttctcctttgtttatgaagctttgtttggcaggatataatattcttggctggcaattttttctttaagaaggctaaagataagccccccatctcttctagcttgtaaggtttctgctgagaagtctgctgttagtctgatgggattccctttgtaggtgacttgacccttttctctagttgcctttaagatttttctttagcattgatctcgaataatctgatgactctatgccttggtgatgttcatcttgtgtagtatctcacaggtttcctctgaacttcttgtatctatatgtccatctctctagcaagattagagaaaatttcctgaattattcactcaagtgttttccaaattgcttactttttctttttctctctcaggaatgcctataagttgtaagtttggtcactttacataatttcagatttcttgaaggtgttttcatgttttaaattattttctctttatttttgtctgattgagttaatttaaatgactggtcttcaggctgtaagttttttcttctgcttcatctagcctattgttgaagctttcaactgtgttttgaaattcctttagtgaattttgtaactccaaaaattgtatttgttttttaaatatagctatcttctattttacgttcaaatcatgtttctgtttctttgtgttcattttcaactttctcttggattgagcttccttgcaatccatacttttaattctttatttgtcatttgggaattttaattttggttagggtccattgcttgagacctacaacaatcctttggaggtgtcaaaacactgttgttttgaaactatcataagagcgaacagacaacctacagaatgggagaaaaattttgtcatctattagtctgacctttgtcagatatccagaatctacaagaaacttaagcaaatttacaagaaaaaacacaaaaccttattaaaaagtgggcaaaggacatgaacagacatttctcaaaagaagacatacatgcagccaacaaacatgaaaaaaagctcaacatcactgatcattaaagaaacacaaatcaaaaccgcaatgagataccatctcatgtcagtcagaatgatgattactaaaaagtcaagaaacaacagaggctggagaggttgcagagaaataggaatgcttttacactgttagcaggaatgtaaattagttcaaccattgtggaagattgtggtgattcctcaaagatttagaaccagaaataccatttgacccagcaatcccattacttgatatataaccaaaggaatataaatcattctattataaagatatttgcacgtgtatgttcattgctccactattcataatagcaaagacatggaatcaatccaaatgcctatcaataatagattggataaagaaaatgttgtatgtatacactatggaatactatgtgtccataaaaaggaatgagatcatgtcttatggatggacatggatgaagctgaaagccattattctcagcaaactaacgctagaacagaaaaccaaacaccacatgttctcacttgtaagtaggaggtgaacaatgagaacacatggacacagggagaggaacaacacacactggggcctgtccagggagggtgtgtggcagggaggacatcaggaaaaatagccaatgcatgctgggcataatacctaggtgattgattgaaaggtgcagcaaaccaccatggcacacgtttacctatgtaacaaacctgcacatctacacatataccctggaacttaaacaaaaacaaaccccaaaacaccttatttttgtactgccagagttcttgtactcattccttatcatctgaaggagctgttgcttcttatttttgaatattctattgtttagatgagatttttacattttttattatttgtcccttgaggttatgactgtggtgtatgttgtgtatgatcatttggtttcttttctgggtgctttcaatgggctctgtatgggtttctcagttgtggatagcttttaggcagtggctttctcaaatgctgcttgttatagcaatgtattggataaatgagccaacacgcttagccctgagagactgagagtgggagatctcaagagtgtatcttgtacactatcactggtttgttttttaaatttggtggtgtggtacagtgttcataccagtgggtggtgcttgagactaagagccagctctacctggtgtagcccaataatgagtggaggcacctgccctgatgggaagtggtggggaagatgtgttagggtccgcttaggtctcaggggtaagggcaaggtgggagggttgcaccagctcctcatcctgagcagtccagaatgtgatccactctcctaccatgcctctgtcatagggctaacatctttcacctcatatagacatcgtcctttggcttctgccacattgtgactggggactgaagtccctctctagcagctataaccaaattgggctggggtttcccagcccagcacagacaggtgtgcatcctgtatgctctccattgccaggacgctgctgtttggtgcagggagtgggagatgggccttgtcctttgtgtatgtcctagtagcacaggctcactttcaacgggggtgctgcctttgcaaaaagtgctgggaaggctctctccaggtggactcttcaacctggagagtctctgcaccattcacaaaagttgacagggggagtagggggattactcccctcttcactttgtttctgtccagtggtgcaacaaccttcagcaattagtgctatgcccatgtttcctttgttccaagaggggctttggtgtgctgtactccttcatcaccaagggattagatctacaccatgggttaaatctctggggatcccacagctcccctggaacccactggttcactgttgggtttccaaagtcagagtgggctgtggggtgtgtttgcaggggatctagtgatgtactgacacaagggctgaggttccccaggtagggcagtggcccccaccaggtgcacaaccactgtggtacgtgctgtctcagctcgggcctgtgggaagtgttgttgcacctacatgggctgtccagctagtgctctgtccctgggaagtttgcaaatcaccattgacagcatttcttggggtcacaagggcagaggggccccctgacaatttggtggtcaccagattgtcacaggggtaacaggagcagaaaatcctccccacctaccctttcctcagggctccaagttcctttggggtcaatctcttctatactcttgctgtttcccgtgtgccccaatttctttttgtgggctctccaacttgtccgggctgtcttcactcagcttttctttcacatcatgaccattcacctataactttgatcttctttcggagacttggcatctgacttttctagtcagccatacgctttcaatcttgagtgcacattctagataaatttttctttttcctatttcatgccaaatcccatgtgaatagttctggaggctgggaagttcagggtcatcaaggtgacagcagtgttattgtatggcgaggacttgctctctgcttcatacatggcactttcttgctgtgtcctcacatggggcaaggagcttgttttctaatgtatatgattctcaatgctgttatgggaacaatttactatatacttttctttttcctaggaatattaccacttcacttccatccccctgactttaattttctgggatggagtatgacacaatttaagttaaaatcctaacaccatgactttatttatggtgataactctaagtcaagtgtgattatttacaagtagtgtctcagtgaaatcagaatgatttgatgtaagtgtttcctacaagaatgctagtatttgtaggatcatgttgtggggacatgctggggacatgcttttccccagtggaataatctcttttgagaagttagatgagctatcattatgttgtgcctccatttctaattctatgaaatggagataagcatgtttgatcagctcacgtcatggacttttgtaatggtataattgtatgtgcaagaatattaatagttaagcataataatttattgtcatactgatactaataatagaataactcttatttctcaatatttattgattcccttatctgataaaaatgaataagccagtccatctcctgacatgaaaatatatacccattttacacaacagtcctagctctacgggctcctaagcttctaaaactcaaatcctcctgtaactgctgtgtccaaccttcttagggagacactgtgatagaaataattccaacttatacatgttcattttggtggttgactttgcactctagtcatattgccaatttcatatttacttagaacaatgaattaaaattcaacaggatggataattcagccaatgctcactttactaaccaattttctcagaatttgattatgcttgaaataaatgtattgaaatagtagtcaagaatccggttgagtctgtatataaaaggcatttatattataatgaaggttcattttcttctagagaccatagcatattaaaataccgggtgacattaaaatattgttattaaccataactcagacttgaatccaccattgcactatgtatgaacaattggaggaggattagaggacaaatgtcagaaccaagtttaataagcagtgagtgggacatttgaacttgtcacaggagtagcactgtggtggacaggcattaatcttttcaagtcatcaaacttttgagttttcctccccccaacatttatagaaagattcaggagagtattttaaagagctcagcaaattgaagtctatatagactgttcttttcattttagaaccagaggaccattaatttttttaaaaaagagtattgctctgattctaatcctcaatttaatacctgctttttattttccaatttgagggtgtaattatgtaagaatatctttcttccttttatagaagaaataatgtttattagtcattaagtggtgactgaagacataatgataataacttccatttatcaagctcgtaatatgtgtcaccatatggtactaggtgcttcgtaaatattattttgactattgttagtttaaaatcttccttcaaaatcttcattttctggtctgtaaaataaactcaatgatattgaaattaaaggattatgtgaatattctaaggtcacagtaagcagaaataaaaaaaaatgggattgatctcccaagatttttttccataaccctacaactttcccctaacaaaactggcatttcttgatgtcagtattgatgtcagttcactgtggtaccccattcagtttatcacaggaattgtataaatttagaaattaatttgctcagtggatttccaacaaatggggagggttgtgtttccatttaactaaaagtaactttgtaaatcctactggatggccttaactaaggctggagaacattcattttaaactcttctgtttggaaattaaaaggaaaagaaggctatgtctacgatgtgtgggcctgttatttaggagtttctattagatgtcacattaagtaaatcaaaattatggctaggcccgtgacgatcagagatataaggcaagaatgtcattaaaaggaaagatatgttgactatcagaatggtatgatttttagtgttgaatatcagaatggtatcagtgtttgtttattttttgaggtgggggtctttctatgttgctcaagctgatattgaatttttgggctcaagcaatcctcccatctcagcctcttgagtaactgggattacagtcatgtaccaccatgcctgacttagaaaggaatgattttgaggtgccaaaagcatattgaaatgccaagagaatgattaggacagcaaattcaaggcaccaagatgacacatggaacctgagatattcctagtttcaactttttgctggacatggagccaatcagagccccaagacaactacatttttgacaacggaagaaggtaatttatgttcttcagaaagcaaagcagattactcaccccaagggtttggaagtatgagatgacctggcaaagtctagttaatttatattaagccagatttagtgtttagtgattataatgagaaactacaatttacataaatattatttgtctattataacaaggatttttttaaaaaactcaaaccaaatatgaataattttaatgtcctcattaagcatcaaggaaggaacttgttacagtgttacaattttacctaatctgcattaggttgcaaagttatctaatgcagatttcaaaaggtttctagtcactatacatcaggatgaaattggagaactttggagttgcattctttaattttatgtgtcaacttgcctgtgccacccagtgtccagattaaacattatttctgagcgtgtctgaaagggcatttccagaggagattagcattgcaattggtggacttggatttccttcccaatgtggttggacatcatccaacccattgaggcctgaataggatgaaaaggcaaaggaaggaagagttcactcttttttagcatcctgcctgactgctcgagctaggatatcagtcttctaccgctcttgtaatggggtttaaaagatcagctaccctggttctgatgccttggccttgagctgagattacaggaccaactttcctcggtctccagtttgtagatggcagaccatgggatttctcagcttccataattgcatgacccaagtcttcataacaaatctttccttatatggccctattggttctgtttttctggagaactctgaataatgcacccctaaatttgaagagtgtttaccatactttttcttcttacacttttattaagtagtttataagtatgagagcacagggtttttttatattgccacttgatgactaaattataatattatctaagcctggtaattgttgtcagtagtttcctattacttttgagataaagcttggggatctcaggaggcctatagggcaatataagacttggcccgtgctggaatctctatcttttcctatctatcctcctgcctatatgccagtccctaagagtattatgctgtctgcacaatttttttgataggcattttttttttttgcttttttttttggttcctacattatctatctcctgacatctgcccacaaactgctactcacttttcaagatgccggtcatgtattatctttcttcatgatacattttctgactttttacatcaccccactctgaatgttggtcacattgtgcatttcattttgttgggatcttctgcctctctccagtgttgtgctgatcactctgatcactctctcatgctttcttctttgctcacctctgtcttccactctatatagtaagcttattgaaggcacactctctattttataaagtaccaaactccaggcctttaacgatgtagcctaatagatagatagtgtttgctggttcatactccattctaattccattgttttataaatgaagaaattaaggactaagagggttaaaagacttgcccacagcattacacaggctgcttattatacataatagttgttaaatagaaagtatggaaagacagtacacaggatctgcattaatacaggcgcaaaacacgtaagaaattccaaatagtgatggcttccatgaggaatagaagtataataatcatttataaagcaagcaaagaaatcactgggaaacaaccagttcttcctcgtctaaatttcctacaagtatgaaaacaaacataaagacacctgttctgtggccactgtttgtagattactttcttaaaatgaaatgcaataaactcatcagatatttacaaaacaaatccagtttaaaaattctgcaaaatatgccactttatcaaaatacaatgatgagctctattccttttgacacaatataatcagtgccaaaatataatacattcagtgaaattcatcacaaaatgggttagttggtgctacaaaggcagtattttctttgtgacaaggagggtaaattttgttataagttgattcagccctgctcatctttgatttttatgatggatatatatttttagaagtagtggatttgtctctgacccaccgggttcctcccagagaccactaaaaaactggagtgtctactaaacagttgacagtttcctggaggctgacatcactgaaattgggggataaaccttacggaaggtacctaagagatagagaaggaaattaggctatctccttctctctctttctatttaagcttatgtggaagggaatacatctctctcagcaacggaataacaatctgaagaaacagactacatacttctgccattgaaattttcctgaatagctctgcttgagaaatagattaatagactgtattgcaaagaagaagagatgagtcaaacttctatctggactcaggaaaacttctcagacggagtccatctggcaatgccaaagggactgactccactaggactgaaagatcaggtttgcacagttaaaccccaatccatccttattttatttccatctgtacatagagcagttctgcttgcctggtttccattcgtattggttgcctcatttcatcatcaaaacatttgtgtcaagtgaattttatgttcaccatttgatagacaaaaaaattaggcttagagaagcatttattcttggtcacagaggttttcttatttttaatctggtttctgcattatatgctgaattttggagacagaaagacaatggtttgactccaggtttagccacttgctaattgagtgatcatgggcaagccactgtacttctttgagcctcagtttcttttctgaggaacagaaacaatcatataagcaaattgctgtaaggattgtgtcacatgaggtatgacaaaagctttatacgaagcagggaaggctcaataaatttaactttcctttttattccagctacacactagctagagatgtttgcttgttatcttcaaggtactggaaaacacagtaccacacccacaaagtttgtgaaaactcaagaattatttaccagtgaggcactttgaaattttaatcctagatttcccagtggtaaataactttacgctaaaaaaaaatcaaaataaatgtactagtgcacttggcatctattttctctgaggaaaaagctgtgaaatgttaacagtcaacatctcttcaaatgttggaacatctaccaaccatagacatagctgtgtctatctggaagaattaggtctcaaaagagaatttgctttgcaaatactcaacagaaaatgtgcagataaaaaaaaagtatagcacacacatctttatactggttaattcaaaatgtcataagagtaaatttaaagaaacaggtaaattaattcatttccagcccaaagccgactttcaatcttgttttccctggatatttatctctgaaaaagcctctgagatttctagcaggagaaagtctattaattttccatatacttgttgatgcaaaagctatcaggattatgggttgaatatttctagtatagggaaagtaagggatgcaattaatctctgtgaactaaaatataccccttttcattaaccttttattgtaaatgagcaaagtaattgaaccggtaccacactgtcagaatgaatgcaatgccggtgggatatgcttgagagagcacatactgattgagtattaaatatctaacggcaataatttatggttcattaactcttttggagtctcttagttgcatacagcttgaattctaagtagtcagacttttagttgaaaacggctttcaaatgctgaaggcagcaagtgcatgcaacccacaatcccctttaatatgggctgttgtgtacctacttaaactacaagaagaatatttgatgcagagctgattgttttaaagacagaaagatgtcatctcttcactccaaaactccgtcttacaaactctgccatgatggatttatgaaagcgtcgagtaacatggacacagaattgagaaaagggataccgtctaagtagagatcctgtgacttgctacatattatgtaaatcccctttcagctagctggtgggtcagacatctcagcttctggtttaaattgacagtagcttccctaattgtattgtgccatcccccgtggtacaattccgttgcacatggaaatggaagcttttattctgttggtaacaaaatataatcaacctgaagcaatgtttatagaaatatacgttttggatttgaagagtgggtgtattcagacctcttgcagtttaaaaacaaacactgttaaaagaaagaaaatgatccttatatctctggtaaagaggtactatagctatttattcaattgttgagctttaaagaaatttctttatttcagttttacctcggtgttcgaaagagcagtttatatttaaggtgaattatatttttctttttcagagcaaatgagtatcttctttgattcgtggaatctgctcagtataaaataaacattttgaaatacaattttgaatacagtttcagacattttgaatataatttgtacttaagtatattatcatgtgtgaaaatgtctacaagctttttgacacctctttaccctattcatattaacagagacttttgacataagtgaccttcttttattctataacttcactttctctctctctctctctctcccccccatctctctctcactctctcttttcctctcccttttcattttcctctctcctgcttctgttatggtttctagtgatagtcagtgtaatgtttattgcattataaaaaacaacaacaacaatcctgtatcttccttttaaattgtcttctgcaaaaaaatgacaagaaagaaaaatgcagtaatacaaacaatacttaagcctcttgcatgtaaaaaaaaaaaagcctgtatttgctatcagacatttttctctactatttctgaactttctgtatctactgttttattttagtgtttaatttttaagaattctggttctgtaatgcactataatttaaagaagaatctttaaaaaagggactataaatctcataaataataaagctgaaatccagcaaaaatcaagaagctttaaaaaataatattttagaaaatgtccaagaattccagaagaaactattttatcagtcaatcgatcttagcaaataatgcccaatctttcttatccaatgataggatgaatttgttttgtgctaaatgccagtttaatgttttgacacaggaaagttatataaagttaactgatagaaaataaatcatattctcagtaggtacacattagcagccttagaaagagttgaaagtatttatatgactgaacaatacctaccacatcaggaagaaaatgatgttgtataatctatgactttgaggacagcctgtaagacaggaagaaaatgagaatgtaaatgaccttaaggatataacaaggccaatggaaccaggatgatgagagaggaaaaggaagatgagtaggtgcccacctccaatctcctaagattattcacatgtgaggaaaaccaataatcaaaagcaatgaagatgtgaaggaaatgggaaaagatgagtgttatcttgcaaggagttacatcccagggcattacgagtttaagaaaaattattaataacaaataaaaacatttaggaattaatcaggaggacatttataataattgaaatggtagcaagcagtacatttattacataaatgtgactgcctagccaggaaagcctctttcaagaaacatgaacatgaacatccagatacacaaaggatttaatgagttaaataaattatggtatagtcttttaatataaaactatgcacctgtgggccaggagcggtggcccacgcctgtaatcccagcactttgggaggccgaggcgggtggatcacgaggtcaagagatcgagaccaacctggccaacacggtgaaaccccatctctactaaaaatatacaaaaattagccaggcatggtggcgggcacctatagtcccagctacttggaggctgaggcaggagaatcacttgaacccaggaggcagaggttgcagtgagccaagattgtgccactgcactctagcctggtgacagagtgagactccgtctcaaaaaaaaaaaaaaaaaaaacttgtgcagctgtggaaaagaatgataatgttatttatgtagtaaaatggaaaaatattcaaaacccaatactaaataaataataaaaaaatgaagtgctaaacatagtgtgctgtttcattaaaagaaaactacgtgtgtgcatatgagtgtgtgtgtgtgcacctgtgagtgtgtgtgtgcatgtgtatgtgtacatgaaacactgataagcagaataatggcccccaaagatgtccatgccttgatcctccttaaaacctatgaacaccttacatagtaaaagaagcttttcagatgtgattaaggttaagaaacttgagatgcagcgattatcctggatcactcagatatgcccaatatataatcatataaatactcaaaagggaggacctttcctaactgtactcagaggatcagagagacggcatcatgagaaaaactctacccaccattcctgtctttgaagactggaagagcacaaaagcctaaaaatgtggatgacctctaacagctggacaaggcaatgcaatagattctgtcctagagcttctggaaagaaatacaatcctgtgggcacctttattttagcccattatggcccctgtgagacttctgacatacagaactgtaagataaatatatgctgctttaacttcatggttatttgctacaacagcaataggaaatgaatcaaccgtataaatatatgcatgcagatatttgcttttgcttgcacaagctgtctctacaaatatacaaaatattttggaaatattgatttctttcttttaatttttaaagttgatacataacaaatgtacatatttgggggtaaatatgataaatcaatatattcatataaaatgtaaagatgaaatcactgtaattggagcatcctgctccttaagtatttgtctttatcttattctagaaacattcatgttattctcttctagctattttgaaatatatactagattactgtaaactatagtttactatagtttatttgatagatactactgatctatcaaatactacgtcttatttcttctatcaagctatatatttgtatcaattaatcgatctcccttctcccctttaccctttccagcctctgtaaccataaataaactatcttcatgagatccagtttttcagctcctacatatgagtgagaatatgaaatatttgtctttctgtgcttggcatatttcacttaacataatgaccttcagtttcatccatgttgctgcaaatgacagggttttattctttttaataactgaataatattccactgtgtatatataccccatttaaaaaattaattcatcctttgatggacagttaggttggtcccatatttttgctacagtgaataatgctacaacaaacatgggggtgtagatatctctttgatatattgatatactttctttcgaatatattccccttcctcaatatgttagttctatatttcatttattgaagagccttcatactgttctccatagcagctgtaataatttacatttccaccaatagtgtatagggatttccctttttccatatccttgacggcatccattattccatcttctgataaaagccattttaatgaggtgaggtgatactatattacggctttgatagttatttatctgatgattagggatgctgagcattttttcatatacctattgggcattctgataaatatttcccttaagaactatcagtgtttgctctatatacttgagagctctagtgttgggtgcgtaggattttttgttttgttttgttttgttgaagacagggtctcactgtgtctcatggagtgcagtggcatgatgatggctcactgcaacttcaacctcccgggctcaggcaattcttctatctcagcctcccacataggtgggactgcaggagtgtgccaccacgtcaggctaatgtgtttttttttgttttttgtttttttctgttttttttttttggtaaatacagggtttcaccatgttgcccagactggtctcgagctcctgggctcaaacaatccacccaccttggcctcccaaagtgcagggattgcaggcatgagccactgtactcagcctgcatagatatttataattgttatattttcttggtgaattgacacctttattattatatagtggccttctttgtctctgatttttatagtctttgatttgtagtctattttatctgacataagtatagctattcctgatcttttttggtttctagtttcatggaatagctttttccaccacttctctttcagtctatgtctttacaggtgaagtgagtttcttgtaggcaacatgttgttgaattttctttctttatccattcaggcactctatattcagcgttgttatttataagtaaggacttactattgtcattttgttgcctgttttctggttgttttgaggatcttctcctttctttctcactgttttcctttgtggttaagtgattttctctggtaatatgttttatttgttgctttttatttttagtgaatctattctaggtttttgcatggtggttaccataaggcttacaaaaaaaagtcttatagatataacaagttattttaaagagatgatgaattatgttagatcacaaacacaaaaataaaaaaagcaaacaaaaacgaaaaaagaaaccctctaaacttttactccatcccctcaatattttgactttatattgtctcaatttaaatattttcttgtttcctgttaatttttctcttaacaagctgtttttgatatcattttcatagattcgcctttgggcttcatactagagttatgagtgaactgcacaccacaattacagtattttagtattctgagtttattagagaacttaattttacaaatcagtcttatattttcaaatgattactttttgcacattagtgtttatttttctttcagattgaataattccattgagcatttcttgtaagatgggtctggtattggtgaattctctcagcttttgtctggggaagacgttagctgtcctttatagttgaaggatagatttgctatagacagtatccttaaatgacaattttttttcttttagcacttcgaaaatgttgtaccactccctcctgcactgtacagttcctagtgaaaagtccattgccagacaaattggggtctttacgttatttgcttcttttcttttgctgcttttagaatcctctctttgtccttgacctttgagaatttgattattatatgccttggggtagtcttctttgtggcaaatctgtttggtgttctctgactttcccatacctggatatgtatctccttctcatgttttggaaagttttctgttatttctctgaataggctttctaccccttgctcttgctcaactcctttaaacaccaataaatcttaaatttggtcttttgaggtaattttctatattttgtgggggatctttattccttttcacttttttctttttcttctctgccaatatattttcaaatagcctgtctttgagctcactcattttttcctctgcttgatctattctgctgttgagagcctctaataaatttttcagcttagcaaacatatttctcagttccaagatttcagtttgattttccaaaaaaaaaaactaaatatctttggtaaatttctctaataagtttctgaattgctttttttgtgttatcctggagattactgagtttctttaaaggtgctattttgaattcttggtcagagagaccatatattgctgtcttgttagagttagtcacttgtttcttgccttttggatttggcaaggctatggttcccagtttgctgtttttttgtgtgtgtatgtatgtatgtctctttgcattaaaggattatttagtcaaatcatctctatctggcttgttttagtttttattggatatgtgttctaagaaattctttgtaatttatctgttgattttctttctttccccgcccccctgctgggttactgcctcctttttggcactagatgctttcttaagcccaggtttgcctcaattctggcaaatgatcagagtgctgcctttcctaaatgggggatgtcccaaaggggatgtccaatagcatgggaaggttggctagggtgagctctagaattaatcttctacagtgtggtgctgctgaatgtccattctgatttggcattacctttggatgagttacacagcagagtttccagggctggagatggcagtccctcctttcccctttgtcactaggtttcctcagcgatattttttcctccaggcactctagatgcttctcatgagtttggcagggacaggtctcctgccagcaaacttaggatgatggggaaactgcttatccaccttgatatcacttttttctaatgtagaagctgtcagtcaggggaaattttccacatgcttgccactagaaggactggggggaggaatatcatgaatatggaagtccacttctttaaccatctgctcaaactattttcatttccctgtggccctgggaactgttttctcctcatatttgaaatctgagagattgctggtaataatcttggcactgtatatttatatttttggtttttggaaagagggggagtgaagccaccttgtttctccactgccattttggaactggaagtccggaaacatttctattgaacaagtattgaatgttaagagacagatgtgcataagtgacttgttcagtatatatttttgtactgttcagattttgagccatttaatgtatctgtttccaaaataaatgtaagtaatttaaaatatatgcaataacattgtcattccttcctaaattatgaaaggtatggcgcatatccaatttgtgcaaaaaacccatcatattctttaataaacttgcagaattttggtggaaaatataattaattattggccagtcaaaagataggagttttgctgagatatagctgattactatgtctttactttagtattttgatttctgttttattgtgactcattctttttctgcagcaactgctaattatttcaagtaaatttcaaggcgagttaattcagtgttattcacctaatcatttaacatttatcagtgtccatcagtgttagaaattagggatttggagatgaatctcatatagtttttggtgtcaagaagctcccaaagagatacatcctcaaggaaataattacagtaaagtttgaaaaatttcataagaggaataatatgggatttcagaagaagaatccagaaataacattttgggagaaaaattgtggcttagaatacttctgctggtaataataacttgtcctttatgcaaattagtaaaaataaagattcttcttcaagaccctttatgaatatctactataaaattgttgtaatagagatacaattctctaatcactacaaaggagatagtgactgatagattagtgaagtacacatatgacatcccaggttgcaagagcagtaacattttctccataggattcctcttaatttaatatccaacagtcttcatttctcattatcagtgtcttcttatgtagaatttaaaaaatgggaaaaagtacttatagatcagtctagcaatttcgattgcaaaaatgcagattttctcttttcaggtagaatagtaggtgatgctgttccacaaaaaaagaaaaaaactttatgacccaaattgtcagtgtgattctaaacattttcttatgttaaatgcctcttataattagaataggtgccaacaacaaatgaaaaaatagttacatagatagcttacatattagttacatagagagcttgagtcaagataggactgaggctaacagcaaattaaccataaaaatagggtctgattactgctgctcaaacttaagcatcttcagtattaaggtagattcaggatgtttgttgatcccaatgggacatcaggatggaggaaggggtgagggaggattccccagaacaagatgcactcatacacagaaacttggcatttaacactgtaattttcaaattgagaagaccaattttaattttgttttatctccttttggatcctactttctggagatttgaaaatgtatttatagtgctagtaaaatctgaacgtctttcctccttctccctaatttttggatatttcaggaattgggatatgaattatacaaataagaaccagccccttctcctgatctgtgggcagcaatagccccaagggactgaaaaacaagtgttttctgcacttcctttcagtttcctaacagcctgttcatgtacttgttcggtaggaaaaagtgttttctaataacaaatctctattatgttaataagtgaggactaaactctgacctttgtcctctcttgcccaaattcttacctgggaggcctggagagtcatgccctaggaaccacaaaatctcatcagatgggttatatttaaccctatgtaatgtaatttactttccaacttgactgtggcgtaacatcacaagacaggtataaaagacaataaaaatattttaccccaaaatatgtttctttgctgtattttaaaatgaccctgcaaagccattttttgtggaagaaaagttgcatctgtaaagaacttctactaacataactggatctttcctccttccaggccctcacaatcttgaagagatgaactgagagtctagcaccttttaaggcctgaaaaggaaaactttgccatctattgtctctaaggggagttgctcatgagactttatttattattatttttttttcggatttctttttttttatattatttttatactttaagttttagggtacatgtgcacaatgtgcaggttagttacatatgtatacatgtgccatgctggtgtgctgtacccattgactcgtcatttagcattaggtatatctcctaatgctatccctcccccctccccccaccccacaacagtccccagagtatgatgttccccttcctgtgtccatgtgttctcattgttcaattcccacctatgagtgagaacatgtggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttggattagttccaagtctttgctattgtgaatagtgccacaataaacatacatgtgcatgtgtctttatagcagcatgatttatagtccttttggtatatacccagtaatgggatgactgggtcaaaaaaatatggaacacttcacgaatttgtgtgtcatccttgtgcaggggccatgctaatcttctctgtatcgttcctattttagtatatgtgctgccgaagtgagcacgagactttatttacataataagaaccttgttctccacaatcctttatcttaatcgagatgctactttctatttatttcagatctttagataatgacttaactgtttcaaccaattgccaatcagaaaatctttgaatccacctattacctgtattccccactcccctttttgagttgtctcatcaatgtataccccatatgtattgattgatgttctaaatgtccccccaaaatatataaaaccaagtttcaacccatccaccttaggcacatgtttcaggacctctggaaaatgtgcctcaggccttggtcattcatatttggctcagaataaacctctttacatattttacagagtttgactctttttgtcaacataaacttatcttcctctcaggtttagaatttccctttctcagtcttcattggacacttatttgttaaggcaacactctgaataaatgactaaccaatgtataactgttacacaggcattcattgcaaaaaaattattgagcttctactgtgtgccaggcacattgttggattgcagggtgctcataggcttcaaaagacactgtagtgagtctgacttgagatcatttctcttctctaagactcaattttctcctttgaaatgagagaaagaagagtactgactctcacctgtgcttttgagtgtatgcatatcattttgcccaccatttagcaagaggcaaatatgtgattgtgcttattaaatacttccttgaaatgtcaatgcattgtattttcatgccagtgtgtaatatgtgggaatgggctttttattccatttaacacacagtgacattgtctattgatttaatgaggaaattacacatgttgtactttcctatttagcaaagggttttgcattaaaggtatatcaaaggaacacattgccatgggtagttgggtgcagcacagccatatggcagagaaaaggccccaccaatcaagcagacgacctgtggtgtctcagacgaggcatacagaaaggcattttaggaagcagcgaaaggggttagccactgggcagcaaacatgtgtccagtaaatggtggccttaatacctcaaatccatttacagtgcctattatttgacactcattcaaaatccagggaatgtgttttgcagtgaccttagataaaaatgagggaaagcaaatagagtaactattaacataattacaaagagacctgttcgatctatgcttcatatgcccatatggccgggtattcagtggacttcagtagtcactgctctcctaataagccctgttaattaggtaataggaacattctctcattgttgacagcagagttttctaacttgctcatattaaaccaagctaattttgttaagcattgagattccagatggcccctaaggtacactctggtatgcaggcaggggaatcagtgcctttgtaatccatgatctacttttttgaactggaaaagctgttttggaaaagattatgtggaaaccaagaaatcaatattcattgtcttatttcctttccaacaaaattagatagttagatatttgtatgcatgtatggatttgtgtgtttacacgtctgtatgtaaatgtgtatatgcaaaaaggagctcatcctctcagcccaacgctttgaagagtgtgtgctccagattgaagagcaatttgacggcgcaatattcattgactttcttttctctccatctttgcagaagctgatttttaaaaaggcaggatattagagctggaatgggttttagtatttagctaaccaacacattcaatttgtatatgagaagactaaggacaagagggaaataccaatataagatcaaaaaataagttagtgtcggaaccaggagttaaacatttttctcctcctgaagagctaatcatgtacttttgttttttaaaataacaccttcattgagttatgatttacataccatcaaattaatgcttttaaattgtaccattcagttgtattaagtgttctttcttagcaatatctgatactataccatctactcatcagcacctttcttgtccgcaggccatatttaagatctgagaacaaaagcctttagtggaaaccgtgatgataatgagatgatcatattttctaaatgtaagctatcattatgcaccaataactatgctaagttccagttcatgcattcaacaaattcttttgttgaatggcactcaactgctatgtgccaagcactgttctaggcactttttgtaaaccaaggagccaagcaaagatccctgcctttatgaggcaagggaagagagaaatacacaacgtgtcaattatataacat

SEQ ID NO: 485 - DNA, 70099 bp, Homo sapiens
gtagagtttttggcagctttagttacattcagtttactactggctaaaatattttgaagacagtgcttttccttagctgggcatgggatctgagcactggcacaactctgggtatgtctttaagtgttacctcacaactactgggtttccgaaacaggaaatctctttccactttacagaccagatgtcatatttttgtaatgttggtgaattcttccttttctccattcttcgctttcactttctatatccatggatctctttctgatctattatccagactttaagggactttttaagggacaaagcattggtatctttcagaaggatttctctgggctctccttcttttctcccaacatccaggtgcctatcaccttccccctttgtgaaggttccttatgcctcaggtgggaatctttctcagtttctttccctccaccatactttgcatactaccctcttggattcagtgaagaaacatgggaaagaatcagtggatgtttacaggcttgctcctcagctgagtttcctagggatgcatgtcagctcacatgctgccattaaggtttgatcaaagcttggtgttcttctcccaatcactttctgtagcacatttctccacctgttaccactctaccagacatgaaagcagctatggatctcttcttttccaagaagtgttcatcacgtatgtttaggtctccaagctgtgatttcctttaaccatggttttgtagcataacagacttgcccctgtgattaggctggaagcaatgggcacttatgactgttcccatcgtaataagaagtatcagtgcatttcaggaatttgaatctctatacatctgttgcccaaaattttttttttgcagtaacctaaatttccctccatattccctaaactctcaccacaaaaagaatcaaaaggttgtgggagtgtagcttgcattacacgtcgcatttgaaaaattatttgactattttttcatcaaattaactggacattaacttagatgtctcaataagtagcagggagcatttttggaaatgctctctaattttgttcttcagcaaacagaaattcagtatataaaaagagaaaaagaaaaaaaaacaagaaaagaaagaaagaaaaaaaaaacagcttaagaccatgataaaccaaagtgaaggaaactgatagcattttaggaaccagcaacatttaatgagagtgaagcaaacagcagggtattagacaaatgaaagcagacgagaaaatctaataaaacagcttgatctagggataaaatatagggccatgatcaaagaaaacaatcttataaagaaaacagtacctgattttctacagacacttagcagagaatgattcaaaaatttagtcaagttgtagtactagatctctattttatgaatatgtatcttatgagaagtattcctttttattttctacaaattgaaaatggagtggtcaataaataagcatgtttttacttacataaaggccccaaaaaagaaaaaatattgttggtttgcttttatttacacttataaataatatagataaaagctacattttatgataggcaaaagaaaatttaaagtagtaattgtgaagcagaagctatataattggattaagtagtcttaatgatttcaaaactcttaaattacccctcaaattacccaatttgaggaatgtactgaaaatcagtatttctcctaagagtgttttacagatctagctaatggaccttattgaaaaagtctgatgtctgttatggcaatttggggagaagggtagagttttaggattcattatatacatttttatagatgccaaattctacacccagattaactttggtaaccactagccccatttctattctatttcttctaaagtaatttatgtggacttagcattgataatgatttttttagggagctaaaaacatgagtatataatctcatttatcctttaaaactactcattaagtagtaaagtgatgtcttctaaaatgggaaagatggctgagaatgcttcttcatataatggtgtttcctgcattttgctgattcatagtagatcttcatacttaatcttagcgcttcttcattgtacaaaaacaacagttaaagtgcaaataaaatttaggaattagttgacagccttaattatgcatgcttgatttctttgtttggctctcagaatttaatccttcattgtcacggttgcatgcttatcacatcttatttgtttatacctgtatccctagcactaaatacatagcttgcacccagtatacactcaagaaataattttgtaatacaaaaatgaaggtttcttctattggaaaataatgttcattacattatatagttgtttgctttctctctctttttctatttatacaggaaaaagtatatatgcatatatatagtaaacacatatatttcagatttaatatataactaataagtatattgttatataataattaattactgtttttattatttgccaaacactattctttgctctttagcgatgttaatccattaactttaataacagttccttggtttaggtactgttactgtgcccagttattttctgttaagtgatctgagagagaggagctaaataaagtgccccaggtcacacagctgctaatgatatcattgggattcagagacagattattttatgcaagtctagcttataaagcatcaaactctactgcctctccaactattcaaacaaaactgagatgcttgtatgtgaagacacaatactacccttgatactaaattattaggaaatttccgtattcattttttagcacacatgtactactatattcagaaataagcatgaggtatacacataaattgtaaggatatagaacatgagatagaaatgtaaaagagggtgatgggggaacttgaggaattaatatcaatttcttaagaaaatgctggaattacactgtgatgaactaggttcccacactatttggtgggagtgaatgagaggctttggatgtgaatgtaggtgtgccttgttcaccttgctcaggttccagcaggtgctcaataaatgtgtgcatgagtagagaaagcaagcaggaaaatggagggggaaagaaggatggagaaaggaggtagggtggtctaagaaatgggaatgtgcttttccaaactagagttaagaccccagcaggcaggggctgggatctataattcttttcaagcccaccatgttcgatataatggaatgcaaggacatccttttttagaaagaatatttaatctgattattcttttacaattgtctgaataatctgccctaagacagctaatgtagcattattactctatcatttagataagaaaagcacaacttgggatagttaaatgaattaacagaggccacatagctcagcgtgggaggcgggactttgtacttggtcttttagttccaaaacattatgtttaccccggtatatattaagcttcaccctactctaagacttaataataaataattaaatattcattcctaaatctctcaccttttgacaaacttgggtctaatttttgaaaaagttttcttttcaataaaacctaaaatttctaacctttcctatacccactgaaatatgagtttcatgaaccaatacagttaatctctctatgaaaatcccttatgttgtgttgtcagaatttcttcccacttacagtatcagttcaaacagctttttagagataactaattcttagggaagcctgagtcctttatggctaatccttcacgtggcagcaccattccctttatttttagcctcatttagttcaagtgacagtctcactctgacatctacagtggcttccagctgtgtctggtctcccaaagggactctgaagggaaatcagaaatgagcactgcagagtttgaatgagttttctctgagtcttactaaatatgaagcttgcatgttacatttctggggatatcctgatttcaatctagtgataagtattggcatttggaggtagtaacccaaccactgtaagtccttttttatttttggtagagctgcacaatctcaaatatttatgcaataattatttcatatacaatttctgttttcagggaaagatagcttgaactggaaactgaacgtttgccatgttatccactctttcagtatacatgcatgcatgcatttattcaattactaattcacatatatcactaattcaacaaacatacttttagtttctacattacattagatgctagattctgggaatacataatgcaaaaagtagcctctgattgccaagtctcatggtcttgtagagataactttgtggagcaaatcattaaagtgctttattgttgacaaagtcactccatctccaacttttaaatttttatcaactaatatgggagcttttactccacagtctcaaatattctaatgcattttttttcaattgttcattggtagatatttaagattttataccccgaactgttttgatcatggctatcataaacgggattacataacatttcctaatcagttatttgagtgtaaacaggaaagttgttaattttatgttaattttgttatcaagtccattactgggcttttgattattttcgcctattttatttcagctacttttgttgggtttcccaggtggaaaatcatgtaattcaaaaaccggaaaaactgtactcttaacataaaaaaaaaactgtgattttcttcttttctggtttaattgaagattatgtatagaatgtagatcagtaataacgatgattagtcattttcatcttaattatttgcattaaagaatgcttttaatctgttttatattattaataatgcttgtttttcaacttctctttttctaaagttcatttttattgcattaaggaagataactattactttactaacattttacagtaagtatggattttgaattttaaaagtgtcttcaatgtctctcttcaagtgatttttattgacccactgttttgatggattaaataattagtgtcataatgttaaactactcttgaatgtgatacctatattttacttattcgttgtacaagtatagactcaaattggatagtaaaggagagtttaataaacaaactatttataaattgtcgtcaggtttaaggaaaccagaaaatggcgatgttgtaccatgggactagtaatagtgggtaaactttactatctctcggctggaagggtaagcaaaaagggttaaacagggtagctacatggccaggactgcttgacaagaagtgtgacccttattagaaagatgcagtcaaccaacagtgacactgtatgaagggagtcaatggaattattcccctacgacattcctgccacccactgttttctgcccatgtaacttgaagccagaggatggaaagtccactgatactctttacgaggccctgatttctagggcacagagctgggtggagcaagaacaagaatgaggaaacaaaatacatttctaatctctatatgtagagtttctaatagcttggtatattccagtctctgtactatatatggtcattcccattatacaacaagaactcaaactaataaaccagtaccgttaagaatgaagaaagaaatgaagatcctgtgttaaaaatttgcgtgtgacaactgtacctaataaagaaaccaatgtggctagagtttgatgagaaaggaagactgacttgggataaggatagagaagaatccagaagatattaaataggattcaagggcttgcaatttataagatgttaggtttttattctagctacaatggaagtccattgcaaggttttatgtagagaagtgttataagaagatcatctgacttatttcctgaaataattcctggtaaaatctctgcaccagatgattgatatagctaagcatgcatacaagtaggtaggtaatattctttctctgagtatgtatggtgggaggatgtgggttgggggggtggagatagtttgttaactgtgttcttgttttcttttctccaggtctctttctgtttaaatcttccagatataggctggatgttttacatttttcaaaacatgaagaatgatttagagatgtaattctttaaacaattatatagtggttggttatagttttaaaatgccttcctgtatttgtatttctgcatcttatttttgtgtacttatacttttcttgacatatttactagaaacttttctactttattgatgattattttcttgaagagcaacagttttgctatttccgatgtctgtgtttattttacactaccatatgcttttggttgtactgtccttattttctgctgttttttttttccaataataagactactgtctaataggtttttgagcataacttgtaagtaatctgtttttattcttagtatcttagtaatatcatttaaatattaaaatattataaattccttgtagattgcatctcttatttttgacatatagtgaagagaataccatttgtcaacaacataaaatcagagttttatttttctatagacccatgagatacaaggacgtttttacttttttagtattttttctatgaatccttcatttaaatgtgtatttaattcaatattttttccagtataatttcccattaaaaatgactttactatgatcattttagggtatatttcaaaaaatttacaaatcatatttttgtgagagacaatataaatatttgcagattaaatttagctatcctttctctgttggaattgtattggctcttttctcaaaaatcaattgactataaatgtgtcagtctattctgggctgtctacatgcctgtttttacaatgataatgcactgcattgtatattgtatctttatactaagtcctacaaccaagtagcatagtccactgaaattgttcttccttttcaaaaatacatcagctattttagtttttttaaaaaaactttcacataaaatttagaattagcttgtcaattttcacaaactacatgctgcaattttaactggaattattttgattttaaagatcaatttctggagaatatcatcttaaaaatagcaaaactcccatccattcacatagtatatgtctccatttatttaatggtcttaatttttctcaggcatgttttacacttttttcattcggaggttttatacctctttggttaagtttattcataattagtttttccatgctttcaagttaattcattactgacatcgcctcagatgattaccaccaataattgatgaggcctcagtaaatgagaacagaagttatcactcagttgtctttaatagattttaaaaaaatgtaaaaaagataaaaaataaaagtgaatttccacttagtgattaagttgtccagtataacatagttgacgtctgtgtatctaaggacgtaggattaaaagcaaactattattgaagaactaccttcatcccttcctaatatcgcctcaaagccttttttctaatgtatcctatgaacacttttgagactcaagtgttcttctactttgtgtcttccatttccagtagaaatatattttccagtagaaatatattttccagtagaaatatattttccagtagatatatattttccagtatacttttcgtgaaccttttgatctattttgtttaattcgtttttactcatttagtcatactttcactttttctttcattcttactggagtctattcaaactcataattaaaaaaatacaaggtacctcatttctgagataattttttcttttatttgtgtctaagttcagtcagttctcttcatttttctctgcttttaaaaatccattaatgttgttagtattttaatttcagaatttttctttttaatattctcaaatgtttgcttgatgacccttttaattcttcttttttttcctgcaggaattttcttacattgatagtctttttgctttttttggcgagacttctgcgtggacttattaattcctctcgtgttcatatatgtagcattttagggttttataaaattgctagttaaatattaccctcttctgtctgtattgcaaagtctagatacgttagtggatttgttttgttgctaggaggatgagtagtagttcctccaattttatggctatattttgtttggtagaatgctaaattttcttcttttgcttttttactcttcatcaatcaattgccaaaggatgctgcattttgacttttttacttatttttatttacttttttgtgtttttgagatggaatcttgctctgtcaccaggctggagtgcagtggtgcgatcttggctcactgaaacctctgtctcctggttcaagtgattcccttgcctcagcctcctgagtagctgggactacaggcacgagccaccatgcccagctaattttttgtgcgtattttagtagagacgaggttcaaccatgttggccaggatgggcttgatttcctgacttcgtgatccacccaccttggcttcccaaagtgttgggactacaggcgtgagccaccgctcccggcctcattttgacttttttttatcccccagaattttgcctgttttattaaaaacaattttattttcatgtaatttctgactttgactcacagtaattggggcatgatatagacagggtctactagcagaaagactcacatgcaaggaatggtataagatatttaatgctctgtctagttacctaacattcattagttaatatatcttgggtggagatccaggaatcatcttccctttagtttctggtcacaatggggctctttctacttaccagatctgttgtcactgctacccctatgagctcctaaggacaaagcaaaacttctatttctgcttatttctatttttctcatcttaccaaatagtcttcttttttcttttcttttagatgaggtcagagtggaatgggactgtagtaaaaggaagtacatttaaaaagctttattcttcatttaaatatgcatcctgaagagatatacagtagattctatgaatgttctttgcaaattacaaaattagccgagccttttcacattatttgtatatctcagaattttaagaacctatttgatgatctcagtaggaggttaatactaatacactttttgaagggatggggacaatacttaatgctaataaactttttttcatgtgacactggaggaaaagcagagaaacacttatgcttttaattgaaccaatttgtactttctacaagctccccctgtgattgtaattcacagtaattttggggaaccactaccaaaaatcctttaccgaaaagaatagtcaggcatactactgagctttggtgtagcaaaaggcgtatttgggttttatttatcctactaggaagcagtgagggactggacacccgggagcaggactacaaaaaaattctcaaatttgtacgttccccatgtttcttttggcttgtatctccctgatgggctccccttagtgatcaacaagaaagtgattcagatggaaagaactcctatatttgtgttccgaggtggtaaagaaggaatggctgggaatatttagtactatgctgaagttgggcctgggggagaacactcagctgagagtgtaggtgtatcctgggggtgcgaggcaaaggaaaaaggaagaaactggagtggggagagtttatttattgcttaactagggacagtttgggattcttaggcaaatggtgttccccatttactgatggactcagacaagtgcagtttaatggcatgtctcagtgaactaagtaactaaataaagatacatttccatagactattgagccaagtatatatttctaaatcaagcatagaaaggaagagaacctcacacatcccatagtgtgctagtagccccagacagtgagaaatgctcacatttctacactttctataaatttcctttgcttcaaaatatcagtgcttgaataaaattattgatgggtttatctcagcctaaaactaaacacatacgtcaacatgtcttaaatattacttattttctacagacagatctcaaaaaattttgtaatcatttgcatagcttaatttccgcttgccaaattacttctattgacaataatccctatgcccagtgggtacttggcatttatcaaagcatttttgcatgcatgacgatatgagattgatcatgcttatagtaatctctggaaacatgactctacaagtcatggagaattcaaacaactcacatcaacccagcaaccctgggagtcatcaggacaagatttaataacattgcacggatattgataaccaagtaagtactctgctcaaagatatttggcctttaaaagctaaaaatagaaactttgatctgatattttgagcccaaatccgaactctttatatcaaatatcataccttctgggccgtgacttgctcataggttttatgccaggagagtagttaaggaatagacaaactaaacagattattgctacaacaactggtataaattgagcactactatgtgtagagatctgcattcagtagtttcaaacatcatattcttgtcacaattgccctataagaaaggggactttgtcttttcaatttacagataagaaagcaaaaacatagatattggaaggaaattatccttatagccacagatcaatggtgaattattttctgtttatttacttagaagatgtctgacttggcagatctcctttaaaatctatccatgttcgaaacttcccgccttaccttcaactcagagaagcataaaagaagggtcttgcagtctcagcatgaatcatgtcaatctctaaatttctcaagtgccaatgcatcttcctgatcatttacctattgtaagtctatctgctaaggctggtttcttggcctcttttgttatctgtctgtctatatatcatctagatatcatttgtctatctctgattgcttcatagttaacttttcttttaattaaaaaaaggtaaggttgagattatttaagaatgtttcatatgagcatttgataaactgtattccatgggacaacatttacacaaaatcatttaaggctaatccactttctaatcaaatatattgcagtgatgttactgttttcagaccatctttgaagaatcactatcatcatcaagagattaacatatctgaaaaatcctgaggttagaaaaaaaagttaattttattgaacatggcatttttaaatgtatttaaatctcctcatgcatccttttctgtttttaatactgtttccttatatcctgaagaataatgtctgcattttcttgtctgtcatgtatataatgtaatctgtctgttcttagaaatcctcagaaaacaaaaccttttccgtctcccctcagcagccatcatagactgattccgcagaggtttgacttctggttgtcttggtgttcggtgtttgttttcacagaatccatttagggtcgcaaagtatttaccatctgctcctactctttcttttgaagtaaatgtcctcatggccactgactcatttcccaggatggttatatggtcacctccatgtccttattcaaagactaagctagttttgaagaaagaagaataatccactatgtcacctgtaggggactgacagtatctcccagggacagctgtgaaagagtattctggggccacgtgtggtggctcacacctgtcatcccagaactttgggaagccaaagcgggaggatcgctggagtctaggaatttgagatcaacctgggcaacatagcaaggctgcatctctaaaataatataaaaattttaaaaatgagtactctgggatacactggtgcagtgttgagttccttgctccttgaaggatgtctgtcctggatgctagagaaattgaagtccagccatgaaaactctttggcatgcctaaagaggactgattagaacttcagttggtattctttaccatatagttgtgactcagtccttactaagataaagtttctgaaatattcctttacctttgtaatgctatgcttgccattctttactctcctcaccccaaatgttttctcaaacaaaagccaatcagagaatggagaacaaacctttccagctgatgaaacacaaatatcttttttctcttggatttatttagcagttgacattaccgaaaccataatgaatgataaagtgaccattgatatatatcagatacctattacgtgttcgataatgaattaaaggtttgcacacaatgatgtttaatcatctctacaaccttgaaaaagttatttcattatttttacaaaatcccctaaatttccaaataattatgctcatgtgctttcaatctagaaacaacaatgaaagtgcatgatagagtggagaaaagtcccatttacacaatgagttttatttcgagctgggggaaatcaagtagataattaggtgtggtatatccaatcttgagagaatatgcactgtactggaggaaaatggctttagaaattaagacagaacttggtttaaataactttgggaaaatcgtttaggccagagaaccatgtcatctccctcaacccggtttcttctctacctaccctacaagtcatcactatattagtgttaactgttagtattaactaagtttatctgattcctctttaagcaattcctcaaaagaaaaaaatctgataattccatatttgtgcttaaagcctcttaatgaatcccactgcttaaacaaacaaacaaaaacaacaacaacgagaaccacaaatcctcagtgtagtggcccttctgcttcagacggtgctggccttaccagcctgctttgaaccagccaggatccctcttcatgctccaaccacataggcttccatttcagttttcagcaaggatcactcttttgcatggaatgtcacatactctctcacctaaacctgaaaaatgtttgcttatctttcagaacttaggacaaaatttatctgatcatgaaagggccaacttatccattatcccacccatcagttgccatctgatgaggtctacttctttttccttgaaatttttataattgtaacaaaataatgcaatgaagactttctcatttaatgctattttatcttttaaaattgttagctttgtaagtttgtcagtgttttctctttttctcttgctgtatctacaatggctaccactgcaactcacaatgtaagtgttcaattcatataggaaaaattgaaagaaaaaaactatgagtaaataaattgatagatgactcctcagttatctcatcttctacatgaaaacaataatatatagatatatttagaagtatgaagattaaatgatatgtagaaagatcatctgttatattgcctgatatgaaattgggaatcaacaatggcagtctttatttttccccaataattttaattttaggaaatttttaggttcactgcaaaactgatcagaaagaacataattcccatgatatccccagctccccaggcatgcacacaacctctctcattaccaatacaccccacccgagtggtacatttgttataattgatgaacctacaatgacacatcactatcacccaaactctatcacattagggttcactcttgatgttggacatttcctgaattttgacaaatatataatgatgtttatccacaattgtagtatctttcagaatagtttcattgctttaaatctttcatgtattgcctattcatccctccatctccgtaacccatagcaaacactaaacattgtcatgattattgtaagtcttgaagtcacatagtgatagtcctcaaactgtttttctccttcagtattatgttacctattctggaccttcagcctctccatataaactctagaaatagtttgtcaataaccacaaaataacttgctggacttttaattgggattgcattgaatctatagatcaagctgggaagaactgacatcttgacagtattgagccttcttattcatgaacatagaatatctctccatgtatttagttcattgatttctttcatcagagtttttcagtaatccttatagatcttgtaggttttttgttatatttatacctaagtatttaattttgcgatgtcctagtataaacagtactgtgtcttcagtttcaaattcaactggttcattgttggtatatataaaagcaattgattttgtgtattaaccttgtatcctgaaacttactgtaatcacttattagtttcaggagtttgtcaattctttaaaattatttacatagattatgtcatctgtaacaataagttgtgcattttcttttccaattagtatatcttttattttcttttcctgtcttattgcactagctaggatgactacgaatggtgagaggaaatatctttgtcttgtcctgatcatccttaaaaagcttctagtttctcaaaattaggtacagtgttaacagtaggttttttgcagtctttgtcctcaagttgaggatgtttcccactatttctagtgtactgagaaaatttttaccatgaatggatgttgaaatttgtcaaatgcttttttctgcattttctaatacaattttgatttttttcttctttagtctgatgtgattgttggattagatttataaatttttcaatataaaagccttttatagctgggataaatcttacttcattgtagtgtataattattttagctattgttgaatttgatttgccaatagtatgttatggtatctgcatctatgtttattagagaattggtctgtagttttcttttcttgcaatatctttgtttagttttggtactagggtaattctggctttttagaatgatttagaaagtattttctctgcttctatcttttgaaagagatggcagataattgctataatttcttcattaaatgtttgacaattcaccagtgaatacatctgggcctgttgctttctgttttggaaagttattaattgtttattcaatttttaaaatagattcaggtctattcacatcgtctctttcttcttggaaggttgtgaagaatccagggcaggaaataacaattgccttaatttacattcacaacagacagagggtaggttgacctaacccctgatattaggaatgtaagcctttttctttcttagttagcctggctcaagtcttatcaattttattgctcttttcaaaaaaaacaaaaaaaaacaaacaaaacagcttttgttttttgtcagtcttctctattgacttgctgttttagatttctgctctttttctttcatgtaacttactttgaatttagtttgctctgccatttctatattctgaaggcaaaagcttagatgattgatttaagatctcattttcttattttctaagatatgtattcaatatcataaattttattttaagcagtgctttcactgcgtatctgaaattttattgtgttttcatttttatttggtttaaaacatgttgtaatttcagttgagatttcttcttagacaaattgttatttagaactctgctgtttatgagtatttgcggattctccagctatctttttgtttttgatttcaagtttaattccattgtgttctgagagcaggaattatatgattcccattctcctaaatttgttaaggtgtgttttatggctcaggatgtggtctatcttggtgaatgttctgtgtgagattaatagtaatatgtaatgtgctgtcattggataaagtagtcaacagttttaattatatctaggtgactggtaatgcttttgagttcaagtatatctttactgattttctgcctggtgaatctatacatttctaagggagggggtgttaaagtcttcaactatatttgtggatttatctacttttcctcacaatgttattagtttttgcttcacatattttgaggctctgttgttaggtgattacacattaaggatttgcatggattcttggagcgttgatcactttatcattgtgtaatgctcacttttataactgataactttctttggtctgaatcctgtgctgtctgaaattaatgtaactactcccactttctgttgattaatgttagcatgttatatttgtccactgtgttaatctttatgtgcttttatatttaaggaggggtttattatagaccatgtatagttcaatcttgttttttcattcactctgacaatctgtgtcttttaattggggtatttagaccacaatgtttaaattaattattgacatagatggattaatatctatcatatgttactggtctttcctaatttattgtcctgttctttttttctttttgtgtcttccacccttttctactttttaggttttatgtgagcatgttatattattcagttctctcctattttgcatatcaattattcaacatttttcagtggttccgctagaatttgcaatatacattctttcatgtctacttccaaataacactagtgtgaatagttaacacaacataaagttcttcattcttccctcctttgtatcattgatataattcatttcgcttaacataagcatgtatgtatatatatgtatatataaaatgtataatcaaataattattgctattattgtgaacaaatttctatctccttgatcaattaaaaataaaaaaaccctttgttttaacttcacttattcttttgctaatgctcttttttcctttatatagatctgagtatctgacctgtattatttttcttctctctgactaacttctttaacatttcttgcaaggcaggtctactggtaacaaatttcctcaagttcttgtttttctgtgaagtctttttattatttttacttttgaagataattcttcacaaattaccgtatcaagaaatagacttctagttgtttattttcctctcaacagtataaatatttcactctatactcttattatttgcatgttttctagggaaaaatcctttctaatttttatattcgcatctctataggtaaggttttccttcctgcacctacctcgagcttctttcaagattttctcttcatctgtgatttatgaagttttaataatatatgcctaaatgtaaagtctttttttttttttttgcatttattctgcatggtggtctctgaacttcttggatttgtggtatggtgtctgttattaatttggtaaaatttgaaataattatacaactcaccatattgtagaatcagtcattattgctccaaatattccttctgtttctgtttttctgtttggtttgtttgtatttcccttctgtaatccctattatgtgtatgttattccttttgtagttatcccagaattctgagattttctatttctttttagtctttttttgttttttcagtttgtgaagtttctactgacataacctccagctcagagattctttcctcagccgtatcaaatctactaatgggtgcatcaaaggcattctttatttcagttatagcattttagatctctagcattttttgatattttcttaaaatttttctctctcttcttacattatccatctgttgttgcaccctgtctactttttccattaatgccctcagcttagtaattctacttttttattttgtttgaattcttggtctgataaagccaacattctttccacattttcttccggttctacgtgtgtttagcttcttcaaactgtttgttttccctttagtatatcttatatttttcattgaaaggtgcacatcacgttctggatagaagaaaatctggaaaataggcctttagttatgtagtggtaaggcattgaggagtagaagcattctatagtcttatgattaaattgtagaattatgaacttcaccagtttataatctttggactttgctagtgcttctcagtttttcctcaccttaggtaagacaagataattggagtgagctggagttgagtattttctttcctccacataaatctaaattccagggttaggtatttttcttcccttagttaggttagtccctaacgaactttgtttctcctgatgaaaggccttgttaagtaagatcagaaagctgtggtatatttcacaatggtttttttcttccccctgctggaatcacaagagatttttctctaatattcacagtggggaactagaagagctcctgggaggtaaaatttgcagtaatgtaggagcctctctctgactggacccccttgggagtttctaactctccgagttgtccacactgagcctccagcaatgtgtcaaatacagctcaaattttacgaccccagcactgattcttgaggaggttcttgctcaggtaaactgtgattttctgcacctgcctgtctgtctctccaattttttggtcagtggtttgccctgtgaccttacctttctgagagatctaaaaagagtttttgattttccagtttgtccaacttgttacttgtggttaggatggatttgtgactttgaagctcctcacatgcaggtctgaaaactggatgtgtggcagttcctttgtttttttttttttcttttcttcttgctcttttttttaataagaagaatgataattataccttcatttttttctgaccactttttattttttggatttatgcatacttactttaatttctataataatcccaacaaagtagatgatctttgtttgcatgcacgccattaaatttgtcttcagttatttaatttaaaaaatgacagagtaacctttgacaaatcttcccatgaactacagtttgtctctcttctacctcctctctctctctcatggccccccacccaccacacacacataccttatccctaacctcaaggatgtaaattctaatacgaaagttagacaataaggctacaattaagatcaagggactctgatgacccaaaacaccgtatcatcctggaaatttgaagagttgttctggaggaagtgacaattgaatagaggtttaaacaataaggaaaagttagccagcaataaaaaggagatggacatgggaaagaacattctaatcagtgataggaatatgatgcaaggatgcagaaattaaagagaactgtatacagcacacttgagaatttccaattaattgagcatagcttgaatgtggaatgcactttgagcagtgataaaacattttaaacccagagtgtatttaatagatgtatagcaatggtccccaacccttctgtcaccaggcattggtttcatggaagacaatttttccatggactggggctggggaggatggtttctggatgattcaagtgcattacatttattttgcactttatttccattattattacattgtgacatataatgaaataattatacaactcaccataatgtagaatcagggtgggccctgagcttgtttaactagatggtcccatctaggggtgatgggtgacagtgacagatcatcaggtgctagattctcgtaaggagagcgcaacctagaacccttgcatgtgcgattcacagtagggttcacgctcctatgagaatttaatgccgctgctgatctgacaaaacagaactcaggtggtaataggaatggtggggagcagctgcaaataatgatgaagcttcgctcacttgctcaccctccattcatcttctgctgtgcagcccggttcctattaggtcaccaactggtactggttggggacccctgatgtatagaacctgagaaaggatctcctaagccaggtggcttaaacccacttctgaagtatattattccttatcttctgagtccctgcaaaatgagaggggagcccagaaaaatgagtggggaactcagatcagtgtattctggagtggcagtggaatcagtcttccttcttctatattatttcctccatatcacaaatcagctttgggttctggacatgcagaatatagataggtccaaactctctttggaaatagaagccattattttttggaaaatcaacactggaaagcaaaggtattgccctttttggagggtggacaaaggtggttttgaatagctgtctggttgggtgtttctgtttgccatcagttgtcatattaatgcatgagtatataacattttacactaaggaagatgaaagttaatttttcaattatgcagcaaaaataaatgtatgcctaacattatggcaggtgcttttagagatagaaagcagagtaaagaaaatagtcatgtttgaacttaaatagccaaactgaattcagtttttgatgctgcatttatttttgttttgttgattgttttccaacggatctatgtactatttttccacaccatacagatttcaatgcatgtgaattgtcatcaggacattggcagtttgacataatgaagttctaatgactgagtacatgctgtgactagtctttttacattacacataaagagcacttttatgtgtgtgagtatattggccctataaaaaaatctttgctgtatcttgcttgagctatttcattaatttctcaggctaactccccgattttacactctagtttcaaaacactctgccccctttcgttaagccaatctttatgagatttaagatagaaggtttgagaatccttcagtggctttcctaactctcaaagacactgatcatcccaagatctatttttccaaactaatggcacttttctactgtgttattgggcatcccacatgttctgttaacccacatatgcttcattaacaagttaacaatgtccatgaagttttttttcctacctgttgattgaattctttgcctacaactgcaattctcagatctatctagttcaaattaaaatttcccctttctttcctgatcattcattaaaagttttaaccttcatatctttaatgaggcacttagaacaatatgtctcatattccagttttctttattggattacaagttcttgacagacaaacttattatctccctgccttagtctgtttgggcttctataacaaaataccacagagtggtggcatgtaagcaacagaaatttgtttctcatagttctggagactgggaagtccaaggttaaggtgtcagcagactcagtgtctgacgaggaccttctctctggttcatagatggccatcttttcactatcctcaaatggtgaatgcgaaaagggagctctctggagtcttttttataagggcactaattacattcataaagattgtgcaataatgagctaatcacctcccaaagaccctatcacataataacattgcattgggtattagcatttcagtgtatgaactggggggttgaataaacattcagtctgaagcactccccatatctctacatcctcccctaaattatatgcatgcattgttttgtttattgtaacagaaccacagtttggtagttctttttctcagctgtattcctagaggaatcctcaatatataaaaaaatcctaaattgattactccttagttagtttaaatctttcccaacttattgcaatatggagataactggttggttgtctttcagggtgagtttgatatacaatggccatgaaattagtcatggaaagaaaacctagaggaaatcacatatttcccacttttacagccacctgtgtctccttcccatcttctttttcctaatctacacctttttgtaccttcgtacattttgtacacttttaattcacttttgtacatggctctactgtcctctgtaaatgttttaaaaaaaatgaaaaaaaataccctccaactccccacaatgaaaaatatttatgcattttatttgtcttatggtttaactgtgacatattatcactattactacttatttgcaattattatttttatgataattaattgcaagctattctaagtcctggggctggtgtgtttttttaggaactctctagacatgggctgtaggaaatgagatctaggttaacctgaaggattatcccataagaaaaaattatgctaaagtcctttattcttcttccttttacttctacccaaatatgagtttgcgtgtagtttcctatctaacatcattttctaagatatatatgtggttcatagctcaactctctgagcaagaaaacatcaatatggtcttaaggatgtttatcttttctagctttctgagtacatgcattttctgttcactgtgcctcaactaaattttataccaagagaaaaccctggagctttttgatttatgtggtagaaatttcacaaggaagtcaagtacccactttcctactttggatagagaaaagtaaataaacacagatttctccatgacctttgtgtgagctctaaattttgagatactttgaccctacacatacttgcccttgcatatgatagtattgtttgcaaacaaatatttgttttcttatttttaaaacaggttacattgtaaactagatttgttgacagggatatgtgggtgctatagaaactgaaatatagctggtgctgaagccgcgtcgttgcctcgggtgaatacccaagatttgttttctcttggtcacggaaaactaggacgcggacacagaaagaatgaggtttagagcagaagtttaacaggcgaaagaaagagaagagctctctgcagcagagaggggtaccagagaaatgggtggccagtttggcagtggaatgcaggggattttatacatgagcttgaggaggtggtgtctgatttacatagggcacaaaagattgttctgttcggaccaggtgtgccatttacttagcacatgaaaagctggccacccccaccctaatcttttgtatgcagatgggttctctacctggctggtgccatgttgcctgcttctttactgtacatgtggttgacaaagaaaagggaaaatggagtctccatgttgaacatgcctggacctcaggtagcactattctattggcacagctgctggcatttacccatgcaagcttccagcttgcttatctatgtctgcagctcactttttcagacttctgtttgttagaaaagaaatgatttgggaactgctttttgttaaaaagggaaattccaccaaagtctcttttaccctcactatctgcctaaataatttctttctagctgctgtattagtgccatacacaggatgggctttctgtgtatgtttttttttttttttttaaattatcttttggctacatttagaaaacaaggaatagaaagggaacagatttggacaccaaacaagcctagtggacagcaagctctacaagattaggaaccatgaatgccccaaactctgtgtggttccaaactcctagcattgttgttgtgcccagaaaaaatgcatttgttgaacaaaacaaacaaaccaacaaaaaacaaacataaatgggattaagttatggctctgtcatttaccagctgtcctgctaagaattaggttatttaaccgttagtttcttcttcatcattgaaattaggatcatactacctagcttcctgaattgctgccatatttaaagaaatgtgcctggcagattttctaaaatacaacagatattgaagagatgctaatggaataaatggatggatgaatgaatgaatgaagggataggtgggtggatagattgatgaatggatggatggatgggtagatggatggatagttagatgaattgaaacactcaaacggaaagatgttgaggtgcatacggatacaatcataagttaactttaccaatacttccttaaaaaacaaggaagtgattattggctttagtctctgtcctaatcccaaagttattagcagaattccatatatcccttgcacatatagcttaaatgacagccttattttatcagatcacccctgactccctcacctacccctgccagttgcaaacacattggaaaagaaagaaaaaaaaaagatggcaatacaagtattacgttttggctcccaaaagtaccatctttgtgcttagcattcattctttaccttcttttccattcagtacttgacaggtttcagaataggaagcaaaaagatagcaactattaaatttggaatgataatctagcttcataaattagactgttattctccattcacattgtgagagttatgaaggaacatatttatctcctgttagaaattaaacttctggatttatacttacattgacaaagttcatctctgcttgttcttcttctcttaatgttcatatttaacatgtctttgaatatgctaacaatttgatcatcttctttaacagcgtacttaatttgtctctacttagccttaatttatgcatttactaacttttgataccttttaaaaaataggtgggggtatactaaaatgtatgtgcttttgtgtatgtgtatgtgtatgtgtatggatgtgaatgcatgaattcacagttgaaaagagcaatatcttttttaaaaggaactaaacattagccatgctatgtttcagactatatactgaattacttactggctaacttcattagcatttcagtaatgtaatgctttaattgttctatgaaattgctttaatcttcctctcctcagtaatgagaaatgcctcaccctattgtaaaacttttgaagtattgtgtgcagttctggatctccatgaccctttcaaacagcatctctggaaggcaaaacttgctgaacttttaagcatgccttcctaaacctgaatttagcctatctagtcagccaattcctccccattaaccatttccagtaaccaagattcccttgtttcttgtagccctttgattttgcaagggaagaatttgataccataaaagtcaagtccacacaaagcagtaaaaggatattatggttcattcaaatatatctgctaattcccaggaattgcttttcctgaatccacactcttgcctctcctcatcttgaagactgtattcctgtctcagaaatcctcttttcactcctttccatgagtgcatttatcatgcagttatcatcttctaagtgagctgtaatcattgaaaaatattttgtttttcctggctctatatttcacctggcaattttgtctttatcccaagttgttttgggatgtccccatagaaaaattttttcaaaactggttttataactaaatggttgtgtgtcttgcatgagtcatttaacctatctgagccttaatttcctcaactgagagataggctcagtgacttctaactaaatgggctattaaaaagattgcattaagaatgaaatgtaaaataaaataaaatagcatttaaattataaaatggagaaataaactatgtcctacatttgaggatgtatcttaccatcaacatctatttctagtctaataataaaagaatgagagaaagaaagagagagaaatagagagaaaggcgagaggaaaacacgaagacagtggaaaaaagtgttctatgtgtatagagagacaaagaatagcccacgatagttaaacttgtaaattaaatgatgcttgatgaggaaaagggcaggatttgtgttgtttttatttttgttttgtttgagtagattgaaatcagcagctcttgagaaaagtctgccttttcattctaaaaaagaaaaactcctgaaatacatgatttgcacatgtatttaatatagttacaacaaaaaattgagaataaacaatttattgagtgaattttatttgtcttaagacactgacctttctctacaaagataactgcagttgcctccagctacgtgacttacctgagatttcttttttcattagtgaaagcagttttggcaactctattcttgaaatgagatgtcaaccaaatgctcaaatatttacgaattgacattttgcgtcttttaaatattcagtctttcaaggtgcattcgttctccctagtgtatagctatgaagattcatttgcaaaaaaaaaaaaaaagaaagtcatcgaaataaaaaggatgttttataacacatggcttgaaatcttaatgtggtgctgcagatcaatctaaccaatgagcatcaaagttcagttccagcatcagtatttttatgataattttctggggtttttttttccattttctcctgtgactgggttatagaagcctccaggtaatgtttgtgttgtaaaattgaggccagtaatttaatccccccataaaactctgctcacaattacaatagcattgaaatggtacataaatgagtttttcataaagcagaaaagaaaaatggtgcaacagttaagctttttaatgatgggcactaaagcaatgctgctgattagattctttgctaattaccttctgttacttagattggatgtatttcagcagaatagaaacatctattcataaatagttgttttcttggtagcaatatgaaaacatttgactctaaagttgaaaactacctctcaggattgtatcatccggtcctcagcttgctgacaaataaaatcacgtgccatctgaaacatggctagaatggcttgtattccactgggtggtatccgccttacataaggaagtgaaaggctgcagcagtaatatttatgctgagacttgaaaaccaaaaggtctgggtgaagagctttggagatggggaccagactggaaaagcaccgaggcaaagatgagctaagtctgtgaacaaaggagaaagtagtccaggatgaatttagagagttaggaagaagtgacatgggctttctaggccagcccaagatattagtgttttagtctaagggttattggaaagcctggagggcctaatcaaaaactaatatcatctaattaagtcttaagaaaatcacctgtatgcccaatgaacaatgggctgtgtgagttaaagatgaaaatagggatccatattacaaggctatagggaatgaattgtgacacctgtaccccctgccaaattgatatactgaagccctaaatggcaaggtcactatatttggagataagaccttaaagaagataactaaggttaaacaagggtaaaagtgtagaattctaatccaacaggaaaggtgtccatatgagaggaggaagacacaccagaagccaggaatatacacacacagagggaaggctgtgtgaagatgagaacacagtgagaaggtggccatctgaagcaaggacaccaggcctctgcagaaaccagccttcctggcaccttgaccttagatgtccaaccttcagagttgtgagaaaataagtttctgttgattaaacagaatatcacccagtatgagatattctgttaaggctgcccaagcagaataataaatccaaatggggagaaataaacaaggatgaaatgtgttttaaaggtggagccttctacctgctcatgaaatgggtatagagtaagggatagagaaatggcaataatagacctacagttatatggcagcatcattttcttattcagagacagacggatgaggcgcacttgagggggaaattggtggttcttctaacatgctaattttgatattcatttggagatataaagacataggatatatgagtaatacttcagaaagttatatatttggaagtcattgtcacctcctataaaagcaatagtattctacttgttaaatttccagttatccagaatttattgtttaacagatgaactttaatacccatatgtgcatgtgcataaacacacacacacacatacacacacaaacacacacttgccaaatttcaaccaagatttattaaatggctactatattgcaggactgtgatatcctcttcgattgtgattttccctggtgaaacacagaacctaatattattaaacctggaatatagacaaaaaagcagacaattaaagtacaatgtgattgtattagtctgtttttatgcagctgataaagacataccttagtctgggcaaaataaagaggtttaattggactcacagatccatgtagctggagaggcctcacaaccatggcagaaggcatggaggggcaagtcacatcctatgtggatggcggcaggcaaagagagagcttgtgcaggcaaactcccattttaaagccatgagatgtcatgagacttatcctctatcacaggaacagcacaggaaagacccactcccataattcaatcatctccctctgggtccttcccacagcttcagaaatgagctgggctcagagccagtggactagggtggcatgggaattagggagacaccagctgacacaggtaagatagggcctgcactattctttcacaaacaccaggcagtgcagctctttgccataaaagtgactctttccttctgcttaagaaaagcagagttaagagtaaagactttgtcttgcatcttggataccagctcagccacagaataggacactgggtcgagttgtgaggcccacattccaggtcctagctcttggatgacatttttagacacatcccaggccaaaagggaacctactgccttgaagggaaggactcagttttggcaggattcatcactcactgactaaagagccctcgggccccgagtaatcaccagctatacccagggaggatggcataggccttgggctctgagatatcttggctccaggggaaatccagtacattcccagctgtagtggctacagttaaagtctctttctatttgaggaaagcagaggaaaaactaaagagaactttgtcttgcacgctaagtaccagcttgaccacagcgggttagagcaataagcaggctcttgaggtccccaagtttaggtgtaggcttttggacagcatttctgcatctacactgggccaggggagagtccactaccctcaaaggtgagttctagaccttgcagctttcaccaaactgacaaaagagctcttgagtttaagagctggcagtagctcttaaggtagtagcctggtgggccgccccccagccttccgtggaccagtggtggagatggccacagaatgaggctccagtgtccatggaaaggagaggaaagagtggaaagtaacttatattgtggtttgtgtgccagcttagctgcagtacaagagaacatcaggtaaattgctgagggttttgatgccagtccctggctcccagacagcatttctgatcaatggggcttgggggagctcaccaccctcaagggaagggccttaggcaaggcccagtgttgtactggctccaggtctgatccagcaaagtcccagtggtggtggccacagaggtgctgcatcaccacacccccagtttcaagtggctcagcacagagagagagagactctatatgtttggaagaaaataagggaaaaggacaagaatctctgtctggtaatccagagaattctttaagatcttatccaagaccaccaaggcaatacctctacaagtctgccaaagtcacagcattattgggcttggggaaaaagtccatttgaataccttgaaaacctttaagtaagacaggcacaggcaagcccagactgtgaaggctacaataaatacctaactcttcaatgcccagacaccaaagaacatctacaagcatcaacacaatccaggaaaacatgatgatttcaccaaactaaataagccagcagggacaaatcctggagaaacagggatatatgaccattcagacagataattcaaaatagctgttttgaggaaattcatagaaattcaaaataacacagagaaggtattcaaaattttatcagataaatttatccaacaatacatcagaaagatctttcatcatgaccaactgggatatatcccagggatgcaaggatgctttaacatctgcaaatgaatcatatggacaaagtacatatgattatttcaagtgatgttgagaaagcatttgataaagttcagtatcccttcatgacaaaaaaaaccttggtatagaaggaacatattgcagcataacaaaagccatatatgacagacccacaactaagatttaactgaatgtggaaaaactgagtgtttcctcttaaatctggaacatgacaagaatgcccacattcatgactgttattcaacatagtactagaagtcttagctagagcagttagacaagagaatgaaataaatggtatcccaattagaaaggaagaagtcaaattatccttgtttgcagatgatataatcttaaattctgaaagacctaaagattccacaaaaaaacaattaaaactgatcaacaattcagtaaagttgcaggatacaaaatcatacaaaaatcaatagcatttctacatgccaacagtgaacaatctgaaaaagaaattgtaacagtaatctcagttgcaatagtcacaaataaaattaaatacccaggaattaaccaaaaaagtgaacgatttctacaatgaaaactataaaacactgatgaaagaaattgaaaagcacacaaaaaagggaaagatattttatgttcatggattggaagaattaatattgttaaaatatccacactactcaaagcaatccacagattcaatgcaatccctatcaaaatactaatgacattctccacagaaaattgaaaaaaaaaaagactataaaatttatatggaatcacaaaagacccagaatagccaaagctatcctgaaaaaaagaacataactcaaggaatcacatcacctgacttcaaattatactactgagttatagtaacaaaaacagcatggtactggcataaagatagacacataaacacatgtaacagaatagagaacacagaaacaaatctacaacctacagtaaactcaattttgatgaaaattctaagaacatacaccgaggaaaagacaatatcctcaataaatggtgctgggaaaactgaatatccacaacacagaaaaatgaaactagatcccgatattttgccatatataaaactcaaatcaaaatgaaataaaagctgaaatataagaccacaaactatgaaactactacaagaaaacactgaggcaagttttcaggacattagtctgaacaaaattttcttgagtaattcctcacaagcacagacaagcaaagcaaaaatggacaaatggaattacatcaagttaaaaagcttctggcacagcaaaggaaagaattaacaaagtgaagaggcaactcacagaacgggagaatatatttgcaaaccatccatctgacaagggattaataaccagaatatataaggaactcaaagaactctacaggaaaaattctaataatcctatttaaaaatgggcaaaatattttaatagatatttctcaaaagacgacacacgaatggcaaacaggcatatgaaaaggtgctcaacatcattgatcatcagagaaattcaaattaaaactacaatgagatatcatcttgccccagttaaaatggcttatatccaaaagtcaagtaataacaaaagctgaaaaaaataaataaaatattaaaaaaatctccaatacttaaaacttttgggccaggtgcagtggctcacgcctgtaatcccagcactttggaaggccgaggtgggcggatcacgaggtcaggagttcgagaccggcctgaccaacatggtgaaaccccatctctactaaaatacaaaaaattaactgggtgtggtggcatgcgcctgtagtcccagctactcaggaggctgaggcaggggaattgcttgaacctgggaggtggaggttgcagtgagctgagaccatgccattgcactccagcctaggggacagagtgagactccgtctcaaaaaaaaaaaaaaaaaagctggtgagtatgtagagaaaggggaaagcttgaacactgttggtgggaatgtaagtcagtacaatgactatggagaacagtttggaggttcctgaaaaaaactaaaaatagagttaccatgtgatctagcaatcctgctgctgagtatatacccaaaataaaggaaatcagtatatctaagagatatttgcacttccatgtttgttgcagcactgttcaccacagccaagatttggaagcaacctaaatgtccatcaatgaatgaatggataaagaaaatgtggtacttgtacacaatgaagtaccagtcagccatttaaaacaaaatgagatcctgtcatttgcaacaatatagatggaactggaggtcattatgttaagtgaaataagccaggcacagaaagacaaacatcacatattctcacttatttctgggttccaaaaatcacaataatttaactcatggagatagagaatagaagggtgattactaaaggctggtaaaggcagttggggataagggcaaggtggggatggttaataggttaaaaaaaatagaaagaatgaataatacctagtatttgatagaaaagggggcctatactcaataataatttaattgtccattttaaaataactaaaagaatataaatggattgtttgtagcacaaaggaaaaatgcttgaggggatggatacccaacttcccatgaaattgttattatgcactgcatgcctataccaaaatatctcatggaccccgtaagtacacctactgtctacccacaaaattaaatattaaaaataattaaaaataaattgaaatttaattaaaaataaacaggattttagactttagatgtcttattttaattaagacatacaaaatattgaaggaagaaaaatgaataaaggaacatgaatggaaggatactagaaagagaactatgtttaaactattcttaattgtaatttaatggccgatatgttttgtggggagtggaggatagataaatatggtatctgtaaatactattgaaatgaattgtgtattattcaaagacatattaaaatacttgcgttggttcctttggaaataaattatatattcattaagcactgatgtggtaagaaattttacctgagagttaaatgtagttattattactagtatatataatttgatgtcagttaactctaggcttatagcatgttgaatcatcatactgacctgacaaaaattggaattattatattacacaggcagtagtcatcccttattcacagttttgctttccacagtttcaattacctgtcatcaactatggcctgaaagtaggtaaatacagtcaagtaagatacttttagagagagagagcacattctcataattttcattacagtatattgttataattgttctattttattattaattattgttgttaatcttttactgtgcctaatatataaattaaactttaccatatgtatgtatttatgggaaaaaaacatagtatatatagggttccatactatctgggtttcaggcatccacaaggggtcttgaataaggagggaactattgcaatgtaaatgagtcataacaattttccttatcgctcccttctacctctccctctcccttcttttccctttgtctcttgttccttctttcctgccttctctccctccctcccttccttttttccttccttcctcccaacagccatgtactcttgaatgcaaatccttccttgatcaagctttcagataccactttcagatgagttttaaccaaaatgtggattgcaggctcatgagagattctgcagcagagaacccagctaagccctatcttgattcccgactcacagaaactttgaaataaaaatgaccattaccttaggctgctaattttatggtaatattgttaggtggtaagagataactgatagagtaaatgcagctggaatgtattaagagttacagagctggaataagataaagatggggacataagcctgggccaaattttagtggtcttttagattatgatcagaactttagcattttttcctacatgcagtgggaagccattgaaggaaatggagtaagaatggtcacatgacctgaataacattttttaaaagatcactccagtcactgtatagtggaaatattgtgtctgaatagatataagtaaccttgaaattagtaattcacaggagagacagcagctctgtgaactccagtagtcaaaggtagctttgcaaaggaagaattgaacttaactttataaattgtgtaggatatggatgggccaaagaggaaagggagaacactcgatgataggaagaaagggttcagagtagttatgaatatgggaatggatgagccttatgtaaagacaatggttacgatttgattgcaacaggaagtctacattaataaataaaaataatttggatcaagaataaactgaatttcatcatcttatcagaaaagagcaacagaatgggaattggagagtcagagactcagggtgaactcacattcataacttaccgataatgagcctcccagagaggttccttatagaagctcttccaactgtagcaatgtgatcaaggtaaatacttttgtcattcacacacagggagaaaatactgaatctattaagagaataaattagttatgaagacagattatgtgcatcatatgacaaagtatccatatggagcgcactacatcagaactcgggtagaactttaaacatgtgaatgatagaagataaaagtataacattctttaattttcaaccgtttcaatgggctgggagatcaaactttaggcattttatgtctaaactgagtgcagaaataggaggattcagaaagtgtactgaagttgatagctgaggacctgaatgaaaaaaatacctcaactttattttgtgacaacaaaaagaaactaagataaataaataagaacagaatttcatatttgagatatgattacctttcaatatctgtatagctctgtggagggtaaaaccctctcttgtgtctgctttctgtttagagagaaagcacagagagagtttcctctcaaatcatatcctaggtttctcaggaacaatgcctttaaaatgtgtcagtctcttgcagctggcaaaatgcctcatcggagctcaggtacatgacagtctctactcttggaagaacaaagtggaggcacaaaaggcctcttgtgaacagcctctggtgttttaatactgtgaatttctacccatctggcaacactgtgtggtatctaggagaacacagggtacaaaaagtgttgaccactcaacagtataagtgcttcacagttagtactctaagattatttacattagaccccaaatagagtttgcttttagtgtggtttggtgaagtttaaccaaacagtcgtcaaagacaaacattagggtttgcatcaatatcgagcctctttccaacttggggactttgactaaaaacttatagttcttacagtaaattattgtgaatataggacaattttcttttctcatacagttctagtgataattatatgtgaatacacacttaaatatttttgctggcacaaactatattaggtaatttttagttactttacgtgccatttaatgtttacactatccctataatgcagatatgatctttattttttcagataaggaagcaatttaatatcttcaaacttaaatctacctaaatttaaacttatttttataatttatatttatataattgatgttataaatgaggaaaaaaatccagccataatttatcatcagtggatgaatgttattcatactctggtatgttcaatataaacttcacatctagttacatatttagaataatatacaggtgttatactcattattaaaatgtatttttctccttacaatgtactatatacatcttaccatgtaaacatattcatttttattttccactgttaattttcaagcactcaatacaaatatctttaactattggacacccaaaaaacatttgttctgtgaatgaaataattatctttgttattctgttgtttaaatttttcatagattattcagtaaaatacatgttgttaagcacatagtacgagggtagacaaatatgaacctaaacttttttgactatttcctaaaattcctctatttttaaaaacatttactagagttgaattaaagggagaaaaatattaagggccaaaaattattttagtttttcttcccatcattatacaatgctactatctcagctaaacttgataaagtataaataataaatattctcattattgtcaaagtagaaaactctgtctttaaattctattttatttttcttattattactaaatgtcagctccccacaagcactagtgaaagatgaagaatattcattagtaagttatgtcttaagaaaaaacttatggtgatgaaattcaatatgtaaagatgtatgttgaccaagatttgttacaagtagctaaattcaaaactgcttttaaaataaaaatatccagtgaagatatgctaatagccaataagtatatgaaaagatagtgaatgtcattagccattaggaaaatgcatatcaaaaccaaaatgagatactactttacacccacagggtggttaaaacaaaaagacaattacaaggaataccaagaatgctgaaaaattaaaaccctcatactttgattgtagaattataaagaggcacagccacttgggaaaacagtctggcagctcctcaactggttaaagaagttaccagaagacccagcaatttcacttttagatatatacccaagagacctgaatgtacatgcccacacaaaaacttgtatatgaatcctcatggcagcattattcataataccccaaaatggaaataacccaattgttcataaattgaaacaacaataacaaaatgtgatatatccatacaatggaatattattcagccatacaaagaaaagaagtaacaatttattccacaacagaaataattcttgaaatcattatgctaaatcaaataagcagaacacgaaagagaaacaatcagtgctgtttaaaatggtgggatcaaacaagctggcttcacttcccttaccttcatacacacacgaatgtatatctatatctatctatctatctatataagtacatatatatatgtacacacacactataacacacactatatataatatacacacaaatatgtatattggaatatatatatatacacacacacagtgctgagattatcagtagcaatattgcaatatccaactcaaaatatgaggatgaaacaattcgcagggccacagagaagtgtacaaactctaagactcagacttccacattcacaacaccccacccttcatctgcctggcaccaagcacatgaaaaattttccccaaatttatggtttctacagtgaaataaatgagattgaggtagacaatcctgcttccccactatcttggatttcctggcagaagacatgtccctgcctcaagccacaggaagcatcacaagtaccttatgggagaaatatccgtgatgatagccagagacagaagagaggtgagactaccatccttaccctcagcctcaggcctggaatctctcctctgtaactcagccaaagatttcatatcagagtggttatgtagtagcactgcattgtagggggtaggtaccacaggtcccctgggcacaaacctctagccagctctcccaaactgctataatatcctcttaggaaccttcccccaatctggacaggcagtattctgatattttaatagagttgaaacaaacctgggcttaaggtgccatctagtgccaaagagagagagagcagaaacaaaaaataaagagatattcaataggtaaactacaaagactctctatgcaaatatttccaataaacaaaacagctagacagagaagactggaataaataactagtccctcaaggcaaagatacagacaataatctaaacaacaacaacaacaacagtaagcaggaaaccatgatctcctcaaacaaacaaagcaaagaatcagtgactggcctgagtgagataacaaagtgtgagctctctaaccaataattcataatagcagttttacggaaattcagtgatttccaagttaacacggtacagcaattcagaaatttatcagagaaatttaaaaaacaaattgaaataataaagtttttaaacagaaatcttggaactgaaaaatacatttgctgaattgaaaactcattagggactgtcaacaaccaaatggatccagcaaaggaaagaatcagtgagctcaaagacagcctattttaaaattcacagtcagaggagaaaaaaaaagtgagaaggaacaaagattcactacaagacatagaaaattacctcaggctgggtgcggtggcttatgtctgtaatcccagcacctggagaggccgaggcaggaggatcacttgaggtcagtagttcgagaccagcctggccaacatggcaaaaccccatctctactaaaaatacaaaaatgagttgggtgtggtggtgcatgcctgtgatcccagctactcgggaggctgaggcaggagaatcatttgaaccttggatgtggaggttgctgtgagccgagattacactgctgcactccagcctgggcaacagagtgagactccattccccctaaaaaaaaaattgcctcaaaagatcacatctgagaaatattgatgttgaagaagttgagtaagagaaaagaatagaaagcttattaaaaaaaataaagaataacaaaaacttcccaaaacttgagaaagagataaatattcaagtacagtaaggtcagagaaacaaatgtgacccccgtaagactaccccaatgacatagtttgaatgccctcttcaaatctcatgttgagatttaatccccagtgttggaagcaggtaggaggtctttaggtcttagggccagatcccttatataaggcttggtgccgtcctcatgatagtgagtgagttcttgtgagatctggttgtttgaaagtgtgtggaatcttccccttctctctctcgatggtgctctagtcatgtgatatgcctcctcctgcttcattttccaccatgaggaaaatgctcctgaggcctccccagatgccaaacagatgccaacgctatgcttgttcaacccacagaaaaatgagccgattacacctcttgaataaaataaactcttgaacctcaaggacaaataaagtattctcaaagcagtaagagaaaagaggcaaataacgtaaaaaagatctccaatttatctggcaacagacttctcaatggaagccacacaagctaggagggactgggacaatattttcaaagtgctgaaagaaaaataaactgccatccaaaaatccagcaaagctatcctttaaatatgaccaagtcttccccagaaaaacaaaagctgagataattgaccactaccagaaccatcttccaagaaatgctaaaaggagttcttcattctgagagaaaaacaaaacaaaacaaaacactaacgtacaaaaagaaaatatttgtcatttctttaaaaatacttgtcgtatctataaaatgttttttgtaagcctcatggtaaccacaatgaaaaaactataatagaatcactaaaaataaaaagcaaggaattaaaatataccaccagagtaaatcacttaaccacaaggaagatacgaaggaagagaaaagttacaaaataaccagaaaataagcaacaaaatggtagtagtaagtttttactatccataataacacttaatgaaaatgaatacaatccttcaattaaaagacatagagtgtctggatggataaaactgtgagacccaactatgagctgcctacaagaaacccacttgacctataaagacacgtataccctgaaagtgaaagatattgcatgcaatagaaaacaaagaataggagtagctatacttagaaaaaaaactagaagttcaagactataagatgagaaaaagaaagtcatcatataatgatgaagagatcaattctgcaagaagataaaacaataataaatatctatgcacccaacaataaagcacacaaatgtatatagcaatcattgatagatctaaaggaagaaatagactgcaatataataatattaggggacttcaacatgccactttcagtaatgaacagatcttctagacagaaaaccaacaaaaaacaactttggaattattctacataatggaccagataagcttaactgacatttacccagctctttacccagcagctgcaaaatacacattctttgcatcagcgcctgagccaattctacagaatagaccatattttaggccacaaaacatatttcaacaaacttaaaaaagtagacatcctgccaattatcttttctaacctcaatggaataaaaccagcaattaataacaagaggaaccccagaaactacacaaacacctgaaaattaagcaaccttctcttgaacagccaaggggtcaatgaagatattaagacagaaaattaaaaactttttgaaacaaagaaaaatggaaagacaataatttcttccataaatattgctaggtaaacttggtaaccacatgcagaagaatgtaactagacacctatctctcaccatatacaaaaattaaataaaaatggataaaagtattacatctgagacctgaaattatgaaactaataccataaagcttttggaaagtacctcaggacataggaaactaatagcataaagcgtttggaaaatacctcaggcaaaaattttgtgtaagacctcagaagcacgggcaacaaaagcaaaaatagagaaacaggatacatgaagctaaaaagcttctgcacagcaaacaatcaacaaagtgaattgtcaacccacagaactgaataaaatatttgcaagctatccatctgaaaaggaattaaaaactggaatatataaggggctcaaataactcaatagcaataaaatgaataatctgaataaaaatgggccatggatctgaatagacatttctaaaaagcaaatgtacaaatggccagaagtatatgaaataatgctcaacatcactaatcatcagagaaatgccaatcaaaaccataatgagatatcatctcactccggttaaatggcctatataaaaaagacaggcaataacagagactggtgaggatgtggaataaggagaacccacatacactgttagtgggaatgtaaattagtacagccactatgcagaatggtatggaggttcctcaaaaaattaaaaatagaacttctatatgacccagcaattccactactgtgtgtgtatccaaaagaaaggaaatcaatatactgaagagatatctgcactcccatgcttattgcagcactattcccaatagccaacacatggaatcaatctaagtgcccatcaaaggatgaattggtaaagaaaatgtggcatatatacacaatataatattattcaggcacaaaaaagatttttattttttactttgcagcgattgtgaaagttagctgtgggtttgtaatatgtggccttcattattttgatgtatgctccttcaatacccagttttttgagggtttttatcataaagtgattttttttttttttttgaggagtcttgctctgtcgcccaggctggagtgcagtggcgcaatcttggctcactgcaacctctgcctcctgggttcaagcaattctctgcctctcagcctcccaagtagctgggattacaggctgccgccaccatgaccagctatttttcatatttttagtagagatgaggtttcaccatcttggtcaggttggtcttgaactcctgacgttgtgatccacccacctcggcctcccaaagtgacgggattacaggcatgagccactgtacccggcccataaagtgatgttttacattatcagtcctgaggtgtgctctttctctgggtcactactctgcctggggttgcatcctcaccacctacactctgtgctctctgactgtaccacactttccatgcatctgcacaatctttaagagaagacactcgctgagttttattcaccagaatatcctaaaccatagcacagtgcttgggatccaataaacattccataaatattttgcttatgggataaaaacatttaatgtttttaatgaaaatatatatatattagagaatgtgtggcatttaatagtgtttgagttgatcgtggtattgtgtaccagcagatacggatcaggttaatttattttaaccacctaaataagtctcaaatatcaaaacataagtcatttgctcatacatgacctttctcaatgaattattaatctttcagtaattgagctttattagtgtacatgtcaaatcaactctttgagaaatgtcaggcatctcaaataaacaggcatcctcccaatggagtgacaatgtcggaaaaggagtcaagtgaatagacaggtatgtcctaaggaagaaaatataaattaacaatgactttatcaagattccacaaggcaaacatttaataatcaccttcagccatttctctctatacagcaacactatctcttcttggtatctatttaattaaatagtctttacacaaaatcaataattagtcactctgaagacagttgagggattttaaggtcagcacaagtcataaatagtcagctttaccaagtcaaaccaaatcactgaaaaaattacaaagaaaattcagacttggaaagggtggctctatgtaactaaaaggagtttctagtattattggtcattcaaagggtaattttgtcagtacaaaatctacttccttagtaaataatacagtgaagacaaacaaactacttaataacatgcaaacattgctttaagggtaataccttgacttctttgcttcttgaaaagtttgtggtcataaaactagcaattatttattccatacctatacctattttataccaagtattgtgctaggtactttcatatataacttctagtataactgcaattaacattagatattataatccatcatcttgtcagagtctagaatgttaactattacacaatggaactccatacaatctggcattttggtaaagagtaatctgatgccgataagagagataactttgcccgcattagagacatactaaatggcagaactggaattcaaatataaggctatttgacgcaaaagccaaagtttttcctctagtaaattagatcaaatgaatatataaataaataagataataatgaatgagttatgagttttgcactacttcataacatggcaatataatcacttaatttcagtagccctttaaaatattattacagaaattgcaaacactacatattttaatgatcccccagataacccctttatctagtatcaacaattgtcaactcatggattattcttccttttttttttttttttttttttgagacagagtctcactctgtcacccaggctggagtacagtggtgcgatctccgctcactgcaagctctgcctcccgggttcatgggactcccgagtagctgggactacaggcacctgtcaccacgcccggctaattttttgtatttttagtagagatgggttttcaccgtgttagctaggatggtctccatctcctgagcttgtgatccgcccgcctcggcctcccaaagtgctggaattacaggcgtgagccaccacaccggcctattatttcatatatatagatatatatatacactctatttctcccatctctggattattttgaggcaaatttcagacatattattttatccttaagtgtttcagcgtcatctctgaaacatagggtttatatatctttaaacattcagaaaatcattatcacatattaaataataatttgttaacattatcaactatctagccagcatccaaagtacccagttactccattaatattgttatctcttacagtgtggttttatgcgtcagaattcataaaacagtcatagatcatgttctagtgatgtctcaaaaaccttattagtctatagattgtctctgtccctcactctctgcctgtattagtccattttcatgctgctatgaagagatacccaagactgagtaatttataaggaaaagaggtttaattgactcatactttcgcatggctgggaaagcctcaggaaacgtacaatcgtggcagaaggtcaaggggaagaaatgtaccttcttctcagggcaataggaaggaaaaatgctgagcaaagggggaaatgccacttataaaaccatcagatctcatgagaactcactatcacgagaacatcatgggggtaaccgcctccatgtttcaattatctcccgccaggtctctcccatgacattatcatggcatagtggtggggattatgggaactacaattcaagatgagattcgtgtggggacacagccaaatcatattattccattcctggtccctcccaaatctcatgtcctcacatttcaaaacacaatcatgcctttccaacagtccccacagtctttgctcattccggcattaacccaaaagttcaagtccaaagtcccatctgaggcaaggcaagtcttttccacctatgagcctgtaaaattgaaagcaagttagttacttcccagatacagaggtataggcattgggtaaataaacctgttccaaatgggaaaaattggccaaaacaaaggggctacaggccgaatgcaaatctgaaatccaataggggagtcattaaaccttaaagttacaaaatgatacctcctctctctttttttctcttcttataatttatttgctgaagaaccagatcatttgccctgcagtttccctcagttcacattttgctcattacacccacagtgtattatttaacatgaccatttgtatcctgtattttctgcaaactgataggtctgagtcagggtttctcaatctcagtactgttgacattttaaaaagttaagttattctgataactcttggttgtggggggccttcttgtgctgtgtaagatgtttagaagcatccctggcctctacccactagatgacattagtacctccccatttgtgacaatgaaaaaatgtctccagatattgccaaatgtctcctggagacaaaattgcacctggttgagaacactgatctaggccaaagcttttattgttttgtcgttctgttttatttactattattaggttggtgcaaaattaattaatggcaaaaactacaattaattatgcaccaacccatattatttctagactaattcctaggagatgttgtcttcttttgtcagttctctcttttattgatggtggcagccttcaatgaacattttccatatctataaaatcattgcaggttgcagaatggtgactttctacttctaccaattcttttgtatttgtttgttttctttttaaatttgtttctgactgagatatttctattaagcgaaagtttttcttattatttggttagtctgagataaagttggtataataaaggcagaataatgcttgatgttttttccatttaccagtttacaaaagcgtaagtcctagccttctccaaggatacctaaaactgataatttttgttttgtctacataatggtgaatttttgataaaatcatattacataaagttaaatccattgtaattagtattcctgtagatgatctacttatctttggcaaatatgacctcttcagtttgactactgaattctttagttttgatatgactatgctagtctttgagtacttccttaatattttgtataaataaatgttttaggtcaatcctttatatttcctgcataggcctagaatcaggcatttctccaaaaggctcttgttccttttattaaaatctgttactacttaactggtaataattatatttgatttccttaaattactacggaaaattatttatactgcttagatggtattaagggaaaaaatatttatttttgcaagtcttattatagcagtacctatggactgtaaagatattgaagacacaatccttgtaccagcagcagctagtagagaatagctggtgtctcagaaatggttgctatgcaaaggaataaatggtttctagtggagtaatattagcgacattaacatctgtgctgagatatcaaatggacatattttcagtaactttgtcttcaccaacattcaaacttggttgcaaagaaagctatcattttgaaaaaaacatagatctttattaaacgaactcaaaatacattaagcagggtagcaatgattttaagttaaaaataaagctatctgtccacattaaaaaagaataagagtcaaagaaaatcacattaattttcactacctgtagaacaaatcagcaaatgttgtgaccatctgtgaaagacaccagggccacataagacatggaattatttaatgtgttaaatccatttaaaatgtttgtatcctgttagttctaacataattactacgttaatttctgtgtgttttgcatattaaacggaacgcactctgggaagctaatggctgctatgtcagcttttttattaaatcacaaaataaacatgcacaatgctgcttctgaagataattagtttactatttctgccaaagtttaaatattgggtatgctttgaagatttgacttccatttgaggtggcagtgggcatgtggtagcttctagattcttcagattatcctcaaggcaagagcatttttagaggagagagaattaaaaagttttgttttcattctttacccttaatttttagcattgcagttataaaaataaccaacataagtctatagcgtagttctacatagaactatactagataatgggggatggagctgacgagtgtaagtgtttcttggtgcaaagcattttaatcaagtgtgaaatatcagatgcaaaatagtctagattacactgctttttttttcttttttttctgagatggagtcttgctctgtcacccaggctgtagtgcaatggtgcaatcttggctccctgcaacctccacctcccaggttcaagtggttctcctgcctcagcctcccaagtagctgggattacagatgcctgccagcacacctgactaatttttgtatttttagtagagacagggtttcaccatgttggccagactggtcttgaactcctgaccttaggtgatctgcccaccttggcctcccaaagtgctgggattgcaggcttgagccaccgagcccagctgattacactgtttttaagcaaaagccacatgaagttgaccagaaagcccttgcctattccagctccagaaataatacgcatatctgtttgacaaagatgaaagtgaatcaaactgagccaacatcaaaaataaaagcaagaccaaataagcctatgaacagttgcaggctgtttccagtgagcttcactcacattcttctccatagggccttaccacaagcctgatccacacaccactgccacatgcttgccatggtaggcatttaaggtcaagatcactgcttcagagaatacaaagtatgcagcctgtgtttcctcatctagttctcacaccttttctgagcaataacctgggaagatacttttgtgtggtgggcaattgctattgtggggcctctgatagacttcctttaagctcagctccattgactatatttgatataatctcaggcatgtccctttagtcctctgagtccagtttccattcttataaagtagaagcaacactaaagttgtcatatatcttttgcaacatcaagtgagataactatgcaaagaacaaagtcctgctcctggcatatgacacatgctttatatgtatgcaatttacatatacttaagttatgattaatatttgtttatttatcagtagtggctttttagggggatagaaatgcccagttttatttctttaattccaaagacagaccatggacgatcttggcttctaatgctaaagaaagaatgttaataatattaagttatagtaatgttaagatattttatcgaattttaatgagtttctaaatacaaaaattaacatactaattttatcttactaaatatctattcctattatttaaataatataaagtaattgttttatttgccatctgacactataaacttacttttcgaacatattttacatatttttttctcatttagtctttcctcatttcatctgagtaatgaaatggggaccggtattgatgtatgtaatgatctataccaggaaatccacagtggttaatggaactgaccaaagctagtgtgtgacaaagtcaggagcaaatcccaagtgttattgcagctagctcaagactggcttcatggcagggctcagtggctcacgcttgtaatcccagcactttgggaggccaaggcgggcagatcacttgaggtcaggagtttgagaccagcctggccaacatgttgaaaccccgtctctgtgaaaaataaaaatgttaaccgggtatggtggcacacccctgtaatcccagctactcgggaggctgaggcaggagaatcaattgaaccctggaggcggaggttgcagtgagctgagatcgcactactgcactccagcttggatgacagagcaagattccttctcaaaaaaaaaaaaaaaaaaaaagaaagattgaaagactgatttcaccattcagatgataactttcctaaggagagttgagtattaagtatatttctcccttctgattggaactttctcctttttgatttcttcttattttttttggttgcgttcacgagaaaattccaaaattcagcaggtgaaaggaaaactttcagattgatttgcatctctagtaactgtaatgaggttagcatttttaagattttacacaaaatttgtacataaaatcatcctaaagcctttgcattcataaaaaatgcttattatttttgttgactcaagatcattcttattttcatcaatgattaccctcagctataataaagtgaaacccaaaggcagcattccctaaagtgcattctgatgatgcataattaagccttcctggacaactgcatgcaaaattaaccacccttttttcagtgctttgagtatttggtcgtcttccatagcagttttcataacatcatttttatccaggttttctactgacattatgtagaggcgttaatttgttttgtgacttttggccaagtcagccagtgtccttaatattcagtctcctgatctgtaaaatggaggacaacaataccttctttattgtgtcttttgaaaggatttagatgattaattttgcaaaatatctggcacaaggcttaccatttagtaaatcctcaacacatgtggatatccttcagttctgtatcacagatgattttttaatgctgtattaaaaaattaaataagtaaatcgattctgtttattgttcagtaaagattattctaaccactactttctggaatatatcagcacagtagcaaataatattataaggtgtatatatttttatgtacctttgttcaatagctttagagaatttaggtttactttgccccttctttctattttaccaaattacattttctccagagctgttctcagctatgctacctcaagtagtcatggtggtattcttcccaagaagtacagggttaaaactataggtcagtcttagctgaccctcttaggagctcacacatttacccatgccctattactcttgaaccaaacattagggctaaattatgtttgacctccagaaactttatttcccaacagggttttaaatctttcacataaataaagacctggcaaacctctccctgttttctgtccctagcctggacagaagagtattttgagtaaatgcagtttaagactaagttgggaatgttctttttgttttaaattcttaacttttaatttttgtgggtacatagtaggtgtatatatttatgaggtacatgagatattttgatacaggcatacaatgaataataatcacatcagggtaaatggggtatccatcaccttaagcatttaccatttatcacttgtcttacaggtattttaattacattattttagttatttttaaatgtacaatacattatttttacctgtaatcatcctgttgtgctatcaaacaccagattacattaattctatctaactatattttgtacccattaaccatcccaactccctcccccaacccctcactatccttctcaacctctattaaccatctttctactttctatctccatgagttttaacttttagctcccacaaacgtgtgagaacatttgaagtttgacttcaaatgcttgacctacttcacttaacaaaatgttctccagttccacccatgctgttgcgaaaaacagaatctcattcgttttatgactgagtggtactccattatgtataagtaccacttttgctttatcccataatctattgatggacacttaggttggttccaaatgttggctattgtgaatagtgccacagtaaacatgggagtacagatatctctttgatatactgatttctttttttgggaggggatatatacttagcagtgggattgctgaatcatatggtaactctatttttactttttcaaagaacttccatgctgttctctatagtgactgcactaacttacattcccaccaacagtgtacaaggtttcctttttctccacattctcaccagaattcgtcatttcctgtcatttgaatgaaagctattttaattaactggggtgagatgatatcatgttgtaattttaattggtatttctctaatgatcaatgatgttgagcatgggagtattttcttagggtctccactttatttacagctggtgctcaatattcataatgtgacatgctcatggaacttgtagggtgacccattgtccaggtttacctgggactgagagcactcctgggatatggaacttccaatgctaaaactagaaaagtctagggcaaataaaaaacattttgtcatcctatgttggaaaagaccatgaagtaaatagtttccatgcataacacaccatccatttgttgaattatgctttttatctcttgtactctgtcacatcttttccaggatgtaaactcattgaggagagagccttggctttagtccctgttataagccatgttagttacatggtaggttctcaaaaggtttttgaaggaagaaaataagggagggatggagggagggatggagggagggagggaggggggaatggagggggggatggagggaggaatggagagttggtgaggtaaatcagtaaaaagaacaacagaagaaagaagaaagaaaaggtgcattgagtatatgcttatttgtctctttcaacgtctttggcaccattaatggaaactgatacatacaaggggaatattccagaaacttaagatttttcctaggctgtagacaatgagtgaccccttgaaccctaaaacatgggtaagcaagagttgcttgcaaaccactgataccatgactgcaagtactgaacaatgttaaaaatttcaaaaaggcgtacttccttgtttcaaactgtcataggcgataaaaatcagattcatctatatctgctgtcttacaagtctaagaattcagactgatatacaatcattgctaatactttccattcaaccacacactgcttaactctgtcatgttattttctcctgactgaaatattaaatcctgtattacatatacttctgcctgttttccctagatccatgaaagtactttagattattccgcctaattctaaaagggactgactctttgggtctaattgaaaatgagatgatggttccaattccttggcatgacatccatgacccttcaatgttggaagtgaaatgatttctcaatcttgttttttgtcactccccttcgcagatgggtcaacattcaatcccatggaattctgtctgattgggtcttgaggtttggatttaggcctgtttatgatcaggtctttccatacatgacctaccataatttgctttggcaaaggctgtgacatctgcgttaccacttttgacacatccacccctaaaaactttgcatgcatgtgttctgaaaagccactggtcaaaagtgatcatccttttaccaatttcactgtagaatttaatatcttaaattagaattatttatttaattgttttacttaccatgatctctatgagagggttgagactttcatctgcatctctcaattcttagtatctagcacaatgcctggtccagaaatacaactatggatatactaaataaacatcaacaaacaatgctacataaggctttataaaagtattaagcggcaggccgaggtgggcggatcatgaggtcaagagattgagaccatcctggccaacatggtgaaaccccgtctctactaaaaatataaaaattagctgggtgtggtggcacatgcctgtaatcccatctacttgggaggctgaggcaggagaatcacttgaaccccagaggcggagcttgcagtgagccaagattgggccactgcactccagcctggcgacagagtgagactccatctaaaaaaaaaaaagaaagaaagaaaaaaaagtattaagcaaactcagacattattaattgtaaggcataaaaaatattgaaaaaactttagtggctttttctgttcttattcatcctcttattttcagttttttaaaaataattattaatttaatcaattcttcaaagtttcaaaaagtttagtatttattttaaaagcaatttcagtgtacctagttgtgtactttttctaatgaatttatgttttattgaagtccctttgaaaaaatttaaaatctagatgcaggccaggtgcaacagctcacacttgtaatcccagcacttttggacgccaaagtgggtggatcatttgagcccaggagtttgagacaagcctgagcaatatggtgaaaccctgactgtaccaaaaatatccaaattatctgggcatggtggtacgtgcctatagtcccagctactcaggaggctgaggtgggaggatcacctgagcccacagaggtcaaggctgcagtgagcagtgattgcaccactgcactccagcctgggtgacagtgggagaccctgtctcaaaaaaaaaaaaaaaatagatctatacaagtaggaagaaatttgcaccgtacctatagctacttctgggatattcattgcataaggtagggttttcaatgtgtttttattgagcctcccctgtgaaacaggctgtcacatggaatagtcatggtaaatgttttacactctcctttcaaagtggactagttgcaaatttatggcagtactataacaattttggacatcagcctcagtttgctgcacatttagacaggcaaagttttaaatgaaatgtagtggtatgattctacagaagtgatattaatgtaaaaaagatctgtttttacacaagtattctgaactccttatatcttcttaagattcaaaagcggctctgacacatattgtcagtgtgaccttgggcaagccagtagaactctgtaagccacagtttgctcttctgtaaactcctacaaataataccgtcagtgcaagttttcctgaagataaacaaaatataatatacatgtttgcagagtgcctgtttcaagaaactgtaatttacttctttcatccttttgttcctggaattttaaacccctgcatttcccataaaagctgtctctcacattttcccagcctggaacttgccgtctctcatccagtcttcagaaagtcaacctctgggtaatttccctagtatcttgactgagatgtgttcttgctctccagtatttgcctctgtcttcccaggctcatttttaagctcactagagatgatgtatatgaaacatttctgataatagtctatttccttctttttccaatattatacaatctaatctttattatttcagaatatgcggttattgtagaagaggcaatatgcactgttgtttcaaacatttctttttttttttttttgtgagacagagtctcgctctgtcacccaggctggagggctggagtgcagtggtgtgagtgcgatcttggctcactgcaatctctgcctcctgggttcaaacgtttctcttgcctgagcctcccgagtagctgggattacaggagcccaccaccacgactggctaattttttttgtatttttagtagagagagggtttttccatgttggccaggctggtctcaaattcctgacctcaagtgatccgcccgccttggcctcccaaagtgattggattacaggagtgagacacagcgcctggccaaacatttatttcttatatcagtatctagcttgtatgcccctgcaatagctaaatctcattgtcaaccaataggacttgccctatgctgactccacactatgttttgggcattttaattttggagattagctattgactattgtgacagttgtgaataggaaaataaagaacacacacacacataaacacaatttctctctgttggcatttaaatatggcctgaccaatggaatgtaagaaaacatcaatgcattaaacgcagccaccaatagttgttaaaatctacacccttacatttgtatttgtggaatcacaatatctttttaaaaaatagatctttttaaaattttaagtttaggggtacaggtgcaagtgtgatatacaggtaaattcacgttaagggagtttgttgtacagattattttgtcacccaggtattaagcctagtacccacattagttattttttctgatcctgtttatcctcccaccctccaccctccagtaagtcccaatgtctcgttcccctctatatgtccatgtgttcttctcagtaagctccaacttataagtgagaacataccctatttgaattctcttgttgtgttagtttgctattgataacggcctcaagctctatccatgctactgcaaatgacatgagttttttttatggctgcatagtattccacagtgtatatgtaccacattttcttcatagagtctgtcattgatggacatttagttaattccatgtctttgctattgtgaaaagttctgcaatgaatacatgtgtgcatgtgtctttatgatagaatgatttatattcctgtgggtatataccctataatggggttgctgggtcaaatggtagtttggttttcagtctttgaggaataactgcactgttttctataatagttgaactaatttacattcccaccaacagtttatcagcatatatttttctctgcagcctcatccgcccctgttattttttgactttttagtgatggccattcggactggtgtgagatgatatatcacggtggttttggtttgtgtttctctaatgatcagtgatactgagctattttctatgtgcttgttggccacatgtaggccttcttttgaaggtgccatttatgtgcttttcacacttcgtaatggggttgatttttggttgtaaatttgtttaagttccttatagatgctggatattagatctttgtcagatgcatagtctgcaaacattttctcccattctataggttgtctgtttactctgctgatactttcttttgctgtgccgaagctcttcagtttaactagatcccatttgtcaatctttgcttgtttccattgcttttggcatcttggtcatgaaatctttgctcattcctatgtccagaattgtattgcctaggttgtcttccagggttttttcagttttgggttgtacatttaaatctttaatccatgttgagttgatttttatatgtgatgtaaggaagggttctagtttcaatcttctgtacatggctagtcagtcatcccagcaccatttactaaatagggagacctttctccattgcttgtttttgttgactttgtcaaagatcaggtagttgtcagagtgtggccttatttttgtgctctccattctgttctgttggtctatgtgtctgtttttgtacgggtactgtggtgttttggttactatagccctgtactatagtttgaagttggataatgtaatgcatctagctttgttctttttgcttaggattcccttgactattcgggctctttgttggtacaccaacaacagtcaagtggagagccaaatcaggaaatcaatcccacttacaagtgcccccgaagaataaaatacctaggaatacaactaaccagggcagtgaaagatctctacaagaagacctacaaaacactgctcaaagaattcagagatgacacaaacaaatgaaaaaacattccatgctcatggatggaatgaattcaacatatttaaaatggccatgctgcgccaagcaattcacagtttcaatgctattcctatcaaattatcaatagcgttcttcacagaactagaaaaagaactattttaaaatttatgtggaaccagatcacttcataattggccaaagacacaaaatctcactaacttattaaagagaggcagtcagtattaccttttgtgcatttagttttatcctccctagactgttcttttaggcaaactcatgttctaatatcccactaagtttttgaagggcctctaggggatttgacactttcaatctttgtaacagcacagtcttgctaggtttatcttcattaaaaccaccaaatggcttttttaaagtcacacagttaataaggagtaaagccactgttttgccattctatgtatttagttaacatttactaggtgccaggtattactttataacaccagggaaccactggtgatcaagacagaaaaaaaatcctggtctcatggagctttgactctagtgcattgaaagataatgaagatgtaaacaagtaaatacattaaattttcagagattgagataaaatcaacacagtggtgagattgagacgatgagaaaatagttactttaaatctcttaggagatgctatctgagaaatgacactgtgtctggaattgatgggttcttggtctcactgacttcaagaatgaagccacggaccctcgcggtgagtgttacagctcttaaggtggcgcgtctggagtttcttccttctggtgggttcgtggtctcgctggcttcaggagtgaagctgcagaccttcgtggtgagtgttacagctcataaaagcagtgtggacacaaagagtgcacagtggcaagatttattgcaaagaccaaaagaacaaagcttccacagtgtggaagaggacccgagcgggttgccactgctggctggggcagcctgcttttattctcttatctggccccacccacatcctgctgattggtagagccaagtggtctgttttgacagggcgctgattggtgtgtttacaatccctgagctagacacaaaggttctcctcctccccaccagattagctagatatagagtgtggacacaaaggttctccaagaacccaccagaatagctagatacagagtatcgattggtgcattcacaaaccctgagctagacacagggtgctgattggtgtgtttacaaaccttgagctagatacagagtgccgattggtgtatttacaatccctgagctagacataaaggttctccaaggcctcaccagagtagctagatacagagtgtggattggtgcattcacaaaccctgagccagacacagggtgctgattggtgtgtttataaaccttgagctagtcacagagtgccgattggtgtatttacaatccctgagctagacataaaggttctccacctccccaccagactcaggaacccagccggcttcacccagtggatcccgcaccagggctgcagatggagctgcctgccagtcctgcgccctgcgcccgcactcctctgcccttgggtggttgatgggactgggcgctgtggagcagggggtggcgctcgtcaaggaggcttgggccacacaggagcccacggagggtgtgggaggctcaggcatggcgggctgcaggtcctgagccctgccccacgggaaggcagctaaggcccagcgagaaatcaagcgcagcgccagtgggctggcactgctgggggccctagtacaccctccgcagccgctggcccgggtgctaagcctctcattgcccggggccggcagggctggccggctgctccgagtgccgggcccgccaagcccacgcccacccgaactccacctggcccgcaagcgccgcacgcagccccggttcccgctcgcgcctctccctccacacctccctgcaagctgagggagccggctccggccttggccagcccagaaaggggctcccacagtgcagcggtgggctgaagggcacctcaagtgccgccaaagtgggagcccaggcagaggaggcgcccagagcgagcgagggctgtgaggactgccagcacgctgtcaactctcaacacctgaagtataagtaaaggttgagaaaggagtcaggcttgcaaaattctgggagaagtgaacttcagaaatagggaggaggaagtgaaaatattcttagcaggactgaatcttcagtctcccaattctcaaccccttgctttgtccaaactcaatgccagttcctttctccacctttgtttagagaagatatttgtagataaacttgtgtttatgtaaatccaatctttattgatacttcagttgtgtctccataatgacccattccatttataaatgtcatcatctggcactctatatatccgctatagtgcaagttggaagatggagcactttttcatttctcttccaacattgttttctgcctagcacattaacatatagctcaattaactacagctcggctctaatgaggccagttgtaaattcaattcttgtataagccacttagctttttattttattgtaaccaaaagctctctaactgatccgagtctcattagttccctctaggtcagcaacaatgctagctttctatgctactctatctccccccagttcctccctgtgttcctgttatagggccctccacagagtaaatgcttaattaatcatttcccaatcagtttttttttcatctttttaagttgtttgcaaaatagaactttgatttgttgtaaattgtatgttaatatttatatgatttttttttttttttttttttttttggtaaaaaacttagcctttacaaaacatcaacccaacctttgggtctgtggcgggttcattgctattcccaccctttcatgctcagatccacctgtgcttcaaggaaaattcaaatgcttccctcttctgtgaagctgttcatgattcagcctcctttcccaaaagtcccatcacatgttgctgtctgacatctgacatgtcagagcagaaccgcttctgcaagttctaagcttcttgagtgcaggtttgatctctaaatcctccttaaaacctccaaagaatctacttttctggtgagaaacattagatttggaggtaatcagaaattggtgaaatttttttctacctctttcattaaataagagaaattattcagagtcctttgattatgtgaggttcagctttatctcttgaaaaacaagtgtgataatctccatctcatatgttcattgtaagtacccaatgagaaaatgtatatacagaaaatattgtgtaagattctagttctgctacttaatagccctgagattagaaaagttatttaacctgtcttaacctcaacatctttatctataaaatgtaaaaattgatggttccaaccttttaaactcattttgaaaattaaatgagaaaatgaatataaagtacctgacataattctcagtatatattaatagtttgataaatgcaatttgttgatttggctattgttatggttatatgtcagtcacagtgcctggtacatagtaagaattgaataaatactatttactgagtattgtagctaatactcagatatttattggttattggttgtgtgcttagaccatgtgctagcgactctgcttaacatttgtgatgcaaaaatgcacacaaaagatgtaattcctgccagatgaagtttatggtcactaaaacatacattaaacatataattttatcctgcatataaaatatattcaatgcatggagttgcacaaatgtaagcttttatgggtgaacgagatatactgaagagtagtcagggttctctgtacagattctgagtcagaaatgctatcctactgcatgaaagcatttttcaactctttttaagaaacatgaatttttctatagataataaaccatcaaatcgagaaacccagacagtttttacatttggctcaaaaagcaataaattcaacaaatgtaaaacacatctactgggcaaaactctttcccagaaccaaaacaaagtggaagaaggagcatttctggcagttttccccaattttttttgttgcttctacaaactgcttctgcaagatgtacttcggacaactgaattatgagccttaactttagtattgttcccccaatttatcttctgtgactcaacagaatctgatggggagccaaagtcataatttagttgttctaaacacttattatcaagggaaagaaaagcatcgtgtaaataaaaacttggaaagcacacatgtatgtatatacaaatatatatatgtatatatatatatttcttcagacttttacaaagaggatgctaagactttctggtttggagttttatgccactggagggaaaagaatttaaaaaacaaaagagaaagaattcccatcttctactacctggatcatactttaaatcactcttcaaattatcattctccttcctttctacatcgatgtatttattttaccctcagcagtagaaataattaatcattgctctattggtaatgccaggttgatattttgaccctttcagcaatctctttttatacaatgcatattatttagttgacttccttttgtaattaccactaagaaaaacaatcatactgtacatatgttttgtgcacattaaaataactgacttttaaagcgatagtatcatcacgtcaatccaatgatactaaaaagaaacagtaaatgttcttaatgtaacattagtatatgcatttttctataaaattaagaatatatatattaatagactgcttctgtaataatggtattacttatagaggcattgtgcacattgaatgtgtgtgtgagagagagagaaagggagaaaaggcagaaaaagacacttatgatttcagcaaaaatataatctgctgctagaatcttgttgttatattcttccttttttgcctttgagtagtgtttctagaatgtttatattagactttgtacacacttgttatattctgcatttaaatgtaatattataatataagcttgttctcatgatattcctggaaacataattttcatggctgcttaacaatcccatagaatgtgtgcacatatggtaggatggacagaagttttctgtctccatcccttggaatcactccatcctcactcgtggttggaaagatgtcatgtgagcggaataattaattgaacttacgttgtgtgtggttagcaatgcttttaagggtgaagtaggatgtcttcagtgctccatgatgaagaattcccactgacaccactcaaactaaatgccagtgaaataagatgggatttcccagtggacgtacgaagtagagggacaaagctggaccccaaatgaagattcagaaaaggaggaaaaagaggaaatgggatctaggccaagggtcttctgagaatctagtagaagaagatgtctgaagtacaggtgactagggagagtggaggaaaatctgtgccatccaacagactctggtatatttgcaaccataaccataactatctaagttagagtctattgaaggttaactgagcttaaatgtccttttaataactgcaaaatatgagtgtggacacgaaaactttgatttaaacaacaggttcttgatagagcattctgtgtttgaatgtttatggactctaatagtcctgaaatcttgaagtattcttgatgtctgcagtaggatgggatgggggagagaaaaccaaaaatctgactgaacatagccacagattgtcactttattatctcaactcaacttatattttgtttctgctgcctattatttacttatataattatttccatttctgcctcccccataagcctgataccaaagtgtccagcacttaaacattgtgtgtgtacaggcaaatctcatttttttgtgatttgtattattgtgcttcacagatatttcattttttataaattgaagatttggggcaaccctgcaatgagcaagtgtatcagcaccactttctccaatagtgtgttctcacttcacatttctgtcatgttctggtaatgcttgcaatatttcaaatgttttcattattattatattgaaattacatattacatatattcatatatattatattattgttgtggtaatctgtgatcagtgatcattgatgtcacttattatcattgttttggggtgccacaaactgtgcccatataagaccgcacatttaattaatgtgttgtgtgtgttcggactgctctactgaccatccattcccccatctctctcccttgcctcaggcctccctattccctgaaacataacaatattaaaattaggctcattaataatcttaaatggcttctaagcattcaagtcaaaggaaggattgcatgtttctcattttaaatcaaacgctagaaatgattaagcttagtgaggaatgcatgtcaaagccaagatagtgaaaaatctaggcctttcgcatcaattagccaagttgtgaatgcaaaagaaaagctcttcaaggaaattaactgtgctactcctgtgaacatacaaataaaagcagaacagaaagtattgctgatgtggagaaagtttttgtggtctagatagaagatcaaaccaaccacatgtccttaagccaaagcctaatccagatcaatgctctaacttctttcagttctatgaaggttgacagaagttgataaaactgcagaagaaaagtttgaagctagcagagtttagttcaccaggtttaaggaaagaagccatctttataacataacagtgcaaggtgaagcagcaagtgctattgtggaagctaaagcaagtcatttagaagatctagctgagataattgatgaaggtggctacactaaacaacagattttcagtgtagacaaaacagccttatcttgaaagcagatggcatctaagacattcatggctagaaaggcgaagtcaatgcctggcttcaaaatttcaaaggacaggctgactctcttgttaagggcaaatgcagctgttgacttcaagttgaaaccaatgcctatttaccattccaaagatcctaaggcaacaaaaattatgttaaatctactctgtctgtgctctaaaatgaaaaaaaaaaccaaaggctggatgacagtacatttgtgtacagaatggtttactaaacttatttatttatttatttatttattttgagacagagtcacactctattgcccaggctggaatgcagcagcctgatctcggctcacttcaatctccacctgctgggttcaaacgattctcctattttagcctcctgagtagccaggactacaagtgcacaccaccacgcccggctaatttttgtatttttagtagagatgggctttcgccatgttggacaggctggtctcgaactcctgacctcaggtgatctacccgcctcggcctcccaaagtgctgagattataggagtgagccatcacacctgaccctactgaacgttttaaacccactactgagagctacagctcagaaaataaataaataaataaaagtaaataaataaataaataaaagtctttcaaagtattactgctcattgacaatgcacgtagtcacccaagagctctaatggagatttacaaggaaatgagcgttgcttttatgcttactgacataacatcaatactataggccacggatcaagaagtaattttgagtttcaagctgtattatttaagaaatacactttataaggctatagctgcgtaggtagtgattcccctgatggatgtaagcaagagaaattgaacactttatgaaaaaaactcatcattctagatggcattaagaacatttatgattcatgagaggaagtcaccatatcaattaatagaagtttgcaagaagttgattttaaccctcctggatgagtttgagggattcaagactttagtagaggaagcaaatgcagatgtggtggaaatatcaggagaactaaaatgagaagcggtacctaaagatgtgacagaattgctgcaatcttatgatacaattataataaagagtcacttctagcggatgagcaaagaaagtgggttcttgagatagaatctacttttggcaaagatgctgtgatcattactaaaatgacaacaaaggatttagaatagtacacacgcttagttaataaaacagtaagaggttctgagagaattgacttcaattttgaaagttttattgtacgtaaagtactatcaagaagcactacatgccatggacaaatttttcataaaaggaagagtcaattgatgtattgtcttcactgttatcttattttaggaaattatagccgggtgcagtggatcacgcctgtaatcccagcactttgggaggctgaggggagcagatcacttaaggtcaggagtttgagacaagcctggccaacttggtgaatccccgtctctactaaaaatacaaagctgggcatggtggtgggcacctgtaatcccagctactcaggaggtgaggcaggagaattgcctgagcctgggagacagaggttgccgtgagccgaaattgcaccactgcactctagcctgggcgacagagtaacgctttgtcttcctccacaccacccccctccaccgaagaaaaaaaaaaaagaaaagaaattgccacagccagcctggccttcagcgaccaccaccctgatgagtcagcagccatcaacgtcaaggcaagaccctcaaccagcaaaaagattacagttcgctgaagactcagataattgttagcacttttcagttttacagtattttaaaatttaagtatgtatgttggcttcttagacataatactactgcacactttgagtacagtatagtgtaaatataacttttttatgcactgggaaaccaaaatatgcatgtgccttgttttcctgagatagtcacttcactctggtggtttggaacggagactgcaatatctttgaggtatgtctgcatatatatgtacatatatatagatatatatatatgatgtatgacatgtcgatttaattatatcattgaaacttttcccatacattgatggaacaatcaaatactggtcagagaaatagtatgaatttaaaacaaacaaaatatacccatttaaaaaaaaaaggtttgtgccatggttaaatccctgatgtactgaaaatgtcgattgaaacatccagtgcccaagaaatgtggggaaatgaataacttactcaccatttggtccaaagttttctcagcaatcagtgcaagaaaattaaaaggttgagaggtgcagatggggtttgttctttaaagggaagtgctgatctaagggaagagccccttggaaattaattagagcccagctggaagtcaaaaatatagaacataaatggtcctgtgctcccccaacccatgccatgcagataaagccagaacgcattttctgatactcccatcctgaattaatcattcgttccaccacgcatgcatggtaattcacgtcaaacaccatttggagtgcatattgcactgacttcttttaaacttagttgtatgctcgcctgtctttcctcctgaattataagccttttcaggaggttagcaaacctctcatgtagagcataatatcaaaaatgttctgtatttaattgacaagaagcacttaagattaaaatgtgatttcttcaaacatgagtttattcatatgtgagaaaaatatatagaatatttaagctcatttaatattattgctgatattaccagctttttgtgaaaagggaaagcatatgtgctgacatttgtatatgagtgagaaaataactgggaggaacagatagatcaacaggaaaagacagagagctggctcaatatgtcttaaagatttcttttttaagatagtctttaacttgacattaaaataattatattgagtgatttcccagatatattaactaatttaatttaaccaagcactaaagtttatatgtttaaaaataggtgtgatttaagataacagatataagaataaaaatatgatagaaagtatacaaaataaactattcaaatcagaaccaactaaaacatttttttctaaaaccaacctgtcacacaatttcagatttaagatttttgtattgggttctatttggctcatttgaggataagcaaaaatattatcacttccaaaaacaaactgcgtctggcatggtggctcacgcctgtaatcccagtgcatttggtggctgaggagggaggatcacatgaggtcaggagtttgagaccagcctatgcaatatagtgagactccatctctacaataaataaaaaaaattagccaggtgcagtagtcctagttacttgggaagctgaggcaggagtgttgtttgagccctcgagttcaaggctgcagtgaactatgatcatgccagtataactcctgtctgggcaataacaaagcaagaccttgtccctaaaaaattaacatcaaacaatcacaatctgaaaacactgacctacaagtccctttcttctctaaaaatcagtatatcaatgatattttaagtttggcccagaaataagcatttaataaatatctactacatgctgaacatcaagccatatttttaagttgctattttatctttatgaaagcaatgtaagataagtaatatcatcccaactgtgtgtagaattcaattagagtatcaatgatatactaattgttagagaaggaagagacttgtaattaccatttggtcaatttaacttcagtaactatcactaatctatgaagcctgatagtgttaatgcaattcctttcaatacgctaaatttgaaaaaaaaatgatgtttgaaactaacattttgcatcatgtcatagcttacaaagcagttttacatatttcacatagtaagaataactaaactttgataggagaggtttttttttttttgagacggagtctcgctctgtcgcccaggctggagtgcagtggcgcgatctgcaacctccgcctcccgggttcatgccattctcctgcctcagcctcccgagtagctgggactacgggcgcccgccaccacgcccggctaattttttgtatttttagcagagacggggtttcactgtgttagccaggatggtctcgacctcctgacctcgtgatctgcccgcctcggcctcccaaagtgctgggattacaggcatgagccactgcgcccggcctacaagagcagatttgaaatgttctcaccacctcacacaacacaacacacacacaaaacgataactatgggtggtgatggatttgtgaatttgactgtgataatcaatacatcatgtgtatgtataccaaatcatcacattgtacaactatatacaatttgtcaattattttaaaataaaaataaaaacaacaacaaaaataatacagacattatgtattgaacactgtcgggtataaaactaatttgtggtagattatttcatttaatcttacataaataccgtaaagttggtatttctattattatctcaatttaaccaatggggaaaatgtatcttagagtgttattttgccaaaggttacacagtggtcttagtaggatttgaacaagggcagtctaattctataacccatggtcttcaatactacggcaaactatctcttttaaaataatggtttgagaaatgtttggtccagaaataaatatttcataagtatatactacctgatgaacattgagccatatttttaagttggtattttatcttcattaaaacgatgtaagataagtaatcttatgcccattttacgtaggataaagctaaaactcagatctaggataactcataggtaaaaactggcatatcctgtcttttgactttggatttcagagtttttccactagggcttagagttgaacacaaatgggtttcagaaacaggaaaagaagcctcaagggtccagatacggaggactcttccaactggacaagtcttagggaacttgaatctggaaaacctacggttattatgggagcacttcaatccaagaagaaaatgattcaaatttgttatctctgtagtcaaatcttagcaactgcacaataaataggctggaaataataaggaatttttttgtttgttttttaaagtgggcaatgcacaatcatatagtcaattacataaatccattgagtgaaggacatacacatatatcaaaaattaagggaatagaaagttggttagtgatgcagagactctcaaggatttgttaccaggtttgactttgtacctatagagaggttaatttttaggcaatgagtcaggaatattttagaggcatgacagtcatcaacatccaatcttgttttcatttggtttcaattgttctctatttacactttcactttattctaatggcttgagccccacttttttggtgtgatctagcatcctggaatttgattttaggtggcctgtaagagtttttctgggcatattatctttggttcttctattcctgactgcattggttaatgtagtagacataaatggaattcagcaaatttttctagctctcaataatctaggcaaattgtggattgagcttttccaccccctttgaagttaggtgggaacatatgtgattaattttatgtcaacttgcagagtgtttctggatgagattaacccttaattggtgaattttgagtgagcggattgtcctttataatgtaggtgggccttgtctaatcagttgaaagcctgattagaacaaaaagactggcctccccaagcaacagggaattctccagcagattaccttcagactgcatctgcaccacggtctttcctggatctctgcctgccagcctgtggatgggaactacactattgactttcctgggtctcaggcctgctgactctcactacagatgtagacttgtcactttctataattgcatgaactgattccttacaataaacctctttctatatagatacacatcctattggttctatttgttagaagaatgcatcacgtgacttcttttttgacaaatgcagcatgtgacttgcttttgtcacagaaatgagcattggagtgatacatcactctcagtgaaatttttaagaagcaggtcacaattcacctggttccctttgtgccacagtggaatgtagaagcacgtgttaaaaataaaatgtctttcagtctggaatccaaaatggtcacaaggaatacaatgcttatttttatctgcaaaaattttactggactaataactgagagcagggtttgcttgttactttgcctaaacctagc

SEQ ID NO: 486 - DNA, 20001 bp, Homo sapiens
tggacacaggacaagaactcaagacgtgctgaatggggggattgaaagaactgtaacacaaacagggctgaaacatgcccactgcttgccatgtttcaggcaatgagaaggagagaagatctgtagccttttggacaccccagacctaggggctccccaagccagggctgtgactactctcttggggctctgagttcctggcatctccaagcttcagggtgccaccttgttccccttgtccagacataggtgcctgctgtggaagctgccgtgcagtacatctggtccagctgcagcctcacatggagccggcacctgtgtcagcacctggagctgcctgccctgccacagcagctggcatgcctggctgtatgcagtggctggaccctgcacttgctcggccacacaccactcatctctttgtgcctggcccacccttggtggatgtcggatccaggctggtagcatgagccaagtgcagcctgccagtctgagtgggcaaaatgagctcaacaggtgcaagcaatactcaggcagaaagcaccagtggacacagaggtttccagctgatgaagtgacacaccaaagatcctgtgacatttattactaaataaatagtattgcatagtttcttcatgtgattgtgtggttatgaatctgtcagggaaaaatacatggcacagtctgtgttattgatcttttatagaccctggtacacatcactaatcaatgatagcactctggacagccactaccaatcaatcagaatgtgtacttacataaaaaactaattatattcatgtagttatttttacatatattccacatatttctttatctacatctgtctatctcaaacaaatagggaaaatactaacattcattcttctcatattcatttaaatgtgtccttttcatagaggtttttttcggtgaagctataaagtcccactcaccaggaattatcaaatatgttaccatcacctattcacatgtcatttatcacaatttgaaattacgatttgaattatcgtgattatgtttatttccttgctttatttttttgatatctcaaatgaaaatataagctctaagaaagtcagaagttatctacctggaacttttctatattcccaatatagacaaaagtgcttactaactagtggccactcaataaatgtttgttcaatgtaagcagtaaagtttataagaaaaggcccaagagcaagaacaaaaatgagaggtgtctgatttctatacattagctctttttatctggagaaaactctgtccaaaataaatataatgtgaactacatatgcacgttttaaatttctagcagacccatcaaaaaattgaaaagaagcaggtaaaagtgattttaagagtatatctaatctaatacaatatattcaaagtagtatcatttcattatggtattgataataaaataataagatattttcttttttttttgtgctaagttactgaaatctggtgtgtattttatactcacagctcatttcaatatgaacgaggcacatttcaaatgctttgtagccatagatggctagtggctgctgcactggacattgtggatagagaatatagtttgtgtgggagtttcacgaaaaataagcccaactggtagggctataattcggtaatcatggcaaggtgagatctgtggaacaaattaacaaaaggaagatgattagcattgtgttcaaggaaaagtaacataacgtatgttgaagttagaagatggcaagaaaaatttggaatttgattgtcatgaaacaagtaagaaatagatacttgaatttaagcagtgacatagactgggaaaggtggggtagataaatcagattcagtaaatattctgaagtagacatttattcaatgcaacttcacaaaaaccatcctattttacaccaataaatatttccaggtttcatttagagtgatttgctgtgataataacagttaagaattatgaatcttttcactcataaaagaagtctttttacacctttacattacactcagctgacagcaaacctgtcaaaaagcaaattgatggatgaaagatgaacataacatttaaaaacactgaacctctttatataaaacttagttggagacttaaagtagaagtgtcttttgaggctacatctttgtgttcaacaaaagacagaagaggctttgtttaagggtatagtgccccatcatttctgctcacacaaaggcaacaatccttaaagcccaactcaggccttgcttcatccatgaatacataagatttttgtgggcctataatgtagcagacatagtgttagttcccataagtgaaatatctcacttgacatatgatctcatggagatcccaaccactctccagctcattgcattctccaaaggatttcggggtgtttactgtcttctttcaatctattcttttttgctaaaacaaaatacattagtccatgtttgccaaaggattaaaagataccagtgtacatgtaaaatacttaatatatactatcttattctttgttgttgttgtttgtttgtttcatttgagacagggtcttgctctgtcacccagactggagtgcactggtacaatcttggctcactgcagcctctatctcttgggttcaagtgattcttgtgcttcagcctcctgagtagctgagactacaggcattcaccaccatgcccaattaatttttgtatttttagtagagatgggatttcaccatgttggccaggatggtcttgaactcctgacctcaagtgatcttcctgccttggcctcccaaagtgctgagattacaggcatgatctactgtgcctggctgtttaacaactgtataatgtaagcactattattattcaaattttccaaagaggaaactgaggcttagagatgttaagaagcttttcaaagtcagaaataaagtggagaatagataggaacaccattgatctaaaaattttaaacaatcatatcaaatatcatttatctcaaaaacatttattctcttaataacctaacctaagggcaacagcaatgagagttgcaaaaaggagactgtccatatgttagatgctactgaaaaattaaataaaatgagaattgagatcatttgtttcagttgcatttctgggagaggtcaactttggtaacttctgaagcaatatttcagatgaggaatggggaagagaatggacagtcattgttgtggagattgtgattgagtaaggagtcctgtagtaatgcatcctccatgggaaatcctaaaacctcttcctctacctcctttcagttccgtaatttgacttccctgggaagtcgctgaaggagatgtgagtaatgtaattgttataattactatccaatttgaccctgatctactagacagttgtagaccctcagagtgaatagtgactttataagtatgtaattcagcatcctatcataaacctttaattttctctggtatcttgggacaaagcatacagtttcatgacgtgagtttgttagttcctttaatttattttaattgttaaatgaatgcaaaaatatttcttaaaatgaaggcaatataactgttagggctgctctgaaattagagtagacatgatatatatttataaagagagttatatgttttatttttcatataatatgcagtgacttgccaatatggtgcattatttttttttcttcttctccctaaggagtcctaataatggtctatgtactcataaaacaactctttggttttcagacatcatggttattaactctcagacttgctaaaaatagtttgaagttcttacaagaaagagctacttaaaaacttctctccactgatatgtttcttctgtgaaaaagagagactctcaaatcttacagcaccactgaagtgttaaaagtataatttctcatgtccttaattcacccccaactcaaagtgtgttttctctctcaaaccattcagaataatttctgttaccaattcagcagatgctctcaatttcagattcatttcttccatctaattgtttctctttttgtttaacagctttattgatgtataattgatatataaagaatgaaacatatttaatgtgtacaatttgatgagtttggacataggcaaacacccatgatgccattaccacaatcaaggcaatagacatacttcccaaagttttctcatgtttttgtgtatgtggggtgtgtgtgtgtgtgtgtttgtgtgtgtgtgtgtatgtgtagttggagtacctaacatgagacttgcccttttaatcatttcttattggccatttgctttcagtttgtccgtgtattgagtggtaattgagcaggcccattcttaataagttggagccatcatctccctcactgaaggtactgggcttcaattaaaacaaagaaaatgcagtgcagtatgtaagggacagtcaaaaaatgtgttgtccaggctaacgagcaatttttattactgaggttgcaatggtctgaattcatgttgaaatcctaaccccgagataattgtattaggaaatagaacctttaggaggtgaataggtcctgagagcaaagccctcatgaatgagattagtgcccttataaaagggaccctagagagttctcttcccacttccacaatgtgaagacacagtgaaaatatatgcatctatgaaccaggagagacactatcatcagacacagaactggctggtgccttgatgcttgactccccagttcccagagctatgagaaataaattttccttgtttataagacactactgtatttttttattataataacttgaacaaactactatagaaacttggcactgagaagtggggatgctgccatgataaatacctaaaaggtggaagcagctttacaaccagggaatgggcagagactggaaaagttttgaggtgcatgctggaaaaagcctacactgccataaatggacctgtaagagtgtttttggtgacagaccagaaagaaaagaggataactgaagacagagcctcagtcttcttagagaatatctaaataatcctgaacagaatgttgatagaaatatggatggctaaagccaatcggatgaggtctcagacagaaataaagaacatgttattggacaatggaagaaacacaattcttgttataaactggcaaaaatatggctgaattgtgcttgtcttctggtgtttaatggaaggtagaacttttaagctgcaaaactggatatttgattgagtcagtttctaagcaagggttgaaggagtggcctggttttacttgactgctcctcataaaatctgagaagagagaaatgacttaaagacagaatcattaactaaaagaggccaggcatggtggcttacacctgtacgaatcccagctctctgggaggctgaggcaagtggatcacctgaggtcaggagttcaagaacagcctggccaacatggtgaaacccaatctctactaaaaaatacaaaaagtagctgggtgaggtggcaaacacctgtaataccagctactcagggggctgaggatggagaattgcttgaactcgggaggtggagattacagtgagctgagatcatgccgctgtgctccagcctgggcgagtggcagaacataaagattaaaaggaggcagaatgtaaagattttgaacattcttgtctatccatgttggaaagaataagagagcctcttaaccttctctattcaggagagaaccagaaggatgtggccaaataaccatgtgttaaggagatcagtcagccatccgaacagaggccaggagctgttgtacaagacaatgaaagaatgaccccaaaggtaattaaaaataatccaagactgcccttcttatcccgagtcccagtgagcaaggggccactgcagagggcctccattagggcaaagtgcagaggagcctccattagggcaaagtgcagaggctgtatgaatgaccctagaacagtagagccacacacatgggagtccagccattgaaaagagctggttcaaaacccaggcacaaagctgtagttggtgtgggaccacccaaagaggcttctcagagacttgggggcccaacctggcaatacagggggtataggacaattactccaatgtgcgtaaggtgagacctctgccctagtgggcatggaacatacagagccatagaagattattctcaagacttaggatctaatgtaatttgacctgttgactttccagcttccttgggatctgttactcctttcttcttccctatttctgttattttgtaatgcgtgtgtctattctgtgcttttcccaccattgtagttcagaagtgcatagtacatttgatttcacaggtggacagctgaaaagcagtttgcctcaggatgaatcatactttgagtcttgcccatatctgatttagataatgttcacaggagacctcagacttttgagatgatgctaggatgaattaagactttggtattattggattgcaatgcatgcatttgcagttaagaaggatgtgaattttggaggaccacaggaagaatttgcaaccccccttacaaatctatatgttcaaattctaacctcaaggtaataatatgaagaggtggtgccattaggaggcgagtagaccataaaagtaaagcccatatgaatgatttcagtgcccttatgaaagaggctggagagaactcccttccctctttcaccatgtgagaatatagtagaaagacagccatccattaacaggaagtgggccctcaccagacacagattctgctggtgccttaatcttggacttcccagcctccagaactgtgagaaataaatttcttttttttataagtcaccccacccagtttgtggtgttttgttatagcaacctacatggactaagacagagacatacagaccctttgagtaagagcctgccctctgaatgacgttagatgttgatatttatgccaaatctggatatatcaatgaacttatgtaaatgatggagtatcatctttatatcaagcagaatataattaattatctactcatatatctaagtctttgatattagttacgttattattcaggaccttcctcatatcactacccagaccctggagggctttatattgctgccccatcattaactggtttactaaatgtctcccagctctagttacttcatgtgcagaaaatactaactatgatacccctttcttgaacttattgtgagattcaaaagaaatccacatataacctcttaggactgcaatttggcatatcatcctaaatattatctgctatcattttcatagctttctgaattagataaaaatatatgagatgcaaaggtatagaagatatatcatggcatacaatttaagggatatagtataagaaagaatagtcatcctgaatgtagcagatcctgtttatgccaattccatgtcacttaaattatgcattctaacttttttcttcatgtctaaataaaattgacatttagaaaagccacagtgacttgacacattgacttagaacaactctaaataaattctgttattggcagaggcattttgaccattagcaatagtttggccatataaaaaagacctatttttatgagtaaggatttatttatatgaagccatgatagggatcaaatagaagctaatatgtgaagcaaagtcaggaaaattagcaaatgtagatatcactcctcatattctcccatagccaaagctaataagtgtgtatttatataaattgatcagagctattattacatgctagatggttatcttatatgaattgtgatacttatgtaattcaaaaaccctaatcatagttattagcaaaacagttgcataaaaatcaattagcctttgcactgtaagacattacaaactagcgcattatttctgcctcacaatacatttatttcccaagcctatataaaatattttcagtatacaatggaagaaacaatattccttcgggaaagttctggagttgtctctgtgaactttccaaggtcaggattatgagatagcaaattcttgattctctgaatcattactcgtgtgttttcctaacttgaacttacacagatttatgctcattttaccattaaaatgaaaaaagacaagactatatgtattgtgatttataggacttgcattcttacccaggatgaatacatatccttatatttgaaatctgaaaaattagcaatacttcttaaagtatggtaaaaagtacaaaagattatttttcaaagttatatttgggttgcttttctctagcacagggaaatatttcaatccaacttctgaagactccttatattttctctgtgttttaaagtttttgtaaaatatctttatcaattctgcaatgaaactgttgagatttagaacctctctgtctgtccttctccccctgcgctttctctctctctctatctctcatagacaatgactattctttcccggggcaatttctatttggcaataaactcagagacatttccaaagtcaagaagaatgaggggaactggggattacaaagttataaaatgcaagttgtcttgttaaagcataaaatgattgcaggaaatgtcactccaggggaacagtgtcttgccactgatttttgctaatggaaacatttgatcgactccaaggagaacgttgcttcatgattactagggcagtgccattattcaaaatctcagtctgattttagcactaaggatgcagttttaatgcccaatgatactgagttcttttcagcaataagtgactcttaaaaggttcaggaatattggttagaagaagtcctacccttaaagtttagatggcaggatatgaatcttaaattttttgtgaacttgaaacaatgatttaacttttctgggcttatcaggattgtggagttctctcctattgatccacctagattttctagttgccatctgtccaacaattattcattgttggtttattgattaattgattcagcaaatatttgtgtagtgctttccattatataaatgaatgcacagcagctgtaccaaagttttactactgactttgagctttagtttaattgatggatcatgaaattagcttcaacatgctgtcaagtaacttgatttaaccctaaagtaggtactctagagctcaagtagaaagacatcttgttctttgccaagattatagacttacagttcattagaatagtgagcctccttctaatagtttatagatttttttcctttttaaaagtatattttatgttaacaattctatggtatttgttagcactttaataaaaactgtgtcccatttttgatggaaagcatcttaccttatttatttggcatactggtattcattaatttcccaacatttcctctaatttaccaggtaaaaagtgctgtgcaaagtgctcaggagcagcatgatatatccgacatgatctctcattttctttttttttaagcaagtacttagcacctactatgttttattctggcccttgagagtcacaggctacctgagataaagtctatatatttagaatctaacagtattaaaagaggagctaatatgttaaggccaagtaccattaatacaaggaagaatatccatttataacaggggagcacaaggagtaaaggaaattctttcaaaattaaagaaaaacatttattataaaattatttatgtatttatttgacatccctcacacatttcagtcaaatgtaaccagtctaaataattgaacatttatgcaacaaaaaacagactattctatgtttctaaatatggacctgtcctgcaatagcctaataataatatattctaaactaaataacagtatccagtgtcaatttataaatcaaataaatgagcatatttactgtcagtttagaaaaatatatatatagctttgttgctcatttgccacaggaaaaccaccacagaattattctatatttttaaattatattttatttgggttataataaactacatagtgacttaaaggaatggaacagaggatgtctttgtttgtttgttttcatatgctggacattaaagaaatttccaaacatagccccagtgcatcccagatgtatttgcagatttcaggctcttattcatttattttaaaatgttgctttgaaatcatcgctaacattttttgaacgctcatcctatccagagctccctttaagtgtttcctaggttccatctcatttaatcctgacaatcattgcatgaggcttttttttttcagatgagaaatctgagttaaaggttgagcaacctccataaaccagagttttgctgaatttcacagtctgagacatttcttccctggcagatgagtcacaagataataagttgtggaggaattacaagtctaagtttttaaccaactgaagctgttgtacatgtgaaaattgaaccaactactttgtagccagatcagcatatttcacagtcacctcttttttgctttctctgcagaattccacacatggttctgcttaatgttaagctacgcatggagacctggtttaattgtaacagaagtggcactttttccccattactgctactgcaggaagaagtgactttatgttaactgaaatgcacaacttatgtagtgtattatacctgaatgttacaaagttcttaagaaattgacagtttaagtcctgttatttgacttatactggaatagtgtaggaggtggattgtactaaaattgagcaagtgaaaaaatgagattaaaaaaaaatgccccaaacaggcaatttctctttaattgaactatatcatgtaatattgtttatttcattgcattattttaattaaaatcaaaagtgctgttactaccacatgtagtccgtttaggtaagtttttgtaatatagttagcatgtcatcatatttaatatttcttagaaatatgcttggtagaaaaatggccacatggaaatcattttatttttctttgttcaaatttgctgtcacataattttacatcagcagttaatactgttctaagcttgggagaaggcattaaaaccattatttggaatcttatttgaggatctgggtactaaaaacacatttgggtaggtgtaatctatttaagaaaacacagatcacgtattcctctgaagctactttttttaaaatgttgaaaatattaagaagttggagatgataactaagaatattgcttgcatgcgaataaccttggcattataaagtgaaactaagtggatccaaataatttagtgaatatttggacctcctatactaattttctactttaaaaatgtccatattgaaattattcaaagctgaaaagaggacagttgcttgagctgagaagagttatctacctatctaactagatgcacatgtaacttcatatgtggaaaatttataactaaaagtatataggcagttttatcatctttatcattctattattatacattgctagttgagacattaaagatgtttgataatcatattcctcagttttcttcttcttcttcttcttcttcttcttcttcttcttcttcttcttgtttttcttcttcttcttcctcctcttttttttttggtgggggttgaggtggagatagggtctccctctgtcacccaggctggagtgcagtggcacaatcatggatcactgcagcctggaactcccaggctcaaatgatcctgcatcagcctcctgaggagctggaactacaggcaactgtcaccacactcagctcattttttttttctgttatttgtacagatgtgacttccatgtgttgcccaagctggactcaaactcctgggctcaagtgatcctccccgctcggcctcccagagtgctgggattacaggcatgagccattatgcccagctatattcttcagtttttaccagggaaaaggttatgttgtttcaaaaaacagaatcatccatagaataaataggaagcaaagtaatttagtcagatactaaactaaattcccctaatcaaaggtgagaccctctgtccctaactccctggatttaggggaggaaaaaaaggattgtaaactttgagtagataccaagaccaagaacatgggagtatatattatatcgctgaatcctgtatgctggaggatgctgcctcctcttggagacttcttcccacgtagaaccatatattcgacttgtcttctcctacatcgttccagtctctgagatctttgcctgagaactaacctcacttaatttatgcagtcttatcattttatcttccatgttcagttttggctttttgttagctctggctaccactgatttgattggcagatgagaatgtactgattatctgcagagatgattgctttacgaatccagtagatgaagaagatttatattgatgattgattattggcaatggtcatttggttttggaagccaattgagctaaaggttttttatttccctcttgtaatgtgtgtatatcaatgtataaacacatagatgcagcattccaactaacataatctgtgataaatatgtccttccagttttcaggaaatatttttgagagtgggacatggatataataggatgagttaaccatgctcagtagttctcagcacgctcttgtcagtagcctgtgcgaggcttcctctcctgctttactgatttccttttctcctcctttttcacacacatccttctcatcctctcatgaacaatgtttctaaaatgttgatgtatatatttttcttgttatgtataatttctacactttttgtgtacatgaattttttattcacctaagttgtattatacaatagatcttacttgatttttaaaatttttcttgtactatggctttaagatctattcatgttatgatgggaacctgtagtatatttctcccagcaaattttttaatgataaccatccaagtagttactaatcctgttgtgcatcaaaatatcttatggaaatttttgcttatttgtttttgttttgttgtaagacatatatactagatgccactcccagaaaactctcatttggagatctagagtaccagcaagttttaaacctttgtaatattggggttcagtcaagattgagaatcaaaagtaggttccagctctacacaattccttatatttcaattcataccctttatgttgtaaatcccaacaattcaattaaacctgttgcttgaagagtatcagtgtccaattaatgctaatgttttaaaataataggttcgctggaaccttctgcaggatctgatattaatttgtgactcctcccacttaaaaggttatcttagtttgcctcttcgcttttcccagtgtctgaaatatagagttgggtacaagcagtgatttttggtgtcgtcgtcttttgtttttaaaattttgtcttaggctggccgggcgtggttgctcacacctgctatcccagcattttgggaggccaaggcgggcagataacttgaggtcagtatttcacggccagcctggccaacaaggtgaaactccgtctctactaaaaatacaaaaattagctgggtgtagtggcaggcgcctgtaatcccagctacttgggagacttaggaagctactcgggaggctgaggttacagtgagccaagatcgcaccactgcactccagcctgggagacagagggagactctgtctcaaaaacaaaaacaaaaacaaaactaaagaaatagagtgaagaaacagaaggtgatcaatggaagcaagaaagccagttaagtttacattattgacatatataccatcatggacaactgtgactcaatcctgtttctgacctatggaaccatggaaactgttccacaaaaatgttctagcaaatgatcagaatgtgggcatttatccaataagttctgcagctctttgtttgaggatttaccctctaccccaccccaggtgttaagtgagctccccttcccctgtactgtcaggctgtgcctatgcgaccagatgagcagtcactcgacattggagaaagcctaaaagctgccacagggtcccttgagatgggattctggaagtttgcaaaatgctgttccccagtgctacgctgaaactagcggggccaagggaatgtattgtggacctcaagtagtgtctgcttccaatgactttctcttactatcgtattcttctttgttcttttttttcttcctgcctgaaaataaaaatatgttcacataccgtgtaaaaatctaacactaggcaagacaagatcctttcccattcataactgcttgatttaatgggaaaggcagatcattcaatccaaaatggtggtggaagagatatgcaaatggaacaactgagactgtttttgcaaaatcaccttaggaaagtcagagaaggcgaagtgggaagggctaatccctgagatgcatcttaaataatgtttacaagaaagcccatgacagaaaacaacctgtttcattatcatgcactccgattatttcccttccatgtgcttgcagaaataaattattctgttcttggccttctctctttacacatattctcattgtcattatgtataatttaccttctttatttgagcgattatttgattaatgttgggctccacaattgaccagaggccattagaacagaaatatctgtttccatttatcttccttgaatcccaagtcctaacatagtgcctgacatacagataaataaacaaacagatgaaatgatagagtcccagtattgatatttaagagtccaatgctttagcaatccctttaatataaacttaatgtatgactttaggaaggtcatttttctttcatgggcctcagtcttcacagttgattattgcatttagagtcctaaaatggaccttctagttgagtctttaatgactcaaaataccatgaagataactttggcattttgtttttcaataaatcagtaatagccattctttgttgaggcctttgccttggaaaagaatcaaccatctttacatagccatatagcatttacttcctcagactgtggctcacatctacacaggtccaaacccttacctctcttaaccctttacatacagtgcacttttatataatcttatgctagaaagagaagtgtttattatttgaatatcaaacaacatagacatgagcatgcttccatttggaaaatcttcttggttctattgtctgaaatatccaccaagtagatctgtaaccagggaatatttaaagccactgtatattttgttctttatttttaaaaagagtgtttttttaaataaagcatgtggaattgctatgttaatataaatcaggtaatgacagagttgatttgtagtgttgggtcagccctcattatctggaagatccatgaagtctcagatgtgtcactaagtcatacagtctttggagagttggggcaaaaacagagatctggtaaattcactgtgaaacatggttgccatagacaatcatggcctgtttctaaaagcagaataaatcctcattggtagaaagtcacaagatgatggcccaaatagtcttatttcatgcatccaggcctcttgttaccctcttgtgtacccaattacaaagtcaggagagaggtaagacattcacaatggatgtgcctcctcatatatagaaggatacacacgaccctactgggtatgcatccacaactgcagagaagagaatacactctgagaaaaactatctagtgagctacacatttccttcaaactttctgagttgtcagcagaacacaatgtcccgtgccaaaaattatgtcagcctttccccccagaaatcactccataaaaatttaagtctgtgccatttcaaattcatctgagaaaaggagagataaagtatccttaaatcaaagagatttatgtattccaataaagctgcaagattttgttttgatagcaataatgcaaaagcccacaaattaaatgctcttgaggaatgattatggctacaggagttattttgtttttatcaggattgaatagctgtgtaacttgtctcttatagttgtacagattgcagttgtattgataagtggtttatgagaaatggtgttgaatgaggaggaaagtacaatttacttttaatttgatttcatttggtaaacctgacttcacagcttgtgttgtgcttatttattattcaccatccatgatacaaagtaacctgccaccagggacatcaattatgaccccccacctccccactcaatgaagattgctgtcatcagaaggaatgccacgctctctgcccatgtgtcagtgatgagtcaatgtaaaatttcctctgacctcgaagggagtttctgcttcttctctctccctattgccagagggtcctttactttacttggcattcactaaagagccacagaggcagaatagactgatcaagcaatccagaggccagtcaagataaattagatgcttaatttatatgccaggctttgcagacagactaattacacaaagacagtttgataaagtaatataagactctgcacatattagccagagcctgcttccgtgaaattattgctgatatatgtgctatgggctttgagatttcatatgcgcaattgttcagcgggcactatgaaacacattctataaaggtattaagactgggtgctatctgccaatcttttctaattttatgctgccactaagagactattcttccttggctttgtgattttatagcactcattgagatgaatgtgaaacagttaaacaggaaatctgaagatacgatggccaagaaagacactggaaatgaagcacagacaattttcatggaccaagccactaaaatattggtgaaaatgggccttttgaagaatcacgctggatctaaagctcttgccttatctcttgagaattcagtctgagtgaccagagacacagaatacaagataggagctgaaacacaccgatagaacaagagaaacctttggctgctaatgttatattgcaagatcacaggatcaaggacagactttatattccagaactttgtgtttgtggacagtggctaataggggcagccaatagctcatgttcttggaatagctttaaacactgtaattgaaatgtaagcttcacctaattgcgtaagagaggccaagaattgactgcatttagtataaatactaatggaaagaaaaggatattttaaagtgaagggtatgagagatgagataattgggagaagaaaagagttttaggtaattgaatgagaagtttgaggatattagtagagccagaagagaaacagctctcacaattacaagaaggtaaaattttttaaaagttcccagatatgagaagatagcatcagaatcacacacacacacgtgcgcacacacacacacacaaagaaaagtattcatttattaccagagaaggatatttaaagcaaatacacatataaaataaacaaaaaatgtatccaaaaagtcattgcggcaacatactaggacacagaatttctagatgggataagcactgcctatagcaaagtcagacctgaataaatttcctctgattgttctacatgttacgcttccagtatagtggctgctcccaggtgaataatggtgcagaggtcatggatatctgggccatcgtatacattcattccttttcctagttagtttttaagagacactttcatccctacctgaactttggttcggaaacctcatagggtcagaaccttgttttctgactttgagttaagggctcccctggggcttcatagaagttttgacattaaaaggcctcaatgtagcttctctagaatttccgaagaaagtttcaattaatgatttacaatttctcaagggaatgtgttaagttcctggacatctaaaatcagcttcaaaaaaattcatgttcaacccacgatttagcctttccatagtgttagagtacctaatatctcctctttgatctgtagaatgatcaagaaaataattgtggctacagacaagtgcctttacatccctaaactccatgatacttggtttgccaacagagtttccttggcaacatgctttagttatgtgttacgctctctaattcctcctctgactcaatttatatcagcatgaacttgctttaacaacaacaacaacaacagcaacaacaacaccaccacaatcctatattgaaattctttactgaatcataaactgctgatcacaagtgcatgctgggaggtaacatagcatcctccataagtataaaaggtctgtaagttctgaaggtagacttcctcagttctgtattttgccagaatgtaatgttagacatgttatttttaaatcttcagattataattttttgtcagtttatttaataatatagcaataataatgcctatgtcactggattgcaaagggaattaaatagcataatgtgtgcaagaagcttagcggcatgcttggcacacaattggcatttaacaaaatttcagctgctacagacttctcaccagactagaacactttttttttctagaaacacatatggataatatttcaaatgaaatagagagtgaattctttacaatctcaaaagtacagtgctctcagtttcacacaaaaaatgtatacttctctttaacagatacacagatgaagatgacatctatggaatcttttccttgcaattgatgcattctttagtccagtaatatcatctcactttgtatccaagagatcctctctgttcatgtagaattcaggtaagtcccctaaacttcttggttttccatctgtggaaaaattgtggtgggaatatttgtacaccagtgctactattttatggctttcagttaccagacatataaaaacctcagttttatctaaaaagttaactttaatataatgtttcatcagtgactaaaatatcttcattcctggtttatttccaagtttaatttctagcctaatgacatagaaatgactaattcctctggcacaagaaagtaatcagtaaattaaatattcttatgcctgtattccaaacttaaaattgcttgttggaagtaaggattgaatggagtatttgattactatcttgaataaatttattaatttattcaaaactcatttgagtgtctataatgtgctagatacatgctaacttctaaagaaaaaagtatatatatatgtttttatatttgctttataattcataaagtgcttttgagtgacattatctattttaacatttacgataatccgataagaaaggtgaatgatctcccattttaagataaagagtttgattgtgggagatgccaagtgacttttacatcatcctatagttaagtactggacagcaggtggaaacaatctattaaaattatatgtcatttccaatcaaactgtactcattctaaagttttgtgtttgtttgttttaccacgtaagtcaggaaacatccagttcaatacttgcctttgtcaaaactttaatcctacgataaataaaatctcctttcttagcctgggtcagttttaggatatactgcatttctgaatgatgaactaacacagtgaaaagcaatacattatgcagagtcagagggcctggaaaaatcagctgctgttgttttagctaatatataatgatttcaggttttctgactaatgaaacagagaatgccatgtttctccctaaatggtgcaatttcagctctcaggctggaactttatcagaaatgcagatttagaaaagcaaagtggtctatgcatctgctcagtagaatgggctatgtgaatgcttgtgaatctttattt

SEQ ID NO: 487 - DNA, 20001 bp, Homo sapiens
cctcagaagcagaagcctgtacaacctgtagaaccatgaaccaattaaacttcttttctttataaattacccattctcaggtagttctttatagcagtgtgagaatgaactaacacagacttcaactaaagaataaattggaggctgggcatgatggctcacacctgtaaacccagaactttgggaggctgagatgggaggatcatgaggtcaggagttcgagaccagcccgaccaacattgtgaaacccccatctctactaaaaatacaaaaattagccaggcatggtggctcaacgcctgtgatcccaactgctcaggaggctgaggcaggagaattgcttgaacctgggaggcggaggttgcagtgagctgaaatcgcgtcactgcactccagcctgggcaacggggcgagactctgtttccaaaaaaaaaaaaaaaaaattagaatctagctcttgtgtgacataaatatgaaatgagaaaataccccagagtagaattataatattaggaataaaagtgacattaatttctgaggcctctgctaagtatgaagaaagagctcaaagggaaacaacaggagccactgctccctaagaaaaaaaaattcccgattctcttaatgggggacagaaatgtcaaaaattgtatagcttcatttttacatcccaaaatatgctcctaatagaaacatagtgctagtgtatatatttttctctagttattattggttctattaacaaaggttagtatgcaacatatttgcaaacatgcaggactacaaataaaatcttgttttcatacatctaacttaaccttataatttttcctattttattaaaagatatttttcaaaaaaataaaaaagatgtttttcatctagcacattattcctttatctgctttgtgatcattattctttcataattaatatccagcaaccattccccaagataagtatttcctatttttcttcttaaaacatactcaaaaaatcatccctttcaaaatacatccttgtgatagttaatttgatagtatccaaatgtagttgtaggacatatgaatttcctatgttcaatatgccatacactcatggcttgttttttttgcttttattttatttcaatagttttggggaacaggtgggttttggttatatagataagttcttcagtggtgatttctgagatgttggtgtagttgtctttcaagcaatgtgaaccataccctatatgtagtcttttatccctcaccctcttccctcccttcctctagagttcccaaagtccattgtatcattcttaccctcaccatggcttttctgatagatacatcatgtactaattgactgtgatcattaatctttgtgttcaatttggcattactggtttattaaggtactgtacacatatataagctaagtgtgtctgaaataacagagaaggtatttaaagggccacaactgcttgttacaatgtaaatgtagtattacaaacacctcaaatttcctgggtgtagaaccacttaagcactccaagatacccttgtttctgtctatgataaagtgcccacactaaaacaatcaaagcttatgcctggtatctgcatataatcaattaccaggtttttctttagcattttacacatgtgatctgaatattcctggtaactaagataggcataaaaggatgttaaagtgtgcagatgcaaaatatttctgaccatcacatttagaatcttcacctataagataatttaggagaacccttctttttaccatattttattcctgttatttatgtattagaagaagggagagagaggaggaggaggtagaacagaagcaagaaggggtagagtgagagaaagaggaacaggaggaagaggaggaggaggagagaaggggagaagaggaggaagggaaataagagaaagtgagagaacaaacttgagattttcgttccaaatctggctgaaaaacacagatttctgggctccctattgtaaggtaatggatgtgctttggtcaaggataggccgaggtaggatgtatacatcctgtgtgatgcagggggattggaatgtaggcgcacaatttcatgtataatgtaaacacagctatgtagccatgacatgggaatgccatcacttggctctatgccactattgtctgtaaaaggcataattgccctgctggcactgtacaggcatgcttgtgcccagagagaaaaagagttaagccgatgaccctgaaggcaagggagagccggctgcgcaggcgtgcatgggagcagctggagcaagcagtcgagacagagcagacagtgtaagagagctgctgatgacagagctgctgaataaagctgtgtttcacctacctacggccccctgagtggtatctgccatttcatccacccactccccttggacctcagcatgggctggaaccgtaccttgaccctaacacatgtcaagcctatcaaattaatacaaatcacttcaggtggttctaattgtcagcagggttgaggataagtgggttagaaaatcctgagattgttgagggtcaaccctcccgggtcctgcaaatgttagcgagcttgtctgctggtgttctcacaacagccttcaatgcctcattcctaaagaatggggactatgggaatcttagaccccatggtaggccatttgggagaatattttggatcagagagggatttctggtctcctaaaattataatgaactcaatgaggataagaaatgtgtcttttccaactctatctctgttgctcaccaggatgcctagtgaggaattggtgacagtaaatgtattgaatttgatgcattattaggccatctgtttccccctgtttgctgtgggtcctgcccaaagctaaatccaagcagagaacgtacttttttgaaagttttcatggctaataagaaacctgtgatgcaggaataagtttgaaaacaaatgtatctacactgtaggagcattggttgaatttgaacccaggaaatgactatttctattttgcctttactcagacatacaaacccaattccattttggtggggtaatggcgttacaggagactagagatccagaaatgtcagatacaggaaaacagaaaagtacaactgctttatcagcttttctaccactgaccctgtgtgggtaacaagcaacggctaataccccaaatccaggatcacatacatcttttggtagaatcaagcaggaagtttttatagcttcagatatatggtttgaaacaaaaaccttttctgctcaactttaattaaaatagaacaaatctatctgcaagagcgctctcgcaaaaacaaaaagcaaatttcacaaggaaaggtggtaatcttgaaatggcatttatttgttcaaagaataattacattttatagcccagctctatgaggaattccaatatgatgcaagtcttttaatatgtttaaatagaaagattcttaatgccatgactagtttttaattgagaccttattaaacaccctattgtgtaaataggaaacaatttcagtttgagtgttttcatttgagtgttttcattttcattaaagatatagcaaatggattcacagaaatttttgtactttactcaagtaattttggagccccatactttggtgcaaaaaataataaggactagccttgcacaatattctttgcaccttgcagtgtatggcaagacatctgatatagggttgaagagcattatattttagataaggtggtggactgtataagcacatggtttctgtaaatttcataccgccttgttattctggcacctgctgttcaaagaaagaggaaacctgaaggaaataaaactcagcacaaaacagctgcatctaaagtggagactgctgggatgcatgaggaggagacacaaagggaaagacaagatggttttaagtgtttcttaaatgtggggaaaaagtttgtttccaatagagtattattatatttaattgagaaaaaaataaataaagcgaagggaaatttgagaggagaaagaaaaggttttgattaattgtagctcacagacccttagggctggaatggactttatagaatcccagtcttgttgggcaactcaggaaagtaaggctcacagaggtattgacgtactaaacacccacttaatgaataaaatgcctgctgcatttatgtagatatgattttttttttaattcctggaggaaagatgaaagatcagtattcacaaaacatttgaatgattttgaatgctgagcccccaagtcttcgccactggggagaaagactgtcctgtggccacagcccactggggagacagactttgtcctgtggccacagccctggtgccagagaaatgggactcctgggttcctcagaggctacactgtctcactcatcacacagcttacagaggtagaatctgagggcctcgctggatactagagattcttgcagtatagactggtagtgaaaacccttctggaaatgtttctgagaacaagaggttgtagttttaagccatgtatccagcatccacctatgacgttgtgttgagttcctggaatcttcgggattctacaccagggcagccaggcgactgagaaggacacagccttcttgtcagaacactctgtgtttcaattttacctctgcaaaggactattcttgtaaccacaagtggatactgaactctctggatctctgtttattgcagggaaaaagtaacatacagcatataaaatgccaagtgatggccttttctgccaaacacagaggagtggaacaataaatttgcattaatttccctcaaattccagaagatatttctttgacttagtgcagaatttgagagaataattttttttcttggttacctaatttgcaaactggaattaagaacattcaaaatcctctcggatcgctcgttaaaatgagtgatgagcaatttcctggaaaacaatgaacattagctatcagtcactctatgaataagttttattattggctccactaattttttcatccttctgtctaaatactggtcccagtttgaatgctgtcttttcactatgtaatgagctacgacaattcacaatacctggatgaagaaagaggtgagtgtggtatggactgagctataatatagttagcctggagatcaaagttctgtggtggaggggaggttactgttttttaaaaaggtggttattcagtgcagcatgtttttattcagtgggttgatccaggtttaatgttccaggaggagaacattttaaaaaatcacacacaaaaaattagcaagagccatagacagaaaaaaacaagaaaaaatatttaaaaaatgttgcatggagtataagttgtgtcaaataagaagtatcacttataaattcatttattattgtgagtatttaaaaagagattctaagatttcttaatatttccacagttcctttctacagtatgattaaaaaaatattcattcattcattcagctccattcattgaacacctacaatacagcagaaatgatttttctggacaacaaacaaaactggagctaattttctagtggcgacggggagatagcaaacaaatgatgtgcttccaggcactggtaagtactatgatggcagattgagagcgggtctagcaagcaagcaaggggcctggcctgtttgtgataagcttgtcaggtgtggcctctttgaggaggtgacaagaaagcagagatccaaattaagcaagagagggagccatgtggaggtctggaggaagagtattacaggtaaaagaaacagcagaaaaagaccttttttgcagatagaaaggagcatgtcatgtacccagaacaacaagaaggccaggtgacccagagattggagaaggtgagaaaggacctttctctatagaatgaaggatagaatgatgcccagaggaaatggagtttatactcaatgttataagaagctgtgatgattaattttgtgtgtcaactttgctaggcttggtgcccagttgcttggtcaaacagcagtctagatgttgctgtgcaggtatttttttacatttaaatcagcagactttgagtaaagaagattaccttccataatgttggtgagccttatccaatcatttgaaggccataagagaaaagacagaggtctctcaaagaggaaggaattctgcctccagactgcatcatcgaaattctgcctgagtttccagccttcaaactcaagactacaaaatctcttggcagaatttccaggctgctagcctgtcttgtggattttggacttgcctgcccccacaattgtgtgagccaattccttaaaataaatctctttctgcatatatacatctgattggttctgtgtctctgaagaatcctgactaatataaaagctatcagagtgatcagagcagggcataatatgatctgattaacatttttaaattatcacacagattgctagcagggataacagactcttggtgaaaagaaggaagtgggaaaaccagctagaagactgctcctgtctcgtaggtgtgacctggcagtggcctgaatttgatcagagggtgttggatttgaagaatattttggaggatttttaaacaaatcagatgatgaatgtgagagaaacagaaaagtcaagccttaagctttgagcttgagcagctatgtgaatggtgtcctcgtaattaagacacttctggaagcctgggcaaggagcaggtgtgcagaggaggaaaagtaatcgggggtggggtggggagggatgtattaaagatcaaagtttttgttttgaatgcattagtctcatgttgcccattagctgtccaaatggagatgtcaggtagaatatgagatgcagggacaaggctggagatcagcatcacttaggtgaccagagcattggtaaaagttgtacactgacagctaagagcacagtctctggaagccagaccatctagattcaaatctcaactctactcttcacagattgaacttgattgtcctggccttctcatctgaaaattaaggatgaaactaaacatacctaattgaagagacatgaagattaaattagttaacatatgtaagcacttaggatgatggctggatcctagaaagtgtgatgtcaatgttatctatgattacaatcagagttcagagttgtttttttttgttgtttttttttttctggcccatcagatcaattgctaaatggagacaggggattgggtattgtttcccaagcatacctactttgcatggattttgattgctagcccaaagaggtcaaactgcaaacaaaaattggggcgaagcaatttattttgccggggcagtgagcactttcagagcaatgaaaactgataaagctccactcccttaaatatgacctttgtcctccctgctttgttttctttcttgtgcttgtcaccttctcacgtatcatctatgacgtgctgatttatttgtttgctttccatctcctgagctctacgtaaaaaagcagggattttttactttctttctttttttttttattatactttaagttttagggtacatgtgcacattgtgcaggttagttacatatgtatacatgtgccatgctgctgcgctgcacccactaactcgtcatctagcattaggtatatctcccaatgctatccctcccccctccccccaccccaccacagtccccagagtgtgatattccccttcctgtgtccatgtgatctcattgttcagttcctttttaacttactattagcacctggaagagtgcctgactcagtcaaactatggggaataaatgatatttcctggcacttattgttccttttctttgtttcttaccttatttcttcaaatattttttcatgagaaaacattatcaaaaagaaggctggacattaatatgcttctctggacctgtggagttgtgcataatgtcagtttcattgagacaaacctcatctatgaaatggatgttcagagaagcccgctgatggcaatttcagttttgtctttggaaatcaattgcggaattgacatacggtcttctgaaagtgatggtactttacttgctgttggttgtccactctagtttccctgccagtctatatgtgggctgcattccactccagctgcaaattctaatcacagatttttgctcagcaatgcttgccaatgagaggcattgagagctatgcattgtggaagttgatacatggcccagtcaatctatgacttatgagacctattgcaagtccaaggaactgtattgattctgcagaatggactggaaactgaccttcatctcacagaaccctccaacttgctcctggtctgtttattcccaatggagcacttgcatcatgcagctttgttccaaaatcattaacttttatttccctttacattccatcatgatttttaccttatgtataaagagtggacaaatagaagtctttatttagcacaaaagctcagtcctgtttcaatgtcagctattcagaggcagttaattttatcttctctcactgcatgggtttagtacacagatactatttccttggaaatgcagacattgtgtcaaaataatgtacatttgatccctacactacttgtgccagcagttattaatgatcatccttagagtattgtattacaagtagtctttttaaaatgtttccctcgtatcttaattagattaatcttaatattaagactgttgcctaatttctcattgtggttgtaccagccagcacattattgcatagggagttcaacaaatgatgggcaaggtgagttaaatattcattcctgaggctgtttgggaagggacatcaactgtctgccgccctcaggttttccttttatctatagaatggatgagaggctgcaatagggctttcctcttcagccattctctttgttcttgagatgcaggtgtggactggacttcaagatactacctagaaaacataaccagtttccctattaggttgtgatcccttcgttgtgcctttgaattccgagcatattttatttcatcggaggatggccattacattctaataactaaaattataggatgttctggccagaaggaagcttataattcttctaccggagaatgttcattatgcagataagtaacaaggactgagaatttcagaacttactccaggccacagggccatcggcttatctgagatgaaagtccatggcttctgagctttcccacagtattacagcttggtttggaggtagctactcatttttcctgggcatttatttaaggtagaacatttaatacaagtctgccttctttgtcaggggtgactgcacctgcagttgttcccactgcagcctaatcaggcagggaggtcagtctgtgagcgtgtgtctgaaaaacacataccgactactttctcgtggctgctttactcagaattgtcacatcattaccaggtctttcctgttgctatgttcggttcacctgaggggagaaaattgaactgaacaatggaagatatgtgaacaatcaaaaaaaaattaaataaacattttttcccctaaggtggaaaggaaggtgaaggagtcaaataaaacctcctaagaataatgattccttcaaaatgaatgtcatagcccttgtcttgactttgttatgtcaatactattttatccatactgcatgatctgcaaagctgatgctacatccaaggatggggaacttccctttgttatctgccaatatagctaccaattctataagtgtgaatggaatggcaatacttttattagtaagcaagtatgtgattttattatacagtatgtcaaataaaaactgccagggagaaaaaaaaggaaaggtaatcttggtgacaggtgaacaccttagttataggaacatcttagtttaaacacagtttctgagtttgcaagttatatactaaatagcaccaccatatggagcagatgtaggcaaagccacaaacactaagaaaatgaggtcacaattgtggaaatgagacatttccccctttttccatgcccttggttgtatgcagattgctccaacctaaagggatacatattgaactcattttctgtaatttaactgaattacaatgttcatttttatatatagctagaaagaactcagacataagaaagggtatctattagctctttctttttttttgagatgtagccttgctctgtcacccaggctggagtgaaatggcacaatcttggctcactgcaacctctgcctcccaggttcaagcgattctcctgcctcagcctcccaagtagctggcactacaggtgcccgccatcacacccagctaatttttgtatttttagtagagacggtgtttcaccatgttggccaggcttgtctcgaacccctgactttatgatccgcccaccttggcctcccaaagtcctgggattacaggtgtgagccaccaagcccggcttagctctgtttcttaacatgaaaacaaaatctttgcatacaattttaatagcaattcaagtggtagaagaacaggtaacaaattgtttatttaaaacctattttactttaaagatgaatcttccattctcctctccactcccttcataatgttcattcattcattccttctttcattaaaattatttggcatgaattgaagttgtttttgaagcacctttcctggaagtaatcaacacaaagagttattgctgtgttctctcactttttttactttgtgacaaaatagaagcatagaattggaccctttgaggaggattgacagctgcaggggtgacaagggctgatcttcctggaggaacagggactaagtcacaccattcagatgtctgccaaatttgagaggctaaaaagacagtacaggggaaaatgatagcccttgtggatttacactgattttctgtgcataataatggacagaattgtttgcagagtgctctttactttggagcaatctgcatacaaccaggggaaaggagaggagagagtctgaaaatgctgcagcagtgagatgccctatatgtagacacaaagtccttctcgtaattgtgtggcaggcagaataatgactctccaaagatgttcacaccctgatccctggaacctgtgaataagttaccatccatggcaaagggaactttgaaggtgtgatcaaggggatgcaccttgagtgaaggagagaagcctggattacacaggggcatctaatctaatcacacccagccttaaaagtgaaacaccttttcctggttttgtcataaagaggtgcaataaaaacagggggagaaattcgaggtgtgagagggatttgctattactgtctttagagatggaggaaggggtagaccagccaaggaatgtgggtatcctacagagactgggaacagcttatagctgactgccagtaagggaacggagatcttagttctacaacctaaggaagtgaattccaccaacaacctgtatgagcaaggagaaatctgtccagcctccggaaaagaacacagctcttccaaaacctttactgtagcctggtgagacctgcataagacttcggacctacaaaactgtaagtccctttatttgctgtgtaatttgttagagcagcaatagaaaatggatacaaatggttacagatcaagagacgtctcatttgggtaggtggaataaagcaatgctacatttgcccttacatcttgaaaacaagcattattgacaatttaggcaaacatccagattaaaataatgaataaaagggcacatgtgcacaatagccagaattgttatttattatcacagaatggagcttttcattttcagacaggcctaggaggtatgagacacaggctttttgttgaggtgttttgaaaaatcatttgcaaattttgatagtgaatgattcctcttcttgtttctgggtaaatgtcatatgtaaatatattcattgtaatcactcagacttcttgagatacctagcaattaggttaagtttgtaccaattcctttgctttttatctccatagttaattgaatcttctacaaaacttacttttagttcattatttctccttctctttggtcttctttctggggatcctgtgtatcttctagttttacattaagattttgcattgaaagtcctcctgaatgtgcaaaattgtaagtgtactcaggcctcacacacagatgtaacgtaagcactcagggacattcgttctgtctggcggtgcctggatcattgcttaggtttaagttgtattgtaattttacttgttcaaaatatgatttcattttttccagcatataaattacttgaagaggcagaatctgagagtcaataaaagttacacatacacagataggtctagtgtggtccgtcctgtattgatacaggctctttaataggcacaagctgttgtgtttgtgcctgtgtgttgtgttgtgtacaagtgagacagacccattcttccttaggctcaggccacatgattttaggtctgttggggactgaattgtgtctgccatcccccaactcatatgttaaagccctaatctctgactgcttctggaaacagggtctataagaaggtaactgagcttaagtgaggccagaagcaggtggtcctaatcctgtaggtctggtttccttataagaagaggaagagacaagagagagccctctcattctctcttcatactcacaaaagaaagacaatgtgagaaaacagtgagaacgtggctatctgcaagccacaaagagaagtctcatcagaaattgaatttaccagcaccttgatcatgtacctctggcttccagaactgcgagaaaataaatatctgttgtttgagccacgcagtcttaaatgtagtatttcgttatggcaatcctatcagactaatatgaagccacttccaggagtttttatttcatcctaggaagcccttgatgcaaattaagcttgggacaggtggcaccatccaatttacatttgaaagcaaacatttctggctgttgtataaaatatgacttaaaagtggggactagaatgaaagtggaaaatcagctgagaagatactattgtgttttgtgtaagagacaatggcatttttcaatatttgtgtgaagcaaaaattacaactctaaatttttcagtttataaagtatgaagatggaatatgtatcacaaaaacctcacaaagagtagtgatttgaggttagtagacatatactattgaacattcatgcatttcctgtgagatggtgtaatattaacattataattaaaattttattattcataatgtaacctctaagttattatgaaaaagatgcaaagatacatagcaaaaatgccaataaaggaaattaaaagaagtaccaaaaatatttgattaactcaaaatgaggcagaagagacagagaagagagaaacagatgggacaattagaaatcaaatagtaaaatgataagccaaaatcaaacttaggctaacgttatatttaatgtaaatgaggtgaatatgccagttgaaacattagaattatcagatagtaggaaaaaaggaagatctaattaaatactgtctacagagacattctgttataattaaatcagaggaagagtgataacaaaaggatgaaaaaatgatacaccatgcaaacaataaacatgaaaaagaacagctatattaacatcagacaaggtaaacctcaagacaaggaagaatgctatagataaagagggatgtttttaaatgaagaattctattcattacaaagacataataataattaatatatatgtgcctaactctagaacttcagattctatgaagcaaaaatagaattacaaagaaaatagaaaattacacatagaaatattcacatgtcctctcagcaatttataacaacaactacattaaaatattggtcaaagagtagaagttatgattagcactatcaacctccttgatcttactgacatttataaagcatgacatcctataactagaatacatattattttcaagtgacatggagctttcaagagatagatggtgagccataaaacaaatctcaaggagaataaattgatacttccatatagtttccaaaattgttgtatctattaaagctaaacttatgcctaccctatgttccaacaaacccgttcataggtatacaccacagagaactgagttcccccaaagatgagtacaaattatctacagcagttttattcattacaccttaaatctagaaagtctaacaggagaatagacacattgtggtatattcatataagggaatataacacagaagaataaactgtttgctgtgcagaacaaaatggaagaatctcacaaatacaataatgtgctcaggagtgcagtcatgaatctggtcatcctgtatgactccatttatatgaagttcaagaacagccaaaactaatcaacagtaattgagggaagaagactgaagagttactaattcttggagtagaaaacattgtctaggaagggcacaaaggatcattctccatgatgacaatttacatgttatatgggtgattgcagcacttaacttaaatgtaagttaagtcccaatcaaagcaactgactgttcaggtaacaaacacttggtttcagaggctcagcctttgcccaacaccaccaactttataaacaagatatgtcataagaaccttgattttccagtcaacatttttaggagctcccaaatgatccaaaagtagaattggatatcatttccttcccaaattcattatttccaaatctgatgacttgaaatgtgtgatcctttagacaggagtttgcaaacaggtgagctttgtaccaaccatataaagaaaatttctagagcaaattattgattcagtcaatcctgcaatgagaatattgaatgacttaaaaatataaatgattttgaactctttggaagcaattaccagaaactgatgtgctaatggtatgttataccagtgtggttttagatgggcaaaacttttgggctagttgaagttattttgaagttgtgaaaaaaaaaagttgtttttctttgacagcacttcctacttctcacacatttccttccattagccgccccttcctttcttccctccctgttattccaggtatgcctagtaggaggcacctctttcacagtagcctagacaagcttgggcatctctgcatggaaacttttgatagaaagagagttacagattgtaagtttttttagttgccacagctgtagggacattaaagatgtcttgtatacatagacatgtgttagctgagccagtggaaagtgctggagttggacctgactttaaacagaggctctagtacttggtagttacgcaatgttgggcaagttactaaaactctgagcctcagtttccttatctgtaaaatgtaattgataatcattggcttatagggtcattgtgctatggttattgtgataggactacatagaatgatgtcgggcatatcataggagctcaataaatgatggtattattactttatgatgataatcctgctgctattgctgctgctgatattacacttagtggaattctgtcctccttccttcataaatacaggcagaaacataagtacacagttaagcacaattaaatgaattcttttgttacagttatgcacaattaaacgaattcttttgtttctttctgaataatggggcttatcaattcttcataaagcactttggattctggagctacatctctaaagaagtccaatgactaaataagatttaaatgccattagtagttcatataattatcacaaagtgccagagagatattttgaatatcaataaatcgagccaccttttttacttcctgtaagatttctattgagatgttaacaggcagaaaatcagtaaaaatattgtatatagtttattttcattttaattttttaaatcccacattgcttagctcaggaagatgtgaacagaaggaagttttagagtagtttattatcctttagagtcagctttgtgaattacctaattactctcaaccttggtgctattgacattctgcatcatcactatagaaaagttcatgtgtggcatgtgtacaacgtagtttaatctgacattcttttttaatatctaggagatttagggaccactgtaaaaataattggcaaggaactgcaaagtgtttttctcttcttaaataactatattacacttatacaaagtatactgagaaggagctaggaagagaatatagaggattactgtgaaatacgatgaatatatattgaatattaactctccatgatcatcatcagtgaaagggatgatgggatagcaaagagaaaatggtatgaaatgcttaggtctgttggaaagaagtaggaatttgattcaagtaaaacaagggctccagtttattattatttaagctgtgcaaaaaatgttaagcattttacatgtactgtcttactaaattcttcaatgactctaagaggaggtgttcaatggaaaatacaattgatcactcatgtgtagtgtcatgaaggacttcgggaatttaacaatggttaagacaatctcacagagtggagattaccaacacataaacagaaaaaaatatattttataataagaagcgaaaggataagcaaagaactatcagtattggtttgtaatctctctcttttttttttcttttgagacagagtctcgttctcacccaggctggagtgcagtggcatgaccttggctcactacaacttctgcctcccaggtttaagtgtttctcctgcttcagcctcccaagtagctaggattacaggcgtgtgccaccatacccggctaatttttgggatttttgccatattgactaggctggtcttgaactcctgacctcgagtgatcctcctgccttggtctcctaaagtgctgggattatgggcctgagccactgtacccagcctgatttgtaatctaaattaatttgtaaaacaatccctatatcactttggaattggaagattttccaggattcagggactgtaggataggaatgactcacatctaatttataatcaaagatttatggataatcactaagacactagatttattaaagtgttctcaccacaaaaataagtatgtgaggtaatatgcatgttaaatagcttgatttagccatttcacaatgtatacaggtatcaaaacatcatgtagtactccacaaatacatacaatttttacttgtcaattaaaaaaaagaatatataactctatattttagtccaaaagaaaggatttgttgaatacgtttgggtaggacatggtctgtggcatgtggcatgcacagccacacccaaggagcaggattctggaaagacagtggcctgaaacacacatctgacccctcctttgtgagaactcccactcaggatccacgcggtgcacacagagggagcctggagggtgtgttgtctctggtggtgagatttcctaagatgtctctgaagggtcttcaagggacttaattatctgggcccatgacccaggccttgcctttgctgggagaagagggcagatgttttagaagagagctggggatgtggtccaagcatcagcatatctcacaatcttctcctgtgcttctgatacacagctggggttgcatgttactaattttttttttttttttgagacagagtctcgctctgtcgcccaggctggaggtgtagtggcgcgatctcggctcactgcaagctccgcctcccgggtttacgccgttctcctgcctcagcctcccgagtagctgggactacaggtgcccgccatcacgcccggctaattttttctattttttagtagagacggggtttctgtaagccagggtggtctcgatctcctgatctcgtgatccgccgcatgttactaatttaatgttacttaggatggccacattgaatagttaaatgagatgattcgtttggagggaaaaacgatggagaagtaacacagagcattaacacagaaaaaaaagaaactttcaagtagacaaagtagatcaacaacagcaaaacttactttctgaattttacaacttattaaaataattaaaatattattttggaaagccaaatggagtgaatatctaacacagacaaaaataaatggaaatgagaggtgaaaggtatttggctgatgattaaaaggaaaagggaataaatagagaatagatgttaatgaaagaaacaatagaacttttccctgagtggaagaaagacttaaatctaaaattaaaaaaggcttagtggctcccaaatagcattgaaattaaaggtcctaaatatcaagtggaaaatatgagaacagcatgtggtttattatgtagcttaatgacagaactcaaaggatcctacatacagccaaggaatcattattttcttagtccaaaatatatatatatatttggagaatgtgggattcagttggtacattcatatgttccatataagttattcaagtatagtgaaaatgggttgagtcatctaaagtgatgaggataatatgacttggatatagatacacacatgcacatatacacacgtgtgtgtataataaacatattaagtatatttgaaataagaaaatctaaaagacaaaaccaagagattagatctaaagttttaaaaccatctcagcaaaactcgagaggtggtgggtgagatgcctgagagaaccatagtccagaggtctattctggcgggactgtactgtcacccacatggtgacagcctgggggtaaaaacattctaatgttttctgcacacatatgtttattgcagcactattcaaaatagcaaagaccagggaccaacccaaatgcccatcagtgataggctggataaagaaaatgtggcacatatataccatggaatactatgtagccataaaaaagatgagttgctgtcctttgcagggacagggatgaagctagaaaccatcattctcagtacactaaaacaggaacagaaaaccaaacaccacatgttctcactcataagtgggggttgaacaatgagaacacgtggatgcagggaggggaacatcacacaccggggcctgttggggggtggggggcaaggggagggatagtattaggagaaatacctaaagtagatgacgggtttatgggtgcagccaaccaccatgatacatatatacctacgtaaccaacctgaacgttctgcgtatgtataccagaacttaaagtatatatatataattctaatgttttcatttggtgccagggaaaggcaagagagcaagtaaactgtcttggttggcactatggctcctaaatctatattcattcatagagaaatgtagtttcatcatagccattaggaatgcgtatgtaactaatagcaatgctgagaagtatggttatctttcaaaagtaaccaggtgtgtgggtggtgaaggtagagaagaatatgaaaaaaattgagatatccagaaacagtaatgagatatataggacagtaatgagagaaacagatcaaatgagattaaataagaataaaaccaagtatgtaaattttcacaatacacaaaaagtactgactgaatttccataacacaattaagagactctcataggaggttaaaatataaaatggacaaaaatatagaaaaattaatagtctaattaaaatagtatgatttaaatgcaccaaacaaatgacaaaattctaaaaaataagactgacttgggccaggtaaaattatagtagttggttttaatataactcattagaaaaatattagtgataaattcagtaaaaa

SEQ ID NO: 488 - DNA, 51814 bp, Homo sapiens
aagtcagaatttgagtctttatctgtctggctgcagagtgcagagtgtgaaatctattctacatactgcaccaagaaagaaaattaaaaggcattatttttccttttcacttcaaaaacaattttgaaaaagaagaatgagaagaatgatcactatagcagatattaaatttatcataaaactataaaaaagagttctgtcctattttaagaatcaacaaataaatagatgaatgaagtaaaatagccctgaaacgtttctgtgtgtgtaaaattaaagcacagtacaagatgcatatacaaaccattagagaaaggaaggcttcttttgacaaacactgttagaaaactggtgatttatacaaaaataattaagccagcatctgatgtgaaatacccaaataaattctaaatgcactgaatatttaaatgtccgatataaaaaccataaaaatgaagaaagtatgggggaagaattaactgatgcttatggaatcttttcaaacactaaagcaaagaaagaatattaaacctgactacactttatttacaaactaaatattatacatgtaaaaatataactataattaaaaggccagagataaacatggaagaaattttatcacaaatattgttccattatatattgctgggagatataaattgctgggagaaatcacctgggaacatggtggcacatgcttgtggtcccagctactcaggaggctgaggcaggagaatcacttgaaccaaggaggtggaggttgcagtgagctgagatcacaccactacgctacagcctgggtgacagagcatgactctgtctcgaaagaaagaaggaaagaaagaaagaaaagaaaagaaaagaaaagaaaagaaagaaagaaagaaagaaagaaagaaagaaagaaaaagaaatcacccaggaaaatacaaacactcttgaaaaacaagatgaggtagaaaaggaaaagaacagacaattcatggaaggaggaacaaaaacggccataaataaaaatacagaaaaatgttcaagagtagacaaagatgaatacaaagacattattttgcttgactatgaaagaaagttttgtaaaatgaataattctaataaggtagttacagtgaaactgggtatctcctgtggtatttgtggtagtataaactaattcagtctttctggaaagcaatcttattatatgcattaagttttaaaattaggccaggtgtggtggctcatgcctgtaatcccagcacttcgggaggccgagccgggtggataacctgagggcaggagtttaaaccagcctggccaacatggtaaaaccctgtatctgctaaaattacagaaattggccgggcttggtggcatgcacctgtaatcccaactactagagggggctgaggcaagagaatcactcgaacccaggaggtggaggttgcagtgagccgagatcgcgccactgcactccagccagtgtgacagagcgagactccacctcaaaacaaaacaaaacaaaagagaaagaaagaaaagaaagttttaaaattaactataacaatttttcgtgaacatttataataaagatataatcagagattcagactaagatttataaagatgttcaatatagtgttatctataacaggaaaaatggagacaatctaaacatccaataatagtttgataattaaatagtttcattcataaagtataatattctgcagctttggataatgttaattacacatagcctagtgctaaacggaaaaatgcaagatgcatgcctttctaaatgccacatgatcacaatcatgtcagacactctgaggcatgtgtgcattgaaaatccattgcaaaaagattctccgaggtaaaaatggtgatttttttctctgatgaaattatgagtgatttttagcttttcctatatcctttactgtaagtatgagatgatttctgtaacaaaaaaatatatatataaattttaagcaaacatagccaggtgagtctctcctgaagcccactgctgggaggagcctcatttgtgagctgtccctgctaaggggaagaattgagactgcagtggtagagtcagggccaaaaggatccccaagaggtcaccacaggagcatgcagccaccgaggcaggtggaggaccagaggctgtaaaggaatgaggtgggattatcagacaggttacgtgatgaagactctgagaaaaagctggccaactagatggaacacagcacctccttgtaatccccagggaggccatctccagacacatcgagattgcagttagggcatgagagctcagtaactctgcttccctgaagtccctgcgctctggtgtcactggctcccagaagaaccatgagaaccaaacaaacctgattccaacgcttcaaccactcagcctcccagcgagatcagttactctgaagacaagggcatccacgcaccaaaagactcactggccagctcagacgaagccagctggaggactgggtccatcacaggggcttcctctcccatcagcaccccaccctgctcatggtcaacaatgctcattggcatggtcaactggctaggaacctctgtgggaagccagaccactttgctgggtgtctgcttcccggtgcatgccggggagatggcagatgaccttgtgaaggtctaatgaggttgacaatgtagatcgaattttgcgtggcacaggctggaaataaacaattcagtatccaaatatgagcatcaggactcaccctcttctctgacatgtggggaaaacagctatcttagggttatttgggaaaagtaaaggagttggtctgtaaaaaatttagcggcatctgcagtgcacaatctaggttaattattactctttactgctactactgtacttttaccattaatacgattatcaccactactactattgctattaccgctagtactatcactactactatttactacggttactacaactgctatttttagcactacatcacactactacggttactactgctgttgctaccattactactattgacacgattactgctatcactattcctgttactactagagctgctgctactgatattaccactactatactaatctaatagtgctataattattgctatcacaattacttttaccattactgttactactgctgcttcttcaacgactgctatcgtactctaagccacctcatgcgtttacagcaaccacacattccagatttaagggaaatcatcttggttggaattattctgtctcatcacctccaaaagtcctctcacaactgtcagactatgcacctgttcgtgcagaaaatatttgtacccgtaacccaaacccttgttgagtgaggcagtcatgcgcagggctgaaggagcctgcgtcagtccctggcagggactctaggcacagtagtacctgcttcccaaaccaccagaaaaaaaaaaaaaataataaatgctgctacacaggagctgttctccttttaaggataaggaaactgaggcttaggacaatacgtaatatggccaagttcatacagctggtgaaagacgagaccctaattcagacaaggttctaccagggcccttgttaccagctaagctactagggtttttttagttttttttttttttttttttgagatggtgttccagtctgctgcccaggctggagtgcaatcttagctcactgcaacctccacctccgggttcaagagattctcctgcctcagcgtcttcagtagctgggattaaaggcaggcaccaccacgcccagctaatttttgtatttttactagagacggggttttaccatgttggccagactggccttgaacacctcacctcaagcgatccaccatcctcagcctcccaaagtgctgggattacagacatgagccaacaagcccggttactactagggttttgaatgattaaaaaacaggttcagattgtggcatttgctcagtttcctcaaggcatgagataggctttggaataaaaagctaagctggttggtcccagttctcctgactccaagcgtttcagtctttggtgacaatttcctccaactgctaatgacaattcagcggcaggtgaccatccttgctgggacacggggctcctggagcaagtcctgtgcagctgaagaggggagcgaatgggaactttggaaggaggaggaaacaggaagtccaagcgagctccacgaagcctccgggcaggaacgcaaacaggaaagcggttctcagccagtggtggcctctcgctagctaggtctggtgtccccaaggcccccctggtgcgtgttatttttggaccatgccacgtggtgagtaagtgcctgttggattagatagagtcaaggccagcttccaggctggtgtctcccaagcaacaggggtcagtggccccagggacatggcctatggcggagtttcaaatcacactacccccagccaccccccagacatctctgaggcccttggataacaaaaggaagcagggaaagaaagagggaactgctcttccttcccctccaatcagaggtctccactctgggtacagtggccagatctgatgaccttagcaaagccgctcttggcctggagaatcttgcaagcttggactttctggggctcgtgcactgatgggcaagctgggtttcctggactgggaggggttagcttccttcccctttgggactcatacctcaaccccatagcaattcactgaactgctcctggccttggttaatcttcagtgaccatggctagtagatcatgatagactttaagaaaggagtgtcaaggcagttggtttccacataagttagactctgggtggtttttatatcataagctagcacatctgacctataatagtaaagaaattatcccattgtgtgaccttacaggattgcatatgtgtgtgcatgcacacgtgtgtgtatgtgcagttatgttttctctctccatctctctctcacaatcacataaacaataaaaaacagtaaatgttaagccttttaaaagcagaaccacatcattttgagttttgcatttcactagacaaagtgggaacattcgtggtaacatcatgaagagtgataacatagtaataaaagcagatttttctcaggcatttaaaaggataagagacaaaggtaggcgcgatccatgctagctgggtctgtccatatgattccccagtatcttggagacaggcaagagtgtagctagaatgggattttaagccagggagaactggggatcaatcccggtcagacaccatgaccctggtcaagtgcctccttcccacttatctcatacacaaaatgggaatggtgcctacagtagaggctttctgccaagatgacaagagccacttacacaaagagcatgtggtggacacctagcggatgttcaacaaatgtctggatgttctcaagatggcgggcagtcccacctttccaaagcctttgcgggcaggacagacgcgctcagtcacaaaattcctttcctttgtctcaatgccccacgttctgggtaacataatatggtgctcctcaacggtggccaagggtcaatgcgatgtttacagctgaacaatttccaggccctcttttctttttctttttttttttttcttttttttttttctgagacggagtctcgctctgtcgcccaggctggagtgcagtggtgcaatctcggctcactgcaagctccgcctccggggttcacggcattctcctgcgtcagcctgcccagtagctgggactacaggcgcctaccaccgcgcccggctaattttttatatttttagcagagacggggtttcatcgttttagccaagatggtctccatctccagacctcgtgatccacccgcctcggcctcccaaagtgcagggattacaggcgtgaaccaccgcacctggcccaggccctcttttcttgtaccaaggtagagagacagacaccaagagacacccccatctttgaatgctagactaaaaacgggaaaatgtttgtaaaattaagttttaaaaagctaccccaacaagtggtatgatatggtcaaccgtgggggggaaagtttgcacagagaatcaaagaatatacactaaaataagaggagcaactattaaatttacagttcaacacagtaggaactagctacatatggctatttagatttaaattaattaaaattaaatagaactaagccttcagttcctgacacactagactcatttcaagtgctcggtcatcacacatggcagatggctactgcattgcacaacacagatctagaagagtccatcagcagagaaagttttactggacagcactgatgtagagatggaggtattttgagtgatttcaaaattttatttccctaaataatattccatcattatttttttcctataaaaatgtaaatagcagccgggcatggtggctcatgcctgtaaccccagcactttgagagaccgagttgggtggatcacaaggtcaggagatcgagaccatcgtggataacatggtgaaaccccgtctctactaaaaatacaaaaaattagccaggcgtggtggcaggtacctgtagtcccagctactcgggaggctgagcaggagaatggcgtgaacccaggaggcggacctcacagtaagctgagattgcaccactgcactccagcctgggcgacagagcaaggctctgtctcaaaaaaaaaaaaaaaaaatgtcagtagcaacagacaaaatactaaaatattattttatgtattgatatggcaccttacttacattcattcatgtttggtaaaactgaaatcacagaaagaggtgctaacctaataacgagggactgatccttagacaggactttcatgtttggccattgctaagttaagcctcatggggcttgaggtggttctctatgaactcaagcaatcttgggtcagggaccactggctccctcaggccaggatggtgtccttcaccactttccaagaagacactcagcatgcatttctgttgtttgttttccttcttaactcctggaatattaaatagatgatctcagaatctttccctccatggttctaaattatatccttaaataatgtggaggaaaaaaaagtgagaaagggcagaacatgcattacaaagtagactcagacacaggacattgttttggacctcaacttcccgcaaatcaagcttggagaacatacacagtgtctgtgtactgagtgaaaggtggggaatgcagaactggacatgctgcagaactgagggggcccatgcaaaacgacaatgcaaggttccttgttcaaaaagtatcaagagattcaaggggacagcagaatgttaaatcaagtgtggcacccatttgagcatgagtacaactgcacacattgcatgcctatgaagatggaccccatgcagaattccagtttttcacaagccattggaaaaaaaaaaaaagatttcaatagaaaatcgtggacattacaaaatttaccagaaatttttgtaagtatcactgcaacccccacccccccacagaggcatcttattttttggtctatctttgatctcaatactaaaattcaaagtatttctatgtaagctattttaaaatatggatgcccatagaagcagagagtagtacggtggttaccagaagccaggggatggggagtgggggagatgtttttcaaaggacataaaatttcaattagagaggaggaataagtccaagaaattcattatacaacctggtcactatagttaataacaatgtatacttcaaacttgcttagagagtagattttaagtgttttcactaccaagaaaaaaataagtatgtggggtaatgcatattttaatttgcttgatttaattaatctaattaattagctatttcacagtgtaaacatactttaaaacattatacaccataaatatatacatttttgtccattaaaaataaataataaattataaaataaaatatatcactacattggaaaaaataaacaaaatgtggtatgagtgttaccaacatcatcaaaaggttaaagagatgggatgaactttaaaacttgattttattggataaaggacaaaaaagttctatcattgtgagaacagatctatgtccaccttataaaataaccccagtcatcttaatttaaacactattgattggtaacccaaatgaaaatcaaaatcaataagagaatttttttttttcagagtgggatattatagactccatcctgaaactagttttagggaataaactttccagtcatataacctaatttatgccactttttatgaatgagtgacttgggctgggagaagagatagaaagttttgacaattttgaaaatgtaggaagtgataagatggttttcaacgtggaaagcagaagcgttcatctttatggaaatttcccacagctacacctattccatttcatataagattattatggggttaagaaaaataagttggcttacatcaggacagattaactcattctttgaagaaggaagaagttggctctaaactctatctcttatgtgattgctgttatcaggtgcaacatggtctagtcaagcaagacagggagcttgctttctttttctgactcagtttccgcctctataaatgggaaaaataagagcccctgcctcgtgtgcatatgtgtgacccaaagagaaaaggcacataaagagtttaacccaacaactgaccaattattaatataattattggaaattacagtgggaggatggacttatatgacatgtttatgaattggaaactaattaaggaggaatctaaatacagtgaacatcattttctaagccaaatattaggatatactatgtgacaattgaaagtgcaaatttgggggtgatgacagaacattttaattcacctctgtgttggtaagtgccagacatggtcacaggacatgcgtacgagtttgaagctttttctttgaaaagttcctttctgaaatcagacgtatctagcactgttgggggaggcaatgagacagacggtgcagggatggacttggtgacatggaaacatcctctactccaaacagatacacaaacacacatccctccatgcacacccctacacacacccctacacacactcacattcctatacatatacccatacacactactgtatctacacacgcacatacacacacacacatactcctatacacattcgcctgtacacacatacacacacgtacccacagacacctccatgtatctacatcccccgaacctgtacacacacattcacacacacacatacaatcagttaattgaaagatcatttgaatgtttaacctgtattctaggtctatacaagcatccaaatttatacacacacacagccaacccctgacacacttgacttgatcttaaaaatatactaaaaaaaaacctttgtagaaacccctaaaagttaatcgtaaagcaattgcaatatcctatcctgtatattgctatatagatgcaacaaatagttccctctggaattgatgtaacccaattcactgtgaaagattaagattcattaggtctaccttggatctgaagtctttaaaggcctgtgtcataagaatgctttatatataagccaccatatagcataaatcccagacatcacatgaaaataagtccaatactggatatttgtctacaattgatcttttttctcctctgtctcctctgtagcaaactcactgctttcgtctgcaaactatctccttgtgtgtgtgtgtgcgtgtgtgtgtgtgtgtgtgtgagagagagagagagagatagagagagagagagagagagagaatagcatcgatggtataggaaggctgtttcctaaatatatttctaatacatgggctcagcaaagaaacaggttcacacacacaaaaaactgagatctgttgttttaataaacatatcatggtttgatatagtggttgttttcttttttagatttgatttatctgtcactttctttccaaatttgatttattggtcaatttcttttcaagatttgatttattggtcaatttctcttcaagatttgattaaaacacattacataagtcttttcagatctatttctaaatatcatatatatttctaagtacggatgtttaaagtctttattcataaatgttcttgattgatgtctgttttttcattagtttttttaaagctttaggtagtcatttattctgtaattggaatcagcataaacaaaccataaaatccaattgtgtaatgaattactcatacctcagattcagagagaaaagaagcttaagatataacaaggaaaaaacagctttatatgtgggagaaacacattggttagttggtcttcaatctctggatttaaagatacactatgaaacaattctacaagaaagtgttctagcatgataccgttgatgaccattagttactccatggctgcatagatggcattgatgatgaagagtcttgtgtttttctgaaaacccttgttttattttgtggatggatccatggagctctgttccttctgccttcttcagagcttccctgcagacttccccagggaggcagtgcccattgaatacctgcccagcagatacctacccaccatactcatggactcatggcaagacactacatagaaaaagaccctgagtcccagagagagtggcagacacaccagaaggtaacctgaagcatggcagagagggtaagtcttctcttcttgcctctgctccttaagcctctacacacacttacacaaaaaataaaagaaggatattcactagctagttattctgtgcacctctgggatgatgacatcttctacattagcatgtattattatttttttaagacatcgttactctcccccttactccagacaaacactgttccagcctggtttcttcatctgtaaaacaaggatatcattacctcctttgaaggatagttgcaaggattaaatgagctaatgtatgcaaagtgcatacatatagttaatgggatctgtttcaaaggatgatggtgacgagcaacaggaacaactgcaagagtgtccagtggcatttcctgagcagtcatggcgtgcccaacatagtgcagagtgctgagtgatacatcagctcattgagcagaacagccccatgaggtcgacgctatgaagaatgccttgtttccagctggggaaatgatacaaggtcagaacacctaacatcagctccactccaggctgggatagaacaccctgcagcacagccactatcctttaagaaagccacaagatactgtctgtgaaggcaagctagagctgtacgttcctcaacaactgcaggtcattaatgtcaaattcaaggtgaagaacttgtgtggtttcagcaagagactgaactgaatcgattctctgcctggcccttggcatggccagtgaagcccagcttcaattacactggccatgtcctcagtgtggaaacctccctttcggatagacactcacttgaaaatgatccccgttggttccattttgtctgtccgaagcctgacaccaatgtgggtcatcttgcagcatctaaaaaagcgccctggaagggaagctgagtctcctcctcctagcagtcctgatttctactaacccagagagttaaagaccatcaccctacagattgaatctagggatggaatgccatttccataatggcaccttatgaagtgatcattccgtaaataaaggaagtcaaaaaggatgcctaaaaatgactggaaagcagacctcctaaattgttccatttcaggagtttaagcaccaattaactgagatactacacaaagacaatctatctagccttggtggcagtataaactgaggcaggagaagcttctttctgtcactaatgttttacttccatctctgtattccagccactctagcttttcctcaagctcatactgctctctccaaatcctgaaaactctgagcccttttgttcccccagggcatctgcagagcccagtactctccctagtgtttaataacccccctggcttgatgaatgggtgaccatttaccaaaatgaactttaatattagaatgaaagaaatggtgtgtaaggagaaaagggaggaaaagagagtagataatgaagatcttcaggggggattaggaaagaggacacccctgcataaagcttagggggaaaggagagagagagagacagacagacagacacacccctaaagacagaaactctcaactcttggtccaccatgagttgcaaaatgggtcaagtcagctgagtctccatcactcccaggtctttgactcttccagtcagtaaaacctgcgaaacctcacattgaaacagctcaccatgtgacccattgggacagatgctcttcagactacaacagaagctagctgagcattgtcatgcaaaaaggagagaaaatgaagtcaagggccacctggcagacaggatcatcctcatgcttgtaaggaggtagagcctcatgatatctcactcactgcctttgtccatctcaccgcctgttattgctgggtagaatttgcctagtttgggtatggtaggattttgcaccatctaatctgtggctagaggaagagtctcctgaaatttcaggcacacataaaagatttgttctgtatgtaggttcccaaccaggttattgtaaagggaagaggaacccagaggacccccagggagattggcacagatggctcacgaaatacctctccagactgagctctcccccagaaccacagcatatggggccactgcagactctttccaccatagccaggaccgtggttcctttggaggcccccgtggcctcacagacagcagagatcccccgcatggggagcagcaaacacctactatgcacaggttctttctggaagctacacactgggaaccacaaaatgttgacaaggacctcaccctagtctccttccttgaggaactactgtacctaagactacacctctgccattcaaagaggggtcacccaaggaagggacaaccttaaaggtgctggatctcccaccagattccctaaggagtcagactccccactggagtcagactgtacctagcatcaatgctcctctccatcagaaagccaagcaggaagaggcacccaaggcatcatttctggttttgaaacaggttcccttgtagccattctctgatatggagtctttcactttccttcttgaattgttttcatggcagaagcgcatgccctgtgggtaatttatggaagcaatacaggcataaccaagcttgagtcccactctctcctttttgatgagattcccaaactggccctaacaattacaagtgagaaagacgtggccctttctgtctccaggaccttttgaaacagaaattaaatccctcatttcccttcctgaagctgtgcctccctggattgtataactgtcttttagggaccacttgggtcaaatccccactgtttgttcttgtgcagcccaggagctcaaaattattttacatttcaatttttttgaagtcaaaagaatagtatttaatgacacatgaaaattagataaagttcaaattttagcgtccataaataaatgctatgcccattcatttatctatcatccacggatgcttcacaccataatggcagagtagctgagtagcttgagtagctgcaacagagacagtatagcctgaaaacagaaatatctgctctctggccctctatggaaatttcctgccaatccctggcattagaggactgggcctggccttacctaattctgcctcctgcttcgacacagctgtgatttttttttaatatatagacattctaaggaagatactccttcaaaatgtttggaggataaaacacaaactccttagcttggtataaagacctgaaacctaaccgccccaagacccccctgccctcttccaagcagtcattctgtggcacccttctctcaggacaacgggaaatgctggctcttcctgggaagatgatcctgctgccttgttcttctgaaccttggcatctgctgctctctcttctttttttttttcagtcagtgtcttgctgtgtcacccagattggagtgcagttcagcaaccatggctcaccgaagcctcgaactcctgggctcaagcaatcgtccagccttcccagtagctggactactggtgtgcaccaccacatccagcttaattgtttatttgttctgtagagatgagatcttgctatattgccccagctggtcttgaactcctggtctcaagcaatcctcccatgtcggccttccaaagtgacacaattacaggtataagccacctgttctcccttcttaaacctattttccatctctggctactaagagaattctttatcttttcgtaagtctcattttaagtctcacttcttttgtaacacttttctcaattcctcaaaaattagctcccctcccccttgggcccctcggtgttcaggacaggatcttggctctcatgatttgtcttcactaaccatagccggccttgctgggcagctggttctgggttcttcccactggatttgctaccaccagactaatttctgggaggggcatttttttctccttgtggttatgttcacagtacttaccttcaaggctggtgcaaagctaaggcttggtaaatgttgacacatgagagaccagagctatgattctaatgccattgcaatcccaatctaccagacaccattttgccacatcagttcaacttggcggcaatagcaggaagctgtgaccagggcctcacacttccctgaggtaaaattgaaaaaacatggaactttgggatataggcaaattggggtctaaatttccaggttgtgtgatctttgaaccttaatttcctcacctgcaaaatgggttattaatatccccaacttggcagagttgagaggattaagtgaagaagagaatgtgcccggcacacagcaggtgcacaaaaaatgccagctgtcatgctgatgctctgcctcggcaacagctctgggtctcttttgagaatggcagccgttcctcaaggcacagcaactccagggaaggccttggccattgccacctctccatcatggcagagaaatctgcattcacagcagttggctgagtggcttccaatggagcctggtctctctggacccctggcccagagacagagacccatagaggaggggctggtgtgaggcagccctggaggctcctggaaccttatgcctctcctgttacagatgcctgcttttgggggaggcttaggcagacagcgtggagtcagtttgtgctcagaaagcacctttgtcaaagagatgcctcagcatattgcctccacaacacagtctgtcatctcacccggagcctgtgcactggtctggctgaagtcagcctggtcagaaagctgccaggtacaagctcgctcccaaaaatgccagagcctcaaagaaagcccaggggaaggctggaagttctcagtgttctttcctctgtcttcttgaaagggcgtctagcatggcagaaaaacatcacggttctacagttctcttccagggagtagatagtcatttcttaacactctcatcactacttaaaaataaccaccagggctgtgtgtggtggctcatgcctgtaatcccagcactttgggaggccgaggcgggtggatcatttgaggtcaagagctcgagaccagcctggcaaatatggtgaaactccatctctactaaaaatacaaaaattatccaggtgtggtggtgcacacctgtaatcccagctactcgggaggctgaggcaggagaattgcttgaacccaggaggcagagtttgcagtgagctgagatcatgccactggactccatgctgggtgacagagtaagactgcctctcaaaaacaaacaaacaaacaaacaaacaaacaaacaaacaaaaccaccaaaccaagaatgaatgattgattctaaagtgctgttcacttactatgagctagcaactacacagattgcagtagaagggtttcctaatgagatcctccaaacagcccaagaggtaggaagtaaaatccctaatttacagatgaggaaactgaggatctgaaagacaagtgatcaagttgagggttccatatccatgtctgctggtctctagagtctttcttcctaatctcccagatcctcatttattagaaaggtagaaaaacgtgggctacatcagagatgctgagacagaggaaaagactcaagagaatttgaaagccataggaaaagctgcaaacggacagtacttgatcagaattctaggaatctaaatgggattttagaaaagagcatgtaacaagacagaagacaggaagacaacacaggtggatgaggacatttgcaaacaagtgagggcccctttgtctctactgatgcggcccagtgaccccattactcagtctcccaggatgctcatgagaaaagacaatccctgactccaaccccagttctaaaggcccagaattctcaagatgagcccagaaaaatgaccttcggggaagctcccacaaataagatttttgtacccttaagtttgaaaattgtatgggcatcacgtgtgacccctcagtttctcatggcctctctgtctacctctctctggggtggaaactgattctgcgtgatttttcctgtttctaccatcagagccctggcatctctcactactttctgatacacacaaagtgctccactgcagggcaggctggaatctggcttcctctgagcctacagcccagaaatgtgagtgagttcagtctggtgaagaactggtgggaagaacttttgattaagaggagatgggatggaagggagctggcagatacacttcctccctgctcctccctctggcaggctgacctaaggctctgtctggaaatgaacaactggcagtgtctactgtgagctgtgaagcagtggccagcttggtactgcatcactttgtatttgcttccatcctcctctctcatctctctgtgccctaactcatgctgccctgggattgcaattcccagtaaataactactgcttcatgcaggccataggctctggtttttcaggaacatgagctaatacaagaaccaatactctagactttacagtttgaagtgtcaggaatgcattcaatgtcttttgatacctgatcccttctcacctctgagccatggtgtactggtaaatgtttaataggcaagtctttgacaggaaaaaagcaccgatttttagtatttgccaatttctgtagcgtaaatgccttcaccacagctgactttaagctaccaatgtaaaattattaactacacagtggaaagatacctgcaataccacactaatacaggtcgggtatccctaatccaaaaatttgaagtccaaaatgctccaaaactgaagtgtttgcacaccaacatgatgctgaaaggaaatgctcattggagcatttcagatttctgattttcagattagggatactcagtcaataaatataatgcaaatattccaaactctgaaaaactctaaatccaagacacttctgatctcaagaatttgggataagggatatgaacccattaatagtatttctaccaaacagataacacagatatagataactttgagggtctcaagaatttgggatagggatataaacctgttaatggtatttctacgaaacagataacatagatgtagataactgcaagggcataaacaataaaatacagtaaaatcactaggaagtgatgatttcgtttagtttagtgatgtttagtttgttttgttagtttagtttagtttagtttgtttagtttagtttagtgatgatttgtttataatatatttagttgtaattttatataatttaattttaaataatggctgtttaataatcagcttgcaaaattcctgaaaatttgacaatctgattgtataagatattacaagcagatgtcagcataccactgtctctaagcttattatatcatccagtcaataatatcaaataccacttacttcctcatgcttttaatcatgctactccatcttttttgaaatgtcttcatttccctttgaatacccagtagattcctacccagcttttaccacttagctcaagctccctcctcaaggcataccctgaaagtccacaggtttgccatgatctggtttagcatgttgactgtagaaagagagttgtattgggtttctgcttttcacggtccctggccattgttgcctgaacccacaataataaccctgcagaaggagactgtaagctgagacattataggacctctgtgttaaaaggattggacccaagaatttgttggtggtattttctgatgaaattgaatatataacacaaattatggggacaagggttgagcaaggagagtagatccttgggcagcctttaaaaaatgtctctctcttattcttcatcttaaatcaaacacaattagacttacatttcagctacgtgggtaaattagataatctcttgggtaagttagataatctctctatgccatgggtaagttaggtaatctatctatgcctcaatttacacatctgaacaatgaggataattagtaataaccacaccatagagtcattgtaaggacacaacatatatgaaaagcttataatagtgcttggtatgagaaatgtgatcaataagtaccagctttgctgattatttctgttacgagtttctaccatccttgtatacatacaacatacaacaagctttaaaaaaaaaaaaaatcaagagacaggggcttgctatgttgcccaggctacacttaaactcccaggctcaagtgatcctcccaggtagctgcaactacaggctcgcaccacagcaccacagcacccagctcacgtacaagctcttctcagccaacactcctttcaacagacttcagcaagtgtagttttttttattcaattccattgctagtgccagctacatctacacttgggctgctgggggagagctaagaaagactttcttgccaaggtaatttcccgaagtttctgtttttggaggagaaaattagacaatggtcaagatcagcagtttgagggtggaagaggagaaaataagcttctctttgccaatgatcctgtcacagaattttccagactttcaggtgtagaggggaagcaaaaacagctctggccatgagcaagaagaaatagatcccccaatagagtcagcccaaatgcagagcacaaagaaactaagattgttttggttgtgggcatttgttctagtctacaatttgtacttcagccctgccgtttactacttacgtggccttgggcgtgttacagccctaaagactcagcttcctcctctgctcaatagagatactaatagcagccaaccctcagagtgttgcaaagattaagtgggatgacctgtgtcatacctaaacatgattaacctccagtaatgctagttatgattccaaagacaaagttcatgtgcaatttttcatttattcaactcatatgtgttaagtgcctactgtatgctgagtgctctctgatgggcaaagatataagatgagaaacacagatgcatcccaataagttgagcattatgaaggagacatgtgggtgctaaaggtccttaaatccatggctcaaaacttcattgggcactaagagaaggactcctgagggaagtgacatttaagccaaggcctgatgggtgcttcagggaagggcagtgaatgtctgaggcagccaccaagaaaatggttcaggggaagcacaccagcttctctcatgcaccttcacatttcagaatgtgacacctgtcctggaaactgatcactgaattgagcaaaccaacaggagaccatcacagctgaagtatctcacaattggagagagtgggtcttgggtttttcctgcctgtggggggccattttattagcacgaggattgttggaaacagccggaaagagtgtgaaagagaaatgtgtgcatttatacttgagctatgccatgttgaaaaagtgaattggaaactatgaactataaagagaaagaagaaagaaggaagggagggaggcaaagagggagagagggaaggaagagaggctggtccatcaacccactgtcaaagaaatatcatggcttaaagtcgcatatcctttgctttggctaattacattaatcagatttgtcatttcaaatgatcatagttcagtcctctacttcctggagctaaaattaaaaagcaatattggcactgatttatattattgtttattttctcacttaagagagaagggaagattggcatcagacttttcgggaatcagctccataacacaaagagaggggagtatgaggatagctgtgcccctggaagcaacacagaatgggcattttcattcatagttggaactcagtcccaggccctgaggatacaccgttgagtgatgcagatactccatgcctttctaagccttactacccagctagggttaaattcaagagtccagtggctttctttgggaagacaaaacaaaacaattttccctgtggatctaggatctttagcctagttctcatttgattataataggggctcctgattctttggaaggtatttgactttgagagatgatcacaggctaaccctcaggcttcctttctctcaagtcaaacaaattattcacagaatttgtttattcttgcctgggcacatgcatttcttttctgaaccaacagaaacactacaaaaccccttacctaggatgtgtcttttcaatctcgcctggtggctgtgtgtttgtttgtgagctgttgacattgatctaattgccgtttctgaaactacagtacagcttgttgtacaccagtgttgagcctgaggacactggccgtggtttgggcgggcttagctagtaaccggcttgcaccatcaagaagatggctgtggaggcccttgggttccagcaaatgatggtttgtgcacacacttaacattcttcattagaatgaaccactgttagaagcagacagcagtttggtttaccacttgaatcagcccgatcacccacattgcaagaacgaaaaggccccagttattcatggtcctcaacaatgtgtatctctatgtaaattctaaaggcatgacaactggtgaaaaataaactgggtcttccagaggggaagtcttcgagtggcaggtttcaaaagctacaggttcctccccaagaggcgcacatccctacctgtttctctgccttccgttctactagcaaagccaggaaacaaatattaggtgattgaaaagcttgaggcttccactgttttattgacttgtcactgcagacaaactgactataatttacttcaagagtaaattactagatgttcataaaaaaaaaactgctgtacattactatctgtaattaagatgttaagcatgattccatttttaaattggagaagccaacggaaatgaaaaatgctgatgatgctatatttcactctaatttttctttccctcctcttgattctatcaatttattgtttagctatctggttggcagatgggataaaacaaagcatggatgcttgaaagttctcctaccataacactgctgctttggttttatttgtgttgtgttgtgtttctctcctatatctatgtcaccttttttgagacagggtctggctctgtcatctaggctggagtgcagtgacacaatcacagttcgctgcagctgtgaacctctggggctcaagcaatcctcctgctttagccttctgagtagctgggactacaggcatgggccaccatgtgtggctgattatttttagaactatttttgtagagatggggtcttgctactttgcccaggctgatcttgaacccctggcctcaagcaattctcctgcctcggcttcccaaagtactgggactacaggtgcacctgggccaggtgcaccactgtacctggccaccaacagtattcttaaatgaaattccatgtcacatattactttggagacattattggttaaatcatgaagtgaaaaggatttgagatgaacgcgaagagacaggaagcctgtgtaagcctccatctggacatttcaaattaagttgaacaaatacaatgttgaaaaggaaacatacgaacgaacaaaaagcaagctgaaaaaaaaaaaacctgaactattttgtttttctacaactgtatgcaattgtggaagctgttgaaggatcccaggaactatcagtccaaaatatgatgcaatggtttgctgactacttcaagctaaaggcatttgagaaatagcaaatgcacagaaggtcttttttttttctttctgaatctcccttacctaactaaatgcacattttccataagatactcactgtcatgaaaatcctcctgaggaatttttatatctatctgggaagattaacacacaacaggaatgagcctagaagtcactggaaattggctactcatccagagaggccactgcctattcttctgaaagcccattcacgttttcataatccctaggtcacctccactaccctcccaactcccctgtgaaggacgcccttcagtgacgaggtgtggcgggaaatagggggaacacacagagcaggactacctaactgttttggagaaattcaacagccatgtaggtctttttggttctcaactgcattcaaggtttgctctacccatccttgcctaggggatttcatccactctgctacctcaatgctgtcctgccgtctacagctgcaaaacttagatttttagtctaagtctttgctttcatcccaagacctgtatctttaactggctctctgacatatcaaattccacatgtgatgaaatcttctgggtcacactgggctcatgggcacacatttctcttccacatgatgccccttacacattaacagaatttgtatgcttttctcttgttcatctgcctattgctggtgtattttaaacatttttttttcctagatgtcctttattaagtgataaaatttccctctcttcctagtttgaagttttctttcttttttttttttatatatactttaagttttagggtacatgtgcacaacgtgcaggttagttacatatgtatacatgtgccatgttggtgtgctgcacccattaactcgtcatttaccattaggtatatctcctaatgctatccctcccccctcccctcaccccaaaacagtccccggtgtgtgatgttccccttcctgtgcccacgtgttctcattgttaaattcccacctacgagtgagaacatgcagtgtttggttttttgtccttgcgatagtttgctgagaatgagggtttccagcttcatccatgtccctacaaaggaaacattttacactggaaccttcaggaaagggagcaggaatctccactgcccctacaatgtcttgaggagaagaagaaaaaatggtcttcaaagccaaataaaaattagaagaattatccacacacttccgaatgaaactcaatggactgagaagagaggagacggtgtgtttggatgtttgacaggaatgacctccaaagctaggattaaccaagagtaactatttgccttcatttatacagaaaatatttgttgagcacctgaagtattgcagggcactcagctgggtacaagcgagccaagagtagacacaacagtatctctggttcaacatgagccgtttgtccccaggctcacaatcacttatgtttgcaagctcaaaaccactgggcagctattacctcttgttggtcttcagcgttctaacacattccttgctctacttggaaaacattccccctttccatccctattcccttaacttctcaagacataatcctgctcatccctaaatattcaacttaaaacatgtaatattcagaccacgtctagtcacaccattctgttcccagtctttacggtacttggcataattgtaatgaattacttgtgtaaagctcatctacaccaacgaattgtgaagcagtacaaagacatggacaaggtttgttttgttcccattgatagtcccagcatctcactgccttaaacaatagtttcttcatagatgatgtgacccgtgaatgaataaatggatggaaggataaggaaatggcaagtgaactccctcaccagctccaggacctataggagtcagagatatagttattacccttgggaaaaatacattttgtaggcttaaaggcccattgtctaaccagaccacaaaacatttctttacatcatctacaccctggctgccaactaacaccacagaaggtctttcagccttgtccctgaacacagacctaagaacacaaatttctcaacatctgtagacctcggactccaggctgaagtgccaagatctctctaatcctcattcttaatcccccatgctttggagaaggccacccactcaccacaaagctgttgtccagggctccaactcagtattgtactcactcctaggaaaacaagtggaagatgaagaggagacatcatcccacccaggaagtgggtctggttatgagaccgtcatacttgcctgcctggattcaggcccctccccaggtccagaaaacagagtagatctttcccttctttttcagatccaaatcaaattcaaacaaaacaaaagcaaaaatccttcaggcctcaatttcaaattcaaatgtgtctactggtcagcaggttcatttgtgcctcctcctgtccattcatccgttcagcaaatatcaagtcagtgttacatctaggcttgcactaggtggttatactatggaaacagacagcagaacttacgctcaggaggatttatcgtacgggctgaaggctgtacccataaagcactggactttccagacaccaaagctaaacctcaatctggcaggtaaaggttttcaactggataactcaagtaactctgaaaactctagagcttagtgcatcgtctcatgtgacagccgctgcccatgtgtggttacagaacactggcaatgtggccagtgtgtctctagaactaaattattaattttgtttgactctaactactttgtgtttaaatttaaaaactgaagcagtgaaaatattgtttctttctgttaagtacatctttattgttgtggtcaaactccatttcactttaaccttattgaacatttagaatccaaattgagatatacatcaaattttaaagacttggcaccaaaaaaaaaaaaagatttgtgaaatatctcagtaatacattttttataatgagtatgcattgatatcataatacttttgatttatggcatttaaaataatattaaaaatcattttagctgtttctctttacttttttaaatgaggctgttacaaaatttaagatttaaaatgtggcttacattatatttcttattggacagctatagatgtcttaataattagctagcaaacacacacacacacacacacacacacaaacacacacacgtgtgaccactgagatgttctcagggagttttcatatctgattccttacactcacctagcaattctggttgagaagtaaaaagccttctactcctttttaatttcacatccaaaaagtatcatccaaactcctcaggacaggatcacctgtgatcatttttggatgttgggaaagccagcctcaaactattagcttaggtttgaagtttattcttaatctagttcataattccacgtatttcaaaggaaaaaagagagacctttcaggcaggtgggatgcatttcaagtggagcagaccctgctttcaacagattccctcccccatggccactgccgccccttcaggcctcctgggatttctgctaagtggctttcactacataattaaatgcaaagtcctggcagggcagcgttcctcctctttaccttagcaattttttgttttgttttgtttcaggagaagacggaaggagtatttcttggtcctaggaagtgtgcctgccttgctggaagacttcttttttgcatttgttacctagaagtttctttcttctagttgcgggggagaaggaaagaagaattatggggaagaaaagtgaggaatcagtttatagccgaataaggtcaacagtgtcaactggggacccagagataggcaagggggaagtagctatgaactgggcacactggtttacttagaaataatacatctttgagcctgataacttccctgatggaagaagacttccactgggcacatcctgaagaagccgcactgtttacaaagtactgtcacccacagcgccttcttttgtccatgtgacaactctcggggcatggagcaccctgtggcagcccacagtggtccgacccacccatcttctttgttaatgaaagtcaggattttattcaggtctgcccagacagtgtggctgtggggaaatctggcagatccccagccctgtggagcatgtgtggggtgaaccttgaccagtccaaacctgtaatggttaattgcataaccaaggccaaccattgacagagggatggacgcctgacaattgcagcctattaactatgtggggaagcgacttctgcaaaacattccttgctcttacgaaggaataaagggctgcacactctctgcctctggttttgggtgggctggtgtaaaaaatgtggtacctcgaaccttacacatgtcttacatctgaagcttgagaatggtggagctgggagagggcaagagtccgggccctgacatcattcagctgtggaaataaacagctttgcaagggcacctacccttggacttcttacgggagataactagtcccagggtgttcacaccattcagagccaaattttctgctaccaaagacccaaaatacccagttacaatcctctacgttgcctctgcaagctgggtctatgggagttgaacccggcccaattacctgtttttgtggaaaaaagaagctttattgaaacacaaccaggggcattcatttacatattgtcgatggcagggttgagcagctgcagcagagatcatgtggcccttgaaacctaaatgattgactacctggccatttacagaaaaggtctgctgacctgggactatgatatcacaactctcccttacctccctttcactcagtgatatggtttcgctgtgtccccacccaaatctcaccttgaactgtaggtcccacaatcttcacgtgttgtggggggggggaccagttgggaggtgactgaatcatgggggtggttacctccatgctgttcttgtgatagtgagttctcatgagatctgatgctgttataaggggctcttttcccttcgctcagcacttctccttcccgccttcatgttgcttccccttctgccataattgtaagtttcctgacgcctctccagccatgctgaactctgagtcaactaaacttctttcctttataaattacccagtcccaggtatgtgtttattagtataagaatggactgataaacttagcaggctcagggatgttgaaaaccctatactgagagcactattctgaaatattccgaggtaggcagtattttctcccacttgatagatgaggaaactgaagttcagaaagagacagtctcttgcttcaagtcacacagctagaaactgacaggacaaggattggacatcaagtctggcagactctaggccatgcacaattcaccctgcactgatagaccctgggccactctgatcctcctggctcttaggtctaggtttgtgtattaaaaacaaacaaacgcaaccaaacaaaacccaaccaactcacaggtaattctgatctgcatccagaacaacatctctgtagatcatcagtttcttttttttaaagaaatgtacatatccatatatctgtaaggaccaattaattgccaacactctgccattagagatacaaagacaatccccatgcatcaatataggacacagtttcatctttgtggcacttttagaccaatgtgggacagattaatcttagggtcttacaaaaggctgtaagagctgagggaatggtcggaggggcctgggctgggattcacagcagggagtggggactgtactgcaagacccccagtcctccctgttgatggcccagtggatccgtgctgagctgacggagtgatggtgcttctgggaaggaagggcccatgggagcatcttgcccacctttcagtgctaaccaaaccaaccatctctggagggttgatcctggacatgcattcctttcactctgcaccctcgtggccatttggccctcctgaccacgccacaagtgtggatcttgggggaagaagccaaggttcaagagcaaagtgtaatgtcccccatcccccagcctgagttagtggatgaaccctgaactggagtctacttggcctgaatccttcatcttggtgagatgtgcagggccctaaggaacctccagttcccgactccttccacacttcatggaaatgggactctcacccggagggaaaaggcctttggaaccctgtggtttgatttccaaatcctctttggctgctgaagcttttgaggctctgatggatgtagggaccctctttccagaaaaatggacttggatagaatcttgaatacctcttagggcattttatagagtcctggaaggtaatcttttggctgtctgggatgaagtaaatgcatataaagaaagactacctacaattgagatgcaaacattaggtggggcatggtggctcacgcctgtaatgccagcactttgggaggctaaggcaggcagatcacaaggtcaggagttcgagaccagcctggccaacatggcgaaaccctgtctctactaaaaatacaaaaattagacaggcattgtggcaggagcttgtaatcccagctacttgggaggctgaggcaggagaatcgcttgaacccaggagacagaggttgcagtgagccaagatcgtgccattgcactgtagcctgggtgacaagagcaagactccacctcagaaaaaaaaaaatgcaaatattagctagaggggtcactcattcaatctgagttttgattactaccttagtttgattatacacatacacagatacatccacatactgtcaaatcaactgagaaacggatccatagaagccacaaggcaagggatttttttgttttatctttttgctttttcttttttaaaaaaagtaagtaaaaaaaatgaccaatgatattagcaaactagttttgtctgtttgtatatttttcctgtcctgatctgggtcaaatttaatgagaattaaataaagtgagggcttcagaaggtgaagcatggcctctccccactgggcttggcacaaggccttgctgggtatctcctccctgcctaccatcgcctccatgagcagctcagtgatctgcatttccaataagtaaatcccatctacagggcaacaggctttcctatgtctagggagatgtgtgcaaaataccttctagtcctcagaaatggaatcttccacctgccagctaatgtctctttgagttccctatttatttttataaggctctaaaggtgaattttctcctgcgtcgcagagctgaaagttaagcttaatgtacaaatctttattttccaaagaggcaggttggccttcttgtatcgacagactccagagcttagatttattacagaatgataatcaggcaaaagaataaataagctgcatctttaattcattaatcacctcggaaagcaaaatgaactacagtaaagaggacaatatgttttcaaatgttgggggtgggggaagagggagtctgtttctcaataaaatccagtcgctaaaatccattttgcatgcagattagagaaagggcattttacctctgcggctgtagttcagataggagctggaagctctgcaaaggaagtctggcagggatgggtgtctgtggatggcccctaatggtccctggtgtcttccactgggttcctgttgtaactcacaagatgacccacaggcttattaagagcccaggtgttggaatcagacagacctgggttcaaattcctgttctatctggaaaatgggaaggcctgtagggagccttcctaattcatttattgccttgagacatgtctacctcatggtaggtgagtctgaaggtcttttatcttctcaacatttcacttcaccaaattctcattaaaacaggcatacactgaggctagaaacatgaggtaaaaattaaacatcaggttttttagtggccacatgcacttgagcactgttggagatatcatccggtttctgagtcttggatctggcctgcaatactaaatagttgctgttatttttgctgctgttcctgagtccttgccacctgaaaactagaaatttgctgcctttccaccttttagtggacctacaaattgagaagtagtaagtgagcatcttgaacccttcaagacaaccttcagaatcaaggcctgtgtaaacatctaacagaaatggcaataatagatcatgtttactgagcacttctaggggctttacgtagattatctcctttaatccttacaagcattcttcagaacactgagtctgttactgtgcccattttacagatgagaagaacagatccaaagaggttaagccccctcatgcaagtttatgtcactaaattagtcagctagaaggttaagcatgtctaccatgtactgagcacttcctgcctaagtccctgcaggatctcattcattcgtagcaacaatctagaaagacaggtctcactattcccacttcacctaggaagccaaacagcctcagagagtttaaaccagagtttctcagtcccagcataattgacatcgagggtcggataacgctttgtgggagggtcttccctgtgcattgtagaatgtttagcattatccctcgtctcaacctcactggaggccagtggcccccctgccttgagtcttggcaaccaaaaatgccttcagacattgccaaatgtccctggaggagcagcatcctccagttgagacccattgctttaaacaggtgagtttctctggatggcagctgcagagctggggatgggatgtggtctttaactcctctatcagattgttttccaaatcctgctttagttactgaaggcagaggttctcaagtgctcaaatgtggtccctgttccaatatcacctggaaacaggtttgaaacgtaattctcaggctctacactcagactgcctgaatcggaaactcggggtgaggccatgcaatgtgtgattctgatgttcactgaagtttagaactcgtgccttagaacagtgcttcttagccttagctacacagtacagtcacccagggagctttgaaaaaattattgatgcctgggtaccaccccaggattatttaattgatctgggctggggaataggcatttgtatttgaaaagcttttcagatgattttcacaagtgaccaatgttaggaaccaccaacctagagggagctgtccccggctcttagggaggcaggggtcaaagtaaaacaagttaaatacaaacaattgacgttggcttcatgatccatcagctggaatccgggagggatgcagcaaagaccaggtggtgggatcctttgctgtcagcttcaaaccacagcccccaaagccccactcctgtctttgttctttttttttttttttttttggatctttcttccattgatttatctaaatttcttcagctgtttggaagctatttatttagactctacaccagctcaaaaggttaagaaagccattaaattgacaggttgatgcttttcatgctgttggacatatctgcaaggtaaaggaattattgctttggatggaaataagatttacctttctttctaacactacctaagcatccttctgggctctgcctaatctaacccctccctccagccctggccttccaaaatgtcctgttatccccccatccctcctcagctctttgctggcctatcttctccccagtctttcagattccaaagccatttccttattaacccagccatgttccctcctatcctattccctatagccctggagcatcctatcacttcttcctgggtatccataacctctccattttccaagatctttctttgacatctccagcccacagccatctctaacttctctgcttagtttgtgcttaccaccagactagcaatagcagatatacatttgatactcctgtgttgaaatcgttcatctgggaagctcacgcaatggtgtgccgctaggtgtttaacaactggctctatgggtgggtcaggataaggaaacgggctctgattttacagcatttgtattcccttctgcaaatattcccacgatggccaatttcatgctaccagtgtaaagtccccagatgtggaattgagaagatacaatacaactggtccttctgagcccatgcctatgggcatactactgacagtcaatccagcaaacatttactgggaatatgttctgtgcgagtttctgtgctaaatgctgagcgtaaggaggaaaagagcagccagctggtattggcacttaacagatgccgcctgggttccttcatttaacctgtataagaattccatcagatctgttctagcattctcatctgaaaggtgaggaaaccaagcgtctatagagggaaagtgactttcccaaagtcacaaagctagaaaggtctggcactgatgactgtgtagtttgctccaccctgaggaatccccacatttccagttaaaaaaaaaaaaaaagtgatcctttgctacatccaagactgtctgagctgacatttccttagagagaagtacatctcatagatattcaaatttggctgcatagaacttagtgtcccagggggatgagcgggagggaggaaggtctaagaacttgaagaatcagctccaccctcagtggcttccaacttctcttttacatagtgatcccagatacactttcattttccaaaacggctcctctgcagaaacaaaacaaaataaaaccggtatgaaaacgtctgattcatgccaaatccctaaatttatggaggtggtaactgaagcccagggagcttctagtggtcatttccaccactccataattctttctagcctggtgcagtattagcatactacaagaaaaaaacatctcagcggaattttttttttttttttttttttttacaaatgcaccaaagcccagtacttccccataaaatgggaaactgttaaggcaaaattttaagcatgccaagaactgcatcctgtaggccaaacgtagtgggttcaaatctctctatcctctgctctcctaggttcaggcaggatagatctacaggtctacaaggtttccagccttggcatcaccagcttctcttaacccagtcaaatctagattcacgaaggagctccaactggacccatgctggaaatgcttttcagccacgttgaacaaaacatgttttacatcatttctttgcaggaagttttgtccctgcttccaggacttcccccaagtgcaacaaggtcaaagaattagaactgcaaaatctccccctttctttgccagcccctgcccctgcctgactcactcttcattttccttctcctaagaaaagactatgactgcattggtgtattttaagatataactcacaaattaaaaactgaaagaagaaacacatttttctgtcaatggcttaaggggattccacctctaagctgctgctaaagctttttcagtcttttttacatttgtagcattttggagcaatttgctggagtcaaagaaaacagtgaaatttccacaaccaacttcaaagcccccaaatcctgtatcggtggaggggagtctggtagcaacaccacaggggccgtttttcaaagaggtgtgtggagggacgtgccaggcatttttgccctgcatctgcgattgatgttaatggcaggcacgtgaccaaatccccatgtagttctttgaaaaatgcccctccctttcttcccccaacacttttggctgtgacaatgcagatgatacagaaaaatcctagaacagaggaaccgctgccacagctcaatgaacaataccggccttaattcaattaacgcacatacgtctcttttatctggtggagagctcagagcaaattcaggttgatcaggaggaggggctacctggacggtttcacatttgaaaatgttttgcatttgaaaaatgaattctaggcagaagtggcttcagaggagggaaacatgccaaatgccaggcactgaccactttagttcattcctctcttgagtttcagcctcctgttttcacgccttatttggcctgaccttcgaatttcttcttgatctgcgccctgtctacccatcttggcttgtgtccgaggcaatccttcctccccaactcacacacataaacacactgtttattccagctatatccaaagtgctgtattgaattaaaattcccaaacatgaaatgtgtataaaaaggtgttatgtctgtgaatagtctgtgctataagatgctataaatattagctgcttaagaggttacccaatttaaatgctcacaatggtgtatggagactgccaatcattctatgttctagccaaaagaaaatatcattattatgtggttgtgaggaaggttgaacattgtttcataatgttattggccattcatgtgtattttttttccccaaaaactgtccattcttctctggacattttcctattaggtcatttatcttcttatggatttccaggagctatttatattaaggaaattaggtttttgactatcttgtggttgcaactttccccacttagtgttttcatatttttgttgtgtttttgttttgttgtgcttttgctctgcataagttttaaatgcttatgtcatcaaacttaccgagcctttgctttacagcatttgggttttacatcaggctaaggaaaatcttccatatcccagattaaaaatctaggttgcttttgatacttttgaagcttttgtttttatgcatggtgtttacaaaatggttacacccctcctgttcacctcataaacccatgtttgaaaaattccccgccctttcttcccccatatcttctggaaagcattgatcaaacaggaccagcatttatgtttttaactgtcttaatcaataataaatcttgaaagcaagaatgcgttttatttgtttctatatcctcagcaccatgttcattttctactgtataggtaatacacaatagatatttgttcaatgaaatcttaaaataattaaagcttaataactttgacaacaaaccagtcagagaaaaaaagacgaactttctaatatatgtccaaagaagaacattaagtaatagcactagtgcagactacatttaacaggctgtccaggaaaggaaacttagtctgcaaaagtgacaaggaaatgtcaggctaggggtcttttgaaaacctagaacaaagttaagagaataacttctaattttgacagattgcaaagatgtcatcttggtcatttcacaaacttttaccaggctcttatctcccgttcgtttgcctgtttgtgtacctaattgcttattcaggtataccgtgccgcattctggaaaggatctgagacagctactatgtgctactcaccgatacagggctgtgttggacacaaaaataaatgaggcgtgaacttcacgctcacagagtttagcgtccaagaggagatgagaaatttaaaacgtaattgtcttacaaggcagagtgaagagtgcctttggagcaggcccacttttgtgtggtttaatactatgctttagaggagaatcaatgagtctgacagtgtgcgatcaagtatcttggttaattccagccagcaccattttccctcagtcctgtttctactttagccccaatcacacagtaaataagtgtctgatgatgacaaataaataaatattttattggtatctgcagaagtctgtgcaaataatttgggaatacctccatccttgtgacttgataactaaatacattattctcttttctctgcagaatgtttttaaaaacaccatcaacaccgttaaaatgagccattctaacacctcaaaatcgtctatgcatctctcttagttcaagtgctggctctgggatgaactgatcacttcactgatttcgtgagacccatggaagacctctgaccatagctcaattgacccattttccaaaagagaagagtgagactcagcagggcaatcgggggaatgtgacctacccaggtcacatggctgctttagtggctaagtctggcttcaaactgaggcttctagacaccaacttcaactcactttccctgggcaccttacctgactgccttgggcttgcttataaagaatagcattgatgtcaatgaagaactaggaagggcagatgaagcaggggaaatgcaaagcaactgttcatccctttccattttaaactggacctcagacatgctgagttgtaaaactcagagtaaaatatgggaaattcaccagcagcttcttgcctttctgggtttcagtagataactgtgtccctggggttcttctactaggagttctcaatcctaattgtacatcagaatcactgggaattttttttttttttttaatactgatgtctgagccccaacggccactaaaggttcttgattcatgtggtctgaggcacggcatcaatgtttttaaagtcccacaaaccagtctttagattcagagacccgtttatgccccaatcctactcactcctctcttctaaaggggtgcacatgaatctcagtacaagtttccctctcccctattgtgaagtggtcattgcccaagccttacccaatgccatgaccccattatcagaaaagcaggcagctgaccatgaaggcccacccttggctactgctgattgaacaagagatatacacctgactaagaggagacagtcagctatcttttctgacaattcctataaccccattttcagaaaatctaatgaagcaggcaaggggccatgaggactcactcttagctactgctgactggacaagagatgaacacctgaccaagaggagccaatcagctatcttttctgagaattggagcttagagactctagccaacctctgctgagggtttcaaaggaactggcatgtttagggtgggacccaggggtgatggtgggaataatttgtactgcacagtagagaaggcctgcctgctttctggaggtagaacaaagcagatgtgcaaaaagagaaaagggaggaacgtgggacaaagagaatgtaccttcatccccaatttttcccgctagccagcttctattttatatccttaatagataccttcatacctataacaaaggaacagaaacctgaaagcatagtttttatatccaaagaatccctggccaagaccctaggaaattaacacattcttatactacctctgctttccttggaaggctcattccatcacaaatgtctgggtcaatttaatcagtgatcctggattttctacaagaacagagagtcctaaaccggggtcctgaaatcccacagggagcctatgaacacagtaaaggtactcatgagccactcccactattaatgggaataatgacctttaccccactgtaaaaacctatagggttaccctcataaggttttcttatcttctgagtatacatcaatggaattgtatcactgctcttgcttttctgattaataaaatgaatacaaagaatgacaaatgaatttttcagataatggtttcatggggagagattaataaaagagtcctgtggtactaaaaaaaaaaaaaaaaaaaaaaaaaaaaggaccagtactttaggcaaccatttttcaaaagtgccccatacaatgtgaattccatcaggcgattgattaaaaaactggttccatgttcttggaagtttgaaagataccatataccacctgagctggtccttccccacggagggtcgtcatgcatgttagtatacaaagcctctgaggcggatgatagcaagattaaatgtttaactttctctgacccttaattttcctaaattgtttgaccacaaaactccctaagcacaactttatttatttttcaggaggagtgctatttttttttttcagaggagggcagctataaactaacgttgtatgtttttcttagttttccaatcttgaaaaacttaaagtgtaggagggaaacgtccaatatcataacggcaaagtgattctaaaacaaaccaaggcttgcaaggtgtcaaggtcaaatttttattccatataatattgtccaaggccaagcatggcagagtgtttaccctgtgccaggtgctttacatacattatcatatttaatccaggtgctttacatacattaccatatttagtcctctacacatgcctttgaggggctattcctatcttacagatgcagaaactttgtatcctttttagtgttactacagattttgctgataactttttattaaatgggacttttattagagtgatttaatgctgatttatcttcactatccagtaatttcctgagtgccagcagtgcacctgatactttacacattacagggtattaacgaaatgtgccatctattgttttttaaatggtcataaaaggacactctctttttcagtagaaaaaaagccactcattacctaccaatatcaaaccacagaatcatttgttttcagagccggaggggtcttggatcaagaccactggcagccacagctccagccttgatactaatcacattatatgcattttcttctgggcctcagtcaaccctactgagaaaaagatgacaaagacggagaggagggcacctgggctcctactacatgtgctgaggtgaaaaacgggctgcttaactaaggaggaatgagggaatcaactggtcgagatagtgtctatctagaaatatctgcatgactgtggtgaagggtcaattgataccttaattgctttgtgcctgagtctcctaatctgtgtgaaggagattagaatatctgcctctctattcattgttacaggtcaaagatggcatagatctggtgtccaggagacactcggtgcatggtagctgttgtcatcatagcccatggaggttttgggtgacctccaaagggcagggcttcgggaacatcactgtcttctgctccacggaagttgtctctaactcctgacatgctggaatagccctcaagtgatcagaagaaatgctaaatgttaacttttctgtacatatttttaaaatctgactttcataatagtctccactgttgtagagttagagaaaaatgaaagtctatctatagtaaaattttgtgattaaatattatggtgcaatgccccaaaaatgaaatgttctgaatcttgactgtggatctccatgtatattttaaaacttccatcgacccctttttctacattttcctcttcattttggtgacctttgcagaaactgagctctgggtaacctctgactcagtctgttcaatacccttgacattggttacatatgctggcattctggtttcaaatttatgtctttggtacctttgtaaaagtatttcccaatttctgaactaatgagcccataataaatagcaaataacaagcagaatagctgttttaaaaatatatatttcaattaatgagataatctggcattaatttaaaatgatcacttttttaaaccagcatttataaatttaactccttggctaaacatgttattgtatacctataatatgctatgtgcactgtatttgtaatttacagaatacattgatttttattttattttattggtatgctttggggtgagtttttttaagatttataccagggacccattttgccccagagagtcacaccatgctttcttcagtattaatgaatccaaaggctaaatgcccaggactcaggtgcatgccgatatttatattgatactcatgatcaatttcttctctactttcacacgatgtatcatttttcaaatgtaaagattttattatgtagtgctttgtttctagatagaattctatagctctattcatttctcatattaacaggataatatttaaatttgaaaaaaacagacatggaaatataaaatgagaaaactacaagactcccccaataaataacacttatctcccatttgacaaatattagagaagctttgacacacaaagccttttaaaaagccatccgtccaagttgaaacccaatggtcctgagaaatagataaataaatttcacttgctattaatcgcaaattactttttcctttaaaaaaattaattaaacacactacatgaaataaatatttcaggcgaccagcagcaaaatgggaaaataccatgtgtttggagctttagggccctctgagtacagaaatttatttgcagcaagcagaaaatagacagcaagcataaaaatacagcagagtccccctagtaaaattatttatcaagctaacaagggagggacccttccagtaacaacaagccagccaggaaaagacatggctttatattttacctttgggttagcaaaccagtaaaaatgccaactgacaagcacttcacataaacatttctttctaaatgagcttccttgttagggggaaagaaaaaaaaagtcttccaagctaaggagccctatagcttacagacagagaattctagtgcgcatactctgactctttgatgcaaaaataatactccttcatgaaaaagtaagggaatgtgaattatgaatggagtttaaataacaaattagaagttcattaaagaaaatgtgcttatatcccatcaatgtatccttgtacttggatgttagaaaaagtcacagtttcagaagatgctttttcaagaccagctttaacaatctgtgaaacaaaacacatatatatttatatacacagatatatatgtgctgacattgcctctaccatacaagcctcattactatattttttcaaatatttattttatgagcaaaaccccaaagtcggtttttacagtttagtttaccgataccaaactttgattataaattacaagtcactttattgcagcttgcaataccaaaagaaaaaggaaaaagggaaagaaaagaaaagaaacaataaaaggaacccttgagtcacagtggcctgatcccaattaaatttcaaagaaatagtaaaaagatgcattctccgaataactgcctcactgccttctcaatagctctacaaataactcctgacaaattcacaatgaaatcacacactaggatctcatctttcctaaagtgaaaatgtcattgtttaaccatggcaaacatgggaaggtgcctttattattattagtgtggaaggaaatgatgctgaagaggatgggaatatctgaatggcactgtgacatgttgagtaaagatagaaagaaacatcttgcaggaaccacacaccagcccagcctcctaccaatacttgagaaaataaaatttctcagcaacagcgatggcatgttttttttattactaatattacccctctcaaacaaaataggacgaaaacaaataaaaagaaacccttccttattatttcccccctctcttgaacagagtgacatttcaccacgcctctgtcaaacctcccactctcaggcagagaccaagttgcaccctgtatttttcttccagggtcaggaccaaaacactccaacactaaccctatcagcctgatttgagaactgggtctattatgtggccacagatctgcagggatggtttgtagcacaggtcatgtgctatttcatgaccatagcctttgttgcccttagactagggtcttgtcaggatgctaccaagtgatcaaagatcagagcaaacagatggaacagtctaaataacacggttcccccaaactgcacatgctgactagaatgcctaggacacatcaatgaacaactttatcactgacaaataagatgaggagaggctgaaagcagaagttctggaagttctgattctgtggttccgctggattagaaaaacatcgaagatgcagagacagtacctcgggggaaagaatgggatgccagggggcttcgaaggtctgatgagtctccagacgctgcttggagggagaacagctgggatccctcagacctgggcagctgagtggccccagctccacggcttagagaaatcctggccccatcacaaattctttctcctcccctactgtgacagatgcagcctcaaacctccgaacctgcttggtaaagctcatgtagcctgtgcacttttcattttcattctactaggtaatggtgagaaactgttccaggctttaaaaggagaaaaaaaaaaatagaagaaaaattttaaaataagaagtctggagaaaaccaataccaaataaacaaaatagcctttgagcgttgggagagaacttcaagtatgtgctacccactggagcaaagaatgagaaagcagttcttagtttgggtcaaataggtcaacacgggtaaaggaatttctgatctctcttggctacccttactgctgagagaagagagatgccaagcatctcttccagcagactcacacgccttctaaaatgcagtgcttgatttcaacactattaaatgtacagtaagcaccttaagtttttttaaaagaattctaatcactccattaaaaagaggagagagaagaggaaaagaagtaatgaaagttaaacagaaaattccattctgctattcagaatgttcagcccagtaagagaccctcatgttcgctttctcccccatttcctgttcatcaggaatgaacctcattttaaaatataaacaagccagaggcacaccacagcagtatagactcagccctttaattaactaccaccggcaacaaaaggtctctattttgattaactttgcagaggggggagtcaaccctggcgttagaatccctttaaataattacaaaccccaactcaactctgctgctggcagcacccaggagccagggaagaagaaaagaaactttgtctgtggaacccaatttaaaggaagagcgacctcagggtcaatttctcggagcatttcagatcaattcaattctcacctctactgcctacctgctagcaaatgaacttactgtgcttttcaatagactgagaggactaaaaagaaatcgtcaccactgcatgtgaaaaaaacacattattagatgatgcttgccgagggaaaacacaatcctaccgacaaaaatctgccttcacctctctttttggactgtcaggctcaccgtactgatgattaagttgtacaatgcacccctggattgttaattacgtgttaatgtcattccgcaggcttacacctgaggtcactgctcggtggccaccttgtctctattgacaatacctgtaaatctctcagctggttggattttcccactgagtacctgacactatgtccttccatttggtattagttcctatgtgaaattttataagtgctaataattttactgtatttcctatagatacagaaaacagaggcgtgctgaattttcccactgtcttactgttgtcctgccattttcctaagagtgcaaaatagagaccgaaaacaaacccacaaaactcaaccctgctgctttagctcatttattgctgataatttcattaggtgtcaggagaagccaaaactgcagacacaaaacaacaactttacagtaatttttggatggaggaaataaaagattcagcaagcagcaggtgaagggagtttaaacattggcatctgtgaacggcggcagtaaatcggagattttggcaggtgactgaacgtgtgcttttagaatgaaagctctacagaagcatcattttgttttaagtaagtaatgagtgctgcacttttgcagaaattccttcgttttattttttatttctaaatgcttaatgtttctttaagttggctccttcaatagtaccccagagttgactgaaaataatacaagtttatatggcataattaggctagttacgctgcacatgctctgctataattaattgattaaatcggctcagtagtgggccagtgcccacagaaagaaaaacgttagccaggctgtatggaaagggggtgatgtggtagttagggaggagtataatccaaataagcaacaataacaaaaaaacaatttagggtaaatccaaataataaaatgctttaaatgaaattgtttggccttattttctcagtgccaacagatatattgatgtaattagcttaagacatactcgtcgaatttgggatagatgggtctctgctccaaatctacagcagagagcattctccttcccttcttgtgggtgggggatttactcttaaaaccgaatatttagaagccctggggggccttcagtgaagatggggtcaagaccagccacctggatttttcaaatagaggcaccaagaaatcagaactcacagtgttggttttcacatgtcttttgtatggcaccacgtggttcaccatttctgttaaaatatgttgatgggttctgcaagggaaatttggttatggcttctttacttttacatttgaaagaagtagctatacacgttgcgctaagacacccacaccaacactcagcatcaggaaaccacatttgcattttatttctggatgattacgggcaacacagaaggacaggcgtgcaagatagaaacaagatttctgagtactttttactgtttttgttttgctttgtttttccccagttcacaaaatcataaagccttccttacgtttgacaactgtttgaattcatgtcatcggattaggtgtaatcagggtaaacgatgtccactccatctgccgattgtaagactagaaaaaaaatatcgatgggtacttaaggcccaggaagtgctgtttataccagttccatcagtttctcccttaggtgacaggaaagctacaaatgggcctctcccctaggtaagtaagtgtcccacctgccctgccctgagacaactctgtaaggtctggttgcatccggatgggtcttagccagtgtcaggaatatctgaaaggggcagagcttagacatgagcacgctaaggtccatccccacgttctgatcggtctttcagcgcataacatgcaagaacatgttttgaacgccaactctccactttggtgcaaaccacagttagttgtgttgtctccttgtcacaactcaagatagaagacagcctcaaagggagattcaaaagccacctttagcgcgaggttaaaacatcatcatcatcatgtgtttccctggcaaagatggtaccatggaaaaatttacatcaggtagccaaatcgggtgaaaggcatacaaggagtgtgcagttgttgtctatgttaatcttcatgttagaagccctattttaagaaggcacagtcttggcgcagcatgcatgttggttgatgtgcgtatgttaagctgtaacatgccctaatgaaaaatgttagtcaggatcaagggatgctactgaaatagagattttaatctttttgagataccacttgggatgaatattttgtaatatgtccaagaaccataatataatctagaatgcttctgagactacataaaaggtaattaaatgactccccaaatagcttatgatttagtttttatatcctagcctagaaaattgtcagaaataagccatgaagctgtacatggttgaaattagccagagagcagaaaagctagtggttcatcagttttggcttccatgactgaaatcccttaaccaaagtgacattctgaaaataaactaagtaactcccccaagagtaccaagtattgaacttttcatatatcagcttataatatctaatatcacggagtaacttcaaggaattgtccttctcctccccagattccccatctgaccaaatgcctttctcttccttgctctcacctgtcaatcatgttcacagctgaaatttgatttctttcccaccagtaaccttatatgaaatattaccagggggtaaggaccagtgtgaaccttgcctttcaagttcattaactctttgctgaaaatggatggtttcaatgtcacgaaacctgccagtggacctagatcatcatatttaataggaggttttcacattgtaatgataaaggctgagacaataaaggaataaagcatcggaactgcatgcacagactcagacacacaaattaaccccaaatgtatacactgagtttaaaactatgtatgggagctattaaagaaaacattaatttcatccaagactagaaaataaacaacaaaatattcacaatccagtaatttaaagtaagactctcatggtagcaccgtgtagaagtaagtaatcagatactatttttaaaaagtgggaaaaaatgaggctatgtttttccaacactctcaactcactggatccttaacgtacctcctttgcaaagagcagcaatttgaaagtgtgatttttgcccccctcagtttcactaaaaaccaaaaaatatatttcatgcaaatttctcagcaagcacaatttttaattaaaaaaatcaaatgtaccattagccaataagaggtgataagaatacataaaactatcacactaagtaattattggtgtaagaatgttggtctagttttccaaatgaagagggttcataataaaattcatgctgggacacttgtaattgaaaacccatttaaatagctcaattccattattttaatagatgaaaatcaggtttctgcttcccacccatctcctccttccccttcttccttgtattgaagtggggaggggatccatagtcacatttggacgcagaagtggggacacactgtgctttgaaattacactaaaatgtccaaatgtaagcaagaactgaattataagtgactgtaaatttgaaatgtttatgaggccccggtaaaaccggccaagggcgatggatactagtttcacagattcacccaaattatctgacactcaagtagaagaagcagctctttgaatgtcagtagactcacgttggataaagctgaagatctgagatctactcaaactggattagtaacttgacataacacatggatataatgaaataaacacagaaaaaataaatgcatgctgattctcacatatatcgcatgtatccctcctctttggcacctagtgtcaccatttacatgacacgtgaaacccaaatactaaaactaatgaaacaggaacttttcacacctaaaaagttagcagcattccttgtttgcttccttgcttttcccttcatttaaaaaaacaaagaaaaggaaaaaaaaaaaaaaactcaagcacatgcaaatcaaaaatcaagatgtacctctttgacttcaggcaactggattttttcacatcactgatgtagaggattcccttgggtacctgatttagtaaatatattaaaataaacaaagggtaattaataaccacgaagaatgtttcaagaacagtatgctacaggcagcctaactatctatcaaaagggcagaattacaccaaaagaagagtgattttgttccatttgcttttgggtggtggcctcaaccctgtcaagccagaggaggggttgacgtggaagggaatggcctgcgttacaagttcactccctctgaactactgtttctcaactgagaggctgagatagccataacccactggttggcagcctggatcagctttgaagctgtcctgagttcaaagggagccaagagattctgggttcatagaagggaaggatttgaatcatttctgttgggcttctctcaaggactctcaggctgtccgcccctgggagaaccacactggcccagcttctgccggtgtgtgctagggttccttctcttccatctgcccccacctcctctgttgctttgtctatcctgctggcaccactgaccttaactgcaaatgttcttttaacaaatagaacagcttagatactgcctctttatttgttaacttctgccctgtttaaattagtagcagggagtgcttagaacggtgatatgaaaatgaggttgctttaaagaaaatctttttgcttcacagtgaataacaaagcacagtaattcaaagtagttagctttctatggttcaaaaaacgcttattgctattagctgtactaatgtaagtggcaaaataattatcatttactgtacagagtccaatattttccagacagcagtttaataacaaagcagacctgtcatttcttcctatagctagtcacaatatagaagttcggactgtcaaaatatatttaaaatctaatttaaaaaattcaacatggtcacagaaaatctgtgtacaataacggcgataaactagtaagtcaatctaattctttttccaacatggatattcagttatttttctttaatcccccacacttttatttggattaccttacaattggtgcgaacaaatatgagctatgctcatgcacctgctgaattctctaggctgctgtaacagaacatataatctttctttacttacattttcattccacataaccctctaattccttcaaatgccctttatctaaatggtaagactatgcccacagcactcggataaatcatttcttacccttgtatctgtcaaagttgccctaaacacgttatatgcgtttattcacattttgtatagaaatgcttttcaaatcttaaggtagaaactactcgcctttacgtattagtatacatttttttttgccaaatatataatttctatgcaaaaaataataggaaagaaacaagaaacagactgaagtgataaaacctggaagtgtatcagtatcagttgttctccatttgaagttcagatggctaatctctttaaaaaaaaacttccccgataggattactttttttttaatctttagaaacaacagagtcttttagaaacgccagtgaatagagtttaaaagcttaagagattgtggggagaatatttttgtaattccttggggacgttgcaaacatatgttaagcttcggcaaggaatatttacatgagatcatatacttgtgaggcatttttcaattttagaaaattattacagagcaataattggacgtaggctttgcaaaatgccccctttgccttcctgaccatatcattgatagtctccgttatttttggaggaaaaaaaacaggcctcattaaatgcgatatttggcatcttgcctgaaatctcataaagtagatgtcctttttagatcattggtgtcattttcttcaagatgacctctactctctggccatctggggaaaccaccctgttatcaaagcatttactttcaaaaggggggggggggtagatactatttgcacacctgaatagcgtccaaaagccattgcagtttctgtgttcatattaccttctttcagaccacttactggggaaagatggtgggggaaaaggaggtctcacatcggggtaagagagattttcgagctgggccgcagtgaagtaatctaagccacatgtctacgagcacatagctcttacacttggatctgtttacctaacaattgaagagttctttaaatagtacaggagcatgcactgatattccagggaagattttaaaagggctcattacctgcacagtgcagtaaatttacatggggatcgcaacctgaaaacgtgttgcaggctgtcagcatgtgtctccacactgctccgagtcacagaaagtctggcaaagggagcttacctgccttttacgtgggaagattgccctaagacagcagtttcagcccaggctctgcgcatgtctaccaaaggacagagttgactgatgaagtctgcctttcggatcatttttatttcataaagtgggaactgtagatttttctcttttctttctttctttctttttttttaagatacagtcttgctgttttgcccaggcttgagtgcagtggcgcaatctgggcttactgcaacctccgcctcccaggttttaagtgattctcctgcctcccaggttcaagcgattctcctgtctctgcctcctgagtagctgggattacaggcacgtgcccccacgtcctgctaacttatgtatttttagtagagaccgggtttcaccaggttggccaggctggtctcaaactcctgacctcaggtgatccgctcacctgggcctcccacagtgctgggattacaagcatgagccaccacaccgggccagatttatcttttaatagcttgccccctccctaatgtgttaaagggtcccaggaaaaaataaatgaataaataaataaataaattttttaagccagatgaaaaaatatattggagtgaatgcctgaagatggaaagacacaaacatcaccttttaacagataaaatcttagaaagattaccgagggtttttccgccttctatgaaaaacaagatttacataaaaaatctgacagtgtaaaaagcatctcagatactgacatgtttgttttagtttcaatgtatctatctgtgcatgaataaatccttccctaagagagagggagagagtaaaaagtagattttttttaaggtgtaacgatacttgcctaacttaagtattctcacaaaccgagggtccctctaagaaaaaggcccctcatggaaaagatgctttctgaaattagtggttttaaaagtctgtcctcttgagacagttcctggatgcctgagatgtgtctagaactgtatgaaatccaagaatgcaggcaggaccctcatcctggcgctgttggagcaatcctcataaagtttgcttgactgactttgttttataatgtgcatcaaactacaccacggaaaccccaaaccgtatcgagatttccataaagatttttaaacatgctatctggatttcccgcttgcctttctctttttccctcttactctgtctctaaccgaagcaggaaaaaaaaagaaaaaagaaaaaaaatctggaaaatgggccggaaaactaatagaagaaaaatcaaatgatctggagccgatgatcttatttacagagggttcctggggccgcgatcgggtggagtgagggggtctcaaggtgaagggcggagccttgcgggaccgagtcttgctccctccctccaggcgcccgcccacccaggagagcggcgcaccggggagttttgatatcccccggagctcgctcgcgctagggcagtccttttgactttttaaaccaaatttgaacacaatccgagctcctgcaggggtgcgggagcttgggtgg

SEQ ID NO: 489 - DNA, 20001 bp, Homo sapiens
tggatcacgaggtcaggagatcgagaccatcctggctaacacggtgaaaccccgtctctactaaaaatacaaaaagttagccgggcatggtggcaggcgcctgtaatcccagctactcaggaggctgaggcaggagaatggcgtgaacctgggaggcggagcttgcagtgagccgagatagcgccactgcagtccggcctgggcgacagagcgagactccgtccccaaaaaaaaaaaaaaaaaatctccagtggctgatgcctgtaatcccagcattttcggaggctgaggcaggcggatcacaaagtcaagagatcgagaccatcctggccaacatgttgaaaccccatctctactaaaaatacaaaaattaactgggcatggtggtgtgcacatgtagtcccagcctctcaggaggctgaatcacttgaaccctggaggtggaggttgcagtgagctgagatcgcaccactgcactccagcctcgatgacagagcgagactgtctcaaaaaaaaaaaaaaaagtgttatccaaatgaatatgggaagcatcaaagactttgtaagtacagagaatgataaagggattgttatttgtaaagatgcatcttagtgacaaaaaacctggctttatttaaaagcagcattcatcagacctgtgaaagtacttcaggaacagattacattgataaaactcatgattagaataaatagctttaaaggttatttaaaacatctaattggcctggaatcccagcacggtgggagactgaggcgagcaggttgcttaagtctaggagttcaagaccagctgggctcatggctgtagtcccagctacttgggaggctgaggtgggagaatcacctgagcccaggaagtcaaggctgcagtgagtcctcatcatgccactgcactccagcatgggcaaccagagtgagatcctgtcttaaaaaaacaaacaaacaaaaaaacccacctaatcctactggtatcagttttatcaatactatcagagttattttaaaatgggtcaatactaggcctagcgtggtggctcacgcctgtaatctcagcactttgggaggctgaggcaggtggatcacctgaggtcaggagttcaagaccagcctggccaacatggtgaaaccccttctttactaaaaatacaaaattagccagatgtggtggtgggagcctgtaatcccagctactcaggaggctgaggcaggagaatcgtttgaacccgggagacggatgttgcagtgagcgcagatcgtaccactgtactccagcctgggcgacagagtgagaactccctccccccaaaaaaggcgggggagtcagtacataaataaggtggtactaagttagctttttaatttttatgctaatttgtcagtaatgccacagagtaaagttcttaactttgagtttacgactggacttcagggacccaagaggctctctgcagttgtgcttatgggaacgtatgcatttttcttcttcttttttctttttttctgagacaagatctcgctgtgttgcccaggctggggtacagtggcgcgaacttagctcactgcaacgtctacctcctgggttcaagggattctcttgcctctgccacccaggtagctggggttacaggcgcccaccaccacgcctggctaattttgtatttttagtagagacgggatttcaccatgttggccaggctggtctcaaactcttgacctcaggtgatccgcctgtctcagcctcccaaagtgctgggattaatgggcatgagccactgcatctgggtatgtgcattttcttaagaggagcattggtagatctcagagcttctgtggggcaggaaaagccatgaagtcctgccacaggactcttgggcctcacctctcagaggacgtctttgagcggaaggtggatgtggtgttagctgttgcaagtaagacagggacggtgtgtcctggtgtgctttgtgtcttaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaaggtaatgcatacataaggtcgggagtgttcgtggtgacacactcctgcacatcagaagctcaaccctgtagcatttctttatgatgtcaagagtgaggacattctcttgctggacgtggacttgttttaagtttcttgacttgtaatagaccttaatactaaaattctcatgaaaatggcctgttgaaaatagaggcaaaaataactaaactctataatcttactagattagaaaaatagcagcttttgtctatcaaaaagaacatcacttttctgtgaatatttcagggatgaatggtgcagtttgccttccaccgagtattaacagctgtgttgactagcccagttaagtggtttttagtgaagtaagaatgatttctcataggcagtgagagtcccttctaacctctagttgtggtggcgcacaaataagacgtggcacttaccagcctcaagtctctgtcaggtcacgggctcggcactttttgaaagcaattttaaagagccccaggttaaaggcatcttgctaaaagcacagcttcaagaagacttttcttgaaagctttagaatttgtgaaaacgtatagtacaacactgaggcttgattgggactgtgattagctagagaggattctcagaatatcgaggtgtttgggaagcagaaaagaggacactgggcctcactcctgggtcctgcagaggaacaaacctgaaccgagagtcctcttctctccgtcccctggcacagcaaccccacctcatacctccttccatatagatgacccaggaactgtgggcatggctggcttctagccggctccctgtctaccctaggggcgccctataccttcccgtgaagactcagacactgtctctcccaggcctgcacacaagagctgtgctttctgctgacgggcttggctgctgtgccgggtttagtgtccgttgctcctctcacacttctagctgccttatcactcatcagccgattgctttttaatcccatttgaggaccagcaagaggaagaaagatgccagtgagaatcatgtaacagatcctcctccccattttattctatccatcgggaaacctggaatgccggctaagtcaaagaaggcatcctcggcctctgctcctgcatcttcactcgcctccagatcagctgtctgagctgacttggatgttttgctacagtgattttatttttatatcttttcttgcttgctgtatttttatatccgctgccacctccaatacattatcaaaatatgacataaatgggggctgggcgcagtggctcacacctgtaatcccagcactttgggaggccgaggcaggcagatcacctgaggtcaggagttcgagaccagcctgaccaacgtggtgaaaccccaactcttctaaaaacacaaaaattagcctagcatggtggtgggtgcctgtaatcctagctacttgggaggctgaggcaggagaatcgcttgaacctgggaagcagaggttgctgagatcatgccactgcactccagcctgggcaacagagcaagactccatctcaaaaaaataaataaataacataaatgggggacaagaggacctcacttgggtcatgggtcagaagtacagatggctgcctcgaacagcatgcctccgacggactcttgtgtcggtgtaagtggtacttctgcgcacagtaagagcagggagttcccgcctcgtagcagctggtagactggttcctatttggagaaatcatgttactgttctgtaactgaagttttgttttgttttttttttgtttgtttgtttttttcttgctctgtcacccaggctggagtgcagtggcgcgatctcggctcgctgcaacctctgcctcccgggttcaagtgattctcctgcctcagcctcccgagtagctgagactacagccgcgtgccaccacgcccgggtaattttttgtatttttaatagagacgtggtttcactgtattagccaggatggtctcgatctcctgacctcgtgatcgcccgtctcagcctcccaaagtgctgggattacaggcgtgagccaccgtgcctggcctgtaattgaagttttatgatctgacgcatatgtaaaattttaattcttgccttggatttttcacaactgtttttgtttttaagtcagcagcttttttcttttccattttgtagagcacctgtttttaaggggcctcccacaggagcatcacagcctcggccgttgctcctgtttctttagtgagctggctgcacattttgtgtcctattacgtcacatggctcatttccttcatgagtcaatttttgtgcaactgaagggatagagtgttgttttgttcctggtctgacaggcagtttacttgctggggagaatgttgttagccattttctgctgctgttaccctgaacctttctaaaagtgcttcaagccattgatattttgttttccagaactgctttctccaggggttaaaaataagaattttaaatgccaccgaacctatcggctctttgcaggtgagtaaatttgtacgacattacttcttcattaaaacactgatgaaggggtttacagctgggcacaggtttgctgcaacttagcatagcgaccagatgctgtactcaggtatccctgtggccttgtgagtcggggagtcacgtgagagttttacctgaaactctgcgtagatgacggattatcatcttggccctgaggacagataacagaagaccttgctcaaagcgaacatttctgtctttgagtcagaggagggagtttcaggctcccaggctggctgtttgagaatgtgacctctcccggctgtgcttgtggcacctgtgggtgacagtgctgtggagtttccacgacacctggtcacccagccaggttgggtgagcgcgcccccagccggtgatccctgcgtcctcccccacaggtattgttagggctgcttgagagggtgggcccgattacacaagctcctcggctgccaggccctcagtcagtcatgagaaatctcccaacagggtgaatggcaccccctgttccctcatgggtggaccttgagacctcttctgtctcctggcttaggctccctgcagtatcattttttctgccacatcatcttccctttcctttctgccttcccttttatccttctttctcttttatagcgtcatcttttatgcctctgagtctttacctctttggattgttgctgtttgccgcacttttgtttgcttcccaggctgtttttactacatgtttctagcttctgtgtcttccctcctctggtgtggcctttggtgaacctgtttgtatcgtaacataacactgccatttattgaccttcacacatgtattgaacctcttcccaagatattctttcatttccttacatgtgtcctaggagatgggaggtgggatccctgttttataaaagaataaaccagaactcaaggaagaaaactcaccactctggcctgcagtggcagagcagggcttcaagctcctgtccacctcagctcacgcccgatgttttaggaagtttggcgagtgggtgagggcccagggatgggggcccaggggtgagggcctagcggtgggggcccaggggtgagggcccagtgggtgaggcccagagccacactgcaaggtgccaggcttccctctcttcctctcactattcattgttccttttgactctcttcttttctccccccgatcacaattcctcctcaacttgctgggcctcagatgggacggccatgggcaccacgcgcttgtgggtgtctccagccctgtctggaatggaaggtctgagtcctcagactctgcagccagccattatcctgcctggctccttggagtgtggcacccaggtcccagtgggtggccagcagtttctccgccttctccctgcacctcttcccctggaggctcttgcgggggacatcactgggcaggggcaggggctagggattgctcctctcctggtcagggccccagtgtgagcacacacacccctccccgactctgcaacctgcctcgccccgggacctgggcctgggttgctctcccctgccctcctgaatcctcatcccctaacccattatttttttgagatagagttttgctctgtcgcccaggctggagtgcagtggcacagtctccattcactgcaacctctgcctcccaggttcaagtgattcttgtgcctcagccccccgagtagctgggattacagctgtgcaccaccacatccagctaatttttgtattttgaatagagacgaggtttcgcccttttggccaggctggaagcctattctgatcttggaaatgaggtcaccggactggttagaattacctgtagagtgagcaaaggaacactttttaagaactgctgtgattgtggggcctgggagaagcaatctcgcgcacaagcttttcaggcggttctcagcgctcctgtcaggggggcttgcaggtgtgagtgacacacggctcagcccagggtagttaactgggctgctgcttatgaaactagaatggtgacatgcagtcccccttgacattttagaatggagatgtcttgtgggaaagacaagttagtaaaacccccaggccctgcagattctactgatggtcgctttgaagcaaaactcttagcccagtcagttaggtctgtgaggtgaagatctaggacagaagtctcaaagtgaacttgggatccaggggacatgctgctgtcatgggtgcttcctgccctttcacaagatggctgtgacttgtgcagcacaggatgaagctatgcccttggattggctgtgtccctggctctccgaagtacgggccccacagtcttgctgtccctatgctgttcagtctcctccggggtccctgcacagaggatttctttgtgcagagcccaggagtctgactggtggcctcagtcataagcactgtcctctagccagccaaggtccctggcccagagaggactgaggcctcctgctgtcatttagcccctccacgtgacaactgcgactagaacctggtgatgtttggtcttgttttagtgctgaaattccctaccagccaagtcttgcatctctcctggttccttttcttttgtgccactgatggtgggcgcagcttagcaggctgccctgtcattccccgcggaatgctgccggacagccgccttcccgaggctggtgtctgctgctggccaggcagacctgtgcccctctgctccatagaagtggaggatgtgttctgtggctgtcttaatgttttcatgacatcttctacagattttttgttttaggcctttgactaaggcttcttggttataggattttttttttaagtaaataactgtgtgtgtgtgtgtgtgtgtgtgtgttttgttctgttaaaacatagaaaaatgggtaattttttttaaaggcaaatgcgtaactaccagcaccatctccgcagtgccccaccacagctccacgctcaagcaaccgtggttagcagtcccagggtccctcctgccatgtgggccggcaccgggagattgtgtcccgtgtctttaggatagatgggccacagaaggcctaaggaccttgttttctcatttaatataccataagcgtattcccgcatcaccattcttaatctattccacgaaaaaataaattgtgttattttaatataatttactcatcagtcatttcttctagtggctattgaggttttccgttttttcactgttataaatgacatcataatctctgtccaagattcagataatctcttcaggacagtctagaagtagagtcagccacatccaagggcatgagccaggtctgtaggcctgtacagctgatggctgtgtaggagtgtctgtgtgaggcgtgggacattttaaatatgtggttaatatgcgtacatgcacacatgtacctatctgacttacccttaccttgcagttatagaaaagtttttattatggattgcttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaggtgtgtgcgtgtttctttgaatgcgaatgccttttcgggtaactgaaattcatgggggcatgagtttgcctgcagaattaaaatctgcccttcgatcagctcgacgtgtttgtggaagctgaaccaccactcaggttatgcttgtttagtattttcaaatggattagtgatttgggtacacgaagtttttgactcttcgattggcagaaaggaggaggttttctccccttcccctcctcatcccttgtttctatagcccaccgttttcagtatcaccaaaatagttgctgtaggtcaaggctaaatgctcttcagttgagtgccactggggcggctgagcggtgcctccagacgccaccctcagtagtgggaaggaagccttctgagacggaagacatggagagagggatgtcacgtgcaagggtgcccgtgccccggcttctggccctgtgtggatgattgtggtgtcctgagatctacagagaaggggttttaacgtggtctgagcctttctctcaagttcttgctcttaccatctggtatttctgattgtagcctggtgccatctggggttcagagcttcctaaactttctgtacaagtgttgtccgtctaacctacttaccctttgtaattctattgtgatttgcttggctgaattataactcatattgagaggtgaagccagctggacttcctgggtcaagtggggacttggagaacttttctgtcctctaagaggatggtaaaatgcaccaatcagcactttgtagctaggattgtaaaacgcaccaaccagcactctgtagctagcaagaggtttgtaaaatgcaccaatcggttcttaaaacgcaccaatcagcaggagtctaaaagcagccaatcacagggaggactgaaaaaagagcactctgataggacaaaaacagaacatgggaggggacaaataagggaataaaagctggccgccccagccagcagtggcaacccgtttgggtccccttccacactggaagctttgttcttttgctcttcacaataaatcttgctgctgctcatagaaagatgcaagctagtgctagcgagacagcctgcaaaacccctgtgttgttttgggctgttaaccatagtctgagtggcttagacaacaaacatttatttctcacagttctagaggctagaagtccaagagcagatgccagcagacctgtctggggaaggcctgcttcttggcctggagacagccgcttgctcactatgtcttcacagggcagagtgaaccctggtctgtttctcttacaaggacactcatcccactgtgggcctccacctttgtgatttcatctatacctaaaaggccccacttcctagtattccgccgggggttcaggcttcaaagatgaatactgggggcgacacaaacggagcccataacctcatgccgcctgactcctgaggctgtattcgtgatgaacgtgtggctgcccaagttttgttttgctcaggcaggatcagcacacacccagccacagacagggaagcccagagcagggcagaatatggtccctcaagtgaataattggcccagggatacagaattaggtgattctagcaaatccagacattttctagggtgccagtgaattttgggtctgtccctgttagctgttcttgagattttgcactcaacttgcgatggttaatacggagtgtcaacttgattggattgaaggatgcaaagtattgtttctgggtgtgtctgtgagggtgttgccaaaggagattaacatttgtgtcagtgggctgggaaaggcagacccaccctcaatctgggtgggcaccatctaatcagctgccagcgtggccggaataaaagcaggcaggagaatgtggaaagactagactagtcttgtggcctccatctttctcctgtgctggatgcttcctgcccttgaacatcggactccaagttcttccgttttgggacttggattagcttccttgctcctcagcctgcagacggcctactgtgggaccccttcttgtaagtcaatactccttaataaactcccctttatatatacatctacctataggttctgtccctctagagaaccctaacgcacaacgtttccattttatgttgcaacgtttaatgtttttgtaagtttcatagtacggtctcctaactttaggttatttacttcgggaactttgctcattaaccttggtgctgaggctacagacttagtgattttccttcattatcatttaacatgcctttgtaggtggcatttaaagcagtgaatggttacatttttagtatgttatagggagattttcctcgcatttgtcagttgttgacaacaagacttggaagttctcttacagggaagatgtcatgaagtttacctggttggtatgttatttgtccactagccaaggaagcgcaagccactgtgtgtttgaggcaggatggagaatggaggtcattctggcctccactggtgtaactatggttcagccacccaagtggctcacagtggcattctgctttcatttctctctctctctcttttttttttttttttttttgagatggagttttgccctcgttgcccaggctggagtgcagcggtgcgatctcaggtcaccgcaacctccaccacccaggttcaagcgattgttctgcatgtgccaccacacccggctaattttgtatttttagtagagacgaggtttcaccatgttggtcaagcttgtctcgaactcctgacctcaggtgatccagctgcctcggcctcccaacatgctgggattacaggcgtgaggcaccgtgcccagcccctgctttcattgcttgatgtcattggtcataccatcctagtctaatgtgtgggcaacgtgagcaggaactttgcagtcagcaaaggcatcatcttagaatgtcttttatttggtgacgtttctgattattgctgtcatagactgcttatacttgaccaggccaactggttacaaagtgacaagcatagtccaagtcagtggcttttgaactatgggaaataacccaataaaccagtgagctagtattgtacagccaactcacgttcatgagtcaatgagaatgagcaagttgtagcagtgtggacacagcagtctcttggcttcatttctcttgggaagtgctgagtgcatcaaaagaactaaaaacagcaagagacagaagactcacagtttttctggtacttctctggctcaagaaggaaaaatatcttgactgagcctagtgaagacagtatctctataccaatttcctgagggtcagtggacttaaaagagattagaccaaaatgttagtgtttttaaaatccgtgtctagcaaggccaagtggtaatagccaactctacacgaagtgttttgtgtttcctttattgttttttgtttgttcgtttgtttgtttgttttctgagacagtcttgctcttgttgtccaggctggaatgcaatggcataatctcaactcattgcaaccttcacctcctgggttcaagtgactctcctacctcagcctctcgagtagctgggattataggcacctgccaccacaccagataatttttgtatttttggtagagacggggtttcgccatgttggccagactggtcttgaactcctgacctcgtgatccatacacctcggcctcccaaagtgctgggattacaggcatgagccaacacgcccggcatgtttttcctttaaaatcagtcacagcaaaagtcaccgagcagacactgttctgccttcttcagacattttctctggcttcctaggaattggggttttttttgttgtttttgtttgtttgtttgtttgtttgttttagtgttattcatcttttagactggccgttcccatcttatttgcaccttttggggaaaagttaacttgctcgaaaatgaaatgcacccgatggcatctgctggctttacctcatggtgatgttcctttatgaactagtgaccaaatgcttcattctcttttctgattgtttccctccctttgctcatcccccacctcagtaagacatgttacatcattttaatgagcaagtgtacatttttttccagtgggactcaaattgtacgtttgcttcttggtcgtacatgcattttgtttcacggatttagttgtgtctcctgttgttctgtggtcaggatacgggatcatttgctaggcactgatttgctgaacacagtagtatttcgttgagtggcccttccttggaaacaactggcaagtaagcaaacctggaaatcactgttctgtgctgtattttcagtaaagggaatttacacagcgcttgctgctgtgggatttgcaaactattttattttgactctaggatttcacacagtgatatgcttaagatattttttataattttttttttttttttttttttttgacagagtcccactctgtagcccaggctggagtgcggtggtgtggtcttggctcactgcaacctccgcctaccgggttcaagcgattctccctcctcagcctccctagtagccgggattagaggtgcacgccaccacacccagctaatttttgtattgttagtagagatagggtttcaccatgttggccaggatggtcttgaacacctggcctcaagggatccacccacctcgaattcccaaagtgctgggatcacaggtgtgagccaccgcggacgacctataaaaacttttatccctttcattttctcatagactcccgtttaagttcttgctctgttttgggggaaagtgtttattgtttgattttctaataacgaaaacattagagtagcttcatttatgctgcctgtttcaagccaatacactgctcagttgtgtttgtgtatttgaaaagtcccctgataggaactttctgaggggtgcctgtgttgttggcacatttgagaactagacaaaatctaactctgtgtcttttttctttctttttcccctattatttggttttgtttttttaacaacccctctggagtgtgttttggttcatgggatcaggccacgtgccctggttttcgaggtatagccttggctttcttgggtcgggtctaataaccctgaccttggacttcccacgtgtccttcaaagaaagcaattatttttgcctattttctgagtatgatggtattctccatttgatttaacaaaaaaattcttcctctgctttaaaagactgaaagcctccctgtaaggtgctgattgccttccagatctgaggaccccgtctctgcctcattcctcctgtttccatcagaagacacaggtctgggactcagcgcagctgacctgtctgtccctctctgcacaggtaaccacttatttattgctgcttaaagtagagcttctgatacccatggggctggcaagagaccctgacattcttgtcttattttatcacatacagtttactcctgggctctgcagagagaagtcagtgcctcaattttccattgaaatatgcacccttggcatcctggcaggtgagcggcgcccccttagggctaatacagtgacataaaatgtgtcatatttttggctgtgtggtggctcatgcctgtgatccccacactttgggtggctgaggcaggctgactgcctgaactcgggagttggagaccagcctggccaacatggtgaaaccccatctctactaaaaatacaaaaattagccaggcatggtggcatgcacctgtagtcccagctacttgggagactgaggcaggaaaatcccttgaacccgggaggcagaggttgcagtgatctgagattgcgccactgcactccagcctgggcgaccgagtgacacttggtctcaaaaaaaaattaattgtcatatttttgaaaaagtatattagctttgcaatgagtaaagttcactctctaggaagatgtccctgtttcctgtggctacaaatgctccctgccacactgggaggccgcacctcactgcgccggagtgcagtcttcagtggggtcctctgctgtgaccgaaagaagggtgcagccgggcctgcttccaaggctagggtctgagacctggagtgtgtccatggatatcagatgttgagctacaggggaccggcagcccacagcagcaccctcggtggctaccttagggtgttcctgtgggcctccccccaccagcacctccctccagctttcctgcctccatcccccctccaggacacttcctcctctggctaaaggtttggcacctttcatttgagagagattaacagcaaacacacagggctttctgcaggccagggctgctgctgagcttttgccaggcatttggtcctctgccaagcccatgcatagtttctgtctacattgtgcagttggggacttggcacctgcccagcacctatgcttggggcccctcctctgtgctgcaggcgggtgttcacaccctttcatacccgctgtcatctccctgcagcccaccctgcttgacgaggtcatcactggtgcttaggagtaaactggaatggcagacagagcccagtggatattgcagaggaacagaaggaaaaagatgtgcatgacgcctcagtgcttgcagcattaaagcaaaaaaaaaaaaaagagcaaagtagcacagtgattaaatagtcgggtgcctgcattccatcctcacctgctgtgaaccagccacatgaccttggacaggtggcctggtgcctcctctgggtagtggctgggagtggcactgtcacctaggccctgtcacctaggcccaggggcaggagtaagcaaggtagcaggtgtgatccattagcacagctgatgctcagtcacggtggccctggcactcctcagagggcccctgccatgcctgggggaggaggggctgcagtccgtgcccagtgaatgtaccacctgcctgacatcgcagcgtccactctggcagatgcgacaccacgcctagtgaggtctgaacagggaccctcagcagtgcgcccacaggtgcacatgagtgatgaccatagctgcccgctggttgtgccctcctgggcaggaagcacaccagggagccctggcagagcaggcccttagggagcacccaggagggcctggggctggggcctcgattctgggcagccagccttcgggaccttggtcacgcgcctacctggacctctgcccctgcctgccctatccctcattagaatcccagccctcctggctgttctgggtactctgatcaagccagacagtgctagttcagcactgagagagtgtgtcctgtctggtcagggaccaccagggtagacagacattcactcctaagttcccaccgaaaaacagcacgagggtatattgggcaaccaggtgaagactgttccagagccagttatcccagaggagctaggaagcctttccctctgctgtcttccttttactcagacacgtcctccagagctggctgcatgtgcattccctctgctttcctggaagtcccctcctttccatctacaatgggacttttaaaaatactcacagtcactagtgcacaagaagaaccattcaaagccggcatccaacctcagatttgcagcaacctaagatttgtttgcaaaggaatagaacgataaagcttcaacccacccacgtttataactgagaagaaaacacacacttcatttggtaaatacagcaaacaactgaaagtatgctttgactctgtattgaggccagttaggggatggaaagggtgaggctaagcaggtaaaggaaatggaagagaaggtcaggagaaggaaaatgtgagctaggcaggcggctcatgcctgtaatcccaacactctgggagcccaaggcaggaggatcatttgagtccaggagtttgaccccagcctgggtgaaataatgagactttgtctctactaaaaaaaaaaaaaaaaaaaaagttaaaaacagtaataaaaggaaaatgtagaggggagaagcaactgagaagagaggggagagtgagaaggaatgagcagggaggtggagggcgtgggggtggctttgttttggcctcatctttccagggagacagccctgtggcgatggccaggccacgatgctaggctgctcttggtcattaccagcccctgaaatcagcgtcctcaaccctagccctgtcatctctgctgggagtgggtctctatttcttttctgcaatttacatttaaagcagagtttaccctggaattctgaaggtttcggtgttgaggtatggtttgcattttagaaattcattttggaaatgtgaagatgtcttctatgcggcttgaaagcccgtctgacgttcacaagctgtatggctcaggtcttcagtgcctgaaggttatacagcaaacccaccttgactttgacttcggagtcttttcctcctgaagccaaatctgtttcagcattctggtctcgttaattctcatggtgacagtatattaatatgagccaaagagaaaataaaattcactgaaagaaaataaggctgagcctcattacgcctgtaatcccagcactttgggaggccgaggcgggtggatcatctgaggtcaggagttcaagaccagcctggccaacatggtgaaacccccgtctctacgaaaaatacaaaaattagccaggagtggtggcacacgcctgtaatcccagctactctggtggctgaggcaggaaaatctcttgaacctgggaggctgaggttgcagtgagctgagattgcgccactgcactccagcctgggcgacagagtgagactccatctcaaaaaaaaaaaaaaagagagaaaatgagaataaataagcagccattccacctcttgggtcaaagcttccaaatttgctttttctccaaggagtggcagccacagcaaaacatcttctgcagcgtctggccagggcgttactccagcccagttttgccctggactagattgagtcaggtcgtgcatggaacgcaagcacaaaccacggtcagctcctcgagactgacccactggcccactgagcagaggagcccctgggtctctggacgctgcccagttgttgacatcctgaggcaggtttgcggctgatggagcaacagggacgggctgggcccggcacctttttcacggaaatgatgagctctggacagcagtgatgccagggcccataaagcctcaggcgcccgtcattgctgctgcctgcgtgtgctcgctcaccgcgacggcggcgggctggaggaagctgtgcaagagccaagtgtctaccatgagtctgcatgttcatatggttcagatttgccttggaatccccgcgagccaaactctttcatttcacttagtaaaagggatgcattgactcagatgttctgtcctatttaaatgagaggggcgcgggaggtgatggaacacaaaaccatgagccatggctttgctggggaatgctgtggatctggtgtgtgatagagagagagtgtgtgtgcgtgtgtgtgtgtgtatggcaaagtgcacaaatcgcacgtgtacacctcagtggctttttacacatttagacgtgtgtaagtgtatagagcatttccacaccccagaggccccgagctcactccctcccgctctccccatccctgacgctaacctgatgcctgttgtcgtacatcagcttctcaacctcggcactattgattgccatttggggccaataattctagggggtggtggctgtggtgggcactgtaggatgtttcctgtgtccctggccctgacctactagatactagatgcacccaccctctccatcgtgacaaccaaacgtctccagacattgctaaatacaccctggggacacagtcaccctggctgagaaccagagcgtgggtcactgtgacttccgcgcttcctctccatggcatcgcacggtgccatgtgtcctgccctccgtgttcttctctctacgctgcttctctgaaatccctccagcggtggcgggtgccaggagttagttttgctttctcactttggagtaatgttgcattttatggatgtgccacgatgtgcttgtctgttccactgcggatggcatctcttgttgcagttggggctgttaagagtgttctcagtgtgccttgtggagggcttgtgtcctttctcttgggtgcatcctcctgagtaggactgcagggtcccaggcaggcgcctattagcaggagtggccaccattgcacagtgctcccaattccattcccacaggccacctgagagtcagggagcttctgtcacaattttaagtgctgcaggattaatgcaaactttctgatgtgcttcaagttgctttgtgttgaaatggactagaggggatttaagctcacagacatatatccagagcatgcccactttgataatgctatcttcactaataaattattctcaaaacagcaggtacttgcagttctgaactagataaagccctttcctttccatctactcactgagtcatcaggtgcctggctgacagctgacgctaagtcttcacaattaaccaagtctctgggcgcccctcag

SEQ ID NO: 490 - DNA, 20001 bp, Homo sapiens
gctggcaggggagtggccctggataagaagcacaccctccaagtcaggaggctccccacccccgggggaggacagaggaggatgtgtgggcaaggccattggcttcctgctctccacctccttgcagatgccctgagggcccacgcctgtctcctggggaacatggaggactgagctgtaggagccaggagagccaggtcccatagtggatcagctgtggccttcatagaggactgccctggaaatgtccatgggacaggcccctgggagtgggaagacgaattagtgggggtaggcagagacagagaaggggcggggggagagagagagaggagacagagagagagagggagagagagagagagagagagagctccaattacagagatccaaagaaaccaaggagcccagacaccatgagagagagacattgagagcagtgggggaggcaggcagagggagacagggcggtggcagccagcctcgctgcacgtgccaggtagtggggcatccctggatgagggggcgggactgtggcctgggggttaagcatgcgcgtgggctaggtggagctgctacctccactgacccttcctagaggcccatcctgccctgcctggggcaccagcgggacctgggagctgggttgtgggtacaccaggaagtgtgagtgtgagagtgtgtgtgtgtgtgtgtgtgtgtgtgtgcaggcctgcctaggggagtgtgtatcccagtccactttcctggaggagcctggttcttcatgctgggggcctccccctggggtcctccatcctggggcctccccgggggtcccacaccagcaggttgctgggtgggcagcagagctctgtaagtgagccccacctccactgggggttcggggctggggctctgtggcagctgcctgaggcctttggctccaactaagcagcctgctccttcccacacgggctctgggctgtacctgtgagccatccttcacaccctctcacttcccgcctccttagctttggcgaggactttgtacaaaggaatttgatctcagcccttgtgatgtgcgctacagtggaagtgagagcggagcctgggccgctgttggggctggtaccccggctctgccgtttgccctgggaccaccctgctgggcctcagttttcttatctgtaaagtggagatatgaatagcacctacctctcagggttcatagcacagtcctagctcctgactggagcctgcaaacatcagccatttgtatggtttgaaaatgtgcccctgtgtacttgcaacccccactcccccgcgaagcccccaggccccttggtgacgctgaccagagcctgctccaagtctggacctggcatcgtaatggtctcccttgcatccctgcctcttccctgctgtttaacccaggcaagtcctgaaccctccaagcctctgtagaaggcggcagaaaaaacccttttcttcccccaggcaatgctctgtgtaaagacactccacacacacactcaggaaatggaaggtaatgctgctgttagaaaggcaaattcatctcaccgctgggcctctgtatgtgaacagacttggtgctttggaaccagaagaaaactgctggggtcctgacagtcccctccctccccgtactacagatgagcaagctgagaccaggcgagggaaacagcagaggaaaaaccagaacctggcccagccctgcagcctccttcttcaccgagtgctgcggactctgttttgcctcgtttcacctgcaagtccccatcattgaacttgtatttatttttatgactcatacagggaactcggcaagcgtgataaagtgcgatgtcgggcaataaaatgccttgttccaaagccggtggcctggcagagactgacagatgttccccagggtctttcttaaataatagaaatcatagtttttagctggccacatagacatcactggaaataaagacgacatttctgagcctccttgcagttagatgtagcaaactgacaaaattttggccagtggcatgtaagggaaagtgtccttaaagagtatggggtgcacatgtatgccattatcttcctcttcctagcttgctagaatgtgaatgtgatggctggagctttagcagccacattggactatgaggtaaccttggtactagaaatccttgcctggtggaacaaacaagatagaaagaccctgggtctccaacccttggctgccactgggcttcttgaacacacaataaaacacatttctatcttgttcaaaaacattgttaatctgagatgttttagctgaacttaacctaatgaatcgacaggggcgtatgaagtgaggatgggaagggactggtccatcctggcagggaggtggagtttatcacagatgtgtttggatcagccagcatgttacagtgtgtttggggggatccatgctgggcttggcttttacatttatctccaacataattcttatcatcacaaactacagctcaaaaaccttcatagagaaggcccacacttcttggccaggtgttgaaggccattcccaccttcctgagcttacacctgctgttcacggtttgcttctgcccaagcagtttctgtgacttgataagaagattgcacccactccttctacctccaatacttggacccactattccctgcacctcttgttcaacaccattttcatgaagcagtaacacccaaggtgaatgcctctcttcttctgagtgtcttttatttctttatttttttttagagatggggtcttgcagtgctgcccaggctggagtgcagtcatatgattacagctcactgcagcctcaaactcgcgggctcaagcaaccttcctgcccccgcctcccgagtagctgagactacaggtgcacaccactatgcctggctaacttatttatttatttttgtagagatggggtcttactatgttgcccaggctggtctcaaactcctggcctcagacgatcctcccacctcagcttcccaaagttctgggattacactgtggccaaccttcctctgagtttctttcccactgtccatcctccttggaggtgcaggtatttgtgcatttatcccatctccctcgcccgaggccacgttcctcgagggcaggatgttctaggccctcatttcccactcagggttggacacagtgtccagtgtctggggggcagtggaggggaatgagctctgggctggagaccggtgaccctggcctcgaatccatctccacctcttcccaaatgggtgaggagcagcacctgatcccttagtctcagctttctcagatgcaagagagggctgataacaggctcatccaagtccaaagtccaagccccacctcatcacccaggaggcgctcaaccatcctaagcagggcccgaccccagggctctgaggatggctgagctcaggctggaagtgatcagcatgcctggctcgcacacctggctagcgaccctgcactaggaagtagggtggctcctcaggtgactgttatgatgagaaatgctggctgagccgaagtgcatacatttccgggagagtgggaacaagttcccaagctctggaggaggctactctggaggcattccctcctctcccctctctgatcctctcgccttccaggcagcgccccatcgactttgttctgcatgtggtttctagggcgctttggtggaattgaaaaaacacggaaatgccagctcagttcccagcagtgcctggctctgcactgagctggttccatctgctgtggcctgagaccaaagcagcctcgcgcacttctgacgtctggcaacggggcccagccggcagcggtgggggcgggctctcctcgccccctgggagctcagcacgctcaggctccctttgaagctactgggaactcagtgcccagggctgctctcagggatcagagacaggatgaggctcccggtcccaagagcacactccgggggtaacggggacttcctgagtccactcttggcctggacagaggggtcaaaccaaggccattccacaggtctgattaaccataattcattcactcattcaccccctggcaaatgtagcatttcttcatttctcagacatggctttgtcatctgtaaagtgggggtaataatagtacctatttcatggggttgctgtgaggattaagtaagatattcacgtaaactgcctagacccagcaaatgcacattcttataatacaatgtcacagctgtgtgtttggactgcagcctggccccctgagtccaaacccaggctccaccacccactggctctgtaaccttggccaagtcatttgacctctttgggcctcagttttctcacctataaatgggtatagccagggtcccccactccctagcgttttgaggtggcataagttaatatttgcaaagcacacagaacacagcccggcactgagcaagcgctatatcagtgtttgttgaaaaatcctgtattctagtaagagctagcaaccagagaccccgatcctcggtcctctgctcgaatgtattaagaatgtccattctcccctgactatcagccatggcggggtagaaaggaagacaggggacggactgagaggagaagtaacgcatcatccctgagctggaggagcctctcatttgcgatattttgtgtctgaagaaactggggctcaaagagaggatgtgacttaccccaggccccgtagtaaggaagtgctggggttgggatctgaacccaggtcatctgtttccaagacctgtggatcccaagaccatgagacaaagtgaccccagcaaagtggccaagtcaaaggagccggaatggggctaagcccattagtattggctgacacaataaaagacttggtttttcagtctatgtaagtgaatgttctggagacagggtgggtgtcagagttggtttgcttcagctcctgatggtgttaccaagggacccaatttctttccttctctctgctgtgctgtctgccattttagttcatcctcaggttggcttccctcttcattgcaaaagagctgcaggagttccaggcatccctttacacaccacctcattcacaaggagaaagagccggttgctaggagaggcctcttctttcccagaagcctccagcacatccccatgccatctctctggctccagctgggtcacatgcccatttctccatcaatccctctgggctgaggaataactcactctgattggtttaggtctgacttaccaggggtgagcgtgctgacaaggattcacatctgatcttgcagtagaatcagcccctccccaacctatgtctaaaatcacaaaaaggcaggatgcaggagatcttggggacacctctgtgatgcccacctactgtatgccaggctttgtaccaggccctggggtcacagtgaacaggacattaacctgtgggctcagaagctcagacctgctgtgagagacagatgagaaagcagggatgtgacgtgccatgtgacccacatcatgaaaggtgagcatggggaaagggtggctgacccagcttgggaatggccaggaaagtgttctggagaatttaacctgagacccaagtaggtgaatggaaagggctgcaaattagagggagtgtgatgtgctctgtgattgattagtgatgtctgctgtgggtggggagtagcagcggaaaggcaagtgagttacgcactgagaaagcgaatccacttaaaactggacccacctttcagagcaaattgggactttatctgaaaaaataccccagcattatgaaaataagctcataaaaatacggtgtttaataaaactagatgtataattgcaactgtgagctaattcttagaccactgtggatagttatgttgcatatatatatatatatatataatattttttttttgaggcaggatctttctctgtggcccaggctggagtgcagtggtgcaactggctcactgcagcctcatcctcctgggctcaagtgattctcccatctcagcctccgaagtagctgggattacaggagcatcccaccgtgcctggttaattttttgttttatttttgtggagacaggttctccctatgttgcccaagctggtctcgaactcccaggctcaagcgaccttctgcctcagcctcacaaagtactgggattacaggcatgaactaactataccatgcctggccaaccttgcataattttatgacttttttttgacagtgtgagacagctcaaatccaatgactgatcaatgtgggggtttgagggcccaaacctcttgctccagcagaggacagctgggaagatcccttctaccccacatgggcacagggagaacttgagctgtgatgcagtttcaagaaaggcattggctgtccccgcaggaatcagcagtgctgaggctcctcttgaaactgcattacagccactgctgcctctgcacaggccagctcctttcctttctttcccctcccagcagcccccaccacccaaaccatctgcaaaccaggagtctgcctcctggggagcccaacaggacaattgctacagtcctttgctggaaggtttatttttctttcttctttcttggaagtgtgggtggggagtgcatgtttctgagcagcaatccaatcaatcacagattgattccaaacccagatgagacaacctcagatcaagttctttagggccacgaagcatccttaattcaggaaaacccagcccttgggatatagctgccccgcccccacctctctctctctctctctctctctctctctctctctctctctctcgctttctccactatgcttcctaccaaagccaaattccttctgcctccaccctgacctggccaggccaattttcccttaatgctcaatttcacctgccaatttgtgagacaagacttcctctatcctgccttgcggaggcccctcagggactcactctccgagggcgtcccctacttcacacaggctcttctcagggtgtatttggagaagaagcctgggatttctaagccccactcccaagcaggcgggaagagccttcttttgcctgcatgcttgcattttctaagaggtttttcttatgggagtaattggagcaggcttcatttatcccacaaagagcaagccttcgcgaggtcacacagagaatgccaggcttgtccaatgttgtggtgcaaagctccccgcaataagaggcaggaaaatggttgggctccagccggcagaggcggggctgtgatcaaagccgtgtcctccccaaactcaagcctgtgactgcagctgggccatcctccctcccgctgccacctgaggagagcctccagctggcccaggcgtcatccatggccggccagcctctccaggcagtttgcctccctggactgtggggaggacctcacggcgcctccctcctggtgtccccggttggcttcacacactctccccagagcccgtttggccacgtttgaggagggatcctgcggagtttccagggcgctcctctgtcttgcctcctcgaggcagtgagaacgtggtttcccacgtgcctgtccgggctgtgagcgacttgctggctatggcttcattctcctgggggagcctcagcatctgccttctttccctttttctctcagctgagggctgggttgtgcatgggccagggaggttctgagagatgagactgggggaaggggctgcagaaggccgggttgggggacgctctgcagggagaaactcaagccatccatggccttcctctcgttagtcaattaggggaaagtttcatttttactgttgcaccttttctgacagggtgaagcagcttacagccactgactgatcaatgggtttaagggcccagaactcttgcttcagcagaggacagctgggaagatcccttctaagctgcatgggcacagggagaatttgagcttgatgcggtctcattacagagttttgcatattttgctccaggtttgttgaggttagaagcagcagaaaaatatcgagttgtcttttccaaaatcctggtcagtgccacaagagtgactgtaatctatgggaagtgtcatccagggtcagggtcttgtaacagagatttgaacctgggcagactggccctgactttcagatcaccctgggcaaccagtgtccttgtttctgggctggaagagccttggggagtcccagaaagtctttggagggagtgattgagagctaggctctggagggcaccagccttgagtccaagccctgccattgccaggctgggcaaggtccccagcacaccaggtctcaggccaggctgggcaaggcccccagcacgccaggtctcaggccaggctgggcaaggcccccagcacgccaggtctcagtttcttcatctgtaaaactaggcttccctggggtggatagtgggttcagaaagatacgtgtgagtcctaacacatactgtgccgtgggtttagttgtgtccccaaaaagatatgtgcaagtcttcaccctcctacctgtgaatgtgaccttatttgtaccaagggcctttgcagatgtgagcaagttaaggtgaggccatactggagtagggtggaccctaaatccaatctgactgaggtccttaaaagaagagggaaattcagatgcagacgcacagagggccgagactgcagagatgcagcttccagcagaggaatgccgaaggtggcccttagccactagcagctggagcgaggcctggagcaatcctccctcagagcctccagacagagacagccctgccgacaccttgatttctggagtggctttcagaactgggagagaatccatttctgctgttttaagaacccccagttcatgctaatttgtctcggcagccctggttcacgaatacacggcaggaggttaagtgctaaagctgttgaatgcgtcctacacactccgtgcacattagctactgttttaactgttgtccttgagttttccccgaaatgctgtctccccatggagctgaagggagtgcactgctgtgcgcacaggaagatgttggattttgaggggtcccaaatagccatgcagtggaacacgtgtgaatgtcggctctgaagtcagcccgtctgcagccatctcctgctcttccacttgttgacagtgtgcccttgcataaattatccagcctctgatagcctcagtttactcatctgtaaagtgggacaataattgtatttatttgggttgggtgaaataatacgggcaaggtacttatccctggtgcacagcaagtggtgaagatgcgttagctgttattgttgttgtgaggggcggagcttcccccaaggctaagactgccttgggtttgcctgaagatgggtgtagtgggttgaagagtgtcccaccaaattcatgtatttgcagaacctgagaatgtgactttgtttggaaacgggatgtttggaagtgtaattggttaaggatgaaatcatcctgcatctagggtggccctaaatgcaatgactaagtgttgttataaaacattagataagggccgagtgcggtggctcacacctgtaatcccagcactttgggaggccaaggtgggtggatcatgaggtcaggagattgagaccaacctggccaacatggtgaaaccccgtctctactaaaaatacaaaaattagccaggtgtggtggcatgcacctgtagtcccagctactctggaggctgaggcaggcgaatcgcttgaatccaggaggtggaggttgcagtgagctgagatcgcaccactgcactcaagcctgggcgacagagggagattccgtctgcaaaaaaaaaaaaaaaaagagacaacacagagacagaggagaagcccacgtgaggctggagtgatgtggccacaaaccaaggaacacctggagccaccaggagctagaaggctggctggaagaggcaggaaggtacttccctagagcctctggagggagtggagccctgcccacaccttgattgcagacttctggcctccggagctgggagagaatatatttctgttgttttaagcaaccccagatcagggtacttgctgtggtagccccagaaagcaaatacgagggagactgagagcctcagtctttgagatcctgtcatcactgcctctcgagtcgccatgggcatgtggcctcaggccgtcagcatctcagggtgttggctctgctcaaagccatccgtcctcgtccacattgcaccttgtccaggccttcttcgagttggtcacctgagcctattattgacggtttggctgtcctccccgttgcaagcatggggatggtgcgatgctgccatttgtcaaacaagagccccggaaagccagaggtacaaccaaagacagaaaaataagaaccatgagcagtcgcggtgcctctattattttcccaggacgattgctcttttcctccaatgggcctggggaagaagcaattctcacagatcctcctcaacatgaagggtgtcagggtccctgcagatttggctggagctccagacctcctctgtgatttggttgccaaggccggatgtgcccagcgagcacttgaaatgaggcctgtgcaactaagaaactgaatttttaaaattaattctgttttaattaattttaatttaaactccggtccttgattcagttattaagaaaactcacgtatgtttggaacaacctgctatgtgaatctgcctttttgactgtaaattttatgaactctaaatacagatcacgtctttccaatggaaatttaacattcaaattgaagtgtgctgtacgtgtaaaatatacaccagattttgaagacctagtatgaaaaaaagaatgtaggccagatgcagtggctcgtgtctataattccaccactttgggaggtcaaggtgggaggatcgcttgagcccaggagttctagaccagcctgggcaatgtagtcagaccctgtctctaaaaaaaaaaaaaaaaaatagctgggcatggtggcatgcacctgtaaccccagctgctcaggaggctgagatgggaggattccttgagcctggcagattgaggctgcggtgagtcatgaccatatcaccgcgctctggactggatgacagaactagaccctgtctcaaaaaaaaaaaaaaaaagtaaaatacccccctttatttattttttgagagggagtctcactctgtcgccagggctggagtgcagtggcgtgatcttggctcactgcaacctccacctccccgattcaagattctcccacctcagcctcccaagtagttgggattacaggtgcctgccaccacagccggctgatttttgtatctttagtagagatggggtttcaccatgttggccaggctggtcttgaactcccgacctcaggtgatccacccgcctcggcctcccaaagtgctaggattacaggcatgagccaccaggcctgggctgccattatactttttatatggattataggttttggatattttgagttaaataaaatacattattaaaattagtatttctccccctttttaaaaattttacaatgtgacaattaaagaatttacaattacatacatggcttgcatgatttcttttagacagcactggtctagaaaccaagctggaagtttggaacggatgtgcgttttaatctccaccaatacagggctttgtgacttggggaaactgcgagctccctccggacctcaggtttccaacaccaaattaaggacgggactcgcctggtggattcagggtattgaggggaacttgagaggggtagagctttgaaaaccaccaccaggttcgttgaccccaattcctttctactgtgacttcatggttcgaccgaggactggctcacactatttcctctcgcaggctgagcaggtgatggcgcttgcaacagggttgctgggcacagttgtgcaggtcgttgactgcacacaggagcctttcctgatttccatgaaagtgctctgtgcccatggagaagaatgtcaagatttctagattggaatggcatttccatttaaaagcacttgcctatcatctagatgtataaataccgtaagggccctctgtttcctgaggccacttaggaatctggagggaaggtctccgggatgaggaatacatttgcagagaaggaagagggttgttgttggttgcagcggtggggtggagagagtattcctgcccaatctctcctttgtagagacttgcatcttcaaaatggccatctcgggcgctcaatattgaaagctgctccacgtggatccttgaaactctcaccctgatgagagtgggcagtgctgctggctcggtttgcatggaatcggtctctcccggtatttcctgagtgcctgcagcacccataggatcagctcacagtgcggcgacccctctccttcccggctccaggaggtctctatgctccaactcccacatctaggtgggccaggtgcctcacttgctgaaggaatgggaacaggagcggtgtgggccattctgggccttgcatgagtgtgtggagctccctgcagagcggcccccggactgtgtcctgagcagaagcacacttggactgtgtgacccccctgcttgtcacagtggtgggcacatggactagcacagtgtgggggaggggctggtccttgcttgccctaaagggctgcacttccaggcagcagggaatggagcgggcacagcctttgttagagtgtccaggcctccccgcattggcctgggcttccctgcagagcttccctgtgccatggggaggaggaaggtttcccagcttcctgtcctgcttcccaggactcagcgcgctccccatggcctccaccctgccacccttctccacacgtgggtaattagcagctgctggccagaggctggctgtgagccaaggcattttctctgcctgggaaaaaaagaaaatgaggttataagttccaagccatggaaaccacctagaactccgaggctgttttgccgagcaccgtccgtgtggagttttggaggggcacggaatccccagcgccaggatgaccgccttccctcggccttgaggctctgctctcccccgggcccttgcttggcacaaggaaggaggcctggaggatgctggatgcttctggacttcccagtgtgcaggagcctggagggaagggggtggtgggtgggtgagtggggaaggaaggggactgggcggaccagagggagtttcccagagggtcgttgttggtgtggcatgggggtggcttagtggagcctctgttctccctgcagcgttccgcccccaacgggacgtgatcgtcactgatggagaccacagataacttctgaggttacgtgaaagcagcaacatagattgtgaagcatgagttgagtctggcaaagccactctgcgtaatgccagggcctccctgcctggcattatgtcctgagtaaggggcagcgctgggatccttcggactctatggccgtgctccaaagcaaacagatatgcaaatatcttttaatgagaaagaagcacacgctcgtaaaattcaaacaacactgcagcttgtaaactaggcacttttaacacacggccactgcattcttccatactcctctcattgagagatggggtcactgtccccttcccttgactctgggggcttatgaccacatcccccaatagagttcagtggagctggtgccatgtgacttcggaggccaggtcagggaaggccatgcagcttcctcctggtgctcgagggatgcttgctctggggaaggctggctgccatatgagaagtcctacaaccctaaggccggcatgctgaaggggcaggtgtgggtgccccggtcctcagtctggctgagctccagccagaagcagctgcctgccatgacagaggaccagcgcgaatgtccagccacgagggacggctagcatggacatccaggcctgttgacggcagaacctggaacttcatgagagcacagggctcatcctccgttcccttggtgtgtggtgtgttcgtggattcacttactcactcgtaacttcatttattcaacaaatgttgattcagcaccttgggccagatgtattttgaaattcatgtttgtttttggattttagcaaggcaataggggtattagggttccccagagaaacagaaccagtaggagatattgatctattgtctctctctctctctccctctctctctctgtcccccctctctccctctctgtctcttcctctctctctctctccctctctctcttcctcttcctctctccctctctcttcctctctccgtcttcctctctccctctctcttcctctctccctctctcttcctctctccctctctcttcctctctccctctctcttcctctctccctctctcttcctctctccctctctcttcctctctccctctctcttcctctctccctctctcttcctctctccctctctctctttctctctctctccctctctctcttcctctccctctgtctcttcctctccctctctctcttcctctccctctctgtcttcctctccctctctcaggagaggggcctgctcagggaagctgctcttgtggctggacgtccgcgctgtccctcccttgaggctggacgtccgcgctgtccctcccttgaggctggacgtccgcgctgtccctcccttgaggctggacatcggcgctgtccctctctcgaggctggatgtccatgctgctctcccttgtggctggcagttactgtggctggcatccagtagtccagctggactgtgaatcggggcccctgtgctggcccccttcattgtggtggctcagggttgttggacttcttatgtggcagccggcttcccccagagcgagcgtcccagtagcaccaggcagaagctctctgctcctctgatctggcctcagcagtgaggcagcatcgtttctgttgattcttttggccaagtgaccacagatcctaccctgattcatggggaggagacgtgaactacctctcaatgagaggatgatcaaagaatgctgtggtcatgttttaaaactgccacactttatgttaattagcttgatttaatcattcacatcgtacacatgtatcaaaccattaagtggcacaacatagatacatagaattcttcatttgtcaattaagagaaatgaataaacatgtatgggatgagtttttaaaaagtgccacactttataagctctagtgttgtttgaacgtttacaagcatgtccttgttttctagttttaaaaaggcatttgcatgtttttctgtttgctttggctataaagtctaaaagatcccacctctgccccttgctcaaggagcctcatgtgactttcatcttcctctacctctgctaatttcccctctgagaagaagagaataggcttcggatcacagctccttggcaagcaaaataacaaggatatcgcgagaaatcagtgaatgccgttgtttcgcggtctggtacaggaataccaggccttcgccaaaatcctaagccttgtgcgttcgaagtttaaatttcccttgggcagtatggtgtctgtacagcgatttgcttaacacttttagtgggttctggggagtcccttattactgtctcttttttatctgtttcttcagcgaaaaatgtgattttcacactaagtagaatagagagactacagagagctccaagtcagttcaagtcaggtttgccaccaaaggagaatgtaccaaatttacaaataaataataaataaaaacaaaaagaaaaaaatcaaacaaacaaaaccctcttgcttttcagagccttgggtttgggttgtgaatgagggattgtggcactgtgttagtttttatggtgaccttccatttctggaaagcagggctgatttttctatgatcttaatgatatgcagttgtcccttaaataaaataatatttaagtgaaaaaagttgaaatatagtgagtaaacgtaaacagaaaccactggtggaatgcagatgtccccaaagtgtggttgtttccccttgaatgacttaaatctgaggaactcagatctaacccagcccctactcgaactgggagggagaagtgactcctctgagctcctcctgggagatggcgtcacaggtttgcagggctcaggtcccaggtgaaggggcacaacatgccccaactcccaaaaggccccccgttttcctccattctggtaactacccttcccaggaaccacaatgtgacctctgtcaccactgagaagtcgtttgagtttgagtttatggctgtggcatgtggacttttttgatcatctttgtgcttgtgactgtgtggttgccaaattctcattttctttgctgtgtagtattccacggggagactgtcctgattcacttacccattttaccatcgatggacatttcggcaggacagccaccaacattcgagactgtgccttttggtgaatgcgtatccctgtttggggtgggaatctgcccagaagtgtaatttctgggtcacagggggattgtgtgttcagcgtcagtaaatcctgccggctgtcaacttcaaaagaggttctaaagtcttgccactcctgctgctttgaaaacctgcctaccctttgctataaataggcaattttaaaggatttgtttctttgctggttttaatcgccttgaaattcttggcgacataaaatatgctccaaaggggataaagagagagttgtgagagttctcgttcaaataaatggcctgtcttctgggtcgaaaggcaaatccattccttgcacgacaagcctttgttcccttgctccttgttttaatccttatttcttagtccgtgaataaaactccagggatcctgtcaagtcatgtaacattggtttcatttttattccttttggcaggtgctggcttcccctggcttcagatgaagttatcggggttggcctcactgccccccaccccagggtgcaggcagtccctgcctcccaggtgtgagttgccccatcaccaggaattttgcagcagctgggctataaaaccagagaagctttgcgagggatgtggctcagagatgctgaggtggggctggtggctcctcgtgctccaccctggctgccctgtacctgctgcgggtgacagttgacacacccacgtcttgggctcccacctgctggctcccagtgactttggctgctggggccactgggcaaatcccaagaacaggaggtggcagggttggggtttttcttatcctgtccccaccctgttctgccaccacagccctgaccatggctgtatctctcctgctcggtgctccctctcccactggctggtgacactatttccttcccttgtcccttcggccctggggtggtcacagtttcctgctgccgttcatcttggggtctccatatcccttacctgtccccttggctctgcccgctgtgcggtgaatgggccctgcaatgtgctgttttcacttaaactctctgaggggggtcactgttttctgccaggactggctcagcctgaaatcagcggtcacgttctggactggccaaacctccagaagcttggcactcttggtgtctctgcggggttcctgccttgctgggactcctcttgctgtctggtggagcctgagggcctcatggtcagcagaacaatgactgccagagctatgcatgcccagatctccagagcccatgagtatctgccctgtggcatgcacatgtgactgggttaaggaccttgcaatggggagagtatcatggattatctgggtgcccaacgtcattgtggggtccctgttggggatggggcaggaggttcagagtcagagaagtgctgtgagggtgaaagcagaggttggagccatgcaattgagggctgtgaagatgggggaaggagccgtgagtcaaggaatgcgggtggcctctggaagctggaaaaggtgagaggccagattttcccctggagccgccagaaggaaccagccatgcccacaccttggattcagcccagtgaggttgtttgggactttggccctaagaattgtaagagaatggatctgcgaggtgaactcagttttgggtcctttgttacagcagccacaggaaattcttcttggaataaggtttttaaatccgtaaaacaaaacgcatagacttatacaggagatggattgtacagacccaccgtcccagccacgcaccccgtggtgggtgccggaccctgcctgtgccctcctgcattcccctctgcaagctggaggctgtttatcatccgcacacttgggttctagccaaggcctttgtccaaccgcagaagcttcctcagaccatgcggggcgagctggcaacacaggaaagtcaacgttcccaaagcagcccttactgtgggatgggggtgtggtggacaaacatggcctccaccagggggcgcgatgcatctcccgttcccctaagctggcctcccggtgcccactgtgctggctggcctggggactgccatttgctggcctccctgtcttcccctttctcacccaccactgctggtttcccagagcacctcccagatacgcctattgcactggaagcctcatctcagggcctggttctgggggaacccacatccaacaagagcctgggcgttcatgaagccctggattcccacccacactctatgccaaggcctttggctgcctctagggatggttccagagcaagcgtgggcaccgcacctgaaggcagtcattctctgaggtcgtcagtggcccatttcagaccttgtgtgggattttggtttaccgaggagcagcggagatgttatgagctcagtggtgacccccggacacagatgttaaagtctcaaaccttggtacctatgaatgttgtgaatgtcacctcactggggaaacgggtctttgcagatggaattaagtcaaggatctcaggatgggatcatcctggatcagccaaatgggccctgaatctagtgaccagtgtccttacaagaagaggaaaggacagagaggcacagagagaaggccctgcggggacagaggcagagatgatggctacgtggccacagcccagggctgcctggagctcccaggagctggaagagataagaagaagccttccctagagcctctggagggattgggggccctgctgacaccttgattccagacttctggactgcagaactgggagagaatacatttctgttgttttaagcctcctcctctcccctccccaagttgtagtcctttatgatgaggccacaggacacaggcttactgatgcggatttgattctttctccttgactttggcctgggcctggctccaagataagatgggctgtgtggccacgagggtggcaggggagccagctgcacgaggttcccattggagcagggccaggagggctgcatggcttgtgctgggcttctggggcccaggtgagccaagctcctgcagcacctgccagcgcatgggcggagctggctgtgtgtggcaaagtgatcaacacttagtttcctgtttgagggatcatgggagatccccccttgcggttgatgtggtgacagcatgttcattttaattgtggagtattccattctatgaacacaccgccattcatgtacctatctccctgttgatgggcattggataatttccagtttgggcctattgcaattctagcacatactatgtactgccatgagcattctagaatgcaccttttggtgactgtacggatgcctgtctgtaggggacacgcctaggcgtggaattgcccagccaccaggaatgacactcaggctgagcttccacggtgtt

SEQ ID NO: 491 - DNA, 40001 bp, Homo sapiens
ttcggggcctccgtggtgcagacacaaagatggatccccaggtggaaacccgggcacgtcatcccggtttgttcatggtgcaagatgtctccggttacttcggggagacaggaacatgacctgggttatcagcaccgtccagggacaccagagataaagcctcatctataacatccccagtaaaaagctgagaattgctcctgacaaggtcctggggctcttccttcctctgggcagggctacagcttagagactgggagaaagccttggggttggccagggacacccacctgcctcaggaggggctgtgttaatgacatcagcctttcagcaatggaaactaaggaggatggggggaggaaagtacaggaagacttgtaaagggaaagttctgtttggattcagggcccaagccccaaaccctgataggaataaaatgatcagaggagcagccggggaggctttggtgcccctcaggcagccgcatcactcaagactgttcacatcagcaatagcttcacggggccggtgtccacgaggctgctgctccggatgcaaagcacaatgctttaggtcaggatgtgggttctagagacagaacagacccggttcacggcctggtgtcacgacgtattgaacctctctgagcttcagtctcttcagtaatgacggtaagtgctttaactgagattgttaacaagacccagcgagatcgtgaaaagaagacaccccgcacagcgcctgttccctcgttagcactcacgcagtatcagctattatcatcatgctggctgacttttatgtgagcgtgtataacacgggtacacacacacacaacacctctctccggagggtaaaaacaagacaaaaagtgaaacaggccccccgatgccgaagagatgacggcaaccccgatattgtgcgtggtgtgaaggtcaccaaagcaaaaccacacgctttgttttctgggggtgtctcattgacagtgcagaggtagcttactagcatttttgcttgtttgtttgtttttttgagagagtctcgctctgttgcccaggctggtgtgcagtggcgtgatctctggctcactgcaacctctgcctcccacgttcacgccattctcctgcctcagcctcctgagtagctgggacaacaggcgcccaccaccacgcccggctaatttttttgtatgtttagtagagatggggtttcaccgtgttagccaggatgctctcgatctcctgacctcgtgatccgcccgcgtcggcctcccaaagtgctgggattacaggcgtgagccaccgcgcccatcctgcttactagtgtttcttaaaaagtcaaagcaacgctattcttcataagtgtgttcctcccatactttgctattcaagagcagctagattaagagaaagaagatccatctagaaaaacataatccctttgcctccttttatttatttatttttcgaaacagagtctggctctgtagccgctctgttgcccaggttggggcaccaccatgcccagctaatttttgtatttttagcatagatggggtttccccatgttggctaggctggtctccaactcccgacctcaggtgatccacccccttcggcctcccaaagtgctgggattacaggtgtgagacaccgcacctggcccaagaacctctttataacagatgcagccataccagagccccagagcgcacattcaaaagagaatctccaacctcttattactcatcttagatcactcattctaaattgcaaattcaaaggggatcccggctgtctctttcctatactcttcagcgaacagtccccaaacacacacgtgcccactcatgatgaagttgcattcagagtatttcccctatggacaaagaggctcagattcctgaccctcttctgaaaggccccagctgcccccttttcacatcttcacatatgagctggcagcaaatgttgcatgaaatgaagaccctgttaggaaagggaaggtgatccatagccatctactcctaatccgctgacccttgatgaaataggcctaggtttagggttaggaaacactgcggctagaaacagagaccttggagacaaatggccctcttgtttcaacaaggaagcttctactgcttgggagaaagtggtcagctcagctctcctcgaaccctactatttaggttggtgcaaaagtaattgctgtttttgccattactttttttttttttttaagatggagtcttgctctgtcccccaggctacagtacagtggtgtgatctcggttcactacaacctccgcctcccgagttcaagcaattctcctgcctcagcctcccaagtaggtgggattaaaggcatgcaccaccacgcctggctaattttgtatttttagtagcgacgaggtttcatcatgttggccaggctggtctcgaactcccgacctcaggtgatccgcccgcctcggcctcccagagtgctgggatgacaggcgtgagccatcgcgcccagccccattccttttaaaaggtctttcacttgccggtgtgagcagaggatcctggggagactccttggaaggggcttcggatccagccaggctcccgcgcagtcctcagggggcgtggcccggctcgtgggggcggagtccatggggggcggggtccgcggggaggagcctgcggggcggtcccccgtgggggcggggccttgagggggcggggcccgcggggggcggagtctgcgggggcggggcccgcggggacggagtctgcgggggcggggcccgcggggacggagtctgcgggggcggggcccgcggggacggagtctgcgggggcgggggccgcaggtcctggtcacgtgatgaggctgcggtaagtcgcccgggctgcctagtcctccaggcgcggttaatccagtcgggaacccctgagtcaccgcccgccgccgctgcgaggagcccggcgagtgttcggcctcggtttctgaggtttcggcgggagcggtgatgcagacgccttcagggcccgggtcgtgtccgtgactcgcgcaggaaggcggatggcgccccccgggcctgcctacaccctgggaacctcgcggggcgaagggggctcgggcgctctctccgcgtggcgagagacccgccagggggtgtggcgtgagtgtgtgtcccgccaggacgttccggtggcgccgcctgacgcgggaggagaaaccagctccagctcctcatctggattttacataaatccatggctcaaagtgctttcctgtccggacctcggtgccggcttcacgggggaaatccctggagccgaggggagggcacgagaaaccaccgacccccggcccacgggccagcccagtccactcctcccggcctctccctcatctcggcctgggccccgcagaagccaccaccagggctcctggattccaccaggggcatcttagtccccagcggggcatttaaagacttaatgtgggccgggcgcggtggctcaggcctgtcatcccagcactttgggaggacgaggcgggcggatcacctgaggttgggagttcgagaccagcctggacggcatggtgaaaccccgtctctactaaaatacaaaacattatccgggcgtggtggtgcgcgcctgtaatcccagctactcgggaggctgaggcaggagaatcgcttgaacccgggaggcagaggttgcagtgagccgagattgcgccactgcgctccagcatgggcgacacagcgagactctgtctcaaaaaacaaacaaacaaaaaaaatgagaaacatgggttcaaactacagtcctgagccatatgacctgaaaggactatatatacaaaggtggtccagaagattataatcctgtattttttcctgtaccttttgtacgcttagacgtgttcagatacacaaacattttccattgtgttacaacggcctatagtattcagtatagtgacctgctatacaggttcgtacctaggagcagtaagctgtctatatcatatatcatatctatatcacatagtgggctataccattgagcctactatgtacctgggctgtatgttagtatttaggtttgtgtgaaatatacagccaggtgatttttgtatttaggtttgtgtaaaatatactatgatgcttgcacaacagtgaaatcatctacacatttctcagaacctctttttttcttttctttttctttttcttttttttttttttttttttgagactgagtctcgcgctatcacccaggctggagtgcaagggcgtgatctcggctcactgcatcctctgcctcctgggttaaagtgattctcctgcctcagcctcccaagtagctgggataacgggtgcaccaccacgcccggctaatttttgtatttttagtagacatgaggtttcaccatgtaagccaggcagctctcaaactcctgacctcaggtgacccgcccacctcagcctcccaaagtgctgggattgcaggcctgagccaccatacccggttttatccccattattaagagactgtaatgagctctgggccctttggcacattacccaatattcttaagccttagttttctcatacatcaaatgggggctaataatacaaacctctctggttgtgagaataaatgaaacagtgcacaaatgagatacaaatacttctaagcatgccgtgaaaggcctgagaatgtatcatctgtaacagcctgttctgtaggctccttctggagagaggagtggggtcggggggagaggtgacaggaaatgacaggcttcatttccaagatttcagtagcgtttgaatcttttctattgaaaatgcattggctgggtgcagtggctcacgtctgtaatcccagaactttgggaggccaaggcaggaggactgcttgacccagcagtttgagaccagcctggacaacatagtaagacttcatctctacaaaaaataccaaaattggccaggcgcggcggctcacgcctgtaatcccagcactctgggaggcccaggcgggcagatcacaagatcaagagacggagaccatcctggccaacatggtgaaaccccatctctgctaaaaatagaaaaattagctggatgtggtggtgcatgcctgtagtcccagctactcagaaggctgcggcaggagaatcacttgaaccaggaggtggcggttgcagtgagctgagattgcgccactgcactccagcctggcgccagagcaagactccgactcgaaaaaagaaaaaaaaaatacaaaaattagctgggcgtggtggcgcgcacctgtagtcccagctacttgggaggctgaggcaggagaattatttgaacccaggaggtggcggttgcagtgagctgagatcgcgccactgccctccagcctggtgacagaaggagactccgtctcaaaaaaaagagaaacaaaattagctgggtgtggtggcacactcgggaggatcacttgagccagagaggttgaggctgcagtgagctctcatgtgaccactgacgtcacatcactgtgatgggttagacactgatgcgtttatagtgtaactgccacgtgactgggttgttgcgtgcacaaccgagcatcccttgaccccttagatcacacagggtttatcccaggaatacaagcctagctcaatattagacaatctgcatgattcactacattaatttattattattaatattagagacaggttcttgctctgccacccaggctggagtgcagtggcactatgacagcttacttgcagccttggactccagggctcaagcggttctcctgtctcagcctcctgagtagccaggatgacaggcatttggaaactgaaaagtggaaataaccagctttcgtttctgggctgcagcttgtttagtgccacatcttggagaaagctctgtgcttgtggttagatgggttgatcttgaatggccaaggtgggtggattgcttgagtccaggagtttgaggctagcctgagttggtctgcaaaccagctcaccagatattgggtttcaccatgtctccaaaaatattttgtgaaatttgtgaaactccatctctacaaaaacatacaaaaattaggctgggcgcggtggctcatgcttgtcatcccagcactttgggagaccaaggtgggtggatcacctgaggccaggagttcgagaccaccctggccaacatggtaaaaccccgtctctacttaaaatacaaaatttagctgggcgtggtggcatgcgcctgtaatcccagctactcgggagctgaggcaggagaattgcttgaacccgggaggtggaggtggcagtgagctgagatctcaccactgcactccagcctggacaacagagtgagactccatctcaaaacaaacaaaaaaaaaagccaggcattgtggttcgtgcctatagtcccagctactactccacaggctaaggtggaaggattgcttgagcccaggagttcaagggtgccagtgagctgtgattgtgccactggcactccagcctgggcaacagtgagacgtgtctcaaaaaaaaaaatgtgaacagattctctcaaaaagaagtaaggtgagaatataaattggatcaacttttctgaaggataattttacaatatctatttgtatttaaaatgcatatatttggccgtgtgcagtggctcacacctgtaatcccagcactttgggaggctgaggcgggcggatcacctgagctcaggagttcgagaccagcctggccaacatggcgaaaccccatctctgctaaaaatataaaattagctgggaatggtggcaggcgcctgtaatcccagctactcaggaggctgagccaggagaattgcttgaactcgggaggtggaagttgcagtgagccgagatggcgccagtacactccagcctgggcaacatgagcgaaactccgtctcaaaaaaaaaaaaaaaaagagaagtgggggaaaaaaggaaactgttggaatcacagaccttatgactttgtaattccttgcacagcctctcttagaagatcagtaactttgttttttgtttgtttgttgttttgtttttgagacagagtctcgctctgttgcccaggctggagtgcagaggtgcgatctcggctcactgcaacctccgcctcccgggttcaagcgattctcctgcctcagcctcccgagtagctgggattacaaggcgcctgccactgcaccagcctaatttttgtatttttagtagagatggggtttcaccatgttggccaggatggtctcaaactcccgacctcaggtgatccacccgcttcggcctcccaaagtgctgggattacaggccggagccaccgcacctgtccagatcaaccactttggggccattgatatcagagatggcctccctgctcttgtctaggaatgagggtgtagcagacccattgagttatgagtgtttataaaagagaagttgctcgacccccagatgagtccctgggtggaaaggaaatggtggatactagaacttgttcttcctggccttcctgggcaactgacacacaggaggcagctctgcctgtgacccgaaggaactaggtgtcaggagcagcaacgcagggcaccccagtgtgaagtgcccttggccagctgaggaattgacattctcctctccaggaacagcagcagcatgtgctgcgtctcgatcgggtgattcccacaccatcactgcatgccacggtcccctgtcagcctgtgaagaaccagtctcagagccacatctgtggcagagaagtccttgctactaatgagattcgagttctctgctaacgtcgcggtagagaagtgctgaccactgctcccttgttgactctgtaagggagaggttcaagagggagctgccggccgggcacagtggctcacgcctcttatcccagcactttgggaggccgaggcgggcggatcacgaggtcgggagatcgaaaccatcctggctaacacggtgaaaccccatctctactaaaaatacaaaaaattagccgggtgtggtggcgggcgcctgtagtcccagctactcgggaggctgaggcaggagaatggcatgaacccgggaggtggagcttgcagtgagccgagatcatgccactgcgctccagcctgggtgagagtgtgagactccgtctcaaaaaaaaaaaaaaaaagcctgctttgtgcctgccaagtcagttaaagacggcaagtgcttagtatgggtctctcttgtacatacatgtatgtagtgaacacctgtttgctagcctagtaccacagttacactgaaggctcctgaagcagaattttgaactctttcccttggttcactgctcggctcaatgcaggtgccaataaagtttgccttcatggtgcctgaatccctttcttccggatggagttcatgggagcttggaattgatagagttcatgggagcctggaacttacagtcataaaatcagacatacagtgttttactctctgcagctgcgttgaagtgggtggtgttttattgttcacatccttctcttttaacctgtttgtttctttctttttttttttgagaccgtcttactctgtccttcaggctggagtgcagtggtgtgatctcggctcaccgcaacctccacctcctgggttcaagccattttcctgcctcagcctcccaagtagctgggattacaggcatgcgccaccacgcctagctaatttttgtatttttaatagagacagggttttgccatgttggccaggctggtctcgaactcctggactaaggtgattcacctgtctcggcctcccagtgagccaccatgctcagccaaagtttgcttgaatggtgcctgaatccctttcttccagatagagtttatggtagcccagaactgacctctcgtggtcataaaatcagacatacaatgccttactctctgcacctgctttgaagtgggtggtgttttattgtccacatccttctctcttaactttctaatacttggtgacgtggacaccccacacacatacgagttacacatatacatagataattatactgttttgttgacctttttcattgagcagtttggaggtataatcactctaaattttctgcagcaattcttttaagcactggaaaaagttgcatttatcaaagtccagcaggtatccccagttatttacaaattcagcaaatttacgaatcacaacaaagctgccatcttaactccacgatgatctttgctgctgaagaaaacagatacatatgccaaagtgccttcagaacctccaacaaattaaaaaaagaaaacacatatctttcatggcaaagacacctaaattagtaaagcactaaattagtgacggctgatctcttagagagacagggagaaagtagaggtagaaagtaacagaatctagagaggcggaagctcagcccagctgtgttggtactgtgggggctgtcactttttacctgcgtagaaagttctgacctaagccgggcgccgtggctcacacctgtaatcccaactctttgggaggccgaggtgggtgaatcacctgaggtcaagagttcaagaccagcctggccaacatggtgaaaccccatctctgctacccagcttctccgcactatcgtccacgttatcactcagcttctctgcactatcgtccaggtgtcactcagtttctccatgctgttgtccgcgtatcactcagcttgtctgcactatcgtccaggtgtcactcagcttctctgcactatcgtccaggtgtcactcagtttctccatgctattgtccgcgtatcactcagcttgtctgcactatcgtccaggtgtcactcagcttctctgcactatcgtccaggtgtcactcagctttctgctattgtgtttgctctcaagccaaaaatcactttgggctgtttcctctctctctgcttcctggctcctaacacaaaaggattactttatcactttatcaaccaactggcaactcctatctactcacacacaaactcaaaagggctttttcctccatgctttgcttagaccaaccttagcctcttaaggacatttagaaccgtatttttgcatccttttaacatcaacctgtagggccagatggacggaaagggccctatattttaaaggtgccagacatttaccacctcatatcaagcacttggcaaagcctgccaaactctggggtgctggactggctgctgaaaaatctcccgagcttgttaaaaacagagattcctggccgagcgtggtggctcacgcctataatcccagcactttgggaggccaaggcggacggatcatgaggtcaggagtttgagaccagcctgtccaatatggtgaaaccccgtctctactaaaaaatacaaaaattagccaggcgtggtggcagacgcccatagtcccagctactcaggaggctgaggcaggagaattgcttgagcccaggaggcagaggttgcagtgagcagaaatctctccacttctttccagcctgggcgacagagtgaggctccgtctcaaaaaaatgaataaataaataaataaataaataaataatgaaaaataaataaaaatatggattccaggttttgctctgacccagtgggattccatttcagtggagctagccaccaaaaatcgatcttcttctgctgttcctgcagaggtgtctgacttgcagtcagtccttatctaaattattccaggtcctgtggcaggtgcttagaaaacaaagcgtgaatcataggagtcattattgattgattattcaccgtgatttttttaccatagatttcctcattaatccccacaacattccaggaaatagacactattaacacatccattttacagataagatatccaaggcacagagacgtgaaataacgtttttaaatcctcacagctagtaaggggtagagctgaggttcaaacgtgggcagtctgaccccagaacctgcatcctttactgccataaggtggtatctgccttcagcaatgctagcaaggtgggaacaatatgtaaattactgtaacaaggccggccacggtggctcatgcctgtaatcccagcacttcgagaggccaaggcaggctgattgcttgaggtcgggagtttgagaccagcctggccaagatggtgaaaccccgtctctactaaaaatacaaaaaattagcctggtgtggtggcacaagcctgtaatcccagctactcgggaggctgaggcacaagaattgcttgaactcgggaggtggaggttgcagtgagccgagattgcaccgctgcactctagcctaggcgacaagagcaagaccccatctcgaaaaaaaaaaaaattactataacaagaagaagaatgaaacagtgttaaactgagatacaaagaggctgggcatggtggctcacgcctatagtcccagtactttgggaggccaaggcaggaagatctctcgagtctgggagttcgagaccagcctgggcaacagagcaagacctcatctctacaaaagttttataaggattagccaggtgtggtggtacatgcctgtggtcccagctacttgagaggctgaagtgggaggctcgcttgagcacaggagtttgaggctgcagtgagccctgatcatgccactgctctccagcctgggcaatagaccatgacactgtctcaaaagagaaaaaaaaacaacaacaaaacaaaacaaaaagagacgccaggcacagtggttcacacctgtaatcccagcactctgagaggctgaggcgggcggatcatttgaggtcaggagctcgagactggcctggccaacatggtgaaacctcgtctctactaaaaatacaaaaattggccgggcatggtggctcacgcctgtaatcccagcactttgggaggccgaggccagcagatcacctgaggtcgggagtttgagaccagcctgatcaacatggaaaaactccatctttactaaaagtacaaaattagccaagtgtggtggcggacgcctgtaatctcagctacttgggaggctgagacaggagaatcgcttgagcccagaagttggaggttgcagtgagccaaaatctctccacttcactccagcctgggcaacagagtgagacactgtctaaaaaaaaaaaagagagagagagataaagagatacttggggagaagctgtatctgggatgggaatttggacttaagaaatttttcacccttttaccaaacagctaaaggagtgtgaaattcccccaacaaatccttgaatggagctgcagacaatcagagtcaacccatctaaccacgcacagagctttctccaagatgtggcactaaacaagctgcagcccagaaacgaaagctggttatttccacttttcagcttctaaaacctgttaattttgtaatatgctcagggtgggagacagctcagcccaggaaatgatgagatgtgaagctgcagattctgtttttctcccaaacactgtgccggccattaattcacctaaagaccatgatttgagacccaactagcaaactaaggggcatccaaagagcaggaagacgtggccatagtttaggtgactaagcaggtactatttggtgtgaattaaggctgcagagcttgaaggtcacagtcttttttttgagacggagtctcgctctgtcccccaggctggagtgcaggggtgcaatctcggctcactgcaacctccgcctcccagatccacaccattctcctgcctcagcctcctgagtagcttggattacaggtgcatgccactatgcccggctaatttttgtatttttttaagtagaggcggggtttcaccatgttggtcaggctggtctcaaactcctgacctcgtgactcacccgcctcggcctccgaaagtgctgggattacaggcgtgaggcaccacgcccggccaaaggttacggtcttaactcctaagtccttctgtgctagcttctcagagattgcacgcaaactgtgcaaagatactgtcttaaccccacagtgatttcacttcttcaaagatgacagactctatggttccaaagcgacaaaactgtgaaaacaaggcagtctaaggtgctgtttctattttggagagatgtgaaatggtttgttttttgttttttgagaccgagtctcgccctatcgcccaggctggagtgcaatggcacaatctcggctcactgcatcctccgcctcccgggttcaagtgattctcctgcctcagcctcccgagtagctgggattacaggcgcccgccaccacgcccggctaattttgtatttttagtagagaagaggtttcatcatgttggtcaggctggtctcgaactcctgatcttgtgatccacccgcctcgggctcccaaagtgctgggattacaggcatgagccaccgctcccggcctgagatgtgaaatgttacacaggacttggacttccccgccccccaccaccaccttaaacctaaagataagctaacttcaggtcccttcaacctaaaatgaacatttattttggctttcatcagtttttggaatctatgatactaggatgtgtgtgtatatatatatatttcctctccatgagtaaccaccaccccagggatgacttaggcaaaatatttaaattattccttaacaagtttaaattaccctaacaatgctgaatatctacagttaatagcaatttaaaggaatataaaggagagatttaagatttgaatataaaaattctgatcctggccgggtgcagtggctcatgcctgtaatcccagcactttgggaggctgaggcaggtagatcacctgacgtcaggagttcgagaccagcttgaccaacatggagaaaccccatctctactaaaaatacaaaattagccaggcgtagtggcacatgcctgtaatcccagctactcgggaggctgaggcaggagaatcgcttgaacctgggaggcggatgttgcagcgagccaagatcgtgccactgcactccagcctaggcaacaagagcgaaactccacctcaaagaaaaaaatatatatatttgattgtacatagtttttccctgtaatgtggcagctatctcggtgtatataagctcaatggccaagttctatttctctccaaataaaatactcagaccaaaaaagtattgctcttgaccaggtggggtggctcacgcctatagtcccagcactttaggaggtggaggcaggcagattgcttgagtccaggtgtttaagaccaccctgggcaacatggcaaaaccccatttctacaaaacatacagaaattaggtaggcgtgatggtgtgtgcctgtagtcccaactactcaggaggctgaggcaggagaatcacttgaacccaggaggcagagattgcagtgagcctagatctccccactacactctagcctgggtgacagagcaagactctgtctcaaaaaaaaaaaaaagaaaagaaagagctctccctctccctctctctccacggtctccctctgatgccgagccgaagctggactgtactgctgccatctcggctcactgcaagctccctgcctgattctcctgcctcagcctgccgagtgcctgcgattgcaggcgcgcgctgccatgcctgactggttttcgtatttttttggtggagacggggtttcgctgtgttggccgggctggtctccagctcctagccgcgagtgatctgccagcctcggcctcccgaggtgccgggattgcggacggagtctcgttcactgagtgctcaatggtgcccaggctggagtgcagtggcgtgatctcggctcactataacctccacctcctagccgcctgccttggcctcccaaagtgcccagagtgcagcctctgcccggccgccaccccgtctgggaggtgtacccagcagctcattgagaacgggccatgatgacgatggcggttttgtcgaatagaaaagggggaaatgtggggaaaagaaggagaaatcggattgttgctgtgtctgtgtagaaagaggtggacataggagactccattttgttctgtactgggagaaaatcttctgccttgggatcctgttgatctgtgaccttacccccaacccccgtgctctctgaaacatgtgctgtgtccactcagggtaaatggattaagggcggtgcaagatgtgctttgttaaacagatgcttgaaggcagcgtgctcgttaagagtcatcaccaatccctaatctcaagtacccagggacacaaacactgcggaaggccgcagggtcctctgcctaggaaaaccagagacctttgttcacttgtttatctgctgaccttccctccactattgtcctatgaccctgccaaatccccctctccgagaaacacccaagaatgatcaataaatactaaaaaaaaaaagaaagaaactgaacacctaaatagaacttactatgtgccaggctcagcccttatatcaacttgctcagttctcacaaatctgcgaggtagggaagctgttataaccccctgctccagaggaggagagcggggcccacaggggctgtgtcatttgcctagagtcacgcaggagtgagtagcagaggcagccgcaaacccagctccgagtcttcctctgttccctgcactagactcactcctctcacgtcagaagtggagaaaggggccagaggaaagctgacgccattggcaaaatcacgtccagcctgaaggggcccgtcggctctaactaatgcctcccattcacattgcccatcttcccatctttcaagaaaatccagaaatccagattgctaggtaaaacctggttttaaatggatccaattttgttttaaccctctgtagcccaaacaaagcacatcagcagactgcacttagcctggggccggccacgtgccaccctgctgttgcagctgtctctaaggactgcgctgtcctctgcctgtctaaagaccctggggaactctgggtctggtggccaaaggggagtcacctcagtgaacaacagctccttcagcccattgatatgaataattaatttctgcgtgctcactgccagcccacaaaggttaccaacaagctcggcattcaggaagccactctgtgccctctgagacaatgaggacaggcgtggggggatcctaggggtgttcagggagccccataatgaagcccagcatggtgagctgtgctcagagagccagcggatgccagcccagcctgctgcctaggtggggccacagagcatcatggaggctcattagagatgggacatgcggcggctttccctgctgtcagcaggagtgggctctggattcctcaagatgctttaaaataaaacggaaaggcgcaattatgcagccaaacagaaggcgaggcagctgcctacaaaacgaggctttctccgtaataggaccccaaccccagagcacagtgcggccgcctcaccgtcccccccaaggctgcagccgtgacgcgtctgtaattggatgcttcgctgttccagctcttggattattcaaattacaggattttcagtttcaattaaggttatgaccaggcaacaagatgagcaagataccatgtttcacctttatagtctatttcagcaagaagcatggccaaactagtaacagtggggataatcataaaattaaccaacacgtactgagtggttaccatgtgtcaggtctggttcaaggtatgttatatacatattgacttatttaaccttcacgccaacttacttgactattgatattatattatcatcgtcccctagcctacaaatataaacactgaggtgcaaaaaggttgaggaatttgctcaaggtcacatagcagttaagtggcagagccgtgaatcgaacccaggcaatgtggtcctagacagcgtgctcttatttattttgttttgtttttttgagacggagtcttgctctgtggcccaggctggagtgcagtggtgcaatctcagttcactgcaacctccacctcccaggttcaagcgattctcctgcctcagcctcctgagtagctgggattacaggcacgtgccaccatgctcagctaatttttgtatttttagcagagacggggtttcaccatgttggccaggctggtcttgaactcctgacctcaggtgatccgcccgcctcggcctcccaaagtgctggcattacaggaacgtgctaccacgcccgactaatttttgtatttttagtggagacggggtttcaccatgttggccaggctggcctcgaactcctgacttcaagtaatccgctacctcggacagcatgctcttgatcatcacaccagtagctgttttcatttatacggagctcaccacatgccggaccccatgctacattatttcatttaacctttgcaacaccaagtgaggtacaatgatccccattgtatagaaaagaaaataagcttatagacaggtgaattaacttggttaaggacacaaaataacaagtggctacagcctggatccaaacccagtttctctgattcaaagccaggctcttaaccttacttggtacgtagtcccagctcatttaacttactggcgtccataaaatttaggtctgtcgggaaaattatctagtccagtcaccttattttaaagtgaaaagctatagtctggagaggttaacagttagtggtgagctggagtagagaataactttggccccagaaagagctgtgttccaatcctggctctgtcctttgtgagctgtgtgactacagaccagtgactcaatgtctctagacttgttaatatagaatgagaagaatgatccttagtctcatgggaacatactgattaaagtatgtgtgtaacctacacttctgctcaacattcggcatgccaaaaccatctcattatagtcagctgtccccaaattacaaatggacgatttcaaactttggccgatgagtctgttctttatgatttgaaataatgctgtaagtgatgagtaggtcaccaagatgggcccccaagtccagtgaacagagaccttggaaaactgcagtgtacttctagacttctctgaattccttatacattccaaatgtgcaaaatccccaaggaaatcgcgtttttcagagagctgagcaatcagatctttaggccttccaccctcacaaatgaagttaatatactactaggtcaatgacatcaggaacacaataggtttgcatggtgcttaattctagtatccttttctatctgtttgtttgtttgtttgtttgtttgtaacagagtctcactctgttgtccaggctggagtgcagtggcgcgatctcggctcactgcaacctctgcctcctgggttcaggcaattatcctgcctcagcctctcgagtagctgggattacaggtgcctgccaccacgcctggataatttttgttttttttagtagagatggggtttcaccatgttgaccaggcaggtctcaaactcctgagctcaaatggtccgcctgccttggcctcccaaagtgctgggattacaggtgtgagccaccacgcccagccatggcctcacacacctggctcatgggtgacaaggaggatccttctcactatgttagtgatttaataaccttgcacctgcagcaatgaaccatcctgtaaggctgatcattttcctttgcataagccgtcaagactgatgatgtgcatctggatttatttcatttttgcggtccttattttttcttgccatggctggttgtatagcacgatgtgcctatgtgaccagcctcccattaaaatctcagactaatacaaaagttagccaggcacagtggccctcgcctgtaatcccagctactcaggaggctgaggcaggagaattgcttgaacccaggaggcggaggttacagtgagccgggattgccccactgcactccagcctgggcgacacagcgagactccatgccccaaaaaaataaaataaaataattgatttttaaaactgaggaaagaataaccccaccacttagcactaagagatcttgggcttgctggtggaccagtcagagcctcagtctccccatctgcccaataggaggctgttctaaaaattcaacgtgacagcgtaggtaaagcacttgacctagtgctttgcagagagtaggtactggagtatctttatactctagttccttcccagctctgtgtcaataaaaattttaaagtggccgggcgcggtggctcacgcctgtaatcacagcactttgggaggcggaggcgggcggatcacgaggtcaggagatcgacaccagcctggccaacatggtgaaatcccatctctactcaaaatacaaaaaattagccgggcgtggtggcgggcgcctgtggtcccagctactcgggaggctgagacaggagaatggtgtggatcccggaggcagagcttgcagtgaaccaagatcacaccactgcactccagcctgggcgacagagcgagactccgtctaaaaaaaaaaaaaatttaaagtaatcatttttctcagcagttgaaaaacgcgacgtgaggtccaggcagcctcccctcagacagtgttatctcaggccgactgtagcgagcgtcgaatgggaagacaggaacaggatcgctgcggaaagacttgcagatttactctgcagctacgcggtgcagaaataacaggacagactcacgtggtgtaaatacagctacacagagcggtggtgcaaagtcaggtggtcacggggatttctgcttatgattctagtatggtatacagagcccagtttccaaaacagccaaatctgccccaacacctggacgacgagtccctgtgactacaacacagccctgatgtttggaggtgacccactccccaccctccttgcaatgggttcctcaaaaccagaacaagctaaaaacgaaccttacacaaccagcattttccagcacagtaaaccaaggcagggaatgtatttttttcactgaacttctcattcgtgactattctaaaatcaaccaggaacttatcgagtgccggccatgagcccagccctgtgaaagatactgttgtgggagagaaaaggggtctaaacgacggtccccgctttccaggagtcagctaaccactcagtttgagagcagctcttcacagtaaacatgtaaaaggctactgccttgcacagggccgtggctccgttgttatttgtttactgactcaataaattaatagatggcataataataagacaattgtgccgtgtggggcccgctctaagaaccgcaagatgggttggagtcgttggaaaaggctgtgccagaggccactagctgcctacgcaatatcaattcttctatttttccttgtaacagagcccctattttacttgaggtggccatacacccagataaaatactgcatttcccagcctctcttatacctcgaggtgactaaggagataaaaacagaaactgtcaagagaggttcccaggaaagtgccttaaaaggcagacaaacagccaccactcactcttacgctcctcttcccattcttctaattcctgcctgaaatgtgaatgtgatggctggatctccagcagctatttcggaccaggaggtgagcttgaggacagagaagcagaaagactgaaaagcctccattcctgatgatcatggagtcaccatactctcggccggactgctggccgctggaattctgttacatgtgagataaataagcctctatcttgtttaagctactttttttcagttttgtcatatacagcaaacccctatcgaccaatcccaggttccacggaaaatcagcccttaaaggaggggttggtttgggggctggtttggggaagtcaaggcgggagggctcttcaaacgccagaaagggcacgggaaaagacgccggatggaatgagcaatggcagaaaggatctgcgtagaaaacagaatataagaagccagatggtggctttgcagacgccaagagagacagggcttgacggggaagcatcagggaccccaggggacctggaaaggttgtcttcctctgaagatgcaaaacacctctggagtagggacagcggtaagtaaaaaaggagagaaaggcaaacaaataagcttgggaaactttattacctggagagattcaaatataagcagtagcctggtttagccaactgaaaattcctggacttataacagcaacaataaagacaccatcgaggaagagtaacgataacagcaccatggaggatcccatctttttttctgagacggagtttcaccctgtcaccaagctggagtgcagagtcgtgatctcggctcactgcaacctctgcctcccgggttcaagcaattctcctgcctcagcctcccaagtagctgggattacaggtatgtgccactctgcccggataatttttgtatttttagtagagacggggtttcaccatgttggccaggctggtctcgaactcctgacctcaagtgatccacccacctcggcctcccaaagtgctgggattacaggcgtacgtgagccaccgcgcccggcctcaaatggcttcttaatatctcttcacaatagggatgggaaaaaattactctatcacagctgaggctgaaaattcaatccttcaaattaagttactcagacatccactgaacacaaggaattcttcctagagcaacaatctcattagtcactgatgggaagggcagaaaacccatcaggttacagatgaatcaggttcaggtaacatgactacttagtaggaaattcatttcccataaagattaaaaataaaaagtctcagggccaagtgtggtggctcatatctgtaatctcagcacttgtggaggccaaggagcgaggatcacttgagcccgggagttctagacgagcctggggaacatagtgagaccccgtctctacaaaaaattaaaaattagccggctcgtggcatgtgcctatagttccagctacatgggaggctgaggtgggaggatcgcttgagcctaggaggtggaggctgcagtgagctgtgttcatgccactgcactccagcttgggcaacagagtaagaccctgtcttaaaataaaataggccagggacagtggcttacacctgtaatcccagcactttgggagtccgagtcaggcagatcacctgaggtcacgagttcaagaccagcctggacaacatggcgaaaccccgtctctactaaaaatacaaaaagtaaccgggtgtggtggcgggcacctgtaatcccagctactcggggggctgaggctggagaattgcttgaactcaggaggcggaggttgcagtgagccgagatcttgccattacacaccagccggggtgacaagagccatactccatctcaaaaaaataaataatataaaaattagccgggcttggtggcgggcaccagtaatctcagctactcagaagactccatctcaaacaaacaaaaaatcagtaacaacacacacacacacacacacacagagacacgaataccctccatcgtcactctacgccaggtgttctgctacactctttaattattctcttgcatttaatcttcgtaactatcctgagagggaagtactaatatttgaggcggtacagcttggtgtgcgaaagcatggacctggaagccagactgcctggcttcaaatcctaagggctacttataagctgggtgaccatgggcaatgttattgaagttctccaggcctcgtgattctcatggaaaatggaaataataacagcacctgtatttgtccgtgttcacactgctgtaaagaactacccgagactgggtaatttataaaggaaagaggtttaattgactcacagttccccaaggctggggaggcctcaggaaacttacaatcaccgcggaaggcaaaggaaaagcaaccaccttcttcacaaggcggcaggagagcaagcaagcctgcgggggaaacttccaaacgctttaaaaccaccagatctcatgagaactcccctcgtgatcaggacaacagcccgggggaaaccgccccatgatccagtcgcctcccaccaggtccctccctcgacacgtggggatgacaattcgagatgagatttgggtggggatacagagccaaaccctatcagtgcctgtctcccgaaggtgctctgtggaatccatgaattaaagcatacgaagtgctcagaacaggagctggcaaaagtaagcccttagggttagcgacgtttattattcccatctgtcagagacggaggcttggaagggtcagtggctggccggtggtctcacacctggggagaggcaggcctgacttcacagcacgcaccacccaacacagctgatcctggctctgcccgtcccctcactcctcaccacaccaacacggcctggtctttgtctttcctggtaccaagcaaggctacaaggtactagaaggaagatactaagcgaattggcagactaacttatttacactctgatgttgctatcgtgcgcggacaaaaaagccgaaatgtgttttggcttaggaatctgcccctcatctaaaaggaaatggaggcccttttcacctctgcttctgggcctctgtaggtgaggcctcacgtgttctctctctgaaaccctgagactaaggcaaagcctggattgcccaataaaacctgaccttaaggacctctgaatgcagataatgagtgtgattgctggtggaggccaatccagcaaaaagagactcatgagccaagatgacctctgccttgagtcctgccctgctgcctgaaaggttctagaaagagtcagagccttgctgggagggggaaacacgtatcttattcattcatattttttagagacagggactcgctctgtcacccaggctggagtgcagtggcacaatcatagctcactgaagcctcgacctcctgggttcaagtgatcctcccacttcagcctcctgagtagctgggactataggttcacaccaccacaactgactgattctttttttcttagaaatggggtctcaccgggtgcggtggctcacgcctgtaatcccagcactttgggaggctgagatgggcggatcacaaagtcaggagatcgagatcatcctggctaacacggtgaaaccctgtctctactaaaaatacaaaaaattagacaggcgtggtggcgggcacctgtagtcccagctactcaggaggctgaggcaggagaatggtgtgaacccaggaggcagagcttgcagggagcccagatggcaccactgcactccagcctgggcaacaccgtgagactccatctcaaaaaaaaaaaaaaagaaaagaaaagaaagaaagaaatggggtctcactgtatcgcccaggctggtctcaaattcccagcctcaagcagtcctcccacctcagcctcccaaagtgctagaattacaggtgtgagccattgtaccagccacatgcaccacggaaaaccaaaccatctgcgatccagaatgactggggagtgggaagctctgaggaagcaactcagctgggcacagtggctcaggcctgtaatcctagcactttgggaggccgagacaggcggatcacctgaggtcaggagttcaagaccagcccggccaatatggtgaaaccccatctcatctaaaatacaaaaattagccaggcgtagtggcacactcttgtcatcccagctactcaggaggctgaggcaggagaatcacttgaacccaggaggcaggggttgcagtgacccgagatgacgccactgcactccagtctaggtgacagagcgggactctgtctcgacaaaaaagaaaaagaaagaagaagcaactcaaagaaaaatgacctgtagtagtggttaattaacacttatgggtgcttcctacgtgccaggacccgtccaaaacgctttagaaatatgacccatttatttctcatatcaacagcaggagagaagaggtgcttattagcctcagtttacagatgaggggactcaggctcagaaaagtcaaataacttctcccaatgtcacacaggcagtctagcttcagaaacatggtttaattccgtgttttcaaacctttttgttcatctcacagcaagaaatacattctacatcagctcccagtgtacacatacgcgtccgcatagaaccgaaacggagtccaaaaacagaataatactcgccgtgtccaatgcactcatcttgagagagaaaaacccctgcctgcctggagcttgcgtttgactggagggagacagtgaataagacccacatgcaaaattgcagcatccacggtggtaatttggggaatgctgtagagaaaaatgaagcaacaaaggacaagggtggccaaggaagaccgcccgggtgcttctgttgccaactgcactaatttcaatgagctgtttcccacagtgcgaaaacgccttcccttaatcgctccactctaatgcctccctgtatgcttgagggctctttctcctagattgtgtgtgcacacatgtatgtggcagtgtgcacatgtatgtacatgtgcaggtgtctgtgtatgcatgtatgtggcagtgtgccatgtatatacgtgtgcaggtgtgtatgtgtgtgcatgcatgtatgtggcactgtgccatgtgtatacgtgtaggtgtgcatgtgtgtgcatgcatgtatgtgacagtgtgccatgtacatacgtgtgcaggtgtgcaggtatgtgtgtgcatgcatttatgtggcactgtgcacatgtacatatgcaggtgtgtgtgcatgtatgtacatgtgaaggtgtgaatgtgtgcatgtatgtatgtgacagtatgccatgtgtttacatgtgcaggtgtgtgtgtgtgcatgcatgtatgtggcagtgtgtcacgtatatacatgtgctgctgtgcgtgtgtgtgcatgcatgtgacagtgtaccatgtgtatacgtgtgcaggtgtgtgtgtatatgtgtgcatgcatgtatgtggcagtgtaccatgtatatacatgtgctgctatgcatttatgtgtgcatgcatgtaaccaagtgcaagtccaccccccactcacttcctcacgaggaggctttggagacagaggcagaacccgaacatgtagctgtgcagtgtgccacaggagcttgccctgcagagggggctggaatggcacctgaaatctagcccaggcatcactagccaaagccgtgagtgccagacacgtgccccagctcacgtctgtagtcctgaggaaggtgactcttgttatcattggtccacccagaggggagcatcttttgcaattcccaggggcagcgccgatttctaacgtgcatcaaggtgccctatgtgctagagtgtcctaagggagacaggcgacgactcacagaaataaaaatcactccctgggaaaagcctagtgtactgggcaccccggggagggtgacagatgtgggtctggggggagacaggattgcagccagctctgaagcagctggggccagttgggtagcctccaccaagggcatttggaacttggcactagggtgaaatcttcaggctcttcccttaagttaaagagacatataaaaatgttaccagcatgggcggcaagagcattgcctgtgggaaacacagccaatctttgctaaggaataagtgtaattgatcaaaacagatgacttgatggaccttccaactgtgcttttagcaaagtggacagtttttcattcaaatgcaaactcatccagataaaatctaataatggagattttggaacaatcccagcatcaatgattttttttcctccttcactgagcaggaaggcatcttaaattcctggttgcagcttgacccaaccggacaccaccagtgtgctgctttccgcgtggctgaggagaccgtgacagttcacagacacagcaaagggctcccacgccacccccatccccacctgacctctcctccttagccccattcccactccctgacctagaaagagctcggtggacgctcaattccaggcaatcatttattcagccattatgcgttgagctttgactgctgcaaagcaccgtgcatactaccagaagggggttcaaagatgactaagatcaggccctgtcctcagaaaagagagcagatgcgaggggagagagatgacaggagacccggtgaaggtctcagctcaccccaacgagcacttaatctttctgagcttcggtttcctcttttatccagtgaagacgctggactagacatggtctctgggcaccaggccagccggaaaacgagatgggcctaagcctccccttgccctcttgctcccagactcctagaaagccaagaggccgggcgccgccttctaagaagaaaacgagtccgcagagggggctggtgagggccgtggcccttccctgaagtttgcacgtggccccaacacacagagcagcctggagaagaggagactaagttcagaaaatggagtggaaggttcggccttccgcggttaggaaagcggagctcagaaggatcggggatttccgggagatgggaagcccctggggtgtgtgcagagaggggtgacagacagaagggtgacagcacccggtggcgccaagggatctggcgggggccaggccggagggaggggctgggggatgtcagggccacggagcgcaaagcgcaaaggcccgggcgccggccctgccgccgccgccagttcattttcatagagtcgcccgagcttaacgtcgccttgcacgtgttttctaagctccacaggtggctttggggtacacgggcgcagctcaccctccttcccgcccgctccccggccccgagctcgaggttaaacagggccgcggagtcggccgggaaggggtcccggcagcccggggtggggggcgcgcggcggggtcgagcggggtctggggggggcgcccacctgcggagaagtcgtcctcgcggtcggagctgtgccggctgccgtcgctgtctctctccggcgagctgtggccgggcgagtcccgctcgggcacccgcaggaacctgcggcgccgccacgggggcaggtgctcgcgcccgggggtctcctccgcggcgaggggcgagcccgggcggcccttggcctcggcctcccgctgctccaggtcgcgggtcccccgctgcggccgccgccccccggggatcaggtgcatccagcggcgggggctgcgcgcccgctcgcgggtcccgaaccggcaaggggccaccagccagtggctgaggatgaacttctcgttgaaatccaccatctcgaagtcgtggtcgccgccgtcgcccccctcgtccgtgccgggagccgcctgggggtccccgaggggcgcgtcgtcctcccgggcccggaaccgcagctggggctgcaggagctgccggtggacggcgtcggcccagctccttcccccgccggcttctccggccgccccgggcccggcgggcaggtccccgcggggagactcggcctcggggtcggggcgcccggggtccccgcggggagactcggcctcggggtcggggcgcccgggctccccggagtctccgccgccgccccgggccagcgcggcctgcgggagcgaggctttgagctgctcctccgccagcacctgttgcagccgctccaggttgagtctgcggcgctccagctcccgctccgcgtcccgcaccgactccagcctcgggaccggcgcctccgccccggggaactcggcccgccagcgccgctcgaacgcgcgggggtcccacatgccccgagctccgtccgcgccgacccttccccgcggcccccgaagagaccagagggaaagtcaagtgtccccttccgccctcgcgcctcctccccgtcttcttcctcttttcttcccctcctgggtttcgcctccctgacgtcggcggctcctcgcggcgggggcgggcgccccggggatgagaacccgccccgggcatcccacagccagctcgggccgcggagccgccgggggagggcgggagctgcggggcctggactcgagccttcgccgcccgccccgatcccggccccggaccccgcccgccccgctcccctgtcggccccgctccctgcacccgagcgcggggccccggacaccctcctgccgggccgggggaagacgtgggggctgagggcggcgtggctggtgccactgcggacccgcggggtcgccctgcgccgggattgatggattgattgattgatgattgattgattgattgactgattgattgattttccttttttgaggccaggtctcgctctgtcgcccaggctggggcacagtggcgcgatcgtgccttaaactcacgtgacgaagatcacggagcagtttagtccaaatccgggggtaacgcttcggggttctgtcggcccctgtaagcttctctcctcttctcactgaagctcttccgggaaaaacacccaaggatgactgagccaagcggctctagctggaggcgcccgggacctcaaagctggactccccggggactgagtccaaccgtggctgcaggggccgcggcctggcggagggtccgcgtgggtgtctacgaggatcccccccgttccatctcctctttgcggcctcagacacttcccctggggaggacgagaaatgggagctgggccgggcgcggtggcccacgcctgtaatcccagcactttgggaggccgaggtgggcgggtcacctgaggtccggagttcgagaccagcctgaccaacatggagaaaccgcgtctgtactaaaaatacaaaattagccgggcgtggtggcacatggctgtaatcccagctactcgggaggctgaggcaggagaatcgcttgaacccgggaggcggaggttgcggtgagccgagattgcgccattgcactccagcctagacaacaagagcgaaactccatctcaaaaaaaaagaaagaaagaaacgggagctggagagggggcctggagacgggggtcccacgtggccctgccctccgcacctggctgagcaaggctttccagttcttttccagggttgtggatgaggctccactgcctgcgaagagaggccctgataaaccatctcgtgctttcttaaagaggggacaccttatcaatgattcacgtttccttcattttaagcatgaagaaattgatctaagaggccgggcgcggtggctcacgcctgtaatcccagcactttgggaggccgaggtgggcggatcacctgaggtcaggagttcgagaccagcctggccaacatggggaaaccgtgtctctacaaaaatacaaaaattagccgggcgtggtggcagacgcctgtaatcccagctactcgggaggctgaggcaacagaattgcttgaacctgggaggcggaggttgcagcgagccaagatcacaccactgcactccagcctgggcgacaagagtgagactccatctcaaaaaataaaaataaaaaaaagaaagaaaacaaagaaattgatctaagaggctgacttggcagctggaaattcttcctccccacagcaccttttggggactagagctaaactcagccaccttctccatagcccctgccacccacccggctctcacctgaaccatgggcacaggccgtcctggtcccacttttccagccccttaattcattcctcaaggctacaaggaagcaaggaagatgtttcttaaccacaaatgtgccatgtgtttgcgccctttcttggctcccgtcgcgtacagggtggagtccagactccttggcctgacgcaggaagtcctcccacatctggtctctgcccacgtcgctgccttcttcctataatttagccttgccagctcaaagctggccccaaagacctcacacccttttccttttccttggaacttctcatctctccctacacgcttgcaaaagtccccgctgcctggggacctccccctctgatgaaccttttcagcccctcctcgcccttgtttgtatcagcattggatctcatgcctgccttttatctttgtttgcccttgttccacctttttttgtttcttttcctgtagagaggcaacggcttctccatctcatctcactccctgaaacggcagggggccatgagcaaatggaacaaatttcaaatccaccatctcggccagttgcggtggctcacacctgtaatcccagcactttgggaggccgaggcaggtggatgacctaagctcaggatttcaagaccagcctggccaacatgatgaaatcccgtctctactaaaaacacaaaaattaatcgggtgtggtggcgggtgcctgtaatctcagctactcccaagggaggctgaggcaggagaatggcttgaacccaagaggtggaggctgcagtgagcaaagatcacgccattgcgctccagcctgggtgacagagcgagactctgtctcaaaaaaaaaaaaaaaatcccccaaaaagacaaaaaaatccactatctcaaagtcgtgctcactgctgttgcccccatcatctcatgttgcccaggctcctcttgaactcctgggctcaagcagtccaccctctctgcctccccaagtgctgggattaccagcatgagccactggggattccacctgtagggtagcggtgcaattactgctcactgcagcctggaccccctgggcggaagccatcctccctcctcagcctgcggagtagctgggactacaggcatgtggcatcatgcctggctaatttttgtatttttcgcagagatgggggtctcactgttgcccaggatgctctggaactcctgggctcaagcaatcggcctgccctggcctcccactgtgctgggattacgggcgtgaggcactgcattggactccactttattgtagttaccagtgagaccttctgtttcccctactctaagaacccctcaagtgcagagattgtgtcttttttcatttttgtattccgacaccttctcgcagagtgtggtatagagatgactgataattgttgaaggaaagaaatgaacgaacgaacaaacagacagatgcatgaaccccctccttgcctcctgctgggctctcctgtcctgaatcactccggactggggcacatttgcttcccacacgtcaactccaagaaagaatttcctttcttgccaaagtctgtgtttactcattttactaatatccctcttccttctttgtttattcttttcctttttttttttttttttgagacagaatctcactctgtcgtccaggctggagtgcagtgacgcgatctcggctcactgcaagctccgcctcccaggttcacgccattctcctgtctcagcctcccaagtagctgggactacaggcgcccaccaccacgcccggctaaattttttgtatgtttagtagagacggggtttcaccgtgttagccaggatggtctcgatctcctgacctcgtgatccgcccgcctcggcctcccaaagtgctgggatgacaggcgtgacccaccgcgcccggcctctttctttctttctaactcggtgtgccactggcatgaatcatcccagtgtttgtcttcacgccagactgctatggagaaatggatatgttttttgttattattattctatttttttttttttgagatagagtctcactctgtcacccaggctggagtgcaatccccattcactgcaacctccgcctcccaggttcaagtgactctcctgcctcagcctcccgagtggctaggattgcaggcacgtgacaccacacccagctaatttttatatttttagtagagacggggtttcaacatactggccaggctggtctggaatccctgacctcaggtgatctgcccgcctcggcctcccagagtgctgggattacaggcgtgagccaccgtgctccacccacgtgttttaaatacactactttggccgggtgcggtggctcatgcctgtaatcccagcactttggaaggccgaggcgggcagatcacctgaggtcagggattccagaccagcctggccagtatgttgaaaccccgtctctactaaaaataccaaaaattagccaggcgtagtggcagacgcctgtaatcccagctactcaggaggttgagacaggagaactgcttgaacccaggaggcggaggttgcagtgagccgagattgtgccactgcactccggcctgggcaacaagagcgaaactccgtctcaaaaataaataaataaataataaaaataaaatgcactaacttcctattccccagtttgagtgatttctcgatctttcacctagctcctcaacctgctttctctcccaccttcactgcacatcccaggggccatcacaatctcctttgtccactgagaaggactgagaagcttccaatgcctatcgccagcccacgccagggagagtccatcaaagggagtccacgacatcttggcctctgtatacagatttcagaatgggagaggaagagcagtccagaagtgagggatgaccccaggcaacagcatattggttggaaactgtttcaatatgtatatttaaatgcaccaagaaaaagaaaactacaggttactaatacgcatccatttctgaaagtgcaagttccctgggaggatagtttcaaatctgtcctttaattaaagccgtggtatgattctcttttggcccaaggaaattgttaccaataccactaattttttccacaaggaccagtagagctggaaatggcagcacacatcatcttctataaacagatcccaggagcagcctgcattgtccccagctggtggatagctcaagctttatgacttggctctgggtcctcatggggacaggggtaggctgctgacatttattgagtccacacctctagctgccatacattttttatctcttctaattcctcacagcaaccctgtgaagaaggtattattgtcgccgcttcagacagacagaaatggaaggtcaaagaggttagaagccacacagctagtctgctgaattttttttttttttttttttttgttgttgttgttgagagacagggtaggcggggcacagtggctcatgcctgtaatcccagcactttgggaggccgaggcaagtggatcacctgaggtcacaagttcgagaccagcctggccaacatggtgaaaccccgtctctactaaaaatacaaaaattagccgggtgtggtggcgggtgcctgtaatcccagctacttgggtaaggtgggaggctgaggtaggaggagcacttgaacccgggaggcggaggttgcagtgagcagagatcgtgccaccatactccagcctgggcgacagagtgagactccatcttgaaaaaaaaaagaaaagaaaaagagacagagtctcactctgtcacccaggctggagtgcagtgatgctatcatagctcactgcagcctcagcctccggtactcaagccatccttccacctcagcctcccaagtgcacgccaccacacccagcttttttttttttttttttttttttttgtagagacagggtctccttatgttccccagcctggtccagaaatcctgggctcaagcgatcttcctgcctcagcctcccaaagtgttgggattacaggtgtgagccaccacgttcagcctgctagattctgtagtcctgcagctttgtaagaacttggtccaggtgcatctgtcactggcatttctttaatcaataaatatttgttgagcacccactaggtcccagggcctggcaaattaagtttaaacttcgtttttggtttatttttttgagacaaggtcttgctctgtctcccaggctggagtgcagtggccgcaatctcagctcactgtaacctccgcctcccaggttcaggcgattctcctgcctcagcctcctgagtggctgggattacaggcatgcaccaccacggccagctaatttttgtatttttagtagagacagggtttcaccgtgttggtcaggctggtctcgaactcctgaccttgtgatccacccacctcggcctcccaaagtgctgggattacaggtgtgagccaccgcaccccaccaggcacccagttttctagaatttttgtcactacagtcttgccttttctagaatttttttttttttttttttttttttttagacaggctctcactccatctcccaggccggagtgctgtggtgcgaccacacgtcattgcagcctcgacctcccaggctcaagcagtcctccctcctcagcctcccaagtagctgggagcacaagccaccacatgtggtgatttttatttattttttttttgtagagatgaggtctcactatgttgcctaggctggtctcaaactcctgggctcaagcccgtcctcccacctcggcctcccaaagtgctgggattacaggtgtgagccaccgcatccggccccttcctagaatcttgtatgaaagaatgtagtcttggtgttggactgttgaaacaacacagtgtttctgagttcaacctgcactgttgtttacatctccttccttcccttcccataccccagggtcggaaataggcattttaacacactaggtggaaacaggcattcaaccttcattctaacgctgtgacaaaagtgttattatcattattttgcagataaacaagtgtggtttgatgagattaagacagtcattcagggccaggcttagtgtctgacgcctgtaatcccagcactttgggaggccgagggggcagatcacctgagatcagcagtgagaccagcctggccaacatgctgaaaccccatcctcactaaaaacaaaaaaaaaatacaaaacacaaaactcaaaaatcagctgggcggggtggcgggtgcctgtaatcccatctactcaggaggctgaggcaggagaattgattgaactcgggaggccgttgcagtgaaccaagatcacaccattgcactgcagcctgggcaacaagagcaaaactccgtctcaacaaacataaaagatagtcattcaagtttgtgtaattcattcctttttattgtggaagaatattccattgtatgaatatacccctatttgtttattctccagttgatagacattggagttgtctctgtgtggacaagtgttttcatttctattccccacaaaaaatacagaaatgggattgctgggtcataaggaaactgtatgtttaacttttcttttttctttttttttttttttttaattttgaaacgaagtctcgctgtttcgcccaggctggactgcagtggcgctatcttggctcattctgcctcccgggttcacgccattctcccgcctcagtctcccgagtagctgggactacaggcgcccaccaccgtgaccggctaattttttgtatttttttagtagagacagggtttcactgtgttagccaggacggtctcgacctcctgacctcatgatccgcctgccttggcctcccaaagtgctgagattacaggtgtgagccaccgcgcccggccaaaactgtatgtttaacttttaaagatattaccatacaatgttttccaaagtgtctgtactattttcctttttttttttttttaattttttgtatttttaatagagacggggtttcgccatgttggccaggctggtctggaacccctgacctcaggtgattcgcctgcctcggcctcccaaagtgttgggattacaggcgtaagccaccacgcccagcctgttttccattattaacagcaatgtgtgtgcatctcattgttctatgtgcatgtcaacacttagtgttgtaagttttttttgctttagccactttagtgggtatataatactatcttgttgtggtttaatttgattattaatgatgtataacatcttttcatgtacttattgaccatttgcatattttcttttatgaagtgtttgtttacatcttttgtccattttttattggatatccttttagagttgacttgtaatagtcctttttttatttttatattttttgagacaaggtcttgaggtctgttgcccaggctggtctggaactcctgggctcaagtaatcttcccacctcagcctcccaagtagctgggactacatgcctggctatggttttttttcttttttgtagagacaggttctccctatgtttcccaggctggacttgaactgctgggcttaagtgatcctccctccttggcctcccaaagtgttgggattacagacatgagccagtatgctctagctcttttttttttttttttgagacaaggtcttgctctgtcacctaggctggagtgcagtggtaccatctcagcttgctgcaacatccacctctgagactcaagcgatccttccacctcggcctcttgagtagctaggattacaggtacgtaccaccacgctcagctaatttctgtattttttgtagagaccaggtttcaccatgttgttaggctggtctcaaactgctagactcaagtgatccacctgcctcagcctcccaaagtgctaggattacaggcctaagccattgcacctgtcctgtttagttcttttctttttttttttttagatggagtctcgctctgttgcccaggctggagtaaagtggcacaatctcggctcactgcaagctccgcctcccgggttcacgccattctcctgcctcagcctccctagtagctgggactacaggcgcccgtcaccatgcctggctaatttttttgtattttttcagtagagacggggtttcaccatgttaacaaggttggtctcgatctcctgaccttgtgagccacccacttcagcctcccaaagtgctgggattacaggcgtgagccaccacgcccagccatggcctgtctagttctttatattatttattcatgctctttgtcagatatataaatatagatagatagatgatagatagatgatagatagatagatagatagatagatagatagatagacagacagagagatagagagatagattttttttttttgagacagagtctacctctgtcgcccaggctggagtgcagtggcgccatcctggctcaccgcaacctctgcctcccgggttcaagcgattctcctgcctcactcagcctcctgagtagctgggattacaggtgtgtgctaccacacccggctaatttttgtatttttggtagagatggggtttcaccctgttggccaggctggtctggaactcctgacctcatgtgatccgtccacctcgacctcccaaagtgctgggattacaggtgtgagccactgtgcctggccgtgtccaagtttttgtatggacatgttttccattttctctgtttctgcttaggagcgaaattgctggctcatatggtcactctgaatttcgcttatcagagaacagtccgaccgtttccaaagcatctacgtcattttaccttcccggcgtatacgggctccaactgctccacattctttcccacactagtgtgcattttttgtatcatagccaccctagtgcgtgtgatgtggtatctcattgtggtttctctggttgttgtttccttcggggtttttttttctttttgagatggagtgttgctctgtcacccaggctggagtgcagtgcctcaatctcagctcactgcaaactccacctcctgggttcaagcgattctcctgcctcagcctcctgagtagctggcattacaggtgactgccaccacgcctggctaacttttgtatttttagtggagacagggtttcaccatgttggtcaggctggtctcaaactcctgacctcgtgatccgcctgccctcagcctcccaaagtgctggaatgacaggcgtgagccaccgcgcccggccttgttttgtttttgagatagggtcttgctctgtcgcccaggctggtgtgcagtggcacagttgcggctcactgctgcttcaagcaccagtactcaagtgatcctcccacctcagcctcctgagtagctaggaccacaggtgcctgccaccacactcagctaattatttttttaactgtcttgtagagacgagatctcactatgctgccggggctggtctcaaagtctgggctcaatctgtgttcccacctcagcctcccaaagtgctgggattaccagtgtgagccaccgcacccagtcctctcagccctctcaacctcccaaagtgctgggattaccggcgtgagccactgcacccagcctcgtcatggttttgatttatttgcctttgcctaataattaatgatgaacacatatgcatggtcttgaaaccacctttccaaaatgatgactgagacagtgttagatctaacttgaccgactccggcttgctcctaacctccaagctgcccttgttcattcctgggcataggctgaactaactttaggagaaacttagtttatagtttatagtttaaacaaagacggtaacagccctttcccaaagcagacctccttcttccccggggactcgtctgcctttgcaggactaactttagccccaagattagaaattatggtttaggagtcatgcagctggaggccagaagattctgaccctccttaaactgctcctaagatcagcgcttgagatattttggaaaccctgcacttcatgagtcagctgacaccacccacatcaataaactggctcatctgatcttgcggaccccacccaggaacgattgagctcaagaagacagctttgacgccctgtgatttcacctc

SEQ ID NO: 492 - DNA, 20001 bp, Homo sapiens
agaaaactatccccttacacatgttttttcttcttttagtattttgatgggcatttagtaattgttatgtaccacaagccagtgagcaagacagccatagtatctgctgtcaaagagcttacagtctagcggggtgaacagaagaaaaaactattaagagagggtaagtgagggctgtaagagcatgtggagaggcatttaatccagctgtgggaaggtcaaggatggcttgctagaggaagtgtaacctaaatagatacaccaaggatgtagggagagtgctagagaagaaagaatattccagacacagagaaaacttgtacaaaaatctgaatgtgaggcagagcaaacgcattggaaaaactggattgcagaaagatgaaagaaggaactgtcttcttcagataatattaaagcaccttgagcaatctggggtccgtgtgtgtctaggttggcaggggctaaatagaggagtgaacttaccggatttgccttttagacaaagcactatgcggaatggatgagaggttgtaggactgcaagcggggatgccaatggctggctggtatcaaaatctagacaaggggatggtaatctgaactaaggtagcactcatggtgatgagtagacaaagacagagttcaaggtgtccaataacacagatgctaacaaccttccagttgcaagaagatccttctatggaggtagcctccctgctattgatggggctgctgagatctattaataggagacatatttgactagagatgcattcctgtggatggtgaagccaaatatcagttgattgggtttgctttgtcacttccaaatgggagcacgtccaagttaggatgactgggatttgggagatactacaggcattgagcttttatctttcagccaatatgacaattttttgactactgtagctttaaaacaagtcttaaagttaggtagaattaggtcttcaagtctgtttttcaaagttgtttggattactctagagtctttgtgtttcctgtggattttaggatgagtttgtcaatgaaaaaaatactgctaggagctaaaatataattgcatgatagcaattatgccaagattaagaaaatttgcctttcacgtaccattctgaggaagttatttgaggattcacaccagcaaaaacagagaaagatcagacaggtaattgtggaatgcaggaaacagccctagattcccctggcatccacaaagcctggaaagcatctggtctagattgtagcaagaggtcagaggggtggatggacgtccccaaaagacagtgaattccttgccttagtagatgacataatgaaaagattggaatattttgaagatataatgggggcatattatgtttttggaaattagaaaaaatgaaagtgtttagaaactctttcctgcaaagcaaggggaagctatacaggaaatctgtggttagagcattaaacaatcatttaaaatgaaatttttagaaaaacatttgttagagtataagtaaaagaaatctatttcaccttgattcagaaaatattctactttgtatagtgcagagattatcatattgaagcagtaaaggaaatgtaatgcctgtacaagactgggctaagcagtaagaataactaccagaataggagtctttgctgcgtgccatgggttaattatagaatcctcacaacaaccccaagagattcatattatttaccctttttagaagtaaaggactgatgtaaaaagaagttaactgagttgtccaagatcataaagctagtaagtaacagagcaaatttcttaaacattgttatgtgctgtttttgtaaatacagatatatttatatatgaaatcttttctgtacagataaataatatttctggtttatgaagtttacaatcaacttatagatatgtcattctagaacacaatgctaattctatcaatcttcgcaatgtacggatactgatattgttagtggaagttgataactgggataaggaaaggtggaagatagggtaagaagagtcatattcccatcgtacgtggggaatgtgtctaaatttaataatgtctaaatctgacaaaccagacatagaagtataagcatattttaaattataaatacaatcaatgagaaagcgttaataattatgtaacaccaaaagtagaaagcaaggaatagggaaagatggggattgtgtaagtaactaagtcttcagttcataatggcaaagtaatgatagtgtctaaaatggatgtcaagcaatttttgtgtaagcatattctatatctcagtggttcttaactcctacaatgcatcagaagtacctagtgggcattaaaaataataccactgcttgagtcccacctccagggatctggatcaatgactatcaggaaaaggcaagtatggggaacttccaaaaacttccaggtaatttttaatgtgaagccataaaggagaacctctgatttaaaaacaggtagatccagccgggcacggtggctcacacctgtaatcccagcactttgggaggccaaggcgggcagatcacgaggtcaggagatcgagaccatcttggctaacatggtgaaacaccgtctctactaaaaatacaaaaatttagccggacgtggtggcaggtgcctgtagtcccagctactcgggaggctgagacaggagaatggcgtgaaccctggaacacattctaagtttgtcaacctagaaatatttcaaattaaaatcacaagtttaaattaaatattcaattacccaattaaatttgcagtaattgggtggccactttagtaagccaagttttcttaaacataacgagttcataagcaccaactattaagactatgatgttctttttcttctacatttctttcctttttttctttttttattttgagacagagttttgctctgtcacccaggctggagtgcagtggcacgatagctcactgcaacctccacctcctaggttcaagcaattctcctgcctcagcctcccaagtagctgggattacaagcacctgccaccacacctggctaaatatttgcatttttagtagagatggggtttcaccacgttggctaggctaatttcaaactcctgacctcaagtgatccacctgcctcggcctcccaaaagtgctaggcctaagccaccgtgcccgacctcttctacatttcaatgctgaattcttttttttttttttttgagatggagtctcactctgtcgcccaggctggagtgcagtggcgcctcctggcttcatgccattctcctgcctcagcctccccagtagctgggactacaggcgcccgccaccacgcccggctaattttttgtatttttagtagagatggggtttcatcatgttcgccaggctggtcttgatctcctgaccttgtgatccgcccgcctcggccttctaactcttctcagagttatgagatacttaccactaaggaggatacttacccttctgagtaactgatgtgaatttaatcacaacttctaatgggcgtaagacatatagagcattgcatgcattcaggacaattctttctgccaattaaggatactattatattatcccatgtatgatgtggggttgctttctcagcacacttggggttgcaaaaagaaaaatttcagacaggatgctaacagaattcttgtcagcaactttgatgtgatgtattaaaccctattgataattgttatgtcaatggctctgtaactcaaaggaggttttcacatgctccaagacctctaaattcatgtctcatacattacctaattcctttttctactcatagacatctgtaacttgaacttaggttgattacctcattagatttctgtttccttggatcttaaattatgcaggtatattttctgcctacttctaaacatgtttgaacttgatggaaggctgcattgtctcatcatcctagaccacccaactattatacatattaaaataataaccaattacattttcagtatctcacatagctaccaggtccttctattaacaatttgtacaataagaacttaaataaaaacataaacaggaatgtagacattagtctaagggaccctgctgtgattagtttcacatcttttcataggaattaagctgcaccgatgttgtttattttctgctttataggtgaatacgtttgtatgtaaaagttagataacatatcccaaaacgtgtagatcataagtagcagaattaagacctaaacccagttctgattacaagtgtactatatattctattgtacctctccttaaaagctcagcaaaggagagagaaagaataaacacttgagagaaagttttccaatatcttttgaactgccttttaaaaatagaaaaacagcgtcataaaagggtctgcgttatccttgtttagtctctctggccaactttgattcttcaggaacatgccatggtgttgaaaacgtttctgtcacaagtgtccttgacgatctatttggaacggatttatgaagagttagtgactccataggcaggagcactggcatttttctttgctatatttcttttcttttcttttttttttttttttttttgtgagacggagtctcactctgtcgcccaggctggagtgcagtggtgtgagcttggctcactgcaagctccgcctcctgggttcatgccattctcctgcctcggcctcccaagtagctgggactacaggcacccgccaccacgcccggctaattttttgtatttttagtagagatggagtttcaccgtgttagccaggatagtcttgatctcctgatctcgtgatcctcccgcctcggcctcccaaagtgctgggattaaaggcatgagccaccgcacccagcctttctttgctatatttcaaactcaagagcccaagagtttgagattccagtgagctcagattgtgccactacacctcaagctgggtgaaagagtgaggccctgtcagactctgtagaaacttctcagagcacattcacagaggcttttggtagaaatccatcccatgccacaagttggtgttgactgtcgctgtccccaaaggtatggaataaaaacctgaaaagcaaagtgtcattttatggatgtgatttttaagtttttcttacccttcttttttaaagcggtggaactatttctttacattaaatcttgtttagaaagccaatattgggaggccgaggcaggaggatcgcttgaggtcagaagttggagaccagcctgggatatagagtgagaccttatctctacaaaattaaaaaatctagctgagtcaggcatggtgacgcacatgtgttgttccagctacttgggaggctgaggagggaggatctcttgagcccaagagtttgagattccagtgaactcagattgtgccactgcaccccaagctgagtgacagagtgaggccctgtcagaaagggaaggaaggaaagaaggaaggaaggaaggaaaggggggagagagggaaggagggagggagggaggaaaggagggagagagggaggaaggaagggaggaaggaaggaaaggagggagggaggggagggagggaagaaaagagagacagaaagaaagccaatttttaaaaagctaaaaacaaagtgactctagtttaaatacaagttagagatctgattcctttcccctctgtcttccactcttatgcatttcctcaacacccacaattgtccgtgaagtagggtttaaattacactttcagagaaagagcatgatgttctaagcacaccgcttctccagaaaacacctaaggtgatcacttcttagaagccttctgtctgctctaaggagaggaagcttgagcatggtatctatagaggtaaatgtcattctgactccttctccatcatctaatactagaaacaaaagcatcattgttccagccatacagaaggcttatgtgatgtttgccagatgcagcacatctctaccactttgtgtaagacaaatatgtatttgtcaaagaataattgctaagtgtgactggtagagtcaagtgcctgtgggagaaattttccctcccttctgtttcacttctaatcccagatgtgatttttgcaagttaagggggtttatcagaataaagctttcccttgaaagggggttagtctagttactccctaattctgcttttctcaccaaatcttaactggctattaggcagcaggcagagaaataatgaaaaaggaagaaaatgtgtccaggccaaccttaccagttaaccgtggccttggggagacccagactccacaatgcttgaatgctcaatgcacatgtaatttatagtacagttattgattgcttctgctacctcagaattatggaaacattcttggaagtcatcaagcaaaaaggtagagactactattatagcgcttacactatccaatagtttgtggttttcctttcacataaacttgggagttgaaacccaaggctaagtgggaattacagccataaaaaacatgggcatctattttattccctcaaaccacattgaagaactttgactatattatccaccctaaagtccaccccacaaaaaatttcaaccccaaatccccttaaagattaacaagctgacaaaccttgctaatgtcagagagaggaaaacagctccctgctaactgccggaaatggactccagacttcctctttcttcagctgaggacactatgtaactgttcagaaatgtgaaggtttcttaaagcatgatgactattacaggactgagacagaggctcctcctggagccaggtagccacatacagccaatgaatcagaccccagtctggcctgatgttcaacaaggagatgatttataatgggatacagggacagccggcagatacacctcagaagttggataatccagaccagctgagcgtagattgtgacatttctgtctctgtccacgtcattttctttctgcagcacgtgaggagagcaggtctttgagagggcagcttacagacatgcagcacataaagattcaggcttatcaagaactggttcaactatacgtccttctgaaaccaatgtcagcctggaggaaatatcccagcagaaattagactccatggaattctggaaattgtaaaaatgtcacaatatatagaaagactattttttcctttctgtatttttggggggtggatggctgagtttatagaaaatcaatctttatttcaaaaggttattagttttataatgtataacatactctgagccataatcattatattattttgggtctgtagatatgtaatattatatcttaattacctaccttgtataaacactatatttactaacatagcaatacactaggtgtatgatattattacttcaataaacgtgtttaaataatatacaaatgtaactctgaaatacatgaagcctatggactgaaatataatataaaggacaatgttcacaaaatagtaaaacatacatatcacattttcaaaaatatctctagacctttctctatagaaaaaaaaacgaaattttattgtgatcttatttccagtaccttaactgaatctaaacccatgaagctgagtaaacatgagccaaccagttttagccaggaatctccactgtattttcttcttccttattcttttctaccctcctctttccccttcctaaaaagaaagaaaagtaactttttcctcctatactcacacatttctgacaccaaatgtgtgggattatttcccccacacacacacacccatcaattatccagttctcaacatttgctgactgggtgtcctctaatttgattcaattctgacactttttacctgaggttagcatcagattccacaagttaagggctcaggcagtcccacaacactatgcccactgccttcagacgccagtcacaagtccaggttgccacctgtggttctgaaccactagttataaatcagaggttcccctgagcccctgttcagatttggtgatttgctagagcagttcatggagctcaggaaaacagtttactactaggttgcagatttataataaaaggatacaactcaggaacagcaggcggaaaagacggtggaggcaacggagcttccacaccctctccaggggtgccactctcccagctcctccacatggccaccaactcggaagctctccaaagcccttcagttactggtttcttgtggaggcattatgacgtaggcaggaccaattgttaactcggtttccagcctgtcttcccttcttggatgatgaagaatgcgtctgaaaattccaagtttctaatcaaagtttggtctttctggtgacctgaccccatcttgaggctactgaggaacccagcaagcatcacctcattagaacaaaagatactgctgtcactcaaggaactgcgagggatttaggagttacgtgtgagaaaccgtgatcaaagaccaagtattagaacaaaagatgctcctaccatcacttaggaaattacaagtctctggggagctctgtgccgggaactagggacagaagccaatgtatatttctcatgatatcacaatgtcacactcttgtttactgccagctctctagcagaacacatattgccctaaagtagcttataatttccatcccattgctactctatacttttggaaaatgctctctaaatagcttcgtcttggtttttgcttttttgataagttgtcaagactagattaatatctaaattaattttttttttgagatggagtttcactcttgttgcccaggctgaagtgcaatggcacgattctcagctcactgcaaactctgcctcccaggttgaagcgattctcctgcctcagcctcccaagtagctgggattaaaggcccctgccactaggcccagctaattttttttgtatttttagtagagacgggatttcactgtgttggccagttggtctccatctcctgatctcgtgatcctcccgtcttggcctcccaaagtgatgggattacatgagccaccgcgcccggcctctaaattaaatttttataattaacattatgttttaaagttcacagggagaattgaaaagcttattatacaaagaaaactatctagtaagttattttcaaaggaaataagaaccagggagggttgagactgctgtccttcaagattaattgctaaaagatattggagaaatccatacagacttttgagaggaaaatttgggaaccctcaaattcctggacaaaatgtcatacatgtgtgaagataatggaaagaattccagatatgcaaatttcataaagtatacaatccacatacttatcctgaaaaatgtcttccaaagatgaactcgaatgtcataagaaactaacaattttggaaaactcaggctcagtaaagaggaagtagaataaaaagtttagaatagaaatttgacattgtttaaatacataatttggtttcacaaacttacagttacaaagaactatgaaaataccatagttcattcagaaagaaaagataatgctttcaaatgagaattatagtaatcagcaacctctgaaatctcatacataaaatgggaagtgaaaaaaaaaatgaaattttctagttttctttcctgaattgcagagactattttatacttgagatagaccattaaagagctaaagaatgcattaaaaaattaaactgtaattaaattaaaaatagagtttatatcttaaaattccatagagaaaataaataaatatacataatctatataacaaaagatagtaaaagaaaaacaatgtacaagcatatattaaaaaaaataaagcaagatggcatgtggagagcaaatgtaaattagaaactggttaaacataaaacgacaaagaccatcaacttgtattacaaaacagaaggcaactatattctgcatccaagagcacactgaaaacagaggaatctagaaaacttcacattcaaagggtgtgaaaacatgtcaatgaactcaagttaaaagaaaccaagaatcagctgggcacagtggctcacacctgtaatcccagcactttgggaggcctaggtgggtggattgcctgaggtcaggagttcgagaccagcctggccaatatggtgtaaccctgtctctactaaaaatacaaaaattagccgggcatggtggtgggcacctgtaatcccagctactcgggaggctgaggcaggagaatcacttgaacccgggaggcagaggttgcagtgagccaagatcatgccactgcactccagcctgggtgacagagcaagactccctttcaaaaaaaaaatatttaatacttcatgttttattaagatcagaaggcaatgggacatccttaaagtgcttttagaaagaattctatgtgcataaaccatgtatgtcaaaaagaatagtgaaataaagatatttcagataaataaaaaacaggaaatttgttacaaaagacctgaactacaatatataataaaatatactctttggactgaagggaaatggtaccggatgctaaattgcatatacaggaaggcaaaaaaagcaccatcaatagtaagtatgtagggaaatgaaaggtgactgactatggtatgtagaagtaaagtatttggcactggcacaaaagaagcaagaaatggaattacactctggtaaggttctccttacatagtatgtgaaatggtatattaattataagtaaactgtgataggttaagaaagcatattgtaatcccccaaagcccagtaaagataaaataataaagacagaaatcagtaaaatgaaaaataatgtagaaaatcaacaggttaatacttggttttttgaaaggattaaataaaattgacatagtccctaggaagactaatcaagaaaaagaagacacaacacaaataaccaatttcagaaataatagagctgatacacatcctatagacattaaaaaagagacgagagggatattatgaacaacttttcactaacaaatatgataacatacataaaaaggacaaattcctttaaaaatgcaatgtatcaaaactgactcaggaagtaacagaaaattagaatagcttaactctattaaaggtatttaattcataatcaaatagttttccccaaaaaaactccaattgtatgaaacatttaaggaaaaaataataccaatcttatattagctctctaaaaaatattggaggaagaaatgctttccagtttgatgagtccagcgtgatgcatatcccaaaactaagtagacattatattgacccatacgacttaataaacgtaaaaacgatcagcaaataaaatccagcaatatataaaaaggatgataatatcaagtgggtttgctctaggaatgcatggccagtttaacatctgaacctgtttggaattttgtggctcttttgttaaattttgttaatttcttgttttattgtattgtaaccacataaggtagcctgtatatacttttccttgtagaaatcactgacaattttttgtattgtagattataaccaattttcaaaatcatccctggggttttgtaaagaatatctattccctgttggttaaaaagcttgacatatctagtaaatcaaccttatttcttttattatccaattaagcatgttatgtctacttgaccaaatgtggtgtgttaaaaccatcaacattcatatttctgttaatgccatcgtctacacttaacaagagtttttactttataaattgtgaggacatttaatttgatggataaaattacatgccaattatatctttatttcaatggataattattgtcaaactgaaacaatttatttcctttttaatgcattttctctgcatttcatgttttttgttgtgtaatggcaatattgtcactttgttatcctttttactcaaaattatgtaatacgctataacctttttttttttttcccccaaagtctccctctgtctccaggctggagtgcagtggtgccatctcggctcactgcaacctccgcttcctggattcaagctattctcctgcctcagcctcctgagtagctgggactacaggcgcgtgccaccacgcccagctaatttttgaatttgtatttatttatttatttatttattttgagacggagtttcactcttctttcccaagctggagggcaatggcgagatctctgctcacggcaacctccacctccttggttcaagtgattctcctgtctcagcctcctgagtagctgggagtacaggcatgcaccaccatgaccggctaatttttttttttttttttttttgtatttttagtagagacggggtttctccatgttggtcaggcaggtcttgaactcccaatctcaggtgatccgcccaccttggcctcccaaagtgctgggattacaggtgtgagccaccgtgcctggcctatcacccatttatatacatatagtgatactttggggtggaattcttacattcatcacacacctgaaattcttaaaattaatttgtgtgcttgcaattaaatttttttattttgaaataattttaaattaacagtagaatacaaagaaattacagagggttcccctacactctttaaacaactcctaatattaacatcttatagaaccacagttgctacacagattttgctagttttttcactaatgtcattttccttttctggatccaatccagggcactatattgtactgttaatcatgtctttttgctctcctctaatctgtgacagtttcttcatctttccttgtttttcatgactctagcacttttgaacggtactgttagggtcttttgtaaacatattcctcaatttaagtttgcttcatgctttctcataattagactgtggttatagatttttgtgggaaaatattacagaggatgtacctgctcatcacatcgtatcaggaaatacatagtatcaacatgacttatcaccactgatattaatgttgatcatttgcttcaggtggtgtctgccaagtttcttcactacaaaatcattatttttcctctccatgtactacttgttggaagcagtcgctaagtgtagctcaaattcaaggagaggggaattaagtcctacctcctggagggaggagtaccaaggaatttgcagacgtatgttaaaaccacacaggaattaataaatacgatggggagaactctgagcctatgaaaacttcctgtttaaaatatccttgaagtttcacccactaattttagcattcattgatggatcttgccagcagccgttattactttggtattctaatagtgatattttaattcccttattccttctccacttagtaattggaatttttctgcaaggaatatttgtccctccttcagttattcattcattaaatcatttgtttataccagtaggaatttgtggatgtttgttttattctttgggttataattcaacactaaatattatcacttattctgttgctcaactcagttgagcttggccattgggagctcttttgggttacctcttgtagccttttgacatgccctcatccttttttcttcttctccttcttctgcttttttaatacgcttttctttctgacactagaagatcccccaggctcatcttgtattttctctgccctggccttaaccttataatttattagctatttctttagagagccctgtttccttttattggagaatagtatttaaaaactaagatcaaggtgctggatgtgctcattgccactgcggtgttacttttagggagcgctcagtatgcaatatgtgtatgtgtgttaactcatgtctactgtacaaacatttctatatttcggtatctatctgcttatccatatatcaaatatgcataaattcatactggaagctctgacttttatccagcaccaaaaggaaacttctagccttccctccttccttatttctaatttctttctctgatagcgagaagctgattccccttaactacattgctcatttatttctttggctgtagcgcacttgtagtttcagaattgctcactcttacccatgtgcaaaatgactttgttaatatttgtgtatccttcattttccttaaagcaacctatcaaaactctcttctccaatttccttaacccatcaccttttcctccccactctgcttgtgtttttgcgaaggattgaaacacgaaaactctgtggtcttttctcactcttttctggagttctaacagaagaaaagaattctgatactagcctgatttttacttccttgagtttggatttttttgctacctggacatatttatagcaaattccttaaactctaaaatataatcaacataagtttggattttagtcttgtttcttaagaattaacatgatgtctttctttgatttaggaaaaattttactttttcatttgaggcgaacatgaaaactctctacatgtgaaatgcctgcatgcctgggcaggctctgggatgaggaaggtggtttcctcttaagagatgaatacaggccgggcgcggtggttcacgcctgtaaacccagcactttgggagcccgaggcgggcagatcacctaaggtcaggagttcgagactagcctgaccaacatggcgaaaccctgtctctactaaaaatacaaaaattaggtcgtggtggtgggcgcctgtaatctcaactactcaggaggctgaggcaggagaattgcttgaatctgggaggcagaggttgcagtgagctgagatcacactattgcactccagcctggcgacagagcgaaactccgtctcaaaaaaaaaaaaaaaaaaggaaagaaaagaaatgaatacaaagactgggagagaagcatattttccatattttgtccttagccccagtaagttttcaagtgggtcctcaacaacagccattccttctgaaaaccctgatgaaggcaaaggagccaccgctgacatcatcaaggctgaatttacccaaactggagctgataaccgtggctaaaattagcgtggctgtgaatgagacgccacttatgaaagacaaaatcagtaagtggccctcgagctaagacttcgtggttggtattttggtctcatgataacagctgattcaacatcagtataaaacttgggttgagaattggtgaagaggcatgtatttccactcccaccagacattgtggagacacggagatgctggggattggccagaatggccgtgtgtgttaagtgtgagcttgtgagtagatgcttgggtactgctgagcccctgagtgtctgaatccccagaacacactcctgaggccatctccccatgtccactcccaaggtgctgatccagtccccaaaggtcaggaagccacctgcactcccagcttggaaaggagagtgatgctggcagaagacaatgaagattgggaagggttggctggtttctattcagttacatgttgcaagatcactctggaagggaggcgagtacatgagtaagagtgagtaggagtctttgttatgtacatggtgtaatatttgctccacaacctcagaacagatagatcattcgcgactcctccagtgtgggaagatcagagtatcagaatctcagattactcaaagcacatctggaaggttttactgcatgggtctatgaccctggcagatgccctgtctggatttgggtcctgggtcttcctctatgtggtctgggcagatcggtcagtttcttcaaccatagagtagggacagtcatctttgtcctgcccacacagggatgtcctgaggctcacacaatagacagaatgtgagcatgtgtgaggaaagctggcactgcagacacagctgtccaccattgagagacaaggtgaggcagcatccaggaaacagctccggactctgacaccagcatgattatccctgctttggccctcagcaggtgtgaactgggaaagttgcttaatcgctgtgcctcagtttcctgggaaagggacactatccatccctaaaattttattgagaacctggtacatggaggcctaatttctctgtgcctggcatatggcaagtgtaattaaacaggccctattaacctggagctgttaacccgccctagaaggttcctgcatctattgaacaacctgaactttcagaaattcctagatctttccaaattaattggaagaaagacacagaactgccttctggcctcctgtgaaatatatgtctccacagagtcctccttattttccatttcttaaggcattccatggcttgcttatcatggatagtgggttttaaaactaaaagggatattttggttcctccaacccaaatccatccctttgtagagaaggaaattgagtcagaatgttcagacaacttgactacagacatataactaagtttcatgctggagccaggctttctcaccctgaggctagtgttctttccgttaaagcttaacatgtttcaatgatattcacaggacttaagtgcccttaacatctagcaaagactggaccgaaccccctttctcacgacttgtggaaagtccctaaggtttctgaggatttcccaagagcttggattcttatttctccgtgaattggcgtcctctatgaatgcgcttcccgtcttgcattgtgctgaccttattccatgctgggctgaccttttctgcttcatttcagtttcaaattcagtttcttttcagtctccaattcagctgcacgctctcctgtctgacttctctctttgctccaggccttcctccttcctttcccatcctcctttcatgatgctttgtgtgttaccagataccaaccctggtctttcagtccctcaaattactctcagactaagttgttgtgtggcagccctttaaaaaagggttcggtttaacaggcattagttaagaaaagcaaaaacaaacaaaataattctcactttctcatatggagcaattcaactgctaaacgcagttctgggccacctccctttggcactctagcttagaattcaccacttaattagattaagcttacagaccaagaactcttttttgctgtgtgatgcaatatgtctaccacagcccctgaatcataatttagttgtttagcaattctacctgcaagacagtttcttaatagtcctggtagaaagccacctgagaagactgattatcctaacttgagacaaatgttcattcctggactaaaatttatggccagaggtggggtttactctgcccaggccagtgcagcaggcccaggcctgcaatggtggcactctggtttgcaatcatccatcctagccatgagaaagtgctccctactgggaagaggacttctggcatcagaagtggggaaggagtgctggaccagtaagagtgatatccatcttggacacgaacaataaggctaggggtcgctctgactaagccatttttccacatcgccactgtgttaatctccccgagtactgcacttctgaatttctcccatattcaaaaactttcaagacttccctttgctcagtgataaatctggttcattgagttgaggagaattattcaaggtcatctacaacttgcctccagcttacctttaattttagatcctgtatcttcttctaccctctttttttttttttttttttttgagccggactcttactctgtcgctcaggctggagtgcagtggcgcgatcttggctcactgcagcctctgcctcctgggttccagcgattctcctgcctcagcctcccgagtagactagctgggattacagacctgagccaccaagcccagttaattttttttttttttgagacggagtcttgccctgtcgcccaggctggagtgcagtggtgcgatctcggctcactgcaagctttgcctcctgggttcatgccattcttctgcctcggcctccagagtagctgggactacaggcgcctgccaccacacccggctaattttttgtattttttagtagagacagggtttcaccacgttagccaggatggtctcgatctgctgacctcgtgatccgcctgcctcagcctcccaaagtgctgggattacaggtgtgagccaccgccagttaatttttgtatttgtagtaaagatggggtttcaccatgttggccaggctggtctcaaacttctgacctcaggtgatccacctgccttggcctcccaagatgctgggattacaggcgtgagccaccccacccggcctttctaccctctttataaagcttttcctttggacagattggcctggttgctgttctacaaatatactttatgtggttctgcacccgggtcattacagaagctattgcacctttgtaagggctgccttccttcacccatcaaatccttaccatcccaagaagcactttcaaaaacccctctttgtgaagtctctcatgatcatttacttttcaccatccagtaatagacaggaaatggaagatgggatgtctatggacagagcttcctcctctcaatataacagcttaagaagcatgatgtttacatctaaagttactcacactgttactcttcagcaaaacaagagtgttggactcgataattgcaaggtcccacctaactccaagggactccaagggattggctaggagagttgctttcaggaagatataaataaacacctgcctctcacagtgttcactgccccctcaaacaataaatggaagacacagtttgaatatcagcttttctgcttatatggggagaatagaaataaagttcactttgatacatatctgtttttctccgtcaaattcatcaaatttcagaattgcacttgttcatccactgactttcctaagggtgggatagtaacaaattctgccaagaaaacaagaagcgaagtataatgaataacagaaccagcttaaaaatttgcatccaaggtgatctttaaactatggtttattaagcataacatatgaataattttccaagaaatgggccacacacaaaggtataatgaatataataatcttcatttccaacatttcattttgcagctccatttacttgaaatgatcggaggcaaaaaatattgtacaacatatttccttttcatgaacatacttacacactatgagagaatatgggatcatttcagtttgatggtgggaaaaaagtaaggaaacatgtagtgtggatttcaggctcaattctgagtattgtgttttgttcagcagtcaaatgaatttcatattattttgtcccaagttatcttgtcagaaggtatcactcccactgaagcattgggaagtgtcactccactgtcaacctgtctgacaatcatattagtaaacactggcggcttgataggtcatgcactgctctggaatacactgagagtgtattaacatatagagtatcactttgtcaaacctgcttgttaatctacatttacagatgtacagtagttgatggggttgaaatgcttccctgggcaggtgcacaatggccccaaaccaaaataagcagcagaaacagtaagcaagtcttgaggttggagtggaagttatctcctttatttgatgaatttcaatacctgcagactgctgacaaagtctgtatactcaggtttttctaacaaatggttcttccaaaagagcttaagaacatcaaacagacaccatttttctttcaatatagtatagaatgtgtatgaactaggaatcagtacttccagtgtatgctacttgtatggcctttcactagcaaggttacttaggtgctcaacctcagttttcttatctgtaaaagggggattcatccatctacccatttatccattcatggacatcctgcctcctgagactc

SEQ ID NO: 493 - DNA, 40001 bp, Homo sapiens
ttagctgggcatggtggtgcgcacctgtaatcccagctacttaggaggctgaggtgggagaatcatttgaacccaggaggcagaggttgcagtgagccaagatcatgctactgcactccagcctggtgacacagccagactccatctcaaaaataaataaataaataaataaataaataaataagcacaaactcccagttacaagacgaataagttctggaatctaatatacagcatggggactatagttaataatacttgacatttgctgagagcatatcttaaggttctcatcacgcacacacaagcttactgtgtgaggtgacagatgtgttaattagcttggttgtggtaatgggttcacaatatatacatagatcaaaacatcacactgtgatcatcacatcaccttaaatgtatacaaccttagacaactatacttcaataaagcaattacacctcactttgtcaattatacctcaaaaaccttagcaatgtgaagctgataacattcagagggaacatggaagaaggcaatcttttaactaggtttaaaaggattaaagataggtaagaatggctgcagtcactagaaaataccacattgccatcacagaagacaggtttgtttgaaacaccaagggggaacttctggaagtgaatagtgaaatcagtgaagttaaaaattaaaacacaacagaatagtgaaatcagtgaagttaaaaattaaaacacaacagattagcctcagatgatgatagaaattataagaatatccatatgtggaattgtctagaatatatagcaataaagatttgcaaactgtgaaagatcatcaggagactggagaattgaaatgagaatatgcaaaatatgcttgacaataattacaaaaggagaaaatgcagataatgagagaacggtcctattcaaagggataatggctaaggaatttctggaattgatgaaaactattgatctttagattccagaaccacaatgagtgccaagaataaatgaaagtagataatatgcagaagtattgtgatactgaagtaaatcaaccaaaattaatgtttaagagacccagaatctcaaaagtatccacccacaagatagtttgcactcagaaatggaaacgggagaaggttacagtggagaaagcataattttataaaacacactcacccaggtggttgcagtccagggagaaagcccacctcaccctcacagcaggggagaaactggcttcatgtttcttgttagcggttgcactgaaaaagcccggcatcccctctgtactgttcctgctgaaagtgcaaaacctgattctcaatgtgaggacgtatcaggcaaccaaatggagggacgttctattaaatgactagcctgtatctggaaatacatcaatatcaagaaatcaaagaggttgcagaacagttccagatgagacaactgaatgaaggcatggttcaggatcttcttcccctataaaaacaatattggaaccgttggcaaaatccgaagaagatgtgaaggtctgagaattgtattgtgttaatgaagatttcctgtttttgatcactgtactgtgataatgtaagagctgcccttggtttcagaaacacacgctcaatacttgtaggtaaaggagcatcatgtctgcaactgactctcacagggtctaggaaaatagtgatagtattctacatctgcaccaagagaagagaatttagcaaatgtagttgaatgttaatatgagaggaatctgaaggaatcataaatggattttttttgcactactattgcaacttttttttttcttttttgagatggagtcttgctctgttgcccaggctggagtgcggtggtgcgatctcagctcactgcaacctccatcccctgagttcaagcaattgtcctacttcagcctcctgagtagctgggattacaggcaccccgcaccatgcccagctaatttttgcatttttagtagaggcggggttgcaccacattggccaggatggtctcaaacctcagggaatccacctgcctcagcctccctaagtgctgggattacaagcctgagccaccacgcccggccgcaacttttaaagtgtctgaaattacatcaaaataaaagataggaaaaattagagaaattaatgtaggcaaggcagatatctcaacagccacacaacaaccatggaaagatttatttatttattttgaggcagagtttcactctgttgctcaggctggagtgcagtggtgtgatctcaggcttactgcaacctccacctcctgggttcaagggatccttccatctcggcctcctgagtagctgggactacaggcatgcaccaccacacccggctaatttttgtaatttttggagagacagggcttcgtcatgttgcccgggctggtctcaaactcctgagctcaagcgatccacccaccttggcctcccaaagtgctgggatttcaggcatgagtcactgcacccagccaggtttctttaatatactgaggaaatataactgtcaaccaagatttatctgcttacatagtgatcactcaagattatgaattgaatcaaaaccttttcaggcaaaaaagaagacttgaagagttcatggctaagagaaattgcattgaactaagtagtaaggatgtagttgaaggaaaccaaaatatttcaccccataatatatttggacacattttgagatggctgtttagaggggcctgcaaacagaagcagccctgcaaagctgtcttttgaggggaaggtttgcatctgtagagaatccgcactgacgcaggcaagtttcctctgaagccttcccttgtctggatctaggaaggagtccctcacagtctgacatatttagccatcagaaagaaacatttaccatctattctctccgaggactgctgtctgtgtggttctgtctgcattctgagaccacctttgccagccaggcctcctcctccctctcccctaacctgtcttgctgtcatcccagcctctgttccttctgtaatctcaaggcggtaaataagcttctgcacaccattgtggggttgggatcatcgctctggtccttctccatctgcacattaataaacgtgcatgccatttctccaattaatctgacttttgtgagttgatttttcagtgaacttttcaagggcaaagtggaggttttcttttggcccctacagttttggtgtcctgaacagaataccaaagctgctttgctcttctggaagcttcagtcaggggacccaggacctgacaagctggcagaagggtaacaaattcttaccagccaggcttctggctggtctctctgtggaatccaggtgagcagatggtaaaaatcagtcatttttcctctgcaagatgttgattagtgtgagaaaggatctgtgtgaacaatgttgggtgcagcgactctggtgtactttttggtgtgaatattcatattgtttagtgcccttccttccaggaggattcttctcctctgtcttggtcttcctgtgttctgtcctgaggagaggacttgtagggtagaatgggggctgaagatcctgccagcccattgttcaggccagacctgaagagcagccagtctgcggctgagatcagatgggcattcaaactttgctgtgggtcctcaaaatagaagccaagccaggtgcggtggctcccagtccttggggaggctgaggtgggcagatcacttgaggtcaagggttcaagaccagcctggctgacatggtgaaaccccatctctactaaaaatacaaaaattagccaggcatggtagcgagcacctgtaatccctgctactcaggaggctgaggcaggagaaccacctgaacccaggaggcagaggttgcagtgagccaagatcatgccactgcactccagcgtgggtgacagagtgagagactgcgtctcaaaacaacaacaaaaacaaaatagaagccagatgaggacccctctcatcttgttttatgccctggagtgtttgacttgtgacaagtgggagcactgtctcttgtttctaccatctggggtgtgatttttgggtcccatcaggtgttcagtctgaagatgcctgggaacctgagatacaaggttttaggcagcacactttttgctctgaatgtgtccagctgttgggaatgtttgtcttaataagaagtcccatccataaggaatttttgtggtctggcccttgttgcctggatagtcctgggaaagtcccatcctaggagagctgtccagtgtcatgaattaaggggtctttgatgggtgtccccagaaatgtgtgggtcaccagaggcactgtgtacacaaacaccatcctaaccatgtgtggcaacagagtccgttgctttgcagggacgtggatggagctggaagccattatcctcagcaaactaacacatgaacagaaaataaaacactgcatgttctcctttataagtgagagctgaacaatgagagcacatggacacagggaggggaacaacacacactggggcctgtcggtggtggggagggagagtatcaggttaaatagctaatgcatgcggggcttgatacctaggtgatgggttggtaggtgcagcaaaccgccatggcacatgtttacctatgtaacaaacctgcatgtcctgcacatgtatcctggaacttacaactaagttaaattaaattaaattttaaaaagaaagaaaaacaatagacaagaaataggaactaaggagctaatttttattttattacttcaaccaataaaaactgtgggttaaaattaaaaaaagtctcttcctatctgagcctgtttctaggagtgaattttactggagggatctttggaactgcctatcctcaccctcttcaggaaacaagtctttcttaaatggtaatagcctactctaagcctgaaaaaccacatccggggctttccatgaagaggctgtgggatggagttgctattagagtaagtacatcattggaaattctagccattagcagccaaaagatggattctttaagtcagaaagacctctaaattacaaaaaatagtttagagatttcttattctaaacaactgccttatttatgttcattggaagattaaattaaaagacacatcatagtgtcatggcttgccttagaaatcctcttgatgaggttaaagagcaaaagtctgacctgaaacaaagctaaaatccttcatatgctccaaatgcctgccctgggtcccttgtggaatctgcagtgccagccactccaccttgcagtctatttttttttttcttgagacagagtttcactcttgtcacccaggctggagtgcaatggcacaatctcggctcactgcaacctccaactcccaagctcaaacgattcttctgcctctgcctccagagtagctgggattacaggcatgtgccaccatgcccagctaatttttgtatttttagtagagactgggtttcaccatattggccaggatggtctcaatcacttgacctcgtgatctgcctgccttggcttcccaaagtgctgtgattacagacgtgagccactgcacctggccccaccttgcagtcttgttgttaaaattccacacattcactgccatggcctgggtgcaggtcctggtcaggaagccagtcgcttttggtttgatatttgtgtgacttttgactttgtggcgtacccacttgtcattgatcctttccccttccatagacagcttttggttttctgtcatctcctgtttgaggggttacacggggctcttaggcttttgtgtgtatatggtcagctgaaaggctgagaccctggaagatatgactggcagatgtgggttgtaccccatttgtggctagcaaaactttcctttctttgagctgtctttgaggtggttctggatctggtgaggactgctgtgctcctctctggagatgcctcatgtgtccttggttaagtcataatcttgattaagccttattggttttggtgagccacttgaggcagtatctttgtttaaaaaaaaaaagatccaatggtacaatctcctgtaatcccagcactttgggcggctgaggcaggaggatcacttgagcccaggagttcgagaccagccctgggaagcaaagtgagatcctgtctctacaaaactacaaaaattagccaggtgttgtggcatgggcctgtagtcccagacactcaggaggctgagctgggaggatttctggagcctgggtagtcgaggctgcagtgagctgtgatcgtgcccctgcactccagcctgggtgacagagtaagactctgtctccaaaaaaaaagtttctcttcttttttgagactgtctcactctgtcacctatgctgatatacagtggtgtaatctcagctcactgcaatcttcaccttcgaagatcaaggaattctcatacctcatcctcccaagtagctgggattacaggcatgtgccaccgctcctggcactttattttattttattttattttattttactttattttattttattttatttttagtagatacagggtttctccatgttggccaggctggtcttgaactctggtctcaagtgatccacctgcctcagcctcccaaagtgctgagattaaaggcatgcgctacatgccgagccataaagatagtttttaagttattgctacagtaaaatagaagggccagacatggtggcttatatctgtaatcccagcactttaggtggctgaggcaggaggatcacatgaggccaggagtttgagaccagcctgggcaacatagcaagactccaatctctacaaaaaaatgtaaaaaattagctggttgtgggctgggcgtgatggctcatgactgtaatcccagcactttgggaggccaaggtgggcggatcacctgaggtcgggggttcgagaccagcctgaccaacatggagaaaccccgtctctactaaaaatacaaaattagcctggtgtggtggcacatgcctgtaatcccagctactagggaggctgaggcaggagaatcgcttgaacctgggaggcggaggttgcggtgagctgagatcatgccattgcactccagcctgggtgacagagcgaaactccgtctcaaaaaaaaaaaaaaaaaaaaattagctggttgtggtggtgcatgcctgtcatctcagctacaacccaggagttggaggctgcagcgagctatgattgcaccactgtactcaagcctgggtaacaaacgagaccctgtctctaaaaataaataaataaataaaaagaaaagtaaataaaacagaaacatcttcagaatttaatttagacatttttgcctgggtctaattaggcaggtttttactgtctctgttaggtgttttacagtcataaaactgaatggatagcgggggggaaaagaaaatagaaaaaatgcaagaagttataaaaggtttatgaaaatcttattttatgtgatcaaaactgagattgaagggatctatttataagattttattaaaattagctttagcattaatacaccgttgcaaaggcagaatttgtttttctcttttaaacatgattttcatgtagtattaataagcgatagtaaatgatttttgttttccttgtaagtaaactgcacaaaaaagaggagagagatggattttgtttgcttcatgctgtcttcattaggtcttttgattatttgggaaacagagtctcccttctatcaaagagtaaaagtttttggttttaaaaatctttacattatcacttggggtaatcatcactaatgaatgactattactttatagtggcgtgtgattcatcctgttttttatcaagtgttttaaactgttgatatttggaaaacttcccaaaatctaatttgaaattatgaaagtaagtattttcatgaagaactcctggaagtccaagagggacgtattagtcttatttggtatgcaaaaatcatatggaaagactggccacataagaaattgtatttaaatttctttgagttgtagttataaaaatgtgttattaatatgtgttcctaaatggtatggggttactaaaattctgatatgtcttcatatgtgttatcagtaataattatgattattatattaaattgctgaatgtcacagaagtaaccaaatttccttgtcacttgtgtctttaaccctggttattttaagtcttttgtcatccacagataatttttgttttactttgactcttctcagaaagcagtttatgatttattatagtcaaaagcttgcttcttcttcaaggaaatttatcaaaaagtccttgacaagtactcttggatacagatttccggtaagtttggatatcataccattggactaggcaaaaacttccagaactctgataagagaaggtgatgggttcctgaagattgctaacccaacatcaagcagaacaagagttaattacatgggactgaactgatagaggactgaacatttttttttctcgactctttggtttgaaacattgtggattctttctatgctttgttttccagaatcaagaaaactatttcctcttaagccatccatagcttttaacaattgaacaaaattgaaacatttatctctctctctaccagatttctctagaaatctgttatttgcataagctcagtaagaatggttttttttaaaataacaggacataactggagacactggttattttaccaaggttttgacaagaatggcatattttcagatatgatgagcgtatttagcagaactaaagttgattttatagatctaataaaaatccttgtggaaagactggccaggtaccttgtctacacagttcccttacaaggttctggaccttgcagtaagtaaagaatgtcactttctgaagggcccaagaacctcaagatatattgggacctcaagaagggaggaattcaccaaatttgtacaggcattacaggcgcagtctgatggcaaactcttggcttggtttcctagcctttagaggattttaaaagtctaatctgaaattccttatgaaaaagttccagcaaggccaacttaaaagaatggccaatcaccatttttttctgtactttattcaaacaatcaggccaattataacaaaacgaaaacttattttgtgaataaattggtcctattgtgatttgtctttgttagaaatggggaactggagagagaaaaactatgtttcagaagaaaactatagtatacccactattctattctagccctgtccattgtttttcagtttttattacttgtctataactgggactgaatcctgaattcttttctggctacaagtctccaagctaatgtttttacattttctcacatttttctgacttggaatcactagaaacaaaaaaaactgtgcttttcttaaagccctgcaaattgacgctagaaaacttgatataaactttaggagaaatcactatagcaactttacatgtaaacagcctttgtacctgttgatgtatagactactcagaaagtttgttggaacacctgattccaactaatatccagaaaaatctgtcagattaccactacaatttgaagatgcttcagcgactctggaaaaactagtctatacactattccagacattaacctttgtttttcttctgtttccatagaaatgtctcaagaagatctgagacaaaatatttaaatttgttcttttctgctcattcaaatttgtcatttcttttctttgcctgtctcttatctaacaagctccaacctaaatatctccaaaggaatcaacttgcctttttatatgtgaaacatttgaagtttcaaagtggggagtggagaaaaccaaaaatattttatctcaatatatactttggtgcactggaaaaaaagactggaaaaaaaaggaaaaggatactcttggcatattttgagatggcttttcagagggcctgcaaacagaagtaggcctgcaaagttgtcttttgttggagagattggaaagacaaaagcaccccacaaatacaatttatttataaaacattatgtgttgtcttagtccattttgtattactacaacagagtaccacacaggcggagtaatttataaagaaatttatgtctcacagttcttgagactgataggtccagtattaagatgctgacatgtggtaagggaaggctttcttgttgcatcatcccatggtggaaggtcgggggcgggggagagagaagagaaagagcgagcgagcgagagggagagagatacccactgccatgataactaacccactcccgagataagggcatcaatccattcatgaggttagagctttcacggcctaatcacgtcgtcttaaagattccacctactttggctcttcctcatggcacctttttattttaaaaaataaaaggtcctacctcttaatgctgttgcattggggaccaagtttccaatgcatgcttttgggggccacactcagaccacagcaggtgtctagccccactgtgtcttgcagtcaagcaaacaaagccaggaaggagtcgggagccctgagccacgtggcctgtcaaggaatcacatggaagttatgtctgtttctcattgctgctatggctgaataccacaaactggcttaaaaccacacacatctgtgctacatttctggaggcgagaaatcccaaataggtctatctggctaaagtcacgttgtctgcagggctgcgctcctttctgggggctcctggggagactgttcttcaccatctcagcttccagaagctgcccacattctctagctaacagccacatcactccaacctctgcttccatgcccacctctctttctatgacctggccctcctgcctccctctttaggaacactgtgatcatcttggacccacccgtgaaatccaggacatcttctccagagcctcacctcaatgcaggggcacatccccattgccacatatgtaacatggtcgctggtttcatggcctgggatgggaatagcttttggggggcattgctctgcctaccacagtaacgaagagcttgggacagctgcacttgttaacatgttggtccacaagaactaaggccctgaaggatttgactgcttcccgctcccttctcctgactccaggtagcagtgaatccacaggagagacagggatcagttgaccttagggtgtgtctggtgtcaactctaattggaccagtaagggaacagaagccttgagaaagtaccacaacagtctgaaagtactcagacagccagtgtctgtgaccatgctgccattcagatttctgccacttgttttccaggctgcagattcttcaacacacgaaaccagtcacgcgacgggacactcaatggtgctgcttgtcctgcttagtttggcctggggttgcttgctacaaggcaagctccacccacagctctgataacccgcccttctctccagtctcactgatctcccgggtggacaatctggaaggggtcttactggagttgtgaggcaggcagaggccagaaccaacagccatgcctggttagagaatgcagcatcctaagcagaggcaaggaggaatctggctgtcctccaagtctcagcctcttcagccggcaccacagacttctgtgcccatgcgcctgggcctgcagctgcctgaggtccatatctattatgtctactggctgggccagggccgtgtcccccttctcccagctgagtcagtgtctgaaaagcagacctgatattaatccatatgtctagcagggtccttgatatcaacacaccaaaaggaggaaaaactcatcaaactggagtttatcctcaattttttgttggggtacaacttcacttgtcacaatatgatgacaataaaataaaagttttataagatctctcaaacccaagggttgggaaacaaattaagcctcaaatgaggggttatgtgtgccagacaaattataggcctggaatttggagggccagccccacctggagctaccacttggcagccccttcactcccatagcaaccagcacaaactaggcagaggtgggcacctgccagggctgtgttcctcccaaagcccaccctgccccaggggtgataccgtgagggtccagtgctcagtccagtcctgcagtcagcccagcccatacccaacatcctgatttgccttccaacagcctttggctggtaacatctcaccccagatttccagccggaaagctactctggaaccaacaaactcagattccaaggagaagagagaaactcacaggaattgcagcctggagagggtaagctcactccatatcttgatacgtagaccagtaagatccaaactgggctgcagcctgcagaggcatgtggctcacacacagcttcctatcagagttcttacacctctgggcatctcatctgagatgtccccgtctctgccatggtgaccttcccctccacccgtgccctccatccttcctccctgtggtgcgctcagccttgatccatcaattacctctccctctcttttacataaaactcagttctttgtcatccacttcctgtcagcctttgcaaaaggtgaactctcacacgagaaataactgaagttcttctatgcaccgctgacgtgagtgtagcggctggagtgtgaaatcagagctacagaggcaggtggaccggtgcatatctccagtgggtgaaggtacatgcatgtccatttcattataatttttagagtataaaaatagactctatatcccctactgagtataagatgtcttttcacagtaatgagaaataaacaaaagcaacccctctcccacataaccagtgtaaatttgggctcttattcaagtcagctcgggtttgaattctagccaactggtaagaagcagcatgattttggacaatcacttaacttcactaagtctgttttctacctataggatcaagcaccagctccaaacaaacaaacaaaacatcagaaggcagagctgtgatccaagccctctttttcatgttcagagcatacatcctccaccttcatcctacaataatatcccaactaatggaaataattatttctatttttgattgcttgtgacctttatagcagccatgcatgaggacaccctccacccctacccttgttactaacacgtacaattgaactaaaaaatatcaagacataatactcaacaaacaacccagtccctgcttctcatgttagttaaaagcacaccaacaggtaactgggagattcatactgtgtaaagtagcaaatattccaggccaaatattccttgtgggaggagcagtgatgatctctgcagctctccatgcagtgggaggcctcccttggactggtcgttagtgaacctgcttcacaccctccacagctcttcctgcagtcttccaaggcccccagacttgccttgtcccctctcacaggagtgctctgtctgcctgttgatgctggaggtgcaggtgggagcttctcgggccaactgctggggtctctgtctcctcagatctgctgcaggagaacatcttcctgtaacctcatcctgtgtgtctgcccattggctctgccaactcatggggtggctgacatactctggacaagacacccaccagcatgagtttgcctcttctttgtcacggcagtaaggctttgttctaattgtgtcacaggagcattgaggaggacagaagcagcaactgtgacctcccccttggccatcagaggcacagctctgcccagctgcaggccacctgcgggcagaccatggctctctgacactctgcatttgaaagcaagtctacagttgtcttccaaagtgctgactcttttgaaacatcatcaaaaagaaaaaagaggagagattggaagaaaagctgtgagatgatggaggcctgagagggagaactgaagaagggtggaggacctcaggccagggccaagagggaccagcactaaagccaagggtgggcaggagcaggggcttgtggatgtcccaactcagacagtgctgccctcttgcaccatccctcaacatacaggtgggcagtgtgactgcctgtgccaaggtgggcaggaaggggaactgcctcctatcaaggtatgggaatttcctcctgtgtagggaagtggagaacctattatttttgctacaacaatgttccttctcatcttgtctccctcaaatagatgctgggatcctggccaggaggtgctgtcttccggttttctgtctgtccctgggctggagtctcaagtgacaggacaggacacctggcagactcctgaaaaactctggcatgcctgcagtgtgccctgaaatggacgctgccgtccctgcaacagggacacatgctcctttctctagagttacagtgtcttcaggcttttcatcttcatggaggtcagtttttaccttaagttattaattttcttacaacatttagcatcttggcagcaggctgtgatgcttgagtggtgctcacacactgagttcttagacctgataatgcttattttaaagttgcaaggtctactacattgacccgaggaataaaaattaaatcttaagttcccccagttgactgatagaaccctctcttggccaaagggccccagagaaaccttaaaaactgagctcctggccatgatgggatgggaggtcagatacacttcaccatgtcccttccatattaacctttagccagaactctttcctaaggagtaagcagaaaccagctctggcaaacaagaaacacaggactcattcctttatcatctgtagccaatcatctgaggccgtggctggactcgccctacctctttgcagttttggagtgacagtcaccagcttcacagtgcatccttcctaaaatggaccaccgcctctggaccagttttggctggctcacagaggatgcacagtgagtggtttgtggcccctgcttcaccttttgatgtcagaggctaaaaactacaccctcgcatgaacacgtgacccatgaagaggcatgaaactcaatggcacattcacatttctcctttcataaatattcattgctcctcctatagtttattgaatatgtatgttctgccactccattcagcataaattccacacagaatacagtctctccttcatatccacgggttctgcatccatggattcagccaacctcgattcaaaaacatttgaaaaaaaagaatgattgtgtctgtactaaatgtacagattttttcttgccattattctctgaacaatacaatataacaactatttacatagcatttacattgtattagatataagtaatctagaggtgatttaaagcaatcttgtccaacctgtggcctaccctccaacacaaatttgtaaactttcttaaaacattatgattttttttttgcgattttttaaagctcatcagctatcgttagtgttagtgtattttatgtatggcccaagacaattcttcttccattgtggcccaggaaaaccaaaagattggacacccctgatttaaagcatgtggaggatgtgtgtaggttatatgcaaatactatactttcatatataagggacttgagcatccggtaattttggtgtccaaatcaccaaaacccttccagaggaggagttttgggaccaatccctttgaagataccaaaggataattgtatttctctgatcactggtcactaaaaagtgtagagatttctccgcaccaaccattccttcagcagataacagctgggtgtctcctaattcaattcaattctgaaactctctacctggacagtgtcagacctcacaggttaagggctcagtcccaccagactgtccctgcttcagatgccagtcacaagtagtaggttgtgacctgtgctcctgcccaactggctgcaaatcaggattcccagcatcccctcctcgggtttgattaatttgctacagtggctcacagagatcagggaaacactttacttacacttcttcatttattacaagggatatttcaaaggatgaaaatgaagaggcagatggaagaggtgcgcagggtgaggcatctgggaaggggctcagagctcccacaccagctccagacacaccaccctccagactccacgtattcagctatctgggagctctccaaaccctgtccttgtgggttttcactgaagcggcattacagaggcatcatcaaccacatcactggcaattggtgatcagctcaaccttcagtccctctcgtctccccagaggttggcaggtggggctaaaagtcccaactccctaatcccgcctctgtctttctggtggccagcccccatcctgaagctctccagggtccccagccaccagtcatttcattagcacacaaatgacactcttagtactctggagattccaagggttttaggagctttttgccaggaaatggggacggggatgaagacaaaatatctatctcaaaatagcacaggagtttaaattcgtaacaggctttctaacatgcaatttgttaagtcattgcatgacttaaaaataagctattcgaaagctttagaaagctatttggaaggaaaagttggtgagtgttcatgaaaagatatggatgaggctgttcatttcagccttatttatttgtctatttatttatttattttttgagacacagtctcactctgttgcctaggctggagtgcagtggcacaacaacggctctctgcagccttgaaatcttgggctccagtggttctcctgcctcagccttctgagcagctgggaccacatgagtaggctcctatgcctagctaatttttatttttttattctttgtagcgacgaggtccccctgtattgcccaggctggtcttgaattcctgggctcacatgcctctcccacctcaaccctcaaagtgttgagattacaggcgtaagccactatgcttggcctcagccttatttgtaatgacaaaagaaaaacaatctgatccatcctataaactaaaaataaaatcctaagccacccccactgactgaacagaccccctcttggccaagggaatcccaagccttgttacactccttcccttttggagtttaggtgcaactgtccagcattaacattagagatcctaagactgacaagacagattctgtgtcaataaaagaccaaattataaagaagacctaaggccatgccaggtgagggtttagtcaggcctgcaggccatcaaccttgctacatagcatccttaacttaaaacatgcctttccgctgacatcaaattttagacagagcttactcctttaaccaactgcaaattagagaatctctgaatccatctataacctgtaaacccctgcttcaagatgtcccacatattcaggtcacaccaatgtacatcttccatgtgttgacttatgtctttgcctagaactctttcctcctcaaaatatgtacaaccaaactaacccgagtgcctcgggagtgcttcctcaggcccttcaagactgtttccccaggccactgtcactcattcactcatagtaaacctttttcaaatattttacagagtttggcttttccatcaataatccatgtctgagaattcttaaatcagcgttcctcaatttagattatctatttgctcctgtcactgtttttgacataccctgatatgacctatgcttttacctaattcttcttgcacatccgcagagacatgttctgtcagtgtcgcctcccaagtgtatcatgcatctgtccacttgccgccatctctctgctacccccttactgggagtcctgtccctcttacttgatggtaagtgctttgtgcttcttacttcttgacagtaagcgcttgcgaatggtgcttcttccagccaattctcttatgcagcagccaaaatcccgttatggaaaaaccaagcttcttcctgctacacaacttttttactagctgcacattcaggacagccagtgtctcattaattactcaggtcacaattcctatttttacatcagaggacccttcaatggctgacgtcctgtgcagtgctggcccctccacacacacagccccttccctgcgatgtcaccctcataatcctggtagctatgtgccatcaactcatgtatttcttaataagagctttagtgagacgtcatttgcatttcaaacaattcaccactgaagtgtacaattcagcggttggtagcatattcacagagccgtgaagccattatccagtcaattgcagaacattttcagcatcctgaaaggatgctccccatcccttccagacctaagcaactgctcatctactttctatttctacgaatttgcctattctggacatttccatgaatggggtcatttatgaccggcttctttcactgaacgtgctgtttctggcgttcaccatggtgtggcatttctcacgtgtgaatgtcgcattgtgtggatggagcacgtgttgtttattcactcatcagtcggtgaatatttgggttgtttcctcttcttggctataatgaatgatgctgctaagaacatttgtgtgcacgtttctgtgtgaacatgttttcaagagttgtgctcttaatacatttgaggaagttttggtggaagagaccacaaaaaatggcatatacatctcagccttctgtttatatagaaaatatttcttgaaggatacattaaaaattctagcagcatgaatgtctctggatagtgggccttgggctaggtattatttaagaatttattgattttttgcattaaagagaaaatattactattctaattaaaaatattataaggaagtaacatgccacactttgcctagcttggtttgctagttccacgaagtcactggcctggcatgccaggccctgacccttcctgcctcactcttggatttgccatagaagcacctgccatttgcgctcctgcatatggaatctgtttgctccggcttcaagccttgtgcatttgtcttctgcctggacgacacttccatccacgcctctgagagactgaacactgctcacctttcccactcacctggggagccttcccttaatcctcgagactaaattctctcagacaccacatgccatcactctcctcattcttaccctcatgttgactccgtgtgtgtgtgtgtgtgtgtgtgtttgtgtgtgtgtgtgttagagctgtgtggtgctcctcttggaaacagtttctgaacccatctgcaggcctgctgcaggagcttcagaaggcacatagggagagggatgctggagtgaagaaggtctctttattggatgttttctttctaatttcaggtggtgactttatgcttggtggatctgaagcaacatcctcaagcacaaaatcatttttatgatgtaaagatccatctgggggagcacctggcacctgtcaaacaccacccagctccgcctagaaccgggctgtgtttgaccctgctctctcctcagactgtgctccatgtggacacctgtggctagctgggtgagggggaagactgcgggataaagagagaaggaggaggcaggagaaatgcacctgggcatgctgccaccccaggcacgcacgtgaaatcttcgtggatgggcaggaaatgcccatccgtagtagcatgggaagcagcatggggataaacaaagaccactcaaatgagagacgcaaaggccccagcaagggagtcagccatcgccagttgcattttggtagaaatttccaggcagacagaggatgggaaaagttcacagtggaaaaagaggaggctccaggtgcactccgagtggaggctgttggcttggggaagctggggtggctgaccagaaacggggcctcctgtgtggtcagttagggcagcagattttctggttggttctaagttggaagctgggacaaaaattagggaagctgttattagtcaagttctggctgttttgggctggttgttacagggcggtgttaggctccctggattgactggagatagcgggctggcttcctgcaggtctgacttctagtgggctggcttcctgggctgttgctgcagatcccaggctggctttggggctggttgctgcagattatggctcagagtttgatttttgtgtgtagtctcgccactgtcattgtatattcagtctctcacaggtcagcttatcagcacctgctgggccactccagggcttgctacttcaaccaagggatgggtcttgcagatctaccttgctagcccccatttcagatgtgacgctcgagtcctaacaaatgaagggcacatgtgtggaggcagctaacagcacagagccaacttctaggagaataggacgagagaacataaagatgtattgaaaaccataactcttgaaaaccgtaaaatctcaatcctcaggcagggtctgaaataatcacaacaaaaagttctttataaggacagaaaacccacctttcggccggaaccgccatcttccagtaattcgccaaagtgacgaacacaaagggaaagaggagaggcacccgatatatgttctctaggccttttagaaaacatggagttgttcctttggccacgtatatgcgaatctataagaaaggtgatattgtagacatcaagggaatgggtactgttcaaaaaggaatgctccacaagtgttaccatggcaaaactggaagagtctacaatgttacccagcatgctgttggcattgttgtaaacaaacaagttaagggcaagattcttgccaagagaattaaggtgcgtattgagcacattaagcactctgagagccgagatagcttcctgaaacatgtgaaggaaaatgatcagaaaaagaaagaagccaaagagaaaggtacctgggttcaactaaagcgccagcctgctccacccagagaagcaatgggagaaccaatgggagaaccaatgtagaaccaatgggaaggaacctgagctgctggaacctcttccctatgaattcatggcataataggtgttaaaaaaaaaaaagacctctgggctgtaaaaaaaaaagtagagaaaatccaaaaggaaataatctgtaaagaggcaaaaccagcaaaatcaagggagactgagaaatttgaaccacagcaacgggaccccacgggatcctagcgttgagaccttaaagggaccctcgaggacctatctctaaccacagcctccaggctgaacctttctcactgccttggggccctgacttcaccaggacccgtgcacggcttagcccctgcaggaagcccagggcgtcctgctggcctttggtgcagagtccttggatggagcagtggcagtggctgactgcagacggcgtggcctcatgcactttctgtgttaaatgcataggtggtggagtggagaagaaagtgacaggcagagaatgacagatgccccctccctggtctgctgcttctcaggggaaggtctgctggggtgactaggggaggaggaggcatggctctgaggcctccctgccggccactccaggcgctcccagccccctggcctccgggccccacaggtccctgagcaccttgctgggagatccctgtgtcctggcagtggtgacaaagctcctaaagcctacctgtcaaaactcccagctctgtgttcaagtatgtttttcaaaaaacattggaatgaaactggtagggtttgcatgatcctcgcagtggagaaaaacgttaatgacgttgctggttggagcctgtgagtgcagcaccccctgctcaggacacacaggcattggtgctgctgttgccagtcctgtcccagcctagctgccttagagaggtgctggagggtcaaactctgcaaaactgcagtttgccactggtgggtggctcaggactcaaggctagcccccagccccagtcctacaaaccttccccgtggacctgtcgtgatgccacccgtcacacccccaccccctgggagcgctgaggcccagtcctggctgccacactcgccatctccttgctccccctagccagagggaggcccagcacctcgtggtcgctttgggggttgggggccccaagtgcctgggggacatgagtttaagcagaaatggtgcacccgaggccccagccggccggccggtcccagcagcgcccccatttctcacgaaggctggcagctacaattcgggcgaagtccaccggcccatctgcacctgagcagcgatactggcccaacagactccaagtgcctggatttgcggtgctaaacctgaaggccttaccctgcagatgcagaggccgccgcggtagatcacagcaggcagaactccaggtcagcgctcttccctggcaccacaccagaccgggctgccgaccacctgggtttctgctgtgccacactgaagaacatttctccaggggacacaaacacttagcattctctactgaagttttctcttttacatttaacatcgaggtgtgcgattcatctggagtgcatacttctgtgcaccgtgagctggtgcccgcagtttgctggccgggggccgggtaggcaggcatggacaaggagtccagcacttgtggaggaagctttggcagctcactgaccaggcagcgggtgcccgacctgggtccctctccctgcgcgcccctcccccatttcccctcccacggtcctcactggtctgccacactgtcttagggcaatttccctttcctcctgctgctcgccccttgccttcacagagcgtgttgcatgtgcaaacctgggtctctgactgcagcccaccctgggacccagcaggagtaggtggtcattctccaggagcacgtgcggaggtctgtactctaccctttcatcctccgaggttaacaataataatagttattgttgctgttgttcatcattattgtaatgattaccattattatttgttattgttataaaaacactgaatgagattttcccatccataaagggtgtctggttgactgaaggtgaggaaggaggagtttcaggctaggaaatattctaattcctgctgtagcccagggtcagaggtcagggggagtcctcggccccagaggtgctgaatcaacccttcactcacagcaagttcccgtgtctctggggcgaatgcccaggggtttggttgctgggttacatggtccttaggcaggggaagcaaaactttacctctactttacctctctggctgggcctaaactttacctctctggctgggcctaagaggtaagtggacataaaacacattaacaggagaaaagcacacagatttgcacatgtaagtggaaccctgtaggaaaaagagatccgaagaagcagttaggcctgaacacttatatactaggttggacaaagagtaagctgtgaaaacgtgcaagacaatggggtctgggatagggcagttcactgtggagaagtgacgaggcagatgagggttagtttaacgagatttgttcatacagattcccctcggccccaactccctgcctctgatggtaagaatggcttccttcctcctggtacagggagggcgcctttcccatgggagattcacctcctactttcaggaagaaaaaggggaggtcagggcatcttccttgtgtctgctgtttttcaagtgcctttagcttaaaataacccttatgctaaagtggcatattttggggtggcatattctgccacgcttcacttgcacgtttttgttgttgctgttttcttttttgaaactgccacactgttttccagagtggcagtacaatattaccttaccaccagcaatgtgtgagaaagcctgttccttcacagcctcacccgcatttgatgctgttcctatattttgttgaaggcatttgatggatgtgtcatgacgtctcactgtcattttaatttacactcccacaaaaggctaacgtcttctcatgtgccgacttgccatctgtacatcctgctcagtgaaatgctagttcatgtctgtgaactaagttttctgaaaaggaatgtggaaagtgactttatttcagtgaacagtttgtaaatggggaagttgcagccttcagtgtaaaaggaaagtaagttctagaaaactaagaaagggtttgggttctatggtaaaagtttctgtccaggtttccaactactttcatttatgtaaatgaaggactgaaactcgtgctgtcctgatcggtggatgtagctgaatcctgattagtcaatacaggtgaaccctgattgatgcagttgagtcctgattggccagggcaggggagttctgacttgttctttaagccttaagcagaagactgtcagaaatttcttataaatggctgtcaggggtccagggaagtggtgctcaggatacagttatcttggcactgacaacaggaactggtttggtttggttgtggaagggaggtcttgtgatacttttacaacatctttctgagaacacagagtacatgaaggctctgtcacccagctacggctccctggttccattttaactttgagcacctcagttagtctcctgggagtcattttttctttctgcagggggcatactttaacatgtctttcatcaattttgtaattggattttgaagaaaaataccgttgcactttgaggtttttttttttacacattcctgtagaatatatggtttgtaaatatattcttctgatctataatttgttttccttctcttaaaaggacctttcagctgagtgtggtggctcacgcctgtaatcccagcactttgggaggccaaggcaggcagatcacgaggtcaggagttcaagaccagcctgaccaatatggtgaaaccccgtctataccaaaaatacaaaaattagctgggagtggtggtgcgcacctgtagtcccaactacttgggaggctgaggcaggagaatcgtttgaacccagcaggaggaggttgcactgagccgagatttcatcactgcactccagcctgggcgacagagccagactccatctcgaaaaaaaaaaaaaaaaagaggacctttcacagagcctggggttttaattttgatgacttccaatttacccatctctctttatgaatcatgcttttgatgtcaagtataaaatctccttttttagcctagatcccaattttctctaagaattttttttcctaaaattttatagttttacattttacattgaaatgtgtgatccatttggagttaatgtttgtatgaggtgtgagggtagaacccccacaatttatccattaagaaaggtgaggagactttatttctcataaggattacagccttcaaggtggccatcccagccaagggaccagaaacaggcacttcgaaggaggaggggttagggtagcagctttatgctgggcagataggctaaacatacatattcaacaggttataggaggtgctatgaatattcatgaaggtggtcctgacacatgcatattgaacagacatgcatgtagcatatgacccatgttcactttggggtggagacttaacatttaaatgtattacagttaggtcctatatgtcaacaggtcttttcagggcatgaagtcacacaagtgtgcagcctctgtaaaccagccaaagacaatccatggttggtggtcttatcaggaagttatggctggtagagcaggggtttagtaagtcagtgggtggtggagctggaaattgttttactcttgtctatcttgaggccagtggttgtttagctgctagagaaaaagaaaagccttgtggtccttagaacacagtttattctttaagcatagggttaatgacttaacccttgcctggcatggccttaggtcctgtttataatttggcattttattgccacagagtctgttctgtcagtcttctgatctctgtgttaacattaatgctggtctaaaccccaaaaggcagggggtataatgaggcgtgtttgacctcccaccccatcatgactagaactaaacttttaagattttcctgaggtccccttggccaagagggggtccattcatttggtgggggcctgggattctaaagttgacagtgtctaggtcaagggttttgttttgcctgcttgtttgctgtgcctgtgatgtgcaattgccctactcccatttgatggaaaggctacctttcctcccacaaggtgcttttgcatgcttgtcaaacaccagctgggtgcatttgttttggtctcttttctgttctgtagatcatctccctctgtccataccacactgtctttactagctatttaacgtgttgaaataggggtaacttaatacttgttttaaattcttcatttaacatttcatcatcaacatttatctcatctaaaacaaaacaaattcacacagtgtacggtgtggatgtactggagtttatttaacccgacccctcttaatcaatggctattatcccccaccccagttttttttgttattatagtaaataatgctgaaatatttttaaaagattttttaaagtttatttttaattgacaaatcataattgtatatattcatgggatacaatgtgatgttttgatatatgtatacattggtggaacaattactttaagctaattaagatatccatcaccaacacatctatttttttgtggtgagattatttaaaatctactatttaaggaattttgacatataaaatgcattaactacagtcaccgtgccatgtggatcactaaaacatattcctcttgtctaactgaatccttgtaccctttgactaacatcttccccctcctgcccttcccccggcctcaagtagccaccgttctactctccgtttctatgagttcaactattttcagattccacatacaggagagaccaggtggtatttgtttctgtgcctggcttacttttcttagtacaatgacctccacgttcatccatgttgtcgccaatggcaggatttccttttattcaaaggcgggacagtaccccgtggtgtacatacaccacattttctttatccgttcagccactagtagatgcttccatatcttggctaggttgcttccgtatcttggctactgtgaatgaaatcaatattcttatcttatgcataagcgatccccacactcatttgttatcttttgactttgcttgtgtattttgttcaaactttatgttgtcaagccgatcaatcatttccttgatggcttctgggtttatttaatgctttagaaaggcttccccattccgaaaagacagaataaaagcgattcacccatgttctccctttcacggtttcaacttcactgtctctcccgccgccagagcccagcaaaactttctaatccgcgaggagcccgggaccccgctgcgctgggaagccgaggcagggcgccggcctgcgggggtcttcggaaacgttcccggttcccgcggaagatcgcccggcccggagccgcgtgggctgtctgtcctcgcaggtagcagtcactcggagcagaacggtagttaggaaaaattttcaagtctccttcggctgcggggtcgcgccattccaggcggtgccaactgggagctccttcacccgccccaggccgagaaacgcgatcccagttggtcagggactaggagaggcctcgcccgccggagatgcggatccgatccgcggccgctggcgccggctgtcgggcgccacctggctgcactgttaaggttttctctccggcgctctggcgaagccggcaagaaaggggatttggccacagggcgcggtgcagagttccaggggactggcagcgctggcaggatgagcccggctttgctgggtgtactcttcgtcctttcgtcggagattaaacctgagggtcagcgttgtaggcgcgctcttgagctcggagtgctgtggcctgagcgggtcaattagtacacgcgggaatcgctgggccttccgagagtgtgaacgggggatggggtatcccgcccggacgctgactggcgtggggcccggtcctcaggccttccattacacccattatctccaagccccgacccggaggtgaggaccggcccggctgttccaggaggactgcgaagggtagcatgggcccgtccgtggccacgcgtgggtcatggtcatccgacttgagcttcacacctttttctgagtcttgttttggaggtggagactggcttgggcagtacgagaaaaacggggaaggcgcagtggatttagccgtggcccgcataatgggatcttgtggttggactttggggccccaccctccccaccggggaagagcgtacagcctctggctccgagatagaggggcgaccagatgtcccatggatgatctttgttagagttgctgggtcgatcagcctcatttctgcagttttgatgtggcctcagaaagctgatcagatcgaccagcagcccaaccaagcagatgggcaactagaatttgggagaggagaaggggaaaaggcgaggagagaagggcgtcgggggaggcctgtggggaggtaagggtagggggatgggggaacctgagatttatatagcaatagtaattgttataagcaagtattataaacaaataataatttatttacatttaaaaactatgtcaatataaataatatacatttatagaattataagtataaattatactttataaataataaatctacataaatagtgattagacataaacagttatacttctgaagaggacgcaggaggggctttctgtctgcagaaatttctaaatgcccctggggaggctgaggtaggtcgaccctggtgaattttgaagtccactctgggtggggagctggcccgggaggcgctggggagtctgtcccctgctcggcagctcacggttccactcacgcctgccagggagccccgaggtgggaatgcgacccgaggtggaccctgacgaggcctggcgtcctacccgcccgcccgcgatccggatccgtccggctggctttcacgctggttgtctagcgacacctggcggtcacctttatatatagcaagctctaccagcgggggcgacgtgggattgggtggccggatggttaaaggggatattaggttatggtggggggtgggggggcgtcctgaggtttatagtagtagtagtaataatattctttttattatgtaatttataaatataaattgtcataaatacacaaataatatatacttatgtagatactataaatgtcatagtacaaatatgcgtaatatatagattatatattttagtaaatatttatgtataaatattaaatcagtaattataattatttggtccttgctgggattcatcattattgtaattattaccattattataaatagtaattgtagtagtagtagtaatagtagcagcttttttttttttttttaaatagcaacactgaataaactgtctctgtcaaagaaaggtgatcaagtgactggagataataaagaagggtttcagtccgtgggatttaaaaaatccacccaagagcctggtgacgctctgacccacagtctgtgaagcagccagctggaaactgcatacagcaaccctaatggtcaggactgcactgacggcttccctcctttttgcccttgcttccaacttaggaccaacagggagaaccaaataggcatcctcttaccagtcaggtaggatcccctgactggatacaggagatggaaataaattgtttaggcagatagggcaaaagagtccttggcagaactctaacaaaaaacatcccaagaaatcatttctttctaacaaagagcagcctgaaagatggagctgcaaacatagatgaggaagctggaagcttgcaggggggtgggggaggcctgcagctgcactgataaaagggactacctggcgccaggcatgtccaccatggggggttcaccttccctaattattttttgttgttgttaacacatgcacagtaagaaagaaataagcaacatggagtagctacccacgtgcgtaataaaagattggtgtgggggcgtccagagattcgtgccctatgcagatggcacacctggtcctgttttttcgcacccgatgtagatcagacactgctccccactagctcatctataaaaatctttgcattccactgtgcatcagcgacctatttttccgggacccctctctgtagcagagagctattctctttctttcacgtattaaatttccactcttaacctcaccctttgtgtgtcctcgcccttgatctctgtggctgtgagacaatgaaccttgggtgtcaccccagacaatgaggccacttcactagcagccgcctctggtggctggcaaccccatcaggactcctcttccccttttccaccgcagatttcccattcctctccctgcctttgagtctctgccaaacattattgagctgcatgaaagaaccttaaatgcatattactaactgaaagaaactgatctgaaaaggctgcatactgtaagattccaactctgtcacattctggaaaaggcacaaccatggagacagtaagaagagcagtggttggcaggggttgggggagagagggatgaacaggcagagcacaggggatttgccggactgtgaaactactctgtatgatatgacagtggtggatatggcattagacatctgttcaaacccacagaatgtactgaggactaaactgacattttttctctcttgcccaaattcctatctaaggggcctggggagtcataccctagaaactgacatctcaacagatgggctttatttaaccctatatataacacagctttctttcccacctgactctcgtataacatcatatgacagataaagaaggaaataaaaatattttaccccaaaataggattttttttgtgtattttgaaatggccctgcaaagctgtctcttgtggggaaaatttgcatccgtaaagaatctctattaccataactagctcttttcccttccaggccctcccaatcctctagagattagctgaaagtctagcaccttttaaaagtctgaataggaaatattggccatctattgtctctaagggcgacctccatgagacttcatctacatggtaagaaccttggtctccacaaccccttatcttgacccagatactcctttgtattgattgcaggtttttagataataactgtttcaatcaattgccaatcagaaaatctttgaatccacctatgacctggaagccttcctcccaccgacccccttcgagctgtcccacctttctggactgaagcaatgtacatctcacatgtactgattaatgactcatgtctccttaaagcgtataaaaccaaactgtaaaacaactgctttgggcacatgttctcagggcctcttgagactgactgtaccttgggtcactcacatttggctcagaataaatctcttcaaatattttacagagtttggctcttttcactgacaatacaacaccaagagtgaccctaatgtgaaccacagactttgggtgataatgatgtgttggtgtgggtttagcagtagtaacaaatgcgccctgctgatgtgggacatggacagtagggcaggctgtgcatgtgtgtgtgtgtatgtgtgtgtgtgtgtgtgcgcacgtgagcacatgcgggccggtgaggggtgtatatgagagctctctgcacgctcagctcaattttgctgtgtaagtatagaaaaaatctttcctccacccatctaaggtttattgccttggccccacaaatttagaccaatgaaagccaggttaacaagagaaaacaacgcatttattaattcatgcatcgcaaatacacatgggagagctcagtgataagtaataactcaaaaaggtggttagaacttgggcttattagcatcttaatgagagagcaatgtatttgtagagaagtggaaagacaaaggaaggggaccttgagcttctttggataacaagttgtgggaaggtagatctatgggggaagctgacagataaggttgatttggtgtgcttgtgatgttgatttttctggtgctacctctgggctggtaagagccatcctgcccttctggtagatggggacagggcagagagtttgtcctgtgtctacttggtctcagttgtcttcagctcaaaataatctttgtatcagagtggcatattttgggatggcatactctaagccccttcagctgtgaattcaaaacaactctaaaaagtcaattaaaaattgtattcctataacatggcccttgctggtggggctcaggacacaccaccccaaaatatgacagtacaaaaccagatatgtgaacacaaaatatacttcttaggcaaattttgatcttgttattctaagaaattgcagacacaggagtagctctgaaaaactgcccttttgtaaaagaaatttataactataaaagaaatctacattagtgaagtatctgtatcaggaagagggctggttccagacaacttctatcaccccagagacttttctctgcagaacaagacaccttttattcaccagacattgcctcccctcaccctcccagaacttgtgcccatcctcagcaagccccaagcccctgttcctttctgtaactcaggacactatctaagcttcattcatctggcccttctcctagtctatagtttgggggactcctgtgcatatagatgtaattaaagtggtgtttctcctattagcttttcttatgtcaatttaattcctagcccagccaaagaacctagaaggggaaggggaaggggaagccatttttccctccacgacctgcttttcaagatcccagtttgttggaaccacttcagagttaaccctctgtaaatacttgtcagtcctcatcttttcagtgttttcacctgacattcactctttattgcactcttacgtctcccaacaggttgctcaagaaactctcccttgctgtggacactgctgacttctgtaaaatacatttacaggaggccattagtttggactgagcttctgcactaggcccaacagactgagacggagcatggacccctattagaggcctgctgggcctcctccagcatggaaacaaaggaaaatcttgatttccttcaagggaaattccaggtacctagctggccttgagaagtaaatgagccacctgataagcaagaagggaataatagcttcaagtaacaggcactcaagtaagtcagagccacaaggtgtttggtcccctattgaaactaaagattacatcttagcatatgtccatgaatggtttttcagaaacccggacccacgtcagatggaaaatactgaccatcatcacagagacctcagatgtcggggagctgagggctgcactctgacggctgctctttgttgtaaatttctttctcaggggcctggagagagtcatgcccacaggccagaccttaacattcctttctgctgaccccaagttttcgacaaagcctggcttccttaaccaattgcaatcaaagaatcctgaagccgcctatgacctgtaagccccttgcttcaagagcttccgcctttttgggccaaaccaatgtataccctctgcattgatttatggtttccctgtaacttctgctttcctgaattgttcccctgcctttaaaatcccttgcttgtaagccatccaggaggttgggtctgaagtgtaagctgccccattctccttgcttggtgtcctgcaagttaacaccctcctttctcctgctgcaaacctccgtgtgggtgtttggttttaccacacggggcaagcagacccaggttcagttcagtaacaagaccggactggaatggagttccttgcgctaaagttccacttttccaaaccaaaactaagttgtttatctgaccttctgagaagtcaggacacagagagataaaaggcaaatctccaacaggccaggtttagccagagtgataagcagtccttcccctctgctttaatgtttacaaggaaagtaactttgcaaccaatctatgctttgttctttgcttccacttcagccttttctatccataaagcccatctcccccactctgcttggaggaacgctcagtctgttttatggaatgaagtgttgcctgattctagaatagcaaataaagccaattaggatctttaaactaaatctgttgtacttttgtcttttgacagttccatgatggaaaatctaatggccactttccatttaccacatcccaggagcagtccaggtaagtggctccttttgtttctggggtccatctcgctcctggctcttgacgccgatgcttctccttctcctcctgcatttcttgtgctcctccccaaggtttgccagcgcgctcacaacccttgcttgggatttaaaatctgaagtgcgtcataactcacccctggactctgttattcttttattggtatgccagaaaaaaagaaccccaagctctctgggtgaccaaattgatatttaaagcattaattattaactctattcttacaacctccagattttatctccactcagaattatatgtacagctgcctagctgatttccagactgaaatgcctctttgacattacagattaaaactgatcccactctattgtccaggtcatcttccttgacttggctgtgacccagacttactgtctaaataaatggtgtgacggctcacctagggaccccaatccagactctaggagagtttcttcagcctgtatccccccatgtcatgaataatccattaccgagtcctgttcgttcttcctatacatctctccaaaggcttccctccatttccacaatgaccccaactgtttcaccactcgctcctcaaagaacctctggatttgtttctagcttttggctatgaggaataagcctgctgagaacattcagctccaggattttgtgtgaatgtaagtgctttagtggtggggcgggaccctgcaggccatccctgggttggatgattctctagagggacccagagaactccaccaagctgacctaaggccctgaaagtcaaacagataccgcatggcccaatgcctgcaccatagctcacttgttggaataaactgcctaagaaaaatgggggtacgtggttacattatcagaggcatcccaggtggatcctggagacatggacagtacccgtagtcacgaagctgacagctggaagaagcccatctggttcaacccctgtctggcatattccttccttctccatcctcactttctacccctcacagggacagagaatttatagcttaccgagccaggccattgcacttttggacaactctactaaatggattttcctcatgccattgcataactgctacctgccaccagagcctcagaaatacatggttttccatcaagcactcatggaacatgtaactgtgggcgcttctagggcggttcatgatggatcctccaagatcaactaaatataaaacaagctcccaggtaacagaaccatttcagctgttaaataaaatcatctgtattaacctagtttaattatgagggacatctctcccaacataatatatatatatataataaatatatacatatataatatataataaataaatatatataataaatatattatatatatatatatatatattttttttttttgagacagggtctcactctgtcacccaggctggagtgcagtggtgccatcacagctcactgcagcctcaacctcctgggctcaagcaatcctcccacctcagcttcctgagtagctgggactatagatgaatgccattatgcccggctaattttttaaaaactttttgtagaggcagggtttcgccatgtttcccaggctggtctccaacactagggctcaagcaatttgcctgccttggcctcccaaagtattgaaattacagcatgagccactgtgcctccaacatactcataatttttttaaaagaatagttggtatttgggggctgggtacagtggctcacacctgtaatcccagcactttgggaggcagaggcaggtggatcacttcaggtcagggtagttcgagaccagcctgggcaacatggtgaaacccatctctactaaaagtacaaaaattagccaggcgtggcacacacctgtagtcccagctacttgggaggctgaggcgagtggattgcttgaacccgggagtcagaagttgcagtgagtggagatcgtgccactgcactccagcctgggtgacagagcaagactccataaaaaataaatagttggtatttgagcctttctttctgaaaatgattgataatggccccattcatctgttgaggttttatatgaaaacaaaaccttataccgttgtgtggagaaaggtgctgactgtcctctttgtggtggggtgaatatggcttcagcacacccagcagctgttttgggttctcaagaagggaggcccaaagtagtccaatcgtaatagggtctctcagaaacccagcccagctactcccctccctcaagggagtttgtgaccttgctactcacagcgtggtccatgcatcagcagcactggggtcacctgaagtttgtgtgaaatgtggcattccaggcctgctgcaccacgtgcatcaaagcacacacgttcttcctattgctgagagggaggagggacggcagcacaggagcaaagccatcactgtgattgcggttagggacagtgccagagcacccagccccgagccccaccaccaccaccccttgtccttaattacagaattcacttgaaattaaaaatccccgctccctaaatacccaccctctcctctggctttctttttagctgaggcagctgctctcgcctcttctttcactcgctcctggcagcacagcaatctctgcaagttacttggaccctcaggactccttgttcaagtgcaatggaggaccatgcagatggcagggaaaaccaaagaaagctcaggtggcccatcatggctgtcatcggtggaagaacgtctctatttaacactgaaccttagtaatgacatgctctccccttgtcctggaccttcattttgaaatagagcattcgggtgggaggggaaccacgggggcatttcaatcctgaacctgctctgggcggtggctctagcctttgggattttgtgctcatttacagttttttgagatggaatcttgctctgtctcccaggctggagtgcagtggtataatcttggctcagtgcaacctccatctcctgggttcaagcaattctcctgcctcagcttcctgagtagctgggattacaggttcacgccaccatgcccagctaatttttgtatttttagtagagatggggtttcaccatgttggccgggctggtctcaaactcttgacctcaagtgatccacctgtctcggcctcccgaagtgttgggattacaggcgtgagccaccacgcctggtctgtcctcatttacttaaagagccattactcacccccaattccccatagatagtggccaacttctttgaaatctggagacattttcaaatgctcaacccttttttcagcaattctatctgtttctaaaataagtgtcactcaggatggatatgcttttagagaaacactgtgacaaagaccctttgctccagaggaaggacctgcagtggccccaggctgtggctccagcatcacttgagacagtgtgaacatttggacacaattaaaatgaggacacttaatcaaagaacacacttacaaaggaaaggggcaggaaagccgggaggcagcaggtgtgggaccccacatgggacaggcagctgtgtgttgttggtaccaccttcctgccatggctttcctacaccagcagagagaaagcccatttctgctctctgctgcaagactctctggatggaaggcccagttccacaggaaagaaatcctggtggctgaggcgtgcctgtgcatagcctggatggctcggcctgtggccggcaggcacccagggcccctggtgggggtctcacccgcttgggatggcctcagctcccaggctgcagccaccactgccatttcaaaggtgagaaggaactgtctgtgtgggcctctcatcccgcaaagtgagggaggcgggagctgggtggtgcagggaattaggaaaggcaaacctgggacgtgctgtgccctgcagtgcagtttccagaggggagcagcccggggtggcagacgtttgcatttggatgttagaaatgctcttcctggctgggcatagtggctcatgcctgtaatcccagcactttgggaggccaaggcaggcagatcatgaggtcaggagagcgagacaatcctggctaacatggtgaaacgccatctctactaaaaataaaaaaaattagccagacgtggtggcgggcacctgtagtcccagctactcgggaggctgaggcaggagaatggcgtgaacccaggaggtggagcttgcagtgagctgagatcgcgccactgcactccagcctgggtgacagagcgagactccgtctcaaaaaaaaaaaaaagacaaatgctcttcctgacttttcagagctgactgaagcccccgtttcttggcctgtgtcttttccttgccttggggtccacattaaccaactatattcaatcaacaagcttaacactgagaatcaagagaagcccaggatctggggagcccgggacccccttcatcatccactgtgcttgggatggggctcctcttgttctcctgccccaaaggagctggcacaccaagcgatgcttccaattgtccactgcctttatgggaagggacagcggtctctccttggtgccagtgttagaaggaagaattgatgctcactcggtcctgctgtgtgtgggagtctcctctgcaccccaccctatcttgtcactcgtcaccactgggttgagcaataccagactttgtttccaggctttgtttcctggcccttgacaataaacagaacagtgtccctcagcctttcacaccacatagacccctcaggatgaggggctgctcaagcagctcccactgatgctgggccttgggaagagggggccagtggggagggccctcccctgagctgagaggtccctttataaaggcaagtccaagccccagagatttgggggtcagcaggggagagagcagggctgaaggcgtagagggggcaccctgcactttatacctggggcaatgcaacaacaaaggtgccaggtatgtggacacacacctagaggaagagtgctgtgcaccctcaaagcctggtctgaggatcagcaaaccagcccctctgggaaggttgttggaaaggccaactctcaagcccctccccacccctgatgcaccagaaccttcagtctgacctagccctgggtgactcccctgctcccgaggtctgggacgagctgcctgcagcactggctctcaatctgcctgattgtcagcaccatctggagagccagagaaattctgaaaagacagatctctgggcgcttccatccctgggattgtgactcagtaagtagggggtgaagcacaataattcatatctatgtttttaaagctcctccagcattctggatgcttagccagcctggggaccctctctctgctcttcgggtatcttacaggtaagaaagatgtcattgtaagcttttacccttggaaacacattcattccaaacatatcaaa

SEQ ID NO: 494 - DNA, 20001 bp, Homo sapiens
actgcacccagacaacaaccctagggtttttgcgatggtaattgagcattggcttcaacttaaagtcatcagctgcattggtccctaacaagagagtcagcctgtcttttgaagctttgaaaccaagcattgccttctcctctctagctgtgaaagtcctaggtagcatcttcttccaatagaaggctgttttatctacatcgaaagtctgggaaccaggcacagtggctcatgcctgtaatcccagcactttgggaggcctaggtgggcagatcacgaggtcaaaagatcaagaccatcctggccaacatggtgaaaccccacctctactaaaaatacaaaaattagctgggtgtagtggcgtgcacctgtagtcccagctactcgggaggctgaggcaggagaatcgcttgaacccaggaggcggaggttgcagtgagccgagatcatgccactgcaccactgcacttccgcctggcgacagagcgagacttcatctcaaaaaaaaaaaaagaaagaaaaagaaagtctgttgtttagtgtagccaccttcatcagtgatcttagctagatctgaataacttgctgcagcttctccattagcagttgctgcttcaccttgtacttttatgttttggagacagcttatttccttaaacttcatgaaccaaccgctggtaacttgtaacttttcttctgcagcttcctcgtttctctcagccttcatagaattgaagaggccttgccctggattaggctttggcttaagggaatgttgtggctgtttgatcttctatcactaaacctttctctatatcagcagcataaggctatttcagttttttatcattcgtgtgttcactggagtagtacttttaattttcttcaagaactcttatttgcattcacaacttagctaaccatttggcagaagaggcctagcttttggcctatctcagctttcaacatgcctttcttaatgagtttaataatttttagctttgatttaaagtgagagatgtgtgattgttcctttcacttgaacatttagaggttattgtaaggttattaactggcctgatttcaatagtgttttgtctcaggacacagggaggtcaaagagagggagagagatggagaaatggctggttgacggagcaatcagaacacacacaacattgattgattaagcttgtcatcttctatgggcatggttcatggaattccaaaacaattgcaatagtaacatcaaagaccactgatcacagatcatcataacagatagatacagtactaatgaaaaagtttgaaatattctgagaattaccggaagtgacagagacacaaagtgagcacatgctgttggaaaaatgaagccaataggcttgctcagtgcagtgttggcgctaacctttgatttgtgaaaactgcattatctgtgaagcacactaaaatgaagtgcaataaaacaaggtaagcctgcacaagttttgtacaaacataggttttcatttctcttgggtatccttaggaatggaattgctggttcctatgatcactctgtttaatcatttctgagcactttattttctggcacaagaggattcaggcttatcttgtactttccctgccttatccctgtaattagccattttgctaaggagccctggtttcttccagtggacaatggcacttagacattaagacttgggtgctgtcggagggtgcggtggctcacgcctataatcccagcactttgggaggctgaggcaggcagatcacctgaggttgggagttcgagaccagcccgaccaacatgctgaaaccccgtctctactaaacatacaaaattagccgggcgttgtggcacatgcctgtaatcccagctactcaggatgctgaggcaggagaatcgcttgaacccgggaggcagaggttgaagtgagccaaggtcatgccattgcactccaacctgggcagcaagaatgaaactccttctcaaaaaaaaaaaaaaaaaaaaaagacttgggtgctatcaaagcatgatgtaagctgatttaaaaaaaaaaaggcgctgggcgtggtggttcatgcctgtaatcccagcactttgggaggctgaagcgtgtggatcacgggtggatcaagagatagagaccatcctggccaacagggtgaaaccccgtatctactaaaaatataaaaattagccgggcttggtggcagattcctgtaatcccagctactcgggaggctgaggcaggagaatcacttaaaccagggaggtggaggttgcagtgagccgagattgtgccaccacactccagctggtgacaaagtgagactccatctcaaaaaaaaaaaaaaaaggcttgggtgctaactacactcattattattaatatgtcatggctcccaggccctctcaatggataaagccagaaaatatctgtatgtatacacataagtatacacacattgacacatgcacacacaacataaacacatacatacatgcatttgcatcaatatttatttctacacctggctattttgtttattcttgtttcgtagagatgggatctcactatgttacccaagatggtctcaaatgcctggtctcaagtgatcctcccacctcggtctcccaaagtgttgggattataggcatgagccactgcacccagcctctacatctctccatgtattttggaaataatgagttcttcccattacctccaattccaatccaggtgtataggattacaggtgagaacatcagagagttcattcttgtttcctcctcctcttctcttctcttctcttctcttctcttttctttcgagatagggtctcactctgtcactcaggctggaatgcagtggcctgatcatgcctcacctcagctttgacctcttgggctcaagcgatcctcccacctcagccttctgagtagctgagactacaggaacgtacccctgcgtccagcaaattttttgtattgtttgtagagacaaggtctcaccacattgcccaggctggtcttgaactcttaggctcaaatgatctgcccatcttggcctcccagagtgttgggattacaggcataggcccctgcacccaggcttcttttccatattataattctctttgccaacagtgagaaacctagctcactttttctcactgggtcagttctactgaatataactgttctgcagtgggcaggtccaggcaaacctatccccaaaggtaatgaagctattcccaaaagtgaggaagctgagaggctaaagaaagaggctgacaaacccagtttctcagaaagaaacatttaacaaggaattaaaacgagaagtcacgtctgacatcagcaagcaaaatggcggatccccacactgttgccccccaaccccagggcttgtataccacagggcggcaatgttaggacagttgaaatcggccccctggggaaaggcaagaatgctatgtgcagatgcctaagggcaagatttagctaacagtagttaaagtagatatcttagacgcatccctggaactggggttactcagaagtcaacatggcagattagtatccaagatggatttgctttagcctccacggcaaccgatatcccatgccctccaccccacccagaccctcctcagcgatcctgggctctgacaccctgccctgggccagcctacaacatggatgcctctttgtccctcagactccagcatgccacgtctttacccacacggaagcaaccctcagccttcgtgggctctgacactctgcctggggccaccctaccctcacctccccacatggacgtgctcctccactcaggctctgaggttgcacatcgagctccccctggatgccctgcccactcctgcaggaatgcccttctcatcccccttgaactccccttcttggggcttggccactaccctggccagatgccctcttcacctttctcatgactcactctcccttgctgagctgggacccaagtggacatcctccctaccttgcttgggttttaacatcccacactgggctgccctcccacttggatgtcctcctctgtccctctttctcctgctctggccacccccaacatcggcaacaccctcctcacttaacttgagctccagaaccatttgctgagccactgcatctcccatccaccctacccctggggacccctgcttactccaccctccccaatatcttctggactgaattgtttttgttttgttgtgtttaatgtcaaccagaagactgaattgtttttgaagggaaggaaaggaaaagaaacggaagaagaaaaaggaggaggaggggaagaagaggaggagaaagaagaaggaaaaggaagaagaaatagagaagaaaacggaggagaggaggaagaaggtggggaagaaagaggaggaggaagaggaagagagctgcctggccaaattttgtggaatgttggatgttgcgggtgacagactgtagaggctgtggctgatgtcatcttctttcagggagaatttgattgcctcctggtagccagatagcatacagggaagtcatcttgatgcagtgaagctggtctaggtccagtttgcccttattcctgggtgtggctctttccagggtctcacctgtaagccacattgatggaagtagagaccgtgcttgcaaaaaaaattgaggctggggtggggaggagagagcccagaggtgatctgggggctcaggagcgcaggatggtggggggacactagtgtgtatttgtcggtggatgggaaggaagttcatcaagtgggaggtggaggcagcccagggagaacagggactgtgggtggcagagcaggagggtagggccctctgagcctgggggacagcaggggttgcaggtgggggtggggggaagccagcaagcttgcttgttgggggtataggattgtggtagggtcctgcctacctccctgtggagaagctggagaggggcagggcagccccggtggtgtgggcagatggagaagggatgggatgcagtgagggactggggctcaggtggaggagggggccaaatgtggggaagaggctcagtgaagggagggaccctccgcggggaaagagttcagtgagaagagcgggaggcgtcatggaggccccatctctttatctagctggggccatctgagagcagtgactgtacccccatccaactctgtccctcccccgcaacatggaggccccagcccaagacttgcagtggggagtgggggggcagcctccagtgtttgttcttgtccaaggctggggtggggagcaataagccaaggccccagactttccgcctcatggtgggtgtgggccagggaggtcctgcacccactgcccgccctctaaccagggggctgagactttcgcccctgggtgctggtgcctaggaatggaggcagggaaagggctgggggctcactctcccctccctccatgcactgcaggggcaggcagtgggacaggcagtcgagctggatttgtttctcattcgctcttggctcctctggtggaaaaatcgaagcgctccccctggtactgctgaggcggagagggtgagcgtggctgggaggctgtcctggcagggaagtccaggggcaggcggggcctggccggggagaggctgccccctgctcacaacccccttcccagccctcttacttcgacgtggctctctaggcccagtgggaagtcctgcctcagctgaagtggaggggccgggccagggaggaggtcggactgggcttgggttcagcctcaggctcgtagcaccctccttccctgggcctgtctctagagcagtctcccaagggtgatttaaaatcccccgagggtcttccaaggaagtgctgtcaagctgcagcaggagggggccgagtcagacctgggacaggctttctcagcattcagactttgcctaagtgggaggtgagctgtgtactaggaggggagggttccacaggcaactgctggatatttcctgaacatccagggacatgagaagccttttctgtacatcatcccatgtggccctcacagacaccccaaggtcagtattagccatcccatttacaaaaatttttttaacacacacggttttgctctgttgcccaggctccagtgcagcggcgcagtcataactgaaggcaccctctaactcctaggctcaagcaatcctcctgcctcagcctcccaagtacctaagactacaggcacaagccaccacacctaactcatttattttttttgaggaagggcctcattatgttgtccaggctagtttcaaattcctggcctcaagtgatccacccacctcggcctcccaaagtgctgggattacaggggtgagccaccatgcctggccccatcccattttacaggtgagggacttgaggctccatgaagtcaggtgccccactcaaggggctacacagcctctacgtggcagggctgggatttgaacccagttgtgtctggctctttcccaaacactggaaaaggcaggcctttttcccctccaccccagggcccgggagcccctgagcagctcctgggtggggctgccccacagggagacagccttgggggaacccaggaggtctttgggctgtggcctgtctctgtggcacagtggggtgcctcgggagatctcccctccacctaccctcctcttgtggagttggacccacccccaccccattttttcagagggccctcaccccagccctctccatcccggtggaaagaggagcccaacctctttccctctggaatccgctgcctcggctctccgatggagagaccatctggagtgcattatgggcagaggagaaagccgagagcaggaaaatgtgagttggccccagcagctcccgtctgcaggggggcggcgggggctcaggggatgggccaaccgctgcctccacctccccagtccctagaaggggcagataagagatgtgctcaggaaagggtggccaggagagggcagggcccaggcctccaacacccttgcagagcccagtttgaacctgctaatcttgccaacctgcccatttcacagagagaagactgaggtccagagaggggtagtaacttccccagggccacacagcaaccctttcacaaatatgcacatgccagtgggcactgaaagtctccagtgttgggggcaggcggagttagcgctgggagtgggaaagaggccggggtcagcctccagagtaaagtgaaggcgcaaagcctcatgcaaacatcgaggaatgccttcattgtttcgaggtctctcttcctggcctcccaagcccactccctgccccaagtgccacccttccctggcacctgatccctgaggacgttgggtcctggggtgggggcctctgggctcttcctctgggtcccaggagccccctccccactctgtggccccagctccagacttggcaaggcaagccggagtgaggtttctccactccctcccaagtgctgtgctggcggctcccgaaataaaaatcaaatgtgggcttggcaaagggagcggggtgggagaagcagcggcagcagggctggggcttcattctttccattgtaacttcacctcctaacctctggcattttaattatgtctcctacccccctcactctgcctgggccagggggtgagctcaccctttcctctagcctgggagggggcagctgctgcctggacccccagtccccggcctgctcgggggaatctgggtggcggccatgctgggggtgtcggcctcaggctccctccagcttctccagtctcagaggggcctggagaggggcccagcccccagacagccagccgacacctcaagttccatgtgtgaatcattagtcttcacacccactgctccatttagtggtggccactgtcctaaggcaaggcacggcaggctcaccagcccattctatggatgacttagccatcatcgtctgcagggccaagcctgggcccaggcctatcgctcctggttctgcactctttccaaacccaggaagaggggcaagaacagctcaggcctgataatttgccttatctcttcgagtgtccgtttttttccaatggtaagtgatggaaagcattattttgatactaaaacatacaaggacatagcatggggtaggaagtaaaatgcctgtgaaagttcaaggtagaaaacaaatcctcaaggaagatctcgtggggctctctgcaggcgggccccagggagtagcatcctcctccttggcatggctgtggactggagtgagatgcagtcatatgtgtttgtagccagtttgtgcagacccaaggctgctgtggaagatgccagtgggtgctgggtgctgggtgctggcaggcagccttggcccaccccaggatgcagaggccttcttccctccaaggcccacagtgggagtcctgccgactctctccgtctcctggggagggaaacctccacaggacaagcagcctgtgtgggggtgggggctgcctccacggacagtgcaggcacagggcaaccttgactgtgagcccagggccagcacccaaccaccccaactgaggcttcctctccatcctctgggaggtcccccgccacactgccttagaggcccagcccctcgaggaagccctcagttttcttctctcttgccctcccagtctccccaaatgcatgttccatcagcaaactctgccccaggccttgctacggcctctgctctggtggaacttccggatgaagagggtgaggcgctatttaccatactgggtgctgtgatgggggagattaaggtgacagcagctccgggaaggggactcctgacccaacctctggtgtgaagagcatagagaaggcttcccagagtgaggggtgaccaggaggagcccgggaggaagagcatggagggcagagggagcagcatttgcaaggcccagaggtaagacagtgcctagggcagggcccacgggagcatccggcctggagggagcggccagggtcctgggagctgcgcgagctgttagggtgcatcttaggaagatttctgggcaggctgtggaggatgggttggaaggtaatcagaacggaggtggagtgacctcttagaaggctgccacagaggcccaggtgagaggtgatggtagccaggcccaggccagtggcagccaggtggaaagaggtggccagactgataagagatttaaaaggcagaagccagaggacttggtgactgatgggcagaaggatgggggccagtgatctgctcaggctggctcctgggcttctgaagaatgaatgaacgaatgaatgaatgaatgaacaaacgaactgggaaacagcaccagatctgaaagccccaggtttcagcttgatcgtcgggctggggagtttgctgctgcacttgcatttggtacacctgcagggcatccaagtggaggtgcccatgagatggctggacgcatggaggtgccctggagaaggtggagagagaggaagccggcacagcctgcaaagaggccagagaatgagtagccagagcccctgaagcctcacaggaggaggtcttagacaaggcacagccaacagtgccaatggcaagagatgaagcaggtgaggcccaagaagggacatgtgttctagggacccagaggcttctccctgtcccccagcctttccttctgtctgtcccccagcccttgcccacccctctacgctccctcccccggtctttcccctatagtactctttctctcgatctcctcctcgtctctcagaccagaaggctcaacatctttctaagggaaacttcgtgctactcccaccccactggggtcctggttgccctccctagcttctgaaatcaccccccacacccccaacaaccaccacatacacctttcaccagagactcacccagcgcttccagaagctggggcaaagaggagcacacacgaccacctgcctactgagcagctcacacttcctccaatggagccaccacaaggtaccggcctccagggcaactgcaggcaatcctggccctcagggccttatggcataaaagggagagaagccatgaccccagcaggcctatgcagacacagtgagagaagaggcccagagaaaaagctatggacgtttagatccagtggagggatctgagtgggcttcctggaggtgactctgcgtagggccttgaaggactggcaggatttagtcatgtggcaatgggagcaaaggcagttgcaggaagagggagtgcggtgaggaaaggggtggaggtgggaactggggctgacaccagggcagccagtgctcatagtggctggtggctgaagagtgtggccagaggggtgggaggcggcaaggtggagggccacatcacacaggctggaatgcggaaggactttagagtttatccactgctgcctcttgacgtggggctttcagatctggtgctgtttcccagttcattcattcattcattcattcaggaaatattgcttgcttggtgctagacaagtgccgaagatgctgtgagaggcagatagaagtccctgctgtcacggatcttaagttccaggaagagacacagatatagagtcgtgaacaagtaaagactaaaaattaaaatcatgatgggggatgccatcatgactggccactctgaaggccgggcttgtgtcctgtctcccctcagactgagggctccctgagggcagagcctgtgcctgctccatcagacaaaggtagaaccagcttctccatcaggctagaagcaccctgagactcagggagaggcatggagcatctgggaacaagagctgaggtgtcctagaaacctcccaggaacagacccagggatagaagttggcaggcaactggcaaaggaccctcttcccagccaggccaaatgtgggagggcttccctctcctcctccccatccagcccccgaccccattaaacctttaaattaacttcagctccaccccgagctatagagagtgccccaaaataaatcctaaattacatgctgcttgggggcaaccacagttctccttcctccctctccagcaagcagacccgcccgacaccgtgctgagggggctcccccaaaatgggctatttatacagctcctgctcccctgtttgctctctggccctgttgtccttgagtgaggcccaagcaggctatacagctgtcttgggagggtgaagggagtgggagaggctgtgagccttgccagggtctgactggccatgggggatgtaatttttagtccaaactaggatactttggagtgctcgtagcagttacacccaggcaatgacataggtctgaactgtcctgggcacacggggtatctggtcacccagcgatggggctcagactccagcctctcagccacccagagcattgccttcttggggatgagagagacagagagagagagagagaagagagagagagattgccttcatccccgttgctgagacaagcagttctgaatatgggggcactggggctcccataccacctggcaaagcagaatgggctctggcttcaaggactcccaggcacagagaggtcctgcaggagggtctgggcaaagaagtggggagccggatgtggctgttttgagaccacaggcttgggtcaggggcctccctctccctggacaaagccaccttccattctgggaagctggccccagatactggagctgctccccttagggaaaagagagagggggagggagaggagaaaagggagaagagagtggaagatagagaaagacaggcacacacaaagaagcggcagagtgaaggacagagacagaaacagaggtgggcaatgacagagggagggagagtggggaaggggtgcttccagagccccaggatggcagcacccccttcctacccacagggcccgctgtggtagccctgtgggctccgcaccgcaccgctctctctgttctccaccccaccgcagtgaagtgggggcagggcctctgctggctgcccaggaggacacccgccgctcctccactgcctccctcctcaagactagcagtgggtggctgggcccagatgcctgctccccggctgctggcgggctcaggtgtctgcagagcgtcctcctgctccctgccatccttgcacgcccctctatttcaggcagcctggcccctgctcagtgccctctctggaagcctgctccttggccagcagacctggctcccccaggtccagcctctacctgcccgctcctcccgtccccttgagggggctttgcttcaaaggggtggagctagggctcctcctccctgtgaggttgcgctgggggtaggagcctggaggggagtcagaggcagggctgaggaaccagaggctcctctcactctgagtcagtcacagggaggggagggtggagggggcggcaaggaggtggaccgagaaagagccggccacagagatgtccagggaatggggcagggctgggtggcagcatcacagtgtctggagggccaggtacacatccaagtgcacaccgtcatgcagcgatttagagacgggccccaacctctgcaggcttcagccttggattgtgaacagaggggacacacagcacaggaccagctgaccagatcccagccaccgcttgtttgcactcacaagtaaattgatgccgacaacctggagcggagggctggtggtgtgtgagtgtgagtatgtgtgtgtgtgttgggagaataacagaggattcaaccagtgtcacccaaaaggggcaaggaccccgcagcactgggaaagggtcacaaaagccttcctcgccttagaggagtcaacatgctgtcttcccaatccaacttgattatctgtctgctcagcagcccccatgatccccacctcccaagaaaacactgtttatggggcctggggcatcaggcctgtcatttagctggaggaggcaacccaagccacaactgggagctgagccctgtgtggagaggcaatgcccagcctgaggcaggcaccagcccagacacttagtgccctgtttaccctggcaagggtggctggcacaggtgggcctctccagggagcagctggtggccctgccagcagactcccctgcaggccagagaggaggccaggacagcagctctccaggatggggagggaggcaccttgcccgccgcacaccctgcactgcagtttgcagggtgccagcctctgaagctcaggggtctcccagctgccctgcaagggagaccatatggcccagggcccagcaggagaaaccacagctccaggatgctggacactggtccccaaggccccccaggggaggctgaaggaagccccaggtctttggggtcctggtctgataggcccagatgccactcaactccccaggtttgtgggacccaccttctgcatccaaaggcacatgtaacttggcataaacaaacaccctttccccatcacagcccatcactacacagtcgctgtacccacagtccttctctatcacacagatggtatagaacatgctcctgcactctgccacacccaacatacacatcatccagcacccagctcacaaacgcagcatacacacaccagacacacaatgctcacccaacacagctccttctccacccgcataacctccactccagcagcaaggtcacatttgcttgcatgcgtgcacacacgcacacgtgcgcacacacacacacagtcctctgaaccaatacactctcctcccagtgccacacttgaaagtgggcccaagtaggggccaccattttagtcctgggcttctccctgcccctcccactctccgtcctccctgccactctcggtcctcctcccacttcctctgcccgccttccactttctccctttctctctctcctagctgagcccctggccctgaggtctctttcccagcacatggtgggacacttgagggccacacatatgggcagctcccagcagctattaaataccacttcgcccacctctggggttttgaggggctgcaaattccggaggacaggaggcagcagctggcagctgctcagggcctcagatccccctgctcaccattcccccatgcaccgcccacccctcctcattccgggctgagtcatccccacatctggaacctctgcacatctggaagagctgaagcctgtgcaagcagctccacgtagacaccccctcccccctgctccatctcatccccatccctgctggcagttggggtccagcatcccccacctggagcaggacctcggttacctagcagcaggcactgctgggccagccttggggaccaggattgcccacaggtctctccccagtagcagtaacagtggcgtcttggtgcccaccgcagtaagcaggcagggcagtgctagccttggaggaggccaggcccaaggctgggggaggcaggagagccaggcagggaggaggtagtggtttggcccagcaggcagagggagtttatcctggcactgggccctgaagccaaacatcctccacgaacctcgcagacacatcaaagcccgcagggaaggggcccttccgtagaggaaacctacagtcctggaggcctgacaacctgactccgggcacaggaccaccctgtcccactcagcaacccaggctcaggtcgggcacagctgcctggagtggacaggcagaaaaggacatttctacccaggggccctgccgcctcaccccactcgttcagtgctgccacagaatgaggttttgcccccatgagggggcagagttggcaccagatttagctttagcccctagtacaggggtccctcccaaactgcccccctcccaccctccaggcagggaaggctgatggggaggggctcactttgtctgtgcgccaccctttcagccccagcctggaagagaagtcgtgctcagttgtggggggatccagcttcctcccccaggctctgatgttctgcagaagacccctccacatggacaagagggaaatggagagggcaggggggttaggggttgggagaaaaaccaagcttcaaaaagtagaagctgaagtggaatcagaaggcgagaactgggctgcaagccacagggcctctctctggggggacagctggggccggaggaggaagaggggttgtgaggcgctaacaagggagagaggaggtgctaacagggccactggggtgcggggatcctgaagccagccccctaaaggttggcccggagataaggaagccaggcactggcggtggggtaaggggtgtgagtgggagctgccaatcaacacaggaggctgggatgctctgcatacacacatgtgcacgtaatgtacatacatgtgcacatgcagctcccacacaaccaaagccaagtctgtcctcagctgggaaccagatgatgtggctgcttagaggcactatgatttgaggaagaatgtgatctctgccagcctgaatccctcacccactgctcacactcattctctgcctttacagcttcaggctgggcctgcgccccactctagtctaagccccagaccatggaagggctccccttcccatggttgtcctgaatccgcagttcctttggatctgaaaagttcttttaggtctaactacaaccccagtaacatttgggtcagaaacaaaggaatccacaagcagggtgcagcagaaccctcttttcaggagccaacaagaacagagctagaaatcgaggataccaaattcctttcttccgtctggctacaggatccggtctcagacagtagactgaaggagggggccccagaggaaggaggccaggcatgggggctctcaagaccctcacgctagtcttagctcagtctctcctgcccaagccttcatggctctgctccatctgccactccagaaaccaaagctcatcagctcaaccttcccctaaccctccccacctgacacccatccaggctctttgaggtgttttcctttccaccctggcctgtgccccagaaacctacactttagaaggataatggctcccaaatggcgtttttgtctctgctaagcctccaggaaagtgagcatcagtgagtccctccaacctgctcattgggataataagtgccctgcactgttaattctcaggtggtttgccctccctccaccctcccggcccacagattcatggttcaaacttggagctgactctagaagtgatctcctccacccccatgcccatcaccccaagaatgagaaaggggctggtgggcttcaatttccaaaaaaagttggaaaggggactgaggtccccatcccatggccaagaagtcctattcttggactctgcctcctccaggaaggcggaccgtaagccaagcattccttgctacacccccttaggagtcgctcaatccctacggagccatcttcctcacttgctgagggggagtcacaaatttgagcataccctttggagggggtgcaggaagcagaagacgtggattccccaaaccacacagccagtgtggtggggagcccagtcagtctgaactcctcccaccccaaccacgagtccttcaccaaggactttggaaatgaattccctacccccttagagaaatctggcccctgacccaggaaggcccctaaccagcttggattcaacgacaacagagccagtgtttacttggaacaaagcaccagggggaaatgcatgctgaatcagagctggccagcccctgcagcagggtgggagcattaggacatgtccacacgtcttcaagggaaaatggctaagggctgtcagagaggcccagggaagaggcctgggtaggggcgagcagggagcagacaatcacttgttgaaggaagatccaagtccaggtaggctttctggaggaggtggcatttgggctgagctttaaaggatggggaagaatgtgttcggtttctgggagggatttggggaagaaactaggtggaaaaaactgcctggacagaggcaaggagagaagcagaaagagtaagaggaggggctggagaacatggtggggggtgggggtcaggtggggactggttatgggggaccctgaaggtctctctgagatgggactttattcaggtggcagcagggagcctccgattagggaacaagagagcgacatgcccaacatggcctgtccctccttggcaatgaggtgaccaagctagaggccttgttgaatatggctacgagagtcctgaggagccaggctgcacggggtgccgatggcagtggggataaagggagaggacacctgtgacaggcacagcctccagtctccatgagctctcagcccatgtggagaggcgggcctcctctgtgaagtagacccaggcagcgctcagtgggctgtgcgggagtagaaagggggaacaaactgggagtggagggaatcacatctccagtcccagaccacgttcaggagtggtcggcacctggacggacatcctctgggatctgtcaccagccccaccttctcaggcctgactggccttaagtggggcccagtggacagcagaggggtttagtgagcaaagcttcctggggaaactggggttggatgctgcagcccatccagggaggtgagcagtccaaaagcagcgagaccctgcactccttggcaccccactctgcctccatgtgaaatgcagagaaggaagtatgggccccttgtctctgccaggaatgacagctagcatttatttgccattactgtatgccagactctgagcggcctgtttcatcctcatcatggcctatatgatgagggaggtactgttatccaactcctccctctccttcctgttgagagaggcccagagaagttccatttctcgtctaaggtcacacagcacaacatattcagtggcacactgactaacacgacacaatactgcccctacaggcagagccgggctagagcagagcattctgctggctttgaaaagagatcccagcctagtgccatcagccattacagatattagtgtccaccaaagtatgggggtgggggggactgccaagtaaaacagaattcaccctggctcttccccttcacccaagcctggccccctgggctgggctgagccaggctaggcgaggccacccaccctgagtgatcctccatccagagcagtggagcagggctccccaggcccgaggtgagtgccacctgtgctgggtgtggcgtcttgagcgctgcatggttctgatcctgactcagcccctcatgtcctgtgcgacctggccttcccgctctccaggccctggttgcctcctctgagaagggcgtaagtgggccggctggcctcggaggcccctccttccagctgggccccggcaggatgcacaatcagctcattctttagtgaatgcactgggggcccagcgagcgtttatgaagacatttcgaagtggctgctcttgggaaaccccagatggaatttggtgttgaatctagggggccgctgactacatgaggcctctgggtttctgtgctcgtgtatgcctgagcacctgcacacgctgccctcctggtgctaggtgacgtgccaaacagaagatgctggccttgtccaggaccctccttcctctagaacagcccttctctgctcagtctaggggggtccatggtgctcccacccccttctgacctcacccaccaaaaatccgagggccctggggccatgatgaatgctaacaggccctggtgttcttggcctggcctgggaccacccacttccaggctcctcatcttgtccccatctgcaggaaggaacgtagggcagtttggtgtcatggaactgggggcccagccgaggggctcaagagcccttcagactctgcctggtgagtcaagtgctaaggacctcacttcttcattggaagatgtggggtgggggtggagtttgttcctaggacattgtagcgatgtggatagcattgccagattttgttttgttttgtttttctttttagagcgagggtggtgctctgtcacccaggctggagtgtagtggtgtgatctcagctcactgcagccttgaactcctaggctcaagtgatcctcctacctcaacctccagagtaactgggactacaggtacatgccaccacaccggcttaattgcttttgttttctttgtttgcagagacagggtcttgctatgttgcccaggctggtctcaaactcctgggctcaagtgatcttcctacctcggcctctccaagtgctggggttataagcgtgagccactgtgcctggcctggttgccagttttaacaaagaaaaacacagaacatcccattaaatgtgaatttcagatagaaaagtaaattttagcataagtatgtctcaaatattgcatgggcccaggtgtagtagctcacgcctgtaatcccaacactttgggaggccaaggtgggcatatcacttgaggccaggagttggagaccagcctggccaacaaggtaaaaccctgtctctactaaaaatacaaaaaattagctggacatagtggcacatgcctgtaatcccagctacttgggaggctgaagcatgagaattgcttgaatctgggaggtggaggttgcagtgagctcacaccactccattccagtcttggttctcaaaaaatatatatatattgcatgggacataattatactaaaatgaaattattcatcgtttatctgaaatttggatttacctgggcctcctgtcttttgtccggcaaccctagatctgggtcaggttgatgccagagacccagagagcagctatgccagcctcctccccctcctcctgcccctcttcagggcactggtgcccgcctagt

SEQ ID NO: 495 - DNA, 20001 bp, Homo sapiens
gtgttctgttttgttttgtttattatttatttatttatttatctagagacagagtctcactctgtcacccaggctggagtatagtggtgtgatcttggctcaccacaacttctgcctcccgggtttaagcgattgttgtgtctcagcctccccagtagctgggattacagatgtgcaccaccacgtctgtcatgtttgtatttttagtagagatgggggtttcgcctagttggccaggctggtctcgaactcctggcctcaggtgatccacctgcctcggccaaaagatgctaggattataggcatgacctactgtgcccagccttgttttttaaattttacattaaggaaactgaaggtacaccgaggaaactgaggatgataaggtcatttgttgaagctcccaataccaataagaggcactttacacttgggcctatctgattccacagtgtaaacttcatgccaaatccactggtaagttctatccttctatcctaacagtcatattggttggctaagcgtttgtcttaagggtattcttcacacacaattgtaattagcctgattgtgcagttttccagccaaaatctagatgaatgattataaatgagagggatgctgctagaaatacattaaagagagacaaaagtgacaacatgccaggcgaatagtctagaaggagatagtaaaaactacacaaaaaaatgcataacttaaaaaaaacttaagaccgtatcactttgtaattaaaaaagcaataaagattagttataaaagttgagggtctgaggctgttttgtgtatgggtctacacttcaacaattcctgagcttgtaactagaataaagaatatcgtaatgatgattacaaaatccatggaaaatagattgaattttccatattaaagtgtgtgaagtgcatttcaaaaagatctgcatgagaaatggttaaaatgagaaatgtgttgactcaagacacaagctataggttacctgtgcaactgatccatctggaatattacattcatcagggctgctattgcctgaaaccaatttggactcggactgctgaaccttcctgatatggctgaatgtttgtgtgcctccaaaatgcatgtcaaggcccggtgaggtggctcatgcttgtaatcccagcactttgggaggctgaggcgggcggatcacctgaggtcaggtgtctgagaccagactggccaacatggtgaaaccccgtctctactaaaaatacaaaaattagtcggtcatggtggcgggtaccaataatcccagctgctcaggaggctgaggcaggagaagtacttgaaccccggaggtggaggttgcagtgagccaagactgcgccactgcgttccagcctgggtgacagaccaaggctctgtctcaaaaaaaaaaaaaaaaaggcataggtcaggcgcagttgttcacgcctgtaatcccagcactttaggaggctgaggcaggtggatcacctgaggtcaggagttctagaccagcctggccaacatggtgaaaccccatctctactaaaaatacaaaaaaattagctggcagttgcctgtaatcccagctactcgggtggctgaagcaggagaatcacttgaacctgggaggtagaagttgcagagagcagagatcgcgcctctgcactcaagcctgggtgacagagtgaggatctgtctcaaaaaaaaaaaaaaaaaaggcatgtcaaaacttaatccccaattcaacagtattaagaggcaggacctttatgaagtgatgaatgcccttataaaagggtttgaggaagaaagttcagccagtattagcctttctgccatgaaaggatgtagtaagaattcatgccttctgccacgtgaggattcagtgacaagactccatgttggaatcagagaccagccgtcaccagacactgaatctgcaggtgccttgatcttgaacttcccagcctccagaactgtgaaaaatgaattcctgctgtttataaatgaacctattcaaggtatttgtgttatagcagcaggaacagaccaagacacttctttttgtcccatctttattgtgtgtgtgtgttttttgttttgttttgtgatggagttttgctgtgtcgcccaggctggagtgcagtggcagtgatctcggctcactgcaacctccacctcccaggttcaagagattctcctgcctcagcctcctgagtagctagatctacaggcgtgtgccaccacacctagccactttttgtatttttagtagagatgggatttttgccatgctggccgggctggtctcgaactcctgacctcaggtggtctgccctcctcagcttcccaaagtgctgggattacaggcatgagccactgcacctggcctctcttttttattggtaaaaggacctcttgtttcatgcagccctagagcttgctctcctaaactcaaaggtgggaaacagagactgaggtcctgacttggatccaattacatggaaaaggtctgaagctcaggtttaactgaagactcctgaaataaaagataagaatcctggaggagctgacccatctttcatccttctgatacaataaaaaaggccccatgagactgctgtagaagagacttcaaatgccttctaagccattgtggctactgtgggattggtcacatattagagaagattttttttgtttgtttgcaacatttctaaccaggattttttttttctcactgagttataccaggctttgatagttagttacaaataaaaaatgagttagcctactattagagtcttgaatgtccaggagaaataagactaagactaagagttgtacagacaattctcttgaattggcaaaaaaaaaaaaaaaaaaaaaaaaaaaaaatcaggccagtagactttcatgagtgttctgccctaccagcatccttcagcacaagatgtacctgctccaccaatggcaagccatagctgctaacaagatcacggtaattcagagctcctgctgcttcttgcctgggtagtcaatgaagtctcaccaggggaagaaaagaatgttcctccctgaattgttcatcaggatggactcattactcgcttctttctgcttggactgaagcgacaggatagcaatttagggatggctgatctaaagcacatcaaggcacggtcgctgagcaggtgcggtggcaccaaattcaaggaaaccccataggtagttcccaccagcaatgtgggtttcagcctttataccagcaccatctgaacaagccccataaaaagtgcagattacaaagcagaagcattttccatgtgggctaacacatgaggtggttgaacaaaaaagcagtagaagagacagccatgcccagaggccagctcagttcttgatctggaagttactttctgccttttttcctgtctctgtttctactagaagcccgctttcttcaatctgctttattttttattttagagagaatgtctcactgtgtcacccaggctggagtataatggcacagccatagctcactgcaaccttaaactcctgggctcatgccaatcctcccatctcaacctctggagtggctgggactacaggtatgcaccatcacacctggctaaatttgtttttttttaagagatggggtgttcctatattacccaggctggacttgaattcttggcctcgagtgatcctgcctccttggcttcccaaagtgctgagattacaggtgtgagccacttcaccaggcccaatctgctctttttttttttttttttttgagatggagtctcactctgtctcccaggctggagtgcagtggcacaatcttggctcactgcaacctccacctcccaagctcaagcgattatcttgcctcagcctccagagtagctgtgattacaggcaaccactaccacacctggcaaatttttgtacttttagtagagatggggtttcaccatgttggccaggctggtctcaaactcctgacctcaggtgatccacccaccttggcctcccatagtgctgggattacagccatgagccaccgcacgaggcccaatctgcttattaatcttagtgtacagttcctactatgtgccaggcatcgtgctaagtgctttctataccttatcttatgtgattctcacaattcgctaagtcctattatttccccctttctcagattcagaaactgaggctctcagaggttaagtattttgcccagggtcatgcagttgttatggggtagagctaggatttagactcaggtattcggattccagaatcccctcacccttgccattaaaggtgtggtctctggaacagggacatcagcagcagaagcaagtatcatccatcacctcagagctggtaagaaatgcagtctccaggctcggcgcagtgactcacgcctgtaatctcagcactttgggaagccgaagcaggtggatcacgaggtcaggagatcgagaccatcctggctaacacggtgaaaccccatctctactaaaaatacaaaaaattagccaggtgtggtggcgggcacctgtagtcccagctactccagaggctgaggtaggagactcacttgaacctggaaggcagaggttgcagtgagccaagattgtgccactgcattccagcctgggtgacagagtgagactctgtctcaaaaaaaagaaaagaaatgcagtctccagtcccaccgccatgcccgacactgaaggaaaatctgcatgttctttttcttttttttttttaattttttgagacagagtcttgctgtgttgcgcaggctggagtgcaatggtgccatctctgctcactgcaacctctgcctcccgagttcaattgattctcttgcctcagcctcctgagtagctgtgattacaggtttgtgccatgacaccaggctattttttgtatttttagtagacagggtttcactgtgttggccaggctagtctcaaactcctgacctcaagcaatccacccacctcaccctcccaaaatgctgggagtacaggcacgagccaccgcatctggccaaaatctacattttaacaagatccccagatgagtcctgtgtcattaatctgatctagtgccatatgtctgctgcccactgatgtgcctctcctcttctcctcccaatccacctccacaccctggtaactaagtgctgggacaggtagggaccagggagtgctgggggcagggatggagaaggggcaggtgttcacctagagctcaaggctggtacacatgctgggtgggacccagaggggtgctgagtgggacccattacttccacagacacggaaacaatttttattactacttcccaagcctggcaatgtttcatgatgcaaatgggctggactgctcaccatttaatatttctcttcagtacttgaatcattaccaagacacagccacctaccactgacctctgttccccagaggatttggacagtcattagagcccattttagtgcagaccttgtccttttgataaatgagttgaaacttaaactccttggctgagaatgattatccagcccccgaatggaatagatctggtgttggggtgggggttggctagcatctcatccactggctactcaccctggagtacatctccaggtctccaagggcttttctgaaatatatccctgggtcctctccaatatcaataaattagactctgcagggtcgcccaggaatatacatttgttgttgttgttgttttgtttttcttgagatggaatctcgctctgtcacccaggctggagtgcagtggcgtgatctcggctcactgcaacctccgcctatcgggttcaagcgattctcctgtctcagcctcctgagtagctgggactacaggcatgcgctaccatgcccagctaatttttgtatttttagtagagacgggatttcaccatgttagccaggatggtctcgatctcttgacctcgtgatccgcctgcctcggcctcccaaagtgttgggattacaggcattagacactgagcccagccgaatatacgttttaaatgctttccagttgaaaacagttattttggctgggcatggtggctcatccctgtaatcccaggactttgggaagccaaggtgggtggatcacttgaggtcaggagttcgagaccagtctggccaacatgctgaaaccctgtctctactaaaaatacaaaacaaaaacattatccaggcatggtggcacacacctgtaatcccagctgctagggaggctgaggcaagagaatcgcttgaacccaggaggcagaggttgcagtgagccgagatcattccactgcactccagcctgggtgatggagtgaggctctgtctcaaaaaaaaaaaagaaagaaagaaaagaaaaaggaaggaaggaaaggaaagaaagaaggaaagaaggaaggaaggaagaaaaagaaagaaagaaagaaagaaaaagaaagaaagaaagaaagaaagaaagaaagaaagaaagaaagaaaaaagaaagaaaagaaaatagttatttctattacatcacctcccctctcccaccaaaaatcctggggactagaataaatcagccttggcacctggttatctgaacgatgcttggtcacatccagaggcaggtaacactccctaatgagacagccctgtttcattttgagtcagctccaaatatgagaagtttttctccagtctctgaggttggactttgcctctctgaaacctccactgaacatctcatttctaactctttgaccaaacaaaatatgcttaatttctcttttacctcccagccattccaatatttggaggcaaatgggaagtggaaggagcaaggatttagaaatctattagaaatgggctcaaattgctgctctgtctgatacatgttatagcatggatgaactctgaaggcatgctaaataaagtaagacagacacaagaggaaaatattgtgtctaagtcctcttacatgaggtaccttgagtagtcaaattcataaagacagaaaaaagagcagtggttactattggagggatgggagaatggggagttagtgtttaatggatacagagtttatgttcaagatgatgaaaagtttctagaattggatagcggtgatgaatgttgatatggtttggctgtgtccctgcccaaatctcatcttgaattgttgttcccataatccccacgtgtcatgggaggtaaccagggggaggtaatttaatcattttggggtccttaccctcatgctgttctcatgatagtgagtgatttctcatgagatttgatagttttatagggggctttcccccactcattctcattcttctctcttgtctgctgccatgtaagacctgcctttgctcctccttcaccttcaaccatgattgtgaggcttccccagccatatggaactgtgagtccatttaacctctttcctttataaattacccagtctcaggtacgtctttattagcagtgtgagaatggactaatacaaacgtacaacattgtaaatgtgtttaaggccgctgaatttgacatttaaacacggataaattttatgttatgtatattttaccacaataaaaaaaatcaaaaaatgctgctgtcatttactagctatgttgtttctctgagctgcagttttctcatctgtaaaatgggtactgtttaattgtaactactgtgcatgttgttgtgacagtcagataggtttagttaattaaagtaccatccttgtattttcatggaaactttgagagtagaaagttaatacatgatgactgatgggaaatccggatttataatagctggcattattaacactgccataaaatcaaaattagccattagtcagagagggcagaattcatgctttaagacatcagaataaaaataagtttgaagatgaaacaccaggcttcaaagacatttcggcttttagtgggcagtggagctatggacccagacctgctccagggactcctggctgattctcctctggggttaggaagttggcagtctgagaagctctgctcgagacaatggtttccatcccctgctgtgtttcagaactgcctgagacaattattaaactaaagacacctggtcccgtccctggagcctacaatttagtcaggcattagttcaggatctggatgtatttttagtttgctccaagcgaatctgaggcattaccaggtttgaggaccactgcgctagggacttctggctgccctgactgcccaagagtagttcaagtagctgagtgaggagttttgatgggagacctgagagatggtcctaacatcccagaagttccccacatggctaagaaagagagggcagccctaacttgggagcaaaaatcagttgaaggtttgtattaatcagggttctctacacaaacctaacagtaacattctgcttatatataggatttattaggttgatgcaaaaataattgccattactttcatggcaaaaactgcaataattttcatttttttttttttgagatggagtctcagtctatcacccaggctggagggcaatggcacaacctcagctcactgcaacctccatctcctaggttcaagtgattctcctgcctcagcctccggagtagctgggattatagggattacagacagctaatgttttttgtatttttagtagagacagggtttcaccatgttggccaggctggtcatgaactcctgacctcaagtgatctgcccacctcagcctcccagagtgctgggattccaggtgtgagccactgcacctggcctgcaattacttttgcaccaagctaatattatgaggaattggttcatgcaattatggagaagttcacgatctgccaactgcaagctggagacccagcaaagcccatggtataattcagcctgagtgtgaaggcctggaaccaggagaactggtgatggaaaagtcgctccgagagcaggggaagaggagagaagaggagattctctggctgacgcagagagacaggggaaaaggagcatactcctcctccttctgccttttgttctattcaggcctttggtggattggacaatgcctacctacattggggagagcaatttactttactgagtccacagattcaaatgcttatctcctctgtaaacaccctcatagacccatccagaaataatgttgaatctgggccctacttggccagtcatgttgatacgtaaaattaataatcacaaaaatcaaagacggaaagtaaccagaaagagatgacaaggagactgcagcatagctttagacctgggtcaagttcagattaaacttcttttaatcgaaaacatgtaatggggtcaaaaaactacctatcgggtgctctgctcactatctgggtgatgaaataatttatacaccaaataccagcaacacacaatctacccatgtaaaagacctgcacatgtaccccctgaacctaaagtaatagttgaaaaaagacaaaagcaacacacacagacacatatgcacacacacacacacaaacaaaaacaaacaaacaaacaaacaaacaaacaaacaaacaaaacagggccgggcacggtggctcacgctgtaatcccggcactttgggaggccgaggtgggtgatcacttgttaggagttcgagaccagcctggccaacatgacgaaagcttgtctctactaaaaaatacaaaaattagccaggagtggtggcacatgcctgtagtcccagctactcgggaggctgaggcagaagaatcacttgagcccaggaggcagaggttgcagtgagccaggatagtgccactgcactccagcctgggcgacagagcaagactctatctcaaaacaaaaacaaaaacaaaaaacatgtaacatagctccactgtacagcgtttgcttacagaggttgcttctgcaatgaagagaattaggcatctgacttgaggtatgattacagactgcagtgaaagctggaagttgaaaagtggaagagttatgtgctgagtataaattctggtgcaccaaaggttctattactttctatctcaaaatcaaatttcaattgctctgggctcctacccaatgactagcagaaagttcaatcctcatagattcctgagtctgtcactcactcctcctccacttggtcagaaagtccctgggctcctgtggccttagaaaagtggcccagctgtctatggccatgtcaccctgaacattctccgtctgtctgatcttggaagctaggcagggtcgggcctggttagtacttggatgggagaaaagtggggcaggggctgagctaaggccttcgtccatgatcccagcatctctcaagttgatccttgggttccaggatgctacggataagctctggtccctgccaagacatggtctctgtatgtcaggctttgctgctctgggggtgacaatgatagccccatagaggttctcttcattgactgaaaggacctcatgcacagggtgtgctcatacatgcttgaggggcagtcaattcccctctggtcagtttctgcctcccacactccttctaactgctcccatttggttatttccacagaactgccccacctgcccctgcaatgagtcttcacacataccatactggcctctccttctcagggatgggagcgagtggagaatggcgagtataacttaggttggcaactctttttttttttctccttttaataaatctccctgatcctgctgtgaagccccagggttggtttaggtgggagggtcggaggctgagatggctcctttcctttttattaccatcagcatatttgggtaaaagacagagctgccaaccaatgatggctatggtagccttgcagtcagagagaatgtgtttatgaagacggcagaaagagagcaagcggacccaacgccactcccaccccactaagaagccacttcacagcacatacttttcctgaatcatcagttggacctaattccttttagctgttaagaaaagctgaatcttgtctaaaaacagtcccatctataatattaagtctggccctagggtttgtgttaataaatggctatagtgtaaaacaacctgaaacttctgctttgccaattctattctagatgtggatgagtcagggttctgggttgcaagaaacagcgagtaattggcaaacgtgagcagaaaaggaatgcactggaaggaaatcagggagctcatgtattcttcgagaaggctggagaatcaggcttggaaaaggcagagccaagggaggtgtgggagcaggaagcccagcaaggggctgcacagacagcatgactctcccccttcttttttaatagcgtttttttatttgtgcagtaagccattggcttaaaaaatgttttaagtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtgggggggggtcggccccccgccaggccagccgccccgtccgggaggtgaggggcgcctctgcccggccgcccctactgggaagtgaggggcccctctgcccggccagccgccccgtccgggagggagatgggggggtcagccccccgcccggccagccgccccgtccgggaggtgaggggcgcctctgcccggccgcccctactgagaagtgaggagcccctctgcccggccaccaccccgtctgggaggtgtgcccaacagctcattgagaacgggtcaggatgacaatggcggctttgtggaatagaaaggcgggaaaggtggggaaaagattgagaaatcggatggttgccgtgtctgtgtagaaggaagtagacatgggagacttttcattttgttctgcactaagaaaaattcctctgccttgggatcctgttgatctgtgaccttacccccaacccggtgctctctgaaacatgtgctgtgtccactcagggttaaatggattaagggcggtgcaagatgtgctttgttaaacagatgcttgaaggcagcatgctccttaagagtcatcaccactccctaatctcaagtaatcagggacacaaacactgcggaaggccgcagggtcctctgcctaggaaaaccagagacctttgttcacttgtttatctgctgaccttccctccactattgtcccatgaccctgccaaatcctcctctgtgagaaacacccaagaattatcaataaaaaaataaatttaaaaaaaaaaaaaaaaaaaatgttttaagcattttaaagttacagtttagtagcattaagtacattcacattgttatgcaaatatcatcaacctctatctctggatttttttcattttcctaagctgaaactctgtatccattaaattctaactcctaactcctcatttgccccttctcccggctgctggtaaccaccattctactttctgtctctatgaatttgactattctaagtactgatgcaagtacttagtataagtactaagtactgatgtgatgtaagtacttagtatgagtactaagtactggtgtaagtacttagtataagtattaagtactggtataagtacttagtataagcattaagtactggtgtaagtacttagtataagtactaagtactggtgtaagtacttatgtaagtacttcacataagtggaaccacacaacatttgtcctttcatcactggcttatttcacttagcctaatgtctttaaggtttatccatgtcgtaggtcagaatttctttcctctttaaggcagaataatgttcaattgtgtgtctataccatattttgtctatccattcatcaatctataacttgggttgctttcatcttttggctatcgggaataatgctgctataaacatgggtgtgcaaatatctcttcaagtccctgctttcaacttttggggtgtatataaccagaaatgggattgctggatcatattgcaataatcttcctctcattcctacatctttatgaccctctcttaagatgcaatgttcagggaggagtacagccaacattcatggtgcccttgaccacactttctcaggctgcctctcattgtggccacagctaggtgcaggcatgctgagtcttccacctaaagcacccactgcttctctggctgaaccccaaggaattcactcagttttcagtctgcagcccagaagtgatgggagagttaacacactccagagtctatcctcactcagtgccccagtccccctcctttaaaacaaaaacaaaaacaaaacaaaaatcctgcttcattatatcatataattcacttatttaaaatgtaaacttccatttttttagtatattcacagaaatgtacaaccatcaccacagtcaattaattttagaacatttttatcatgcccaaaacaaaccctttaagctatcaccctcctactcccctaatcctctcatccctaggcagccactaatctacttcatttctctataaatttccctgttgttaacatttcaaacaaatggaaccatagagtacatggtcttgtgtgtctggcttcttttgcttagcataatcttgtcaagattcacccatgttctagcatgtatcagaacttcatgtggctcatgcctgtaatcccagcactttgggaggctgaagtgggcagatcacttgaggtcaggagtttgagaccagcctggccaagaggatgaagccccgtctctaccaaaaatacaaaaattaaccaggcatggtggtgcgttcctgtaatcccagctacttaggaagctgaagcaggagaaacacttgaaccctggaacccagaggtgaatattgcagtgagccaagatcacacactgcactcctacatgacagagcgagactctgtctcaaaaaaacaaaacaaaacaaaaaaaccttcattcccttttatggctgaataatattccactgtatggatataccacattttatttatcccttcatcagttgatggacatatttgggttgtttccacctttagctattatgactagcattactataaatattcatatacaagtttttgtgtggacatatgttttcatttctcttgggtacatgaccaggagtgaaattgctctaggcttccgttaagagtaactgtgagattcattctatattgttcatcagatggtccccaacaggatggatggagctccagtgtccacactgagaagctcagcaagacagccttcattgttgccacctccttttacatctcactttcctcactcctacagccttgctccctaggatgactcccaaaataaactcccgacacccatgcccttgcctgttgttctgctttcaggcaatccaaatgaagatatgaaagttcggccaggcacggtggctcatgcctgtaaacccagcactttgggaggccaagggaggcagatcacttgaagtcaggagttcgagaccagcctggccaacatggtgaaaccccgtctctaataaaaatacaaaaaaattaaccaggcatggtggtaggcacctataatcccagctactcaggaggctgaggcaggagaattgcttgcacccaggaggcggaggttgcagtgagccgagtttgtgccactgtactccagcctggatgacggagtgagaacctgcctcaaaaaaaaaaaaaaaaaaaaaaaaaacaaaaagatatgaaagtgcataagagttcaggcctgttcgtgttcctgttcttcacgtgtcagaggcaagaagcatgaggcctcttcaccttccataaagggagatggcgcccactgcacaaggtgtctgatgtaaactaagaaaaaccaaataacaacagcaaccaaaaaaaggtgaaagtcacaaggtgatcccaacgggtggaggaagaggactagcatgttagatgcatatgatgctaacaggggccctgtatgcattattctgtttaattcccacaacagcccggagaggttgataatttgcctggggttatcccagaagtgaaggagcccagatcagcagccaggttcctccgattccagtggctgtcctctgtcacctctccccaccctctggtcagtgctcttcacagcaaactggtaatttcctaactgcctttaagtgaaagtatctttttggctccacattctactgcaaaggaagccagatgctatttttcagtcctgtgaactttccatttctggcaggtggctggctctccttttccctggatagaatgtaatttccatttgctttccagcaatcttattgattgaacatgcttccaaattttttcatctttgacacgtttcttacaatgtaattttacagggcaggaatcatccttgttgaagaggagagtccaagacggggcggcattcttgtgtaatgagttgctttagctttttctttttttctttttcttttttttttttttttggctaaaactaagaatgtgtcagtggcaaacactaaaaatccacccccatttacttcttgtggctgttcctgagggatgtcagtgataaagtcacccaacttacaaactttacagtgagtcactcatcccattaaaggcccttgagatgtacgataacagcaaaaaaaaaccccacctttccagaaggatatcataacaattagaaaatcagtcatgatggcagtgaacctcaatgttctgatccacaaaataaggctttggtgaagaataaatgaaattacatttgtgaaaattttgcagtgtgagcttttattactcgtatctttacaaagaacataatagatactgctacatttttgcaaagcaagctgacatctggagtatgaaacaatcattaataattatctgtgctggtcaggcatggtggatcaaggttgtaatcccagcaccttgggaggccaaggcagggggattgcttgaggccaggagtttgagaccagcctggccaacatagtgagactccatttatataaaaaaattaaaaatcagccaggtgttgtgccacacacctaaattcctagctacactggaggttaagacaggagggttgcttgagcccagtaattcaaggctatagtgagctatgattatgccactgcactctagcctgggagacagagatagagcctgtctctcaaaacaaaacgaaaacaaaacaacaacaacaaaaagctgggcacagtggctcatgcctgcaaccccagcaccttgagaggccaaggcagaaggactgcttgagtccaggagttctagaccagctggacaatgtaccaagacccccatctctttaaaaagtgtagctgggcctgggtggtacataactgtagtcccagctactcaagaggctgaggtggcaggatcccttgtgcccagaagttggaggatgcagtgagctgtgatagctacacactccagcctaggtgacagtgacagagcaagatcctgtgtctaaacaagaaaaagaaacggtatctgtgcaaaaaaaaaaaaagtattcaaaagtctaaaccttgtgttagagacagccattgcacaaacaagaagaaagggaattcattagaccatgcataagtatcagaaagagcctgaatgtttttttaaatcattattatttacaatttttttttttttttttgagacggagtcttgctctgtcacccaggctggagtgcagtgacgcgatctcggctcattgcaagctctgcctcccgggttcacgccattctcctgcctcagcctcccaagcagctgggactacaggtgcccgtcaccgcgcctggctaattttttgtatttttagtagagacggggtttcactgcattagccaggatggtcttgatctcctgacctcgtgatctgcccgtctcggcctcccaaagtgctgggattacaggcgtgagcaactgcgcctggcctatttacaaaaattttttagagacagagtcttgctccatcatccggctgcagcctggacttcctgggctctgacaatcctcctacctcagcctcctgagtagttagtattacaggcataggcaaccatgcccagctaattatttttaaagtgttttgtagaggcagggtctcactatgttgcccaggctggcctcaaattctagacctcacctggcatggtggctcacgcctgtaatcccaacactttgggaggccaaggcaggattgcttaagcctaggagttctccaactccagcatagtgagaccccatctctaccaaaaatacaaaaattagcctgacatggtggtgcatgcctgtaatcccagctactggggaggctgaggtgggaggcttgctcgagcctgggaggcagaagttgcagtgagccaagatcgtaccactgcactccagcctgggtgacagagtgagactctgtctcaaaaataaaataaataaaaacaggccaggcatggtggctcacacctgtaatcctagaactttgggaggctgaggtgggcggattgcctgagctcaggagttcgagaccagcccgggcaacgtggtgaaaccctgtctctactaaaatacaaaaaaaaaaaaaaaaaattagccaggcatgttggcatgtgcccgtaatcccagctacttgggaggctgaggcaggagaattgtgtcaacccaggaagtggaggttgcagtgagctgagattgtgccactgcactccagtctgggcggcggagcaagactccatctccaaaaaataataataataatagtaaataaaataaaaataataaaaataagaaataaatatatcacctcgttagtccttacaacaaagccaatagcctttgttcacataagtggaatcccactctcatttcatagctaagaaaactgaggctcagaagagaataggatttacccaaagtctcaggaattcatctgagccctatggaccaccccacagcagtgcagattatctttgcaaggtattacgtgcctaagacagtctttccagtagatgactcagtgagctggcaccacttgcagactagccagtagagtgaccacagtgtatcaggaagatgtgtcactgagaaaacaaaaccagcaaggattgtgtgatgccacagtgactcactgtgcccaaggtcccccactctaactaggagtattccccagtggcctttatacaacttgctgatcttttcctacttggctcgtctactcgccgcacaatcattcccatgcagccccaccccaccccagtcccacccgtcctcctgatggggcctgcttctcatcctccgctgaggtgtcagattgacttccagaggcttctgcagagcacttctcactccaatctcctccaattctctaagcacaagcaggaacctgggcatttccagctgctcaagctaagaggtcccccttccagcctggctcgtgctggtgcttaggtggggctcctgtccctatcccctacagctctgttgtctctcgatatgtcactctttgcaccagaaagaacaaccaaggatcattctcaatgcttcacacagaaaccctcttctcccaaatgaatttcccgttccctttctcagggacccccaaaggtatagctgcagcctcccagaacacttattctacaggaggctgcttagaccacagctgtattcgggaaaaggaaatttcattaggatgtaatgatctcaggcctccaaagccctggctggctggaaaaaggaggctacagtcaggatcctgtccaagccgccagaagaagtggctgatggctttctaggctgcctctctctgtgcataatcctgctcatatctcactggtcacagctgcaaaggagtttaggagtgtagtatcttagatgggcacatatccctagaaaagcattgcaaagcagaaggggaaaatggagttgggtagacaacaagtattctcagaagataagggcatagctggcaatctgaacagtgagtgttaaggttagccattccaatatcacacagataagaaaaggccctatgatttggcaaccaagagattactcatggccttggaaaagacaaacctagcagaacactggattgggagtggggttaagcaatgagtgggggtgaggaagtggagacatgggacccagacttttctacagagatgtttcagtaaagagaaatgagggctgggcgcagtggctcatgcctgtaatcccagaattttgggaggccgagacgggcggatcacaaggccaggagatcgagaccatcctggctaacatggtgaaaccccgtctctactaaaaatacaaaaaattagccaggtgtggtggcgggcgcttgtagtcccagctactcaggaggttgaggcaggagaatagtgtgaacccgggaggtggagcttgcagtgagctgacacagtgccactgcactccagcctgggcaacagagaaagactccatctcaaaaaaaaaaaagaaaaaaaaagagagaaatgagagacagagaaatagacagctgtattataaaaatatacacataattcctaacctttattttgactgcttcttttcctctccccaactcaatcttggcaacagttactaatagcaaaattgactgacctgagttccagcttctctctgttcttcttcccagggaaggtgctaatgaggaatgaaatggccaaaggctgaactgcgggagggagaagtgaagctctgg

SEQ ID NO: 496 - DNA, 20001 bp, Homo sapiens
tctttctttttctttatttctctttctctctctctctctctttctctctttctttttgggagagtctcactgtcacccaggctggagtacagtggcacaatctcggctcactgcaatctctgcctctcgggttcaagcaattctcatgcctcaacttactgagtagctgaaataagaggtgcacgtcaacacacctggctaatttttgtattttcggtaaagatgttggggggcggtgtttcgggggtggtttacaccatgttggccaggttggtctcgaacccctggcctcaactgatctgcctgtgttgggctaccaaagtgttaggattacaggcatgagctaccacacccagcctaaacttttctttcatattcagctttatactgtcaactacctccttttattattatccaccagcagtgatttttctggcatagattcaaggtgaaccattgccaaaaacattttttggcacagggtaacaattaaaattgataatataccaacatagtgcagagagattagaatatttcccggcactgctttcctgattatttcagagcaaggcaacaaagctgtatgtgctatttctttggagtggatgctatccaaaattattcctttggatatagtgttctgtcatcatcattatcctgggtgttgcaatattcatatccaaaatattttttgttaaaataattgtttttctcacctcatgctttttcttatttcttttctttgcagctgtttttaaattttaaaatgcagattaaaaggtaagttaggggtgttttttaaaaaggttgcagtaagaatacaagatgaggtagtaactggacacatttagtgcatttaagattttagtacattttagtaacttaagtaacactcaatgtagtttaaatttacctaaaaattgaaatactaaaatggagggtctggggaattgctaggagcaatggatgaatcaatagtcagagtgaacttttacagcaattcaaatatctgattgttctaaatgcatggtataaaataataccaccttcagttaagatgactctggccttgtcttttccaatgccatttttttttcatatccgagtactgtgaaagctggcatgtgtatgtgttggaggaagggaaggatggcctgaactctgaagtcaggatacctaagtttaaagcccaggtccaccatttgttagtcatgtggcatttgaccaactacatgatttctctgtgtttccagttcctcatctagaatcagcagttcaataaaagtccaataaaaaatgggctatagcctcacttagaggttgccctaaaggactatggtgaagggaaagccctcataatgaacagaattttgcctggggcacttggtcattcactttgtgtgaattttaaagtggcctgaaatggccgggcacagtggctcatgcctgtaatctcagaactctgggaggccaaggcaggtggatcacctgaggtcaggagtttgagaccagcctggccaacatggtgaaaccccatctgtactaaaaaaatagcaatgcagctttttataagagtcttgtgaggactaaatgagaaaatgtatgcaaagcatacaaaatgaactattattacactattgcagaaaaaacagtgacttctttcagtattaagtctcctatgatggctgttcttttagaaatagacctatttcaatgacaatcaaaattatcctctagaattttttttttttgagacagagtttcactctttttgcccaggctggagtgcaatggcatgatcttagctcactcactgcaacctccgcctcccgggttcaagcatttctcctgcctcagcctcccaagtagctgggattacaggcatgcgccactacgcctggctaattttgtatttttagtagagacggggtttctccatgttggtcaggctggtctggaactccctacctcaggtgatctgtctgccttggcctcccaaagtgctgagattacaggtgtgagccaccacaccggcctatcctctagaaatttaaatgtactccttttgctgttatgctaattgaagttctctgtagatcttttcactgtggaacaccaaaactctagataagactcactcttggagacattgatagtttcacaaaaagtatggactggatctagaacagaaggtgagaggattaccctgaaggcaaaagccaagcttcatactgccattagaaccctgagcttgaaccagctacagagttgtcaaaggcatttgaatcagagcaactccatcttgaatagaggctgggtgaaataaggcaaagcctgctgggctgcattcccagtaagttaaggcattctaagtcacaagaaaagactggaggtcagcataagatacagatcataaagaccttgctgataaaacaggttccagtaaagaagctggccaaaacccaccaaaactaagatgaccactagagtgacctctggtcatcctcactgctacactcccaccagcaccatgacagtttacaaatgccaaggcaacatcagaagttaccctatatggtccaaacaggggaggtataaatattccatcccttgcttagcatataatcaagaaataaccataaaaatgggcaaccagcacacgtcggggtggctctgtctatggagcagccattctctttattcctttactttcttaatgaacttgctttcactttactctatggactggccttgaattctttcttgcacgtaatccaagaaccttcttttggggtctgaattgggaccccctttctggtaacagagagcagaaagttgaagctggaactgtgatgatgagctgagactctgcagttcagcagagactttttaataccgccaaaatcaactaatctctagaggaaacatatccaatttaggcataaccaattaggccacagagatgaaattctaccaatgatctcagaatcaatatcgccaagctcatataaaggcaaatccctttaagtaaaatcagcagacacaaataacagaagagttggctaagtatgtcaatatcaataaaaaaatggactatagtctcacttggaggtgaccctaaaggatagtgatgaagggaaaatcttcctcatgagcagaattttgaatggggcacttggtcattcactttgtgtgaattttaaaatggccagaaatggccgggtgtggtggctcaaacctgtaatcccagcactttgggaggccaaggcatgtggatcacctgcggtcagttctagaccagcctggccaacatggtgaaactccgtctctactaaaaatacaaaaattagccaggtgtagtggcaggtacctgtaatcccagctactcaggaggctgaggcaggagaatcacttgaactgggaagtggagttggcagtgaactgagattgtgtcacagcactccagccagggcaataagagtgaaactctatctcaaaaaaaaaaaaaaaacacaaaaggcctgaaataagaatacacatagtctcatgggcaggggagtcgtaaatggcttgggtggttggataggaacccggaaagtttggaagattgaagacaagagtgctggcaaggaggcatgtggatgatctaatggtaataaacacaaagagtgagaatctttgcatttgtacatgaatgtcggacaaggcacaaagaccactgtgaaaaaaataactgagttgacagaatgacacagccagtagatattagccagcctctgcccttggacatctcagtgcttaagcaatggacttgtgtatggagcatctatggtgtcttagatggagtctatgcataggctcaacagcaaagatttttttctcaccaagcctactactggtagagggctgacatatgagcaatacagactaggactatggcccaccctccctactagagttcaattcctgccaaatgccagtcagccatttggtgacatcttggaatggacaatatttcatcttggtttgggttgactcatattgtggttatgaatttgcatttcctgcatgcagtacttcagccatcgccattcttccaggtctcatagagtatctgatctaccagcatggactcctacatgacatcacatgggacaagagacctgctttacaacaaataaaacatggcaatgagcaaatgaccatgggattcattggccctgccatataccacaccatctagaaactgctagtttgaaagaatagcctcttgaaattttagcccaggctctgacttggagatgacacactgtgaagatggggaactaacccttagattgaagtatacatcacacatcttaaaccaattgttcatatgtagtgctgctatgttcccaataggtagcacacgtaagtttgagaatcaagggaagaaggattgtcctcgtttatactcatgaccagtgatgcatttggagaatgtgttgtattttctgtccctgcaacttcaggctctatgatctagaggtcctggggttcagagtgggggatgctgccagcagggaacaaagtaagaattctgctaaaattaaagctaaaattttggaatcttcatgacagtaagccagctggcacagaaattcacactcatgaggaagtaaaccattgctgcacaatagggcctgagaagaatatgtgtgccactgggacatttcttggtatccccatgtccaggttttaactgtaagtagagaagcacctaaaacacacacacacacacacacacacacacacacacacacacacacaaaacctcagttactgagaggcctccaggatgaggagataggttaccctaccaggcaagaacccagatcatccaaaatgctagagaaggggaaagaagcctagaaagagtaatggagggaagagaccgtgagtagcggttactgccttgggaacaactgcagcattagaaactgtagttattctcactaacccttttattctttttcgcagtgttgttgaggctgtaatggggtataggggtcaggggaatgagaggaacttaaatattattcattcccttacgtgtaccaaatactctatagtcaaggtaacactcatattatatgagctaactttttcagctatctctacccttcaaagacaacagatccttttagtgattaaaaaaaagtaaggaaagaaagaaaggaaaagaaaacaggaaggaaggaaggaaggtaggttggttgattgaattttgggttttctttctcttcaaatgcaggaagttttcttttacaaggttcccttccaaaatagtcttaatagtctttctaagaaatgcgtatgcattgcacaaaccaatcagccggcctcctggagttagccagccagttccctgaagtcaggcagctagtttgcactttttaagctgtttcttagtatttcaagcatagatgttcaatcatgctaatgccactctttctatataattgtgtctctaagactcctcatgttgtgggtgaaagaaaacttatctcaaactggcttacataataaaggggatttgttgacttccataacagaaagttcatctatacggagggcttcagcattcatgaactgatagttagaaggtgtcaccaaatacatacttttttctactgccttactctgcgttcatgacattggctttatctaagtctgactcccctccatttccacttccagaccccatggtcatgaaaggcttctaatataaataaggctatgtgtttctccattcttgttaaacaggagaaagaatgtgtctgatccagcattcaaaagtacagtaccaagactcgccctgactggttggcttaagttacatacccaatcttgaaccaatggccatggccaattgataatgtatccttaatggtttaaccaaccaggacccaccacttaagctaaggtaggtttatgtttacccaaaaggtgctggctgtgttgagaaggtgtgaacaaaggtgaatctcagacttgttagaaagtgaaaatgtttggataggaaccaacaatgctcactagaagcagttatttttcaagcatgggtgaggccttcctcttaattcctcatggagttaaagacctgaaaaataacagaacacagaaaatttacaaactagatgctacggtttgaatatgtcccccaaagtttatatgttggaaaaaatgcatcctcagtgcaacagtgtggagaggtggaagctttaagaggtaattagggctcttccctcatgagtggattcatgcctttattgcaggggtgggttagttatcacaggagcaggttcctgataaaaggatgagttcaggccatgtcctctttctgtctctctctctctttctcctctctctctctctatttctctctcacatgctttcttgcccttccatcttctgccatggaatgacacagcaagaaggtgtctccagatgtgggctcctcagccttggacttcctagcctcaataactataagaaatacctttctattatttagaaattgctattctttggtgttctgttatagcagcttaaaacagaccaatacaaataactgacaccaggaagtggggctcttgctgtaacaaatacctagaaatgtggaagtagctttggaactaactgcctaatgggtagaagctgtaagaagttgaaaaactctgtattaccatgcctggagtattaaggaaaattctggtgagtgctcagaagaaaagagagagagagagagagatcccaaatcttcttggaaattacttaagtggtcatgatcaaatattggtagaaatacagatggtaaaggccattctgatgaggcttcagatggaaatgaggaacaagatattggaaactggagtaaaagccagttttattatacacttaaaaataacttggtggaattgtgttcaagtcctaggactttgtgaaagcagaacttaagtgcaatgaactaggatatctgtcataagaaatatccaagcagcaaagcattcaatatacaatatggcttcttttgggcacttacagtaaaaagagataaaacagaaatgatttagagatagaatttataattaaaaggaatacaaaatagaaataattggaaaactctcagtttcgctgtgaaaaaactaaaaaagtgggctcaagagagaatattaagggtgttgctaagtgacgccttactaaagggattaatatggatagaatgaagccaggctctatccataaagactatgaataaataaacataaaggaatttcagagatcttcaaggcaagctaagaccctgagggccaggttatcagagaggtgcccatggacctcagcattcactgtccagggcttgtttgtgactctgctccccacattccagcacagtgctcctctgctgccccagcagttgctcaaacaggcccagatgtggctcctgccacagctctggagggtgaaagcggtaagccttggtgacatccatgtcatcagcatccacatggttctggctttgcagacatgtggagtgaacaagttgtggggccatggcagccccacactaaacttcaaaagtatgtatgggacagcccagtgattcaggcagagacttgttgcaggagcagggccaccacaaagaacctccactaggacaaagcctgggagaaccataggaatggggcagctcctgagaccccagaagtaggaccaacagtatgcaactccagcctgggaaggctgtaagtacgagactccaacctttgagagctgttcaacggactgaacccatcgaagccataagggaaagtctgcttgagaccttgggggtacagctgccaccccagtgtgcccagcacacaaggcatagagtcaaaggagaaaattctccagccttaagacttaacactgttttctctgttgatttttggacttacttgggacaagtcatccctttcttcttgcatgtttctccttttaaaaatagaaatgtcggccaggcgcagtggctcacacctgtaatcccagcactctgggaggccaaggcgggtggatcacgaggtcaggagattgagaccatcctggctaacatggtgaaaccccatctctactaaaaatagaaaaaaattagccaggcgtggtggtgggcacctgtagtcccagctacttgggaggctgaggcaggagaatcacttgaacctgggaggcagagcttgcagtgagccaagatcgcaccactgcactccagcctgggtgacagagcaagattctgtctaaaaaaaaaaaaaaaaaaaagaatagaaatgtctatcttatgcctctctcatcatcatattttgaaggcatgtaacttgctaatcttacaggctcacagctggagaggaatttatctcaggatgcattgtgccttgcgtctcctccatatctgattgagattagattctagactttggacttttgagttggtactgaaacaagttaacattttggagctactaggatggaattaacatattttgcatgtgagaaaagcataaattttggggaccaggggaagaatactatggtttgaatgcatcccacaaagttcatgtgttggaaacttaatccccaatgcaacagtattgagaggtgggacctttaagagatgattaggtcatgaaggctctgccctcatgaatggactatgcctttattgcaggagtgggttcctcataaaataatgagtcaaacaccctcctgttgctgtctctcacatacctgtgctgtttcatcttccatcattggaagatacggaaagaagttccttgctagatgcagacactgggacttcgaacttcacagtctccagaactgtgagaaataagtctgtcttttgtaaattactcagtctgtggtattctgtttcagcagcacaaatcaaagacacaaggtaaaccttaaaaagaatggatcctagatatgactgttgttgaactccataggccaatctctactacacagaaaatcctttgtgccggttccttctaaatgttactgtgcatacatgtctttggacactttgtgaaaatgctgattctttgaataaggcctgagattccacaattctaacaagttcttaagtgattttgatgatgttgatctggcggccacactttgacagcttctctcctgatctcctattcacccccaaagtgctcacctcagagaaaaaggtaaccttgagcttgtctcttcttataggaaactaatttccatttccttaattcctactgaaaaaaatacaaattcttaaaatgaaacacttggcagagttttgtgttcacctccaagcaagacaaacttcatataattttgagaaaagtttaactccatattgctttcaatctttccctcctgaataagaatatttccttaccatgagatatttttaaaagtacttaaagtgtcttttccaaaaacaaagatgcatatttcctcaatgattaatttcaacttcctcagccaggagaaaaaccgaaaatactaccaacaataaaaactgcaaaaaccaaagctttaaaatggcgtttttcacacacattcaataattttaaattacaggatctggtctcaataggaacatatgcagtgtgtatgtgtgtgtaatatatacacacatatgtaactgtataggtatatttgcacatttacacatgcatgcttactagaacaaataatgccaataacttatgacacgcttactcttcctcctctttctatttttttctttttctttttttctttgaggcatttagtggctggtcagggaatctgaataccatttattgtaaaatttctattttagtatgcctttcagttctaagcaactaacttaccaacttttcaaacacaatttgtctgcgtagagaagaccagcacacaggaagaaaacaataacagaggcagcattgcagttctcaggtacacacaggacaaccgaggcatggtaagtgaaatatataaccaactttctcataaaaagtaagtttgtaacaaatatgagagcagaattcggtgatatttgttcatgattattctatttatactgcttatttaatgcagagttttgaatatttgtttctcttgcattgtattagtcaattcttgcatttctataaagaaataactgaaactggctaacatatgaaaaaaagagttctagttgacccgtggttccacaggctgtacaggaaacatgacgctggcatcttctgagcttcttgggaggcctcaggaaacttacaatcctggtggaaggtgaagagggagcagacacagtcacatggtcagagcaagagcaagtgagagagcaaggggggagatgccacacactgttaaacaaccagatcacaagaaaactcactcactattgtaaggacagtacaaaagggatggtgctatatcattcatgagaaatccacccccatgatccagtctcctcccaccaggcccccacctctgacattggggattacaattcgacaggaaatttgggtgggaacacatatccaaactataccatgcactccagataatatttacttagcaacagaaaaaaaaaaaaaaacccttaagcacaaatctgagagagcgtatgcttctaagggagggcttttcattgaatctcgaggctatagaagtgccttttccgatgtggatggcactgctttattcatgaggctctcatactggttctgcctttgtctgtaattaaaggtccaaaagctggctttatatatcactcaaggcaactgtaaaacataagtatatttcccctctgtttaaataactggaataatttgtcccataatcacattggtctctgtgagctcttgaagttttattaaggtataacccacgagtcacagtaatacttggttttgaagcttgattctcatagtactttttaaaaatatgaatcctaactttgtgtaactttaaagaatgaacaggtttgaagacacatcaccatggaaatcagaaggtcttggcatatccctctaatctgagcatggcctacgcagcattggtcatgtgttaggtaaagaggcaaacaggcaggaaaatgccttggctaagaacatacactatggactgtctgggtataaatcctggctttgtcatctactaactagttacaggatcttgcgaaatatgcttaaaatatttggacttcagtttcctcctctgggaaacaaagaaaatgaggtacagtttttagggatgttggtaaacaaaatgtgtgaataaatgcaacacccttagaaaagaaactggcacatagtaagcactcaataaatgtcagaaattgttattgctgcagttcagtggttctcaaatgggagtaattttacccctccagggacataaggcaatgttagaagacatatttaagtgttgagactgagggcaggaaatgctactgataactaatgggcggaggccagcgatgctactaaacatcctacttgctgccgccaccaccacaaccaccaccaccaccaccaacaaaagattatccagcacgaatgtcaacagtgctgtggtgcacaaaccctcctatagaataaaatgtttcttgtgtatcaaatatacatctcagaaataaattacaataaatgggtaaaaattgagacactctctactcttaacctcttttactgtgttctctatacagtaggaagcatatattgcttcctttaagtatagcaaatactgtatacagaaaagtacctatataataagtgtacaactaaagattttcacaaacacacccatacaacatccaaataaaaaggtagaattttaataggactctagttgtagttctgcctaaaagtagccacttttcctgacctgaagcatcacatacgatttttgtgtgtttatgtttatactctataaacattaagtatttttgtgactagtcttattcatattcttgcaagtagttatagtttgttcaattctcatggctgggtagtattccgttgccaaaacacaccagaaattatccatccattctttattctggtgggtttcaactttggactattttgaatagcacagctgtgtgcattccaatacacaactctgagtcaacaaatatatgagtttttattgggtatgtacagcataacctttggaaagtaatggaaaatccagccatgatttcccattacagttcaaacaaaatccaagatcctttaagaggtcatacttcctagtttgcttgagatagtgccaacttgtgtttgtcctgacatttgccatcactctcgaaagtgttccactttagaaaagaaatgatgtgtattgtctactagataccatcttacctaatctgctccatttatttcctgaatctttgctggaagatcttccattgctcacccgaccccagtcacacttctctttccaggttccgaaatttgccatatatttttcatgactcaatccttgtcttatacatctattcttcactcggggcatggttggtacttttccgtcttttagttctgagtttaaatgtcaactccttggaggggcaatgcctagtcaggctatgaatattcttccctcattctcacacttactgtgcctgcacactcttaccttcatagtatttagtacactaagcatttatttatgtatttaagtgtttattatgcttcccctggctcctactagaaagtcaactccattaggctaaaaatgatgtgtttatcacttctgagtagccagtaaatatctgttaaatgtatagataaatgaattagcaaaaatagacaaccaagtaggaaatcagaatcttgcttctaaatcatcatgtttggtcctttaatgcaatttcttcacaaacaattgcaaagacagtaaacaagcgaaacaagatgcttctaggctaaaaaaataaaaaagaatgcataagaaaaggaaaaaaatagtactttatttatttttttattattattatactttaagttttagggtacatgtgcacaatgtgcaggttagttacatatgtatacatgtgccatgctggtgtgctgcacccactaactcgtcatctagcattaggtatatctcccaatgctatccctccccccaccccacaacagtccccacagtgtgatgttccccttcctgtgtccattgtgttctcattcttcaattcccacctatgagtgagactatgtggtgtttggtcttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggatgaactagtttacagtcccaccaacagtgtaaaagtgtttctatttctccacatcctctccagcacctgttgtttcctgactttttaatgattgccattgtaactggtgtgagatggtatctcattgtggttttgatttgcatttctctgatggccagtgatggcgagcattttttcatgtgtttttttggctgcataaatgtcttcttttgagaagtgtctgttcatgtccttcgcccactttttgatggggttgtttgtttttttcctgtaaatttgtttgagttcattgtagattctggatattagccctctgtcagatgagtaggttgcaaaaattttctcccattttgtaggttgcctcctcactctgatggcagtttcttttgctgtgcagaagctctttagtttaattagatcccatttgtcaattttggcttttgttgccattgctttcggtgttttagacatgaagtccttgcccatgcctatgtcccgaatggtaatgcctaggttttcttctagggtttttatggttttaggtcgaacgtttaagtctttaatccatcttgaattgatttttgtataaggtgtaaggaagggatccagtttcagctttctacatatggctagctagttttcccagcaccatttattaaatagggaatcctttccccattgcttgtttttctcaggtttgtcaaagatcagatagttgtagatgtgcggtgttatttctgagggctctgttctgttccattgatctatatctctgttttggtaccagtaccatgctgttttggttactgtagccttgtagtacagtttgaagtcaggtagtgtgatgcctccggctttgttcttttggcttaggattgacttggtgacttttttggttccatatgaactttaaagtagtttttttccaattctgtgaagaaaggcattggtagcttgatggggatgggattgaatctgtaaactaccttgggcagtatggccattttcacgatattgattcttcctacccatgagcatggaatgttcttccatttgtttgtatcctcttttatttccttgagaagtggtttgtagttctccttgaagaggtccttcacatcccttgtaagttggattcctaggtattttattctctttgaagcaattgtgaatgggagttcactcatgatttggctctctgtctgttattggtttataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctgaacagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcattgttgaattttgtcaaaggccttttctgcatctattgagataatcatgtggtttttgtctttggttctgtttatatgctggattacatttattgatttgcatatattgaaccagccttgcatcccagggatgaagcctacttaatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagggggaattccctctttttctattgattggaatagtttcagaaggaatggtaccagttcctccttgtacctctggtagaattcggctgtgaatccatctggttctggactctttttggttggtaagctattgattattgccacaatttcagatcctgttattggtctattcagagattcaacttcttcctggtttagtcttgggagagtgtatgtgtccaggaatttatccatttcttctggattttctagtttatttgcgtagaggtgtttgtagtattctctgatagtagtttgtatttctgggggatcggtggtgatatcccctttatcattttttattgtgtctatttgattcttctctctttttttctttattagtcttgctagcggtctatcaattttgttgatcctttcaaaaaaccagctcctgcattcattaattttttgaagggtttttttgtgtctctatttccttcagttctgctctgattttagttatttcttgccttctgctagcttttcaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagatagtttgttataatttctgttcttttacatttgctgaggagagctttacttccaagtatgggtcaattttggaataggtgtggtgtggtgctgaaaaaaatgtatattctgttgatttgaggtggagagttctgtaaatgtctattaggtccgcttggtgcagagctgagttcaattcctgggtatccttgttgactttctgtctcgttgatctgtctaatgttgacagtggggtgttaaaatctcccattattaatgcgtgggagtctaagtctctttgtaggtcactcaggacttgctttatgaatctgagtgctcctgtattgggtgcatatatatttaggatagttagctcttcttgttgaactgatccctttaccattatgtatggccttctttgtctcttttgatctttgttggtttaaagtctgttttatcagagacgaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaattggatcctgtcattatgatgttagctggttattttgcttgttagttgatgcagtttcttcctagtctcgatggtctttacattttggcatgattttgcagcggctggtaccggttgttcctttccatgtttagcgcttccttcaggagctcttttagggcaggcctggtggtgacaaaatttcccagcatttgcttgtctgtaaagtattttatttctccttcacttatgaagcttagtttggctggatgtgaaattctgggttgaaaattcttttctttaagaatgttgaatattggcccccactctcctctggcttgtagagtttctgccgagagatccactgttagtctgatgggcttccctttgagggtaacctgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcgtttctttttattcttttttctctaaacttcccttctcacttcatttcatttatttcatcttccatcgctgataccctttcttccagttgatcacatcggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcggagtaatttgattgtctgaagccttcttctctcagcttgtcaaagtcattctccatccagctttgttccgttgctggtgaggaactgcgttcctttggaggaggagaggcactctgttttttagagtttccagtttttctgctctgttttttttccccatctttgtggttttatctacttttggtctttgatgatggtgatgtacagatgtgtttttggtgtggatgtcctttctgcttgttagttttccttctaacagacaggaccctcagctgcaggtctgttggagtacctggccgtgtgaggtgtcagtctgcccctgctggggggtgcctcccagttaggctgctcaggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgtgctagcaatcagcgagactccgtgggcataggaccccccgagccaggtgcaggatataatctcctggtgcgccattttttaagcccgtcagaaaagtgcagtattcgggtgggagtgacccgattttgcaggtgccatctatcacccctttctctgactaggaaagggaactccctgaccccttgcgcttcctgagtgaggcaatgcctcaccctgcttcggctcacgcacggtgcgtgcacccactgacctgcgccctagtcagtgactgtctggcactccctagtgagatgaacccggtacctcagatggaaatgcagaaatcacccgtcttctgcatcgctcacgctagttgctgtagaccggagctattcctattcggccatcttgtctcctctccccaaaaatagtactttaaaagaagaattatgtaacccagctataactaggacatccaagtccagtcttagtagattctcacattcattcaatacccacagtgttaaaaattaattaaatgtcttgagtttattgaggtctctagaagacataccaactataaattgtgttctatgacaaatggaagtgcttgctaaataacagtagataacacttgctgggcagtaattctgaacataatcagcattttaatgtatccctctccctgaagggcctccagattacctcctgctttccacgagaatctcatttttctctgcttttttccctgctttcatgagacctcactgtttctttcttatcttcataacctaatgatgtagtctattcaatttttctaataagatgtcttatcattctctcatgtttaaatttttttaaaacctgtaatcttgatgagaaatgtcaagtgacagaagactctagcagctcaatgaggctgtgttggaatgaagaaagaagaaaaagatgtttttgtttatttggttgcttggttgttttttgtattttttaaagtaagaactaccatcttttctattactttttccttgttaactcacacccttcatgtgtagggggaggccatactagcaagaagagagaaaactgtcgtacaaatgagaagatgtagaaggaaggattgatagggggtgatagggtcatatttatttttttgttgttgttgttcaatggaacaataagcatttggagtctttcacagatgatgaaagagacttgagaaacaataaacggattaaaatccaaaaaaaagataatattttattcagggaaaatggaaagaataagaatgctcaccttggtatttatgttttttgggaaagcagcaatgatgagtctctcaacagagtgacaaaaatgaggagaagtcctctttcaatgcagaaattgtgctataggaaagagcaagcaggggtagagggatgaatcccctttagg

SEQ ID NO: 497 - DNA, 20001 bp, Homo sapiens
aacctgtcagttgcatgatcttggggcaagtgatttagccccatcagtcttgtgttctcatctcatctctgagggctttagtacctcctcctggcacgtgttgtcaagtaggaagaatgcatgaaatacaactcaataaatgtgtatgacaatgaggagttaagcacttgagatcttccactgttttgtagagctagctgcatccttgaagatgaatgtgtttggcctggtcacattggtgtgaggacacggaggctcaggaaggcagagcaacttgccgaaggttgattttctcatttattccccaactgccccctctgtcaactttcctagtcctcggaattctgcagcaactgaaatctccttccagcctaagcccatgacaacaatgctcacagaggcaaagtctgccttgtaaaaattattttttttcttttgagattgagtctgtctctgttgcccaggttggagtgcagtggcacgatttcggctcattgcgacctcagcctcctggattcaagcgattctcctgcctcagcctcctgagtaggtgggactacaggtgcccaccaccatgcctggctaatttttgtatttttactagagacagggtttcaccatgttggccaggctagtctcgaactcctgacctcaggtgatctgcctgcctaggcctcccaaagtgctgagattataggcatgagccattgcacccagtcgaaaattattttcttttaatgttttttttttgttttccgagcacctattgtttgccaagtcatctacctggtattggcgtggtctatctaaaaaggtgacatttccactaaaacctgaagggtaaaaagtaggagttaggggaagaaagtccatgcttaagaaagcttgggccacccccagtccagggggagcaagcgtctccccacggtccacagaaatggtcttaataaagctagaagtgacttcatggttgccaaacccaagggcaccactgcatttgactgctctgtatctgtttcacccgaagtgccctcagacttgacatcctctgcctctttgttctccatgacactcatctgtgctggctctgctcctacatcttcgaacctcctccttagactcactcacagcctgctttgcctacatgatgtcctctgaatgtctgtctcatctgctcacttaacaaagcctcatggtcaaatcttgtgatgatgaagcccagccctatgtctccaggactcaggtcccctctgtcctcagacttggatatccgcctaactggctgttatcatgtcttctgggtaccgtgaaagcccctcaaactcagcagccaaaatgcaccacaatttctactttctagggcccacatatggacccttctcttttatatccagagccagtgacacttgggccaccatgtcagaaacctggaagtcagctaattctcctccttcttccatagttgatcaatcaataagccctattgatattgcttcctgaatgtgccttgaattggtccttttttccccatccctgctgctatttcaggcccttgtcatttcatgcctggactttgcaatagccttttttttttttttttgagataggatctcactctgtcgtccaggctggagtgcagtggtgcaatcatagctcactgcagcccaacctcccaggctcaagtgatcctactacctcactctcctgagtagctgggactgtaggtgtatgccgtcatacctggctattttttctttttttgttagagacagggtctccctatgtttgagaccaggctgatctcaaactcctggcctcaagtgatcctcccacctcagcctcccaaagtgttgggatcataggcataagccaccatgcattgccccaatagacttctaatggtcccagcttctccacctcctactcctctttcaaagtcatcttccatactacaacaagaacgtggtatttaaagtacacctctgaccatttcaatcctcagtgcaaaacccatccaataaacctcaagcttcttaataaaagatgcaggaccccttcatgaccaaaccctgcttactattcgtgtccttcatagcccgcttcttctacctttcccttgatattccaagataaactgcttgttgttctctcaacacattgtcctgtttctcattttatacaagttgtttcgttgctgaaatattattgttctctatacccactccatcttccactcttccttctttttttcatctagattacttctattcattctttaagacccaacagatagggccgggtgtgtggtggctcacgcctgtaatcccagcactttgggaggccaaggcaggtggatcccgaggtcaggagatcaagaccatcctgactaacatggtgaaaccctgtctctactaaaaatacaaaaaaaaaaaaaaatcagccgggcatggtgtcacgtgcctgtaatcccagctactcaggaggctgaagcaggagaatcacttgaatccgggagacggaggttgcagtaagccaagatcgcatcactgcactccagcctgggggacagagcaagactctgtctccaaaaaaaaaaaaaaagaaaacccaacagatattaccacttccaaaatgccctccaggattgcctttatattgtatttactatgttttattaaaatcatctgtttaaatgtcagtctccccactagactgtaagctcgtcaatatcaggcaccatatgtatgtctcagagcctaccacatggctggaacaaaataatgttccataactacttgttcaactgaattctcaaaattttccttccatgttactttagctctacatcaagaacaacaaaaactgaggattttgagagtgatgttttggccttgaaaacaatctctgtgcaaagcaccaagtgacatctaaagtctgtgccagtagggacaccaagagttggcttgaggagacatcatgggcctccccaccctgagcatttaatgtctgtgtgcaattgacaatcaaaggcctaaaaacatttttacattatttttgccatcatatttctgtatctgtttcatctgaggctttttctttttttctttttcttctccttggctagatcaaaagcttccagaggtcaaaaatagtgccttacgtttctcttctagccatctaagcatcaaccacaagtaattcagtaagtgtccattataaacaaatacaccatatggccaatagtgttcagcactgttgacagctataaagcagaccaggggatatagtagtgatggggcgaggtgaggggttagggctgccatctacatgtggtggcttctctgatatggtggcatgggagcagagacctgcaggaagtgtcagagtaggtgagtcatgaatatatatgtaaagttgctgcgttaaagaaaagatggcccaaacgctttgaatactcctcctgttgagaagtggtgtctatgtcccctgaccttgaatctgggagagctatgtaactgttttgattaatagagtatggtggaattaatgttttgtcagtctctgggcccaggcattaagagaatagcatcttccacttcttttctatcggatgcttgctcttggtacccagctgccatgttgtaaggaagctcaagcagcccttggaagaggcctatgtgaagagaaactgaagatgcagatcaatgacccagctgagctcccagctgacagccagcaccaactttctgtgaagcctagttgagccaccccagctgatatcttgtggagcagagaccagccatctctgcccacttctgcaaagttttctgattcatgaacaaaataaatgcttgttgctattttaagatactaagtgatgagatgatttgtaatacagcaatagatagctgcgatggaagcttctctgatagaagactgtaaaggcaaagaccttaactcaggataatgtttgaaatgttctagagacggtaaggaggctagtgtgatcgaccagagaatataagcagcagagcagtaggaggtgaggtcaaagaggtcactagtggcaaggtcttgaaggacactgcaagacatgacaaggacatccgttttattatgagtcatatggaaagcactggggagcgttgcataaaagagtaatatgatctggctcatattttaacattcacagcacatgaagctgaattattcttcagtggctgaattattcaatggctacctattaaataaatacttaagttcatggttcttgatcctggctgcacattggaatcaaaggggacttaactaagaaaaggaaataataattcttgggatccacctcagaacaattgaatccagtctttgggaatgggccaaggcattgatttaaaacaaaaacaaaagcaaaacaatcaaaaccaaaaacaaacaaacaaaaaaaaacaaaaaccacaactttcccaatgattaagtgtgtagtcagagttgagatccattgtctagagcaggggttggcaaactacagcccatgggctaaatggcccatcatccaattttataaagcctcattgaaacagaactacactcactcacttacattttgtctaaggcaactttcctgatgcaatgccagagctgagtagttgcaacaaccacataatctgcaaagcctaaaacattaactatctggctctttccagaaaacgtacgcctgcctggcctacagcagtagttcttaaatcaccagggaactttgtaaaaatgcaaaagcccaggccctctcctacttccatgagcctgggcctctgagtctttattagctccctggggtgagtctgctacacaccaaagttggagaacccctgtcctgactgatgaggaagaccagagaaacaccaaccaaggctgagtgtgagtgaaaactgagctgtgcttctgtctggatgtccttttgtctctcattatgtcagcctttcccctcagggagctgcagattcaaacaggcttctctgcccaaactgacaaattgagatgtcacaagaaccatttcagctggtcttgaaagcaggggaaatcacagcctctgcatgttcgtaggcagcatacctggctgcagtcaggccctgcatgatgtacacaacatgcaaaagctggttatgttcttgggcagtatctatgaggtccataccttagtccccacagctgcctctcatgtggtgtcttgctcatgggaacagcccctaacacgtaattgctttagtatagtcgcacttggccatgaccatgcatcattagaacctgtatggagcctaaaataaataaacaataatctgatgcttggtctacactcctggggattctaatttagtaggtctgaggtgggatctagttagatggccgttatgcacagccaccttagctgggattattgtaggctctagaacctcaagcagtgacttccaaacttgaacatgcatcagaaaccctggagggctcattaaaaacacagattgctgggtcccaccctagagtttctgggagttctgtgtggaacccaagcaaatgcctttccagcaagttcccaggtgatactgaggctgctgctctggggagaagatactgagaaccactatttttgtgcatagggaggtgctaccatgaaaggtacttcaacaggctaagaagcttgggcttggttcagggtatttggatcctattgttaaaccattggcaagtccatgcagatctcagttttgttgtggatagttaccaagtccataggctgatagtcagataatttctcctggaaggtactgcggaaggacaaaggatgatgaataaagaatgaataaaacaaagcctgaggaaacaaagcatttcaaaatggaaattattcaaagctcctttaaaacccaccaccagtgagaacctgaaagcataattatataactcatgaatataattaggtgcttcccttccctctccacccacttctcctaaggctttgggtctgagagaagtaggagggggtcctgagagtctcagaactcacaacataatatcctgtcttcttctgttcttataaacttcctcaaaaaatagtacttggatctggctggagccaaaccccagagctccctgtccatcaattaatatttatggggccttcacaatgagctaagcaggcatataaaagacaacagtacctgcagactgtcattaagccaaagaagaacaagcacctggccttccttctcacaaggtgttggcagctggatggttgtgtctgggtcaaaatgaacattcagccactcagcccagaaacatctcttggacgctcactctgttgcagacactcccctaagcactggagagatggcaatgaacaaaacagacaccctgccccaacagaagtgagaggtgagaggttctaaacagcttgtggacaaggtctggtggtagatatctacactagtggagccccagtctggtgaccgggtcagccagtctgttcaaaggctgtctgttcatttcatttgtcccttcccataaactactactgggaattagacatctgacatgtgaaggcctgtgactgatggggtccaagtttagaaacgttaaatgcattgcctccaaggatgactcagatgctggttggatttccatgtatcttgcctaaataagattttcactctgaagctgtttggagccaaagcatccaaaactctccagagcatcttctctccccagcagccctgctcgccggaacttatgtgccagttcagaggctaccttgacccttgctggaatcttggagttctccaagatgttctccaagttctcaaaggtggctccttaactcctccaaaaaggaaatgtggttttccagtgtattgcgtgccctttttgaaaggtggcttagatactagggaacccagatccccagatctgagcatgactgttggccacaacagaagtgtccctgatcaggaccctgcaactgtaaggtgcatggaggcaggtgccatttttcttgtgcatcgtggcaaccccagcacatagcacaggacctggagctcaatgggctggtgaaggaatgaatcagaaacactttatggaatttgaagtcccatggaactctggccaagaaatctcaccacctcaagctcctcatgttaacctcaccaaggacacaatgcactcccattggagcatggaggtcagacatgaggtggaggtggtaggagtgggaatctaaatgaagaccatggaacaggagaaccggccactggaagacctagatagctgccccatgagggaggaaggagagaaatgagttgtgggctagagaaaaaacactgagtccacatcccttcctcctccaaccccactcccaaacattagttaaatggggagaataggagtcaattctgaaagaaaagaatttaaaattattcccttccaagacaatggacctgggaaaaatggagattatgagtgctgagtcaagattgagccccatattggaggtaaggagcaggaaggcatgaaacataaaagaaatagaatactcagtttctgtgttcagtattgttgtggtatgatagaagaatgttttaagcatgcatagcatgttagcacaaacatgttagctttaatgcaattcattatatgcctataatatatgtaagcaaacctaatatacattctgcaggaaagcaagaatcagaaaacaaggtaagtttgactgggcgtggtagctcacgcctggaatcccagcactttgggaggccaaggtgggtggatcacttgaggtctagagtttgagaccaccctggccaacatggtgaaaacccatctctactaaaaatacaaaaattagccgggcattgtggtgcgtgcctgtaatcccagctactggggaggctaaggcaggagaatcacttgaaccagggaagcagaggttgcagtgagtggagatcgtgccactgtactctggtcttggtgacagagtgagactccttctcaaaaaaaagaagagaaaacaagacaagtttatgttttcactgtgtggaatatgctttgttcttctatacctcgagatatttgcatgtgcttttctctctccctgaaatgccaaaacttcttttcctggaaaactcctattcaactttcaaaacttaattttcgtttcatttcttacctccaaaaataactactttccctcatggattaccatagcacccttaccctctaccatcattgaaaatatgagttaacatagtggttgaacttgttacccattcttctacccttcttgactctgagttcctgaagaccacgttcctgccctcttcatccttatctcttcggggcctgtcatgaagtcttcaatacatgatttttggataaaaaaaattgttaaagggccattacatgatatgtcagattggaacatccagtggggatgggggtatgtctgtatggagaaaaccgagttgctgtacagagttgaaaattgctccctgagtcagagcttccaagcaatgggaaagggggaagaccatatgtcaacactggctaagagctaccccaacattcaggaggccctctcaggaagcatggaaggtcacaggcaattggagacttgttctttttttttttttttatcagataagcacttggtggagtattcaaagatcagcaggtcccagcttgaactttctaaagaagtcatggccatataccctagatttggtacaagaatgtgggcagggaaaccaggattcagtttgccccttgatgacagacccatcaaatccactggagctccagtcttggcaaggcctccaaaactctatggggataaactgccccctccatcccactgccgggtgtctgagagttgctatttgagaaaatggtaagcaaaatgaaataagtgtggtatttaccgctgttaattaacagcaaggtgttcatgagtaatgttgtggtattaagggtgtggagcagtttttcttattgactccctcctttgcagggttataaactccaggagagttgttccctcctggctgaaacttggcagctggcctggggttcttcttgtggctggtgtaggaccggcccactcatcagcctgttgagatctgcctccctttctaccatagtcactgctggggccctgagcttctggaaaatgtcttattataagctactcatgctgtgacactggcgtttgaagtccctaaaacaacgaattaaagagtgagccttacatgctctagaaacatccaagttcaaatgaaggcacccaaaaagccaacggaagattgtctatgaagcaaacaaggctgtctttgtacagcaggtgggtgcaaaagtgttaaaccaagagccactctgtaattctcctggatcagtagtcaacatttttagcaaagattcccagagggttgcttcagatgagaagatttatcagggagtgagttgcggggtggtgcatcttttattttggattaaatttataacacgctctggcttctcattccttgaataattgaaacatcccactatgttttacacttttcactttctatgttttttcacacaaaaaaaatcattttaatttttctccccatcaataactctctgaaggaggcaaggggggtattgttactccaattttgcagataaagaaatcgaggtttagagaattcagatgaccttcctagattcatatgacagtgcccagtctcagactccatcttctgacaccaagcccagtgctcagattttccaccctaatgtcttctataaaaaataagagtcagcatttttctcccacctggtcccacatcctgcaaagctgactggcaagcaggttgatggcaatgtgttgtgacttcccctcttggaaaggaagtgttctcagtgagtggtgattctcttctgcttaaatttagagaaacttggttcagattggcttggatttctgatggctagggatccaagatgaagggtcattctcaactctcttaatcagaattttgatcagaggaaaaaagaacacaagagaggagacaactctgaggatcatgactagaccattatctcccaatcagacaaaggcaacactagcacaacctcctcaaagacaataatatggtacaaggaaccaacaaattagtaacctggagattttaattagtgagttgagaactagacccaacaggaactcctccctagaaattcttcctgttccaaccacctggcaggaacattcattcctatctggaaatgttttcaagaaagctggcaataaccagctcaaccagtcccatcctctaagacgaagggaagtaactcttggaatagtgaccaaagcccagctgacgactgcggcaggtcccagagacccatggaaaagggaaaggacattggtcacagctgccttcgatgtctttgtaaatcttggcagaaccatgcagaaacaaaagaccaagaaagacaccccagtttcaaacatggagatcgaacggctactcataattatccacctgaacagaattgcactaagagtgcataaagagatattttatttcctttagagatgaacgcaatatgctttattttgccattgctttcccttcctacctaaggcaatttggctcacatttacgtattgtgtattcctcaatctcatattacctgtggaatggaaaagagaagtgatgagaaaagaacacagcctgaatatgaaggacacagcatggacatatcatgcatacatgatctgtatgggatatggtccttggttctgtctcagagccctagctcaccaatgaggggaagcaatcctggaattcatttttatgtctcctgcatccaggaaatctctcgaccactgctggtcttcaagttcctcctaacctgtctcccactcctcatcttccttatcaatggttgcctccaatatggatcccacactttttttctcagggaagccacccttcccctcactccctacttattttgtaccttgcaatcttagcatcctgctgggtgctaatgaagcatcttacccacatgtgtctgaaaactctggagaaagtgagtcctaagagtagggaagctggtgggagctcaagtttctgttaaaccctctttagtaggattatgcagctgatttgcttacaagtttcctaagaagcaagccttcttcaccaaggcaagcatcactgttattttcttagagatggcccatctagtcttacatgcacgttccttctgttcacatggtgtagaatttgtcccttttcaaaacaataaccctgggctgagtgtggtggtgtgtgcctataatcccagcactttgggagactgaggcaggaggactgcttgagcccaggagttcaagaccagccagggcaacatagtgagacctcatctctactaagagtttaaaaaaaaaattaactgggtgtcttggtgtgcacttgtggtctcagctacttgggagactgaggcaggaagatcacctgagccctggagatggaggctgcagtgagctctgattgtaccactgccctccagcctgggtgagagagtgagcctgtttcaaaaaaaaaaaagaccgaacaaacctggaatttttgttctaaaatgtatttgattcctttcagagacttccttgtataataacagtatagtatgaacagatgtaagttatccactggaggtgggtagtgacagttacaattagataatgctgatgacctaatctctccctagtttatcccactgcaaactgataattgagaggtggcttttcagagtctttatttctgtgaacaaagcttaccttgaacttctcatgatgacatgaaatagaagtaaaagtaacaactaaaagagccctggacgttcccctattgtgtgatatgttacattgctgcaaagtgacaacaagcaagacgtaagggttttatcagaaaaggctgggctggctactcacatcactcgatggaaaaattagtcttttctgcagaggatgaatgctcttctcagctgagctcacagacgtggaagagttgcgcatttaaccaaaagaagtggggggtggggaagttcacttagccagccagattattcaaataaaacctgtgatcagcgggcagctgatcattctcacatctttaaacaggtatgaataggttacacaaaatagaaccgcaaagtaatatcaccaaaagggaaacccatgagagtttaatacatccttggaagaacttcaccaacaaagcaatgcttgcagggcaaagaactatcccatcattcacatgatgtatttatcatttgaaagccttttcacatctctttttttttttttttttttttttttttttttttgagatggagtctcgctctttcacccaggctggagtgcagtgggtcaatcttagctcactgcaacctccacctcccgggttcaagtgattttccctgctttggcctcccaagtggctgtgactacaggcacccaccaccacacctggctaagttttgtatttttagtagagacggggtttcgccatgttggccaggctggtcttgaactcctgacctcatgtgatcggcccgccttggcctcccaaagtgctggggttacaggtgtgagccaccacacctagcccacatctcttacttttttttttaactttacaatctgtgagattcatggtgacagtattattatttatgtgattcgagtgataaagtgaacagcaagtgtgattctttcatggtcacataacctcattgaggatatgtccacaattataatccacatcactgaaacttgggtttgttttctcttcccagaacataaggttctatttagcttatgccattttggccacccctctccaagtaaaagaagcacctttcccaagctatactaagagaaataataacctggaagtgccttggcctcctgaccttaaggcacccttgtagatgttgacaagcatttgccaggataaatgaaaaggagagggtgcccatctccccctcttctcttttcatgtcctgtggttattattctgtgatgcaggtatttcagcccctgctgtaccaggcaacaggattagacaggttagtggagcatcagatttccgactgttaactttttcacttttcttctctgcacgtaggcttgagaactgacaccaagacaggaagagggaaagtgatagaggcaaaacggaagattaaaagctgatagacaactcagagagctagagggggagtcagaaagtatgaaggcagagacctcaagggatctgatgcagttaatcaaatagtatgaccttgtagctatgtcagtgtctgacctgggggaatctgaaggagggaggggaggagagatttagatagaaaccacacatgaggagagtaaaaggaaagtaagtcttattaaaggtgggagagtcagtactagctgttgaaacttatgcatcccatttcttggatgagaaatagatagcatttattgagctaatgaccatgtaattaagctccaatgagttaagcttaagctgtagcagggatagagcagaggaaatgtaccgagaaaggtgcttcaccaaaaacaaagttgattaaaaatgagatcaaatgatccaagagtgcattagaagagagaactcaatttattatccaaatgaaaggctgagattgactcctgatagccctcttaaacattaaattccacaattgccatgagtaggagatggccctcaagcagtcatgggtcctatggtaaggtcacgctaaaagctgaaaggacctgcggatggtcaagttcaatttcttcagtatcatgaggaagaagggcactgatatggtttggatttgtgtccccacccaaatctcatgtccagttgtaatccccattgttagaggagaggcctggtgagaggcaattggatcttgggggtgggtttcctcctagctgttctcattatagtgagttctcatgagatctgattgtttaaaagtgtgtagcacctccccctttgctctcttcctcctgctcttgccatgaaagacgtgccagcttccccttcaccttccaccatgattgtaagtttcctgaggccttcccagaagtaaaagcctgtgcagcctgaaaaaccatgaacgaattaaacctcttttgtttataaattacctagtctcaggtagctctttgtagcaatgcaagaatggactctcataggcaccaaatttggagtgatacactgggtttagttcctgaatctctctttcacttgcaatgtgacccttgggcaaaccatttaagctttctgatcccaatttctccattgcgtatgacacagatactgatgttcaatgtgagcatcatacctatggaatgtgagcaagattactcagtgccagaaggtactttgtaagcgttggcagtattcagttgagaatgctgagacccaagagatgaaatgatgctcaaatggttacttaaatagtcaagaccagaacatgggtctcatggctaatgtcccttcctagttgagaatacagtctcaggtgtaacattataaatgttactgtgtggtgatttgttgagacactcccatttgccctttggattgagcagtgaacaaaccccaactccattgccaactcattttcttcccacttatcctgagagcacagaagaacagtgcttgccccagaaatcattacggcagcttgccccagaaatcaatagggccgcttcccattgtcctttgggaaccctctattccactctaacagcaagcaggcagtaataggtagcacaaaaagccatagcccctaggctaccagggtcagaacagaaatctgcaggggtgcagacaaccactgtgagcctgaggagttggcaccatcttaagaagagtattagaccagtcacatgcacttagtctttcttcttaagctcctcagaagactgtctggtgtcacccagaagccagctaagccataaattcacccattgggtgagccctagcaacctgtctaatcctgctgggaaacagtacatccggcccttgacagcactctcatgactgcttgctgagaagcggtattttaaataaagagagaaaaaaaaaacaccctattgttttactctggtaattgatagcaagtttctcatgagtaattttatagcactcagggtgtgccggagtttgatttaacttctctttacaggagcttcaaacctgcagtacaaacatggttttgaatgggatgaaacatgcttcaaagatccatatagatattgacatttcctatttctatggcccacatattagaggcctttctctccacttcttctctaaatgtccccttcacatatttgagatcctgaaagatctcaacgaattttggttctagcatgtaggtatctatttaatacatgtattctggcaattttattttatttttattatactttaagttctggggtacatgtgcagaaagtgcagttttgttacataggtatacacgtgccatgctggtttgctgcacccatcaacccgtcacctacattaggtatttctcctaatgttatccctcccctagccccccaccccccaagaggccccagtgtgtgatgttcccctccccgtgtccatgtgttatcattgttcaactcccacttataagtgagaacatgcagtgtttggttttctgttcttgtgatagtttgctgagaatgatggtttccagctttatccatgtccctgcaaaggacacgaactcattctttttttatggctgcatagtattccacggtgtatatgtgccccattttctttatccagtctattatcgatggacatttgggttggttccaagtctttgctattgtgagtagtgccacaataaacatacatgtgcatgtgtctttatagcagaatgatttataatcctttgggtatatatccagtaatgggattgctgcgtcaaatggtatttctagttctatttccttgaggaaatgccacactgtcttccacaatggttgaactaatttactttatagcaaccacagtgggattcccaaagtgcaatctaaaaattggttcctcaaaatattatttttaaaaggatggggaggggcttctgcagaactagttttagcaaattcacaatatacattagtgtggtgaatgctctgagaagtcctgcagaagacagccaagctcatcactaatttgaacacaaaatttcccaaagtaagcagaagacagaatttttctatgggaaactgcatacacacaaacacattctaccactttttaattttgcgttttttttttttttttttttgagatggagtcttgctttgtcgcccaggctggagtgcagtggcacaatctcggctcactacaagctccgcctcccgggttcatgtcattctcctgcctcagcctcccgagtagctgggactacaggcgccgatcaccacgcccggctaattttttgtatttttagtagagatggggtttcaccatgtattcaggagggtctcgatctcctgagctcgtgatccacccgcctcggccttccaaagtgctgggattacaggcgtgagccaccgtgcccggcctaccactttttaatttaacagtgatatctgatcctacagagctaggatcttgaggaacatgtgttgagaaacactgcactataagagaaggaaggaagtccagtcagtgctcaggagtaaaccctattctactttactcttgcttttgtaccccaattattcaatcaacaaacatttattaagtattcaatatgaataatgggcaatggaagatgcaaagataaatcagatatgaagaaacatgataacagcattttcaaaaagaatgtgatggatgggcctttgaaagatctcgttcgaccacctctgctatttaaataagaaaacagggattgaggtaaattaggtggttggtctctgaacatagaacaccatacaactcttccagtttgaagtcccttaagtagaatgtaagcatggactccaataaacatttggcctaaagaagaaaaaatggttctatatataagtgccatgagccaaaggtatctgcaaatattcccaaagtaggggatttcaaatcccatgatttttagggaagggcagaaatgaggactgcatatttcggggaaagacatcaaagaggaaatttgatgagccagaggtcctgcattgaggaagacattgagttagatactcaaacctggtctctgggccaagaggaaacaggcctctggttgcagcattcaagtctacttggtaacttccactacttggtacggccatgggaatgccctggagttgacaagagacactgcccttgatctctcacagtggacactcagtgccttcacagattcacagctgagctcttcatggctttatttatttacttcattgcttttgatgagttgcttataccttaagtagggattattcgtttagtaatgggatttttcttctctccagccctgggagagcttcttcatcctcagagctttcagttatggcctatggactggtggttcccatatttataagtcaagttctaaacttttgttcgagcttcatccctcataccccagctgcctgttgggtggttttcattagtccctaaacattcctctgaaccttattatatccaggttgtcttctctcaaaccagcttcccctctcaatttccctatatcagtccatgaagccattttacatttttttcacctcctcattcccatactgttgggtactcagttttgaaagcatggaactttttccctctccttttcacttctcgtagcaataagtaactaagacatgccctttttctttgaaatgtttatctattcttttctttccctttctatttgctaccaatatagatgaaatagattttaccccttctggttgaatttacagtcgtctaactccaaggccctagtcattccctcttccaatccatccatatgatttctataccaggctgtgccacttcagttgttttgttgaaaacaaaacaacaaaacaaaacaaaaacagatgctctggacactgtatttcaataaattctctctgacatggtcagaaactatgacccatttgctgttagtggccactcaaagcaagtaagtctctgcaatcacagcatgttctgggttcatccacaatctcctcatcagccacagtagccccatctgtttcctgcctaccaagtgccagctatctgctcagtgcctgttacaacactatttttttgtttgtttttttccctggctgaagtgcagtggtgcaaacacagctcactgcagcctcaacctcctgggctcaagcaatactcctgcctccgcctcctgagtagctgggaccacaccgggctaatttctgtatttttataaagacaggttctcgctatgtgacccagggtagacttgaactcctgggctcaagcaattctcccacctcggcctcccaaaatgctggtattacaggtgtgagctattgcacccagccaatacaacactattaagtatctatcactatacgcttttcatggaaaagaaatcttccattgacatctaaaatccttatcaaaaagtgatttccagcttccccattaatatgaggtacaaataacattcaatgtgccttaaaatctgtttggatatatatcattgcctatatatatttgaacattaatggaaataatcatataatttggaaaagagagaagtgaaatgcatgtctcttttagacaaaattggaggtagcaagtagagaaaaacatgaaaagggctttaaaaaaaggtggtggcagggaggtaggcactgcctgtttaagacatgggcactacccattagtgtgttagaacctgttgttaatggaaaactcccaatcaataaagtggttttgcctaattttgcatttcggaaaaaagtattagagactcccctaagccaggctgtttcagcagggccctgtcaaactctgcactctctccacagggtagagttcttggacccctccccattttactccaacaaggctgtccaccttcccgttggccctgctgagccctgcaaatcactctaggtgcacctgcccccagcccaccagcccaagaaccacaaacccagctgaggggacgagtgggattactgcaaataaagtaaagataatcccaggcaagaaccttttatccaggaaaagactccatcaaatcatcctcacagctcctcaccatctcctcttaataacttgcatgccagaatgttacaaagattaaacctgttgaggaatgtgatgctttgtagccccagcatggagtgctttgagccaggggaggaggggcaggtggagggcggtgggtagcaaggaagaaaagaggagaagaaagcaagacaaaagagagtacactctgcaatcattctgctaaaagcctttgttcagccggcacattatttggtgatctagacgaggcataataaggcactttatctgcgcagtttattgtgtgtgtgtgtcataggtctacgtgtatattactgactgtaaaatatatataatatgtgccaagagagagaagagagagtgtaaacgatctgactcagtgagcatttgctttgtcggaggcaagctggtcttctgcaccaaaattgtgattctcatgttaaatcaagcagtgatatttgagaaaaggccatttcatgaagtccaaataattttaagataataataaatggctatactaattcctgtcttcaagagcctggacaaagagcagtaataagactctactggacatcaagcatagagtttattttctggaagttcaatgggtagcagagagatggggcaagacaacgcccagatt

SEQ ID NO: 498 - DNA, 40001 bp, Homo sapiens
actgagagtggagtgttgctataaagatacttgaaaatgttgaaacagctttgaaattaggtaatgaacaaaggttgaaagagtttggtgggttcaaaaatagacaaaaacatgacataaagtttagaacttcttagcgactagttaaatggttgtaaccaaagtcctgatagaaatatagatagcaaagcccaggctgatgaggtttcagaggaaaacaaacacttattaaaaactggagtgaagatcaccctggttatgccttaataaaaatctgggctacactgtgtctatggcttagggctttatgagagacaccacttacaagtaataacccaagatatctggcaaaagaaatttctaaacgacaaagcactcaaaatgtggcctgggtgcttctaacttcctacgactagatatgagaacaaaaaaacgacttaaatttaacacttataattaaaaaaaaaaaaaaagcagagtgtaaaaacttagaaaatttccagcttggccatgaggtagagaacaaaagtgcctttccagtgagaaacccaaggcacttgtaagataacctcctgctagataaatttacatgactaaacgggagtcaagcacgaataacaaagacactggaaaaaaaaagacctggaagacatttggaaggtctttggggaaaatcccttccatgacaggcccagaggcctaaaaaatggttttaggggccaggcctggatccctgctgccctctgcggccccaggaggctgctccctgcatccctggctgcttcagctccagccagggctcaaagaaccccaggtaccattcagggctccacttcagagggcatacgccataagacttggcagcttccacatggtgaagcctgcaggcacacagaatacaaaagtgaaagaggcttggcagcttcctcctagatttcagaagatgtattaaaaaacttgggtgcccagacaaggcctgccacggggcggagcccccacagaaggcctctgctagggcagtgtcaagcaaaaacgtggggttgaagctcccacagggtcctcaccgggacactgcctggtgaagctgtggaaatggggctaccagcctccagacctcagcgtggtacagccaccaacagcttacaacctcaacatgaacaggcaccagactccaacccgttaaaaacagccaggggggctgtgccttacaaagccagaggggtggagctgcccaggccttgggagcccaaccctcacaccagtgtgcccaggatgtgggacatggagtcaagagagattatttcagagctttaaggtttaacacctgccctgctgggtttcggacttgggtagggtctgtcatttctttcttttggttgatttctcccttttgaaatgaaaatgtttacctcatgcctgtaccaccattgtatcttgaaagtaaatcacttggttttgcttttacacattcataaatttaaaacaacttgccttgagtctcaaatgagactttaaactttttgagttgatactcaaatgagtttagactttcaaggactattggaaaaaaatgattatattttacaatgtaaaaatgacatgaaatttaggaggccaggagtggaatgatatggtttggatatgtgtcccctccaaatctcatgtggaaaccggatcctaaatgttagaaatggggcctgggggagatgtttgtgttgggaggcagatcccttggtgcccttcccacggtaatgggtgaattctcgctctgttagttcacaagagagctggttgtttaaaggaggctggcaccttctccccctctctcttgcaccctctatctctctttttctctatgtgacacaactgctccctcttttctttctgccagtgagtggaagcttcttgagcccctcgctagaaagatgctagtgccatgcttcctgtacagcctatagaaccgtgagccaaatacacgtctcttctttatacattatccagcctcaggtattcctttataacaatgcaaaatggactaatacaagctgaatacaagatctgaaattaaaaatttattggatagatttaacagcagattgatgagaacagaagagtcaatgaatgtgaaaatagatcaataaaaaatacccaccctgaagaaccagcagaaaagaagactttaaaaaaagcccagagcctcagactggagatgaaggtctaacatatattatacatgaagtctaggaagagtcaggagtgaatgaatgcataaaaagtagttaaaggaataagggctgaaaattccccaaatttggagaaagacaaattgaagattcaagaggctcaatgaaccccaagcaggataaatacaaggagaagagtcgttaaacaggcgactgcagaaggaaggaacatgctttatcttcaaaccgctggacagcagggcccacctctctgcaggcttcatgtacttttgtgatacatcacatgacaatattgccatcgtctccctaaaaagtgcacacagggggcaaaggttgaaaaagcacctattatgtgctaatggcctttgtgtatattttcttaatttacactcatagtaaccacaagaaccaggaactgctgtctccaagttgttttattattaattttttaaaaaccaaaatcagcactaaggctcagagatgttgagtaactcacctaagatcacacagctagtagtaagagatagagctggggttgaaagcctagttccaaagcccatgttctttctttctttcttttcttttttttttttttttgagatggagtctcactctgtcgcccaggctggagggcaatggcgtcatctcagctcattgcaacctccgcctcccaggttcaagtgattctcctgcctcagcctcctgagtagctgggattacgggcgcacgccaccacacccagctaatttttgtatttttagtagagacggggtttcaccttgttggctgggctggtctcaaactcctgaccttaggtgatctgcccacctgggcctcccaaagtgctgggattacaggcgtgaggcaccgtgctgggccccatgttattttgtattcgtgcctattaacccttgcagcacattggaatcacgtggtgagggatgggggtggggattgctttcaaaagcaatccccacccccaacgaattaaatcagaattagtcagggctgcatccaggcattggaatttttttttttcagcccctctgtgtgattttaaggtctgatgtggattgaaagtcactgttgtacactatgctgcactctgggaaagatcagacgagaaaagaaaactgggtcaatcccactcacattggtagatgggcgatgagaacccccgcaaaggtcctcagaacggagctccgagccttgatctgtaagcctgtacccttccttccttgtcttttcctgatctctaggagctacacggctgtcaccactctcaggtccagaagatatgggggtgataaaagcggccgaggagcctctctgcagcaggtcctgagttacgggaggctgcagccatggacacgggacacttactctgggtgaaggatgaggagcaggacctcagcgctctaactctttcaggcttcggctggggaaggaagagagtcaggcggccccatgactctccccagagcccctcgggacggccccccagagcccctcttggggagagactgggactgctgagcttggtggacacagggcgaccaccccaggggcccagccttgctacctcccctccctgtttacacccctgcctcctaagcacagcccggcctcaacatgcatctcctaccaccccataggagtggtagaccccgtctacaccgggtccagaaaccacacaacccataggttctgtgagctcctggctctgttttctcaaatcgcagcagagcatatgctcaataaagagcctccaggtgcatgtgagggtgggtgaggtggctcccactgctggctgggtgagcagttggtgccgctttgccatttgccactagattagcccaaaaatcaaaaagagggggacccacccagcacccctcttgtgatgatggcggtgatggtgatggtgaggctgatggtggtgatgttgccaccttccactgagcgctgactacccgtgaggcactgaacaccaccatcagctcaccgccatctcgcagccacccacaaagggcactgctttagctctgttttacagatgggaaggctgaggctcagagaagatcaagtccttgcccgtggcagaactcatatcaaagccaggtcagtctctaacaccggagccctttggaggggccctcttctacccattcctgtgttcttcctgcccctcactggactgaactgagtttagcccgaaatgctcctcccaggcctgcagggacatggctgacctcacatgctctgtgccccctttagggtctctgctcccctattcctcctcagcccacagcctggggtcaagggtgactattgtgagccctggtctggtcctgagtggctgctgggaccttcccaatgcctgggtgaaactccagagaacgaactctgggccagcaggagtttgctgggaagtggctgcaggaggtggctcgggttttttttttttgagatggagtcttgatctgtcactgaggctggaaggagtgcagtggtgcgatctcggctcactgtaatctccgcctcccaggttcaagcgattctccagcctcagcttcccgagtaactgggattacaggcgtgagccaccatgcccagctcgggtctctttctgtcaaggcaatgaagaggctaaggagggtgacagaggagccccctgagccccaggcatggtgggctgtggacccaaccaccggcttcctgcctcactgaggcaccagggcgaagacactgatattcagtactagcaaccccacagccagtagatagtcaagttccctgccctttccaatgcccacaggacactctgggtcactcagggagctcggtggcccacccaggcccaaccctgagcccatcgatctgggtcctggggggaacatgtgggagtccagcccggtggccccccgggcgctctaagcagcctgtgcctaatgaccgcagaaagccattacagctcacttagctgtaaacagctctccacagcactcattagggccgaggagctccgagagctctcctcctcgggtgtggggcatgtgcccagcgggggctacgccttcttactggaaacaccgtttcccgcccggcctgccttccaggaaaggtgagcccggctggggcccggccagcgccctgccctcccctgccctctctgaccggggtctgaccctccacaggggctctctcctccctgggcatttcccagcctgcaggggcccagggacaggacaggcagagccccaggtgcccccttgacaacacatgccgggctttccatggccaacctcacggcccacggggaaggaggagcgcccgcggggccagctcccctgggtgggccagcaccctgggcatgccgggccaggcgggtgcccacagagactcccctcctccctatgatggggatgtgcctgggaaagatggacagttctggggcctaaactgcaggcggacaagacctcggcattcagtgcaggtgttgtcttctaccaaatcagagctgtccaaatggttttagattcggtccccacaaaatcctgttgagggtcccaagagatataacagaggtaagggtggttgtcctcatctaagtgggggtgagggtggggtccacagcctgtctgttttgctgtttccctccctccccactttgtcctatcccctacctgccgtgagggctcagttatccctgtagaattctggggtctgcagacacagtttagtaaccactggcctgcaccacgcactgttttctgtgcctggagcgctccgacccctcttcctagccagctcccatccacccccacatcctgatggcaccctgtccccagccctgccctcccttcctctcatgccagcctccctcttatcacccagctcttcaccttcttagcatacccctacattttccagtgatatttctatttgtgtagttatttgcttatcgccttcctattccctgagctctgtagggaggaagaccatgtctgtttttgtctcatctccagcatgagcccagtgctaggcacacagcaggcagtccataaagattgactgactgactgaatgaatgaatggtctaagcatatgatgctcagcttgctggagaaggggcatcaacatcttcctatcattgaccccttctgtgtcctcagccctcatgactgatgtgtcttccatctactcctccaccccaatctggtcagtatctacttgtcctttatctttcatctgagatacttcctcccggggagcctcccagcgccgtcaaacacccagcatgctcacttgtaatggcgccttcttatctctttcttcctggaccaggaagcagagcacaggtgtctagtgtcaacacatgccaaggtgtccagtgcaggtgtgccacatgaaggaacgggtgactgccccatggccctgctactatggggcaacaccacctccttggaggctgatgacctgctcatataggatggggcctctccatcctccacttcctcacaatcagcacccccagacaccttcccaatgtctgagcaaaactctgcagagaacacactctgggccagcaggcggtcgttgggcaatggaagtgggtgcacgaggtggctcgggtctctctttgggttgagacaatgatgagtctaaggagggtgagtgaggagcctcagagctccagcgtggtgggctggggacccaaccatcagcttcctgcctcactgctgcaccagggaaaggacactggtacctggcactagcaggcccacagccagtagataggtcactctgcacccccttcccaacccagttccccagaggcttctccatctcaggaatggtcacctctacccttcacccagctgctaggaccccaaaccttggagtcgtcattcagtccatcagctcggcacatcctgctggctctacccgccaaacgcaccttgaatctaactgctgctcaccacccatgttgccatcaccctgggcagcaccaccaccagctctggcctggaccacagcctcctcccaggcatgcctgctcccctccgctccctgagccttagccccacatggcagccagagggattgatttaatgcataaattggatcatgccactacctggctcaaagcctccagtgactgccactcacacccagtcaaatccagagtccagactgcaacctgcaaaggcctgtgtggatgggcccctggctctcctgtgctccagcctcctctccacacatgcccaaccctgccctttatccgggccttgctctcaggggccctgggctccgccgtctctgcccccttccaaatgtcacctccccgaccatgaggaccactccagtgccactccccagacctgctggcttcttcctggccttcgtgggccctgtcccttcctgacactaccgctcacatctatgcgcttcctcactgtctgcctgacctcaggaatggaagctctgcccacatctatgcatttcctcactgtttgcccgaccctcaggaatggaagctccatgaaggcaaggacttttgtctgtgttgtttggctcctgtcccttcagcccctagaacattgcctaatacaccaataaatatttatcacatgaatatttatgtaatatctattaatttaggggtaggtgacacaagtatttgttacatgaatggatacttttaaatccattgttgattaattgatcagttccccttggttaaatttgtttataaaagaacatcagatccaaccctgatcacagctgacatcacgtgcatgcacatgtgtacgtgcacacacaagcacacatgcacacatacacgcctcgctgatcagccttattagttttttctctccctttttcccagtagctgcaacttcaggagactaccttgtgtgtgagtgcaggagatgggggtggatctttccctcaaggccagccctccccaccaggctcagctatcagccaggagacaaggtcctctgtgggcacaccatcacctctacctccccttcggaaccaaggcaagctctaaatgccttgcccttgcttccttcctaaacatttaatgccatactggccttctccacctctctagacactttctaccaccctggcttatgctagaagatcagatgctcctggtaataatgacccaagtacaacttaaccaagagggtgagtcttgagtcttgagaagtatgagtctctggtggaaacccagtggaacaccctagagggtgctgggtttggaggctataccaacagaccaagagttcaagtcttgcaccttagtagaggccagccctaggacttagggaagccatctgtcctctctgctcaaggtttcagtgactggttggctaaaggactgctcgtatagtctcagacaattaaccttccttgagcccctgttagtgggaggctgggctctgcctgggtttgggaatctggaagatgggcatatcccctgggaatcaaacagtcctggctctgctgcttccccttggggtgatcctgggcaggctgctgaagctccctgggctccaggctcctcaatggggcgaatgacacctgcatcgggaagatcaaagccactgctgagttctaatttgacctgggccatcctgtgacaactcttgtaatcaaagaaaccctgggttctccctcatggactccaaatctgccccaatcactccagggctctcagaaggagccactctgaaccagcacttcattctttcactcgttcattcaccaggtatttccagaacgcctgccagttccaggcatcatgtgaggctgtgaaaagtggcatagcaatgtggacgagagcttggattctgaggtagactcatttggggctgaagcactatctcttgctagccatgacctgggggcaaaacacgtaatctctccgtgccagtctgtactatatctgcagaatagagcagtcatcacagttatctcaccaggtggtgatcaggattaaacgagttaatatgtgtaaagcatgtaggattgcgtctggcacttggcaagtaagatatgattgttgtctttgtaattatggaattaaagttgaatagacaatctttgtgctcaaggagctcagcttagcgtgggagacagagcatacacagacaacggcaacgcagcagcgctagggctaggagaggaagacgaacaaaagctggggctgtggattctcacgaaggggcagggcctgctcttgaggggctcacagtctcaagggggagaggaggtataaaaagggagagcaaagtcaaccaaaattccacaccgtctgcagcccaatacatgcagcactgagctgggggccgtgggggatgacttcagcaaaagacacgcctgtggtgggatgaggaagtttgcaccaaggacagaggcagggcaactaggttcctattgaacaggaccaaaaggcagccaaattctcgaggcaaaaggggctgcctgggatgcctgggaggaaggtgagtgtgggaaagttaagatgatgaaatcatgaggatgggtgtcccaaggaaaggaagggaaaggcatcccaaagaaggggagggaacgtcccaaggatgagaaagtcatcccaaggatgggaaagagcatgccaaggatgggaagggtgtccccaaggaagggaaaggcgtcccaaggatcagaagggcatccccaaaaatgggaagcgcgtcccaaggatgagaggggcgtcccaaggatgggaaggacatcccaaggaagggaggggtgtcacaaggatatgaagggcatgtcattccaagcagtaaaatggcagaagcaaagaggcatggatagagaggaaagggctttgagggagagtgagccaggcaggcttgccggacacaggtggagttccatgagagagggtgagacatccaaggcacagctggctagaacaaattctcatcactgtccaacatcatggcctaagaaaatgcaactcaatgtactgcaaatacaaaattggtgcatgtaaaaggaacctcgtgatcacaggtgtagtacactcccccagagaggccagggggttgccagtacctataggtctccctcacccagtaggacttggccaagctattgttgacagtgaatttttacagccactgctataaaaccttcagccttaactaccttgctctgctatggctggcaaccccagggtaccactaatgctgccctattagcgtccaaagcattctgtgcaattctgagaacaagccctgattaccaaggcccccaggatgccatgggaatcgccaaggatacactgtggcctctgaacagcagaggcttcggagcgtgggagtggccctgctgccatctcccaggtcccatggcagcctcacctgcaatcccttccaggaagcatgtcccctatgggagggtccaggctagagaaaggacacggactggatatggaggtgtagaccccaaagagccttggaatgactgtcctggaagcagatccttggacctgaaatccgggtccagagatggacacagaagagtgaaggaatttcatccacaggtactgttagccgaggtttaggaacccataaagagacctgtaaagtcttcagtggaatttatccaaaaaaactcttaagtggaatccattggcaccaaagttccaggaccaatcccagttattcattttcttatttactcaacaaacatatactaagcatccaccccatcacaggcactgggctgggtcccagagacagacaggcagaaagctgacagtccctgcactcaagaagccgtaagttcagtgggggagagagggtccccagctggtgtggagagtggagggcaatagttctacccttcagggctgcgggcataggactgtttatatcacaggtcagtttcctccaggatatcaaggtgtccttcatttttaccagtgctggagtcagttctccctgagagaggcaggtgctgtgggggagggaggagaccatctctacctgggcgtgaatcctgctcctcccttatgagcttggtgacactaggtaaacccttgactttcttatgccccagtttcctcacgtgtaaaatagcaatgatgattgtctgtggtcagcagaatgacacctccatagaagtccatgccctgatccctggaacctgtgaatacgttctgttatgtggcaaagatggaattaaggttgctaatcagatgatttaagatagggagactatcctgaattctgagtgggaccagtgtaacatgagggtcctgaaatgcagaagaggacggcagaaggggagtgagtgtcagaacgacgtggcaggagagcaggcagcttctaaaaactgcaaaaggcaagaagatgggttctcctccagggtcttgagccctatggacatctttttttttttttttttgagatggagtctcgctctgtcacccaggctggagtgcaatggtgcgatctcagctcactgcaacatccacctccctggttcaagcaattcccctgcctcaacctcccgagtagctgggattacaggcacacaccaccatacctggctaatgttttgtgtgtatttttagtagagatggggtttcaccatgttgggcagactggtctcaaactcctgacttcaggcaatctgcccgcctcggcctcccaaagtgctgggattacaggcgtgagccaccacacccagcttgaacatcttgattttagcccagtgaggctcattttggacctctgacctcccaaactgtaagataacaaatttgtattgttttgagccaccacatttggggtcattttgttacagcatcccagaagctcacacaccacagtggtccctacctcccagggttgtgacaattaatgactcggtgacacacagcaaacagaggagtgtgattatttggggagctgggaggacatggttctgcagaccaggcctgggttgggggctcctactggagacagcatgaaggtcccggagcccttggcacagaggacactcaggtcaaagggtcaggggcagggattggggttgggccaacagtgtgagaggctgagttagctggagcacctcaggcagggaaggtggactcagcttatccacccagccattcgcgccagcccaacctgaggcacagtctaggccgaccccacttcccattcgaagcttcatccctgggttgtcacaggttgcctgagctccagccctcacttctctctctgcccagtgtctctaaggcaccccaaagtcactctgtcccagaccaagctccccacatcaccatctcaggcttcctctccagcgtggtctccttctggaaggggcaccccttgtcggccgggtcagggacccaggagccatccccacccctcccttcccctcggcatcctcactggttcctcctgggccctgccagttctagctctttcctctggtgttcttccacatctctccatccctattgctgcacgtctggcctgagctcctgccacctctgcctgccccttcaagagcctctcactcatcctccgcagtctccccaggctcttctcatcaccgcagtcacagatccaagtgatcatctcaagattaaatcctaccaggctttgggaatagagaccatgtttcttatcagggcccgaggggtcaggcctctgctgccctctgcaactttatggggcactgctttccagaatcttcctcatgctcttgcctatcacacagccctttggcagcaccctgcatcctcttactcaggcttctcgcacggtgctccccctccctgaagagtctccccgaccctcactgactgagctcacgtagcgcttctcaggaagctgtgatgggctgaattgccctacccaccccagaatccagatgttgaagtcctaacccctgcacctcagcatgcagcagtgtttgcagatagggtctttgcagaggtcactgaggtaaaatgaggtcagtaggatgggccctaatccaatatgactgatgtctttataagaagagattagaggctggacgcggtggctcacgcctgtaatcccagcactttgggaggccaaggcaggtggatcacctgaggtcgggagttcaagaccagcctggccaacatggtgaaaccccatctctactaaaaacacaaaaattagctgggggttggtgaagggcacctgtaatcccagctactagggaggctgaggcacaaaaactgcttggacctgggaggtggaggtggcagtgagctgagatcgcaccactgcattccagcctgggggacaagagcgaaaccccgtctcaaaaagaaaaaagaaaaaaaaaaaaaagagaggttaggatgcagacacacagagggaagatgatgtgaagatggccatctatgatcaaagagagacacctcagaagaaagcgacctgaagacaccttggtcttggacttccagcctccaggactgcggaacaattcatttctgttatggccatcctagcaaatgaaaacagacgccttccctgccccctcacctgcagtgggttctcctttctgttagacactcccgcctgcctcattcctctccctcttggcacataccaacgtgtaattacacagcctctgccaggctgcaaagccccctcttttcccacagatgctctgaggacatggtttgctttccaggccaaaatctgttataaccactccctggtgttagcacccctttccatggggcccccagctctgtactgtaccctgagtaaggctgttgccccctcgcagggacagccttcctgaccagcactggcttctccggaacaccggggctcacgccgacccagggccagcttcatgggcatgagatccatgtggtcacacagggccccaagctcagagggacccgtgcttggtttaatgttttgctgttgccatcttgaaattcttaatgccttcatctttgaacttgtgctttgtaagtgaagtggaacaatggcacatatgtgtaagcggaggagctacacaaagaaggaaaaaggttggtattttagtacaggctgagtatcctgtatgtaaaaggcttgggacccaaagcgttttggatttgcgatttttttcagattttgaaatatttgcgttatatacttaccactgaacatcccaaataggaaaatccaaaatctgaaaattgtgagcactgacatgacattcaaaggaaacgctcattggagcattttgaatttttgagtcagggtcttgctctctcatccaggctggagtgcagtggtatgaatactgctcactgcagcctcgaactcctgggctcaagtgtctcagccttccaagtcactgggaccacatgcccagctaatttttgtattttttggttttttttttcagagatagggtctcatcatgttgctcaggtgggtctccaactcctgagctcaagtgatccacccaccttggcctccccaaagtgctgggattaccagtgtgagccactgcgctcagcactttttgaattttagattttcagatttggggtgctcaatctgtacctttaacagcacttttgctggtctttcaaacacagactccccaagttcactttacactgggccctgcaaactaggtagccagtcccatgcccaaagtaggaaacgctccaggtcagctccccttaaactggtcctaaggctagtctcttcctcattagtttcttgggccttccacaggaaactctgcacccactctcacatatcatctttgttctggcacacagagaatctgggtctggggtccacataccagccccgcctgccccagcttggctgtgataagcgcaccttcaaggcttagaggcttttaggccctgacagcagtgggcgctgagctgtgacctctctctgcaggactgacagctattcatcagttggtgctcgctggaccagctgctgcccacccctgcatctttgcccatggcaggaggcaacactctcggaatgccagccttgcccagggcttttctcaaaggacacctcggggaggcagcccctcttctgcagcctgtctgcacctgacgcagggcctatttcagacagcccaggtcacccccagggcaatgagccccgagtgggccaggagtgggggatggtgttatttggggagggggcagacagccattggcagagccacctgagggtggtgtggcctatttaggagggactcacagcccacactatccctcaggggtcaggataggagcccttgtgagaactctgtctggagcctgggctctctcctgcatctttctacctcacccagggtgagacttgggactgggatgggatagggtgtggagaggccctctcgtatcttacttggtgccccactttgggctgagcaggggacagtgtctgatctatggcaggaagagaagagacaaggtagtgagtagggtacacactgcacaggcccgagcatttgggggcgctcaccacgcaggcatcagcatttgggggcacacaccacgcaggcatcagcatttgggggcgcacaccacgcaggcatcagcatttgggggcgcacaccacgcaggcatcagcatttgggggcgcacaccacgcaggcatcagcatttgggggcgcacaccacgcaggcatcagcatttgggggtgcacaccatgcaggcatcagcatttgggggtgcacaccacgcaggcatcagcttttgggggtacacactgtgcaggcacgaacactttgcctttttttcatgctggcaacagctggtgctgactctcagagcctgtggctgtgacaattatcaaaatgtttactatgtgtcactattaataatgtagaagccccgctagcctgccagtcagaaagagagagagtgatagccgaggggccaggctcccggaaggctcctgctcgctgcctgttcacccttgaccctgctgggcagcctggatgtagggagaggctgtgtcctgaatggtgccttcatctgctcttcttagccagcacccccagaaaggaacagaaccccttctcctcctgggtaccccccttcagcccttcagatatagggtctagatctgtccatccaagaagccttctggaagattctgtgctcccccacagcattgcactctcacttctgtgtgcagaagcgtggtggtcaggactcacgtctcgtcagcctccctgcaacgcccctctctgtgagctctttggggctgagacattcttccccgctagcttcctttacaaccctctaacgtggcaagtgccctcctgcctgccccagggcctttacacagcccgcctcctctcccaggacactcaccccctgcctctttgcataccaactcctatgcatcctttaggggtcagttgaaatgtcacctcctttgggaagccctactggaccgctcaactaggtcacagatcccctgttcaatattttcacagaatccttgccttatgggaccaatcactgtagtaatgaaagtttttaatcgaatgtctgtctctccctgtagtctgcatgctccctgacagcagaccgtggtttcttgcccactgctatcttcttagcatacagcagttaataaatatccatggatgaaggcatgaatgccaggaacaagccctgactcctgtagactctaacctcccatcttctctcccactcgggtgagcactttgggctgctgggggtctgctacgagggtggaattctcccttctggaacagtccctgcatctcgtgatgcatcccatctctattctaaggcatggccagctccccaccaaataaagagaaaggagggctctcaacaaccgcctctcacccactgagccactgcccccaaacctcaagaactaggatgaaaagttagaagggccaccctgtgcggtgtgccctggctgtgatgacagtccccggccctcaccctgttcacaaaccagcgaacacttgggcttgcatggacactgcctggagggaagatgcagggccaagagtgcttcaggctcagggtgagcacacgggtggtgggctgggggcagggagagtgccaggctgcctgcccccaggatcaaaggccctgagctccagatgaagggtccaggggctgaaattttatgcctggctctgccactgacttacagagtgagcttgggcagagggtggtagtgacttctgagcctcagtttcctcaactgtcaaatccaccagggatcagtgtcccattgacatgcagattttgacttccgatgataggaccctggccacggagcccacctggaatggtttccttagcagaggaaacttggggttgtgggatgtcggctcttggcaagacatcactcaaagctcacaaggccttctctagcagtacggacggagaggggagagcatgcctccagctccctgcccagtgggcacccaggcaggcaaaacacctcccagctgtgtcctgcacactggccaaccgagagagctgggcagttggcctggccgccgggacctcgcctgctctgcacaccttctcccagtgctaggatgaagtggctggcaggccctagcatggggctgggagtgagggtctcactgggctggccggtgctacaggggtgggaagctgccttggcggccccacctagcaccagcttttccaataaggttgttgctgtcggtagaaaagggctgggtgagggtcaccctctcagtgctttccagacctgagcgccctgatgcccgggtataggatgtctcccttctccccaaagagggaaacagtcagctccgagggcgggactgtgccacctccgccttgccctgctctccgactgtaggaggctttggagagagtcagcccctagcacgtacccagggagcaccttctgggaccagtgctggatcaaaggccctgagctccagatgaagagtccaggggctgaaattgtattcctggctctgccactgacttacagagtgagcttgggcagagggtgatagtgacttctgagcctgagtttcctcaactgtcaaatgggagggtcaggctccgcatcttaatggggtctcccagctgtgcttctcccccttctgcctgtgtccctgcagggttcccctgcctctcctgccaccacatccctggccctcgagtctctacaggagaagaggagtgattcagaacaggaagacgctcaggtcgaagcccgttgatttgttacaggtgacggatgctgatggccgttcatctgtggttgctgctgattagaaatcagtctccagtggaagattaaaggctgggggcagagtagggtccacacactgctcagggcttggtcctgctctctgccatggggaagtcagggggcagtgcccagcacacacaacagtgcccagcctcactgaggctgctcagacacccagcggggaaagtggtgctgatcctgttggggatgtgaggaattgaagctcagagaagttaagtaacttgcccagggccacacagctggaggcagagctgggatttgaacccagaactgtctcagaatgcactctgtttcccctatgccatgcgcttctcgtagtgggtggcagagtctagggcgatgagaagtctggagcctgtgcaaggccaggcttttctctgccatggagtggtgtgccacggataacacaggagctctttctgggcctcagttttactctctcttgtgagcaggaatcccccggagggggtgttaaaacatagactcctgagccttccccagatactctgttcgggttggtcctgagtaggtgctgcgggtctgtgggccacactctgaatagcacctactaactagcaagtctcttgggttccttttggcaaaaatcccccatctccatggccaggcggggaaatactggctaaaaccctgtggtgttcctgtcctcaccacccaccatcctccctcaggcctgactaccccctacactcagaagccacacacctttgagtccagggggagcccccaaccccacactgtgaatgcagctctctgtgtgagccaacagagggtggtagtgaccagaagggacttaggagccagcactgtgatttgaaaatgagcttttccacttcctgtgtgaccctgggaaagtaactagacccctctgagctccaatttccacgtctctaacataaagactggaaagacatacagaattgaatgtcattaaacggcacaccaagcgcatccatacatatgtgtgtcctaggaaatatatatataggatgtactcggaaagggacaagaaacggacagttggaacttcagtgggaagtgaagatcctttggggatgtatgcattcttactgcatgcttgtgttattcttccaaaaatgttctaccagcctcatgggctattgtagggctaatggaggtgatccctacaaagggttgtgcataaggcctggcatatagcaagcactggataaggtgttagctctcctcctcttcctccttctccccaccatgcctctcctgctggctagctctccctgccctcctgccattctcctggatggcactgcctccctccctcctgttgctctttatttatttatattctcttcaaaaggaaggggtgtgtgtggctggatcaattcatccatgtcgctcacttggctccacttccctcctccttccgcccctctccccctcgctgagaccaagagcgtaaattccttctggctattaattaaaagcagcctctcccttcgcgccagtgtactcgccataaattaatagcggtcttcttaatcaaatcttatctcctcctcgagccataaacatatggagctcaagttggtatctctgtgcacccagccgtgaaatttaatttctgatgcttcggtggactgcagggggtgggtgggtggtcttgtgttgggggccacccaaacttgagtcccagaaccagacccctggtcgaccagctgggttgactcaaccacctcccatgacgtctgcaggcaaagcatgtgtgactctttaagcctgaaggtccagcagtttcgttgcatgattataatcgttggcattctaaaggctttcagagattttatctcatccgattctcatgcaagctctatgaggaggaataggttgggaatatgagccccattttagagatggaaaaactaagtctaacatgttctttagagtcagatctgaatggaattcctcctctgctgctttctagctgccactctgaccctcagtttcctcatctgtccaaggggaaagagaatgcctcttgcagctttgaagtgcgaatgggattaactgtcatatgtaaagggctcggtatggtgcctggcctgtggctgctgcacagggtagagatattccactaagtgacctgcccaagactatccacccagctacaaatcggcagtctgggccataggcttcaactcaaattccatgcccttggaattccatctccaggctctagagcctgaggtccccaggctaggtcccctaggcaaaatcagctcagctgccccctccttctggcctgtcaaatgcccaccccaagtacatgtccataagccactggcccgaggtggagccaggagcctggacgggccagggcagagcctggacagaggacacaactgccagccttgctccagctgccaagtaactttgagccaataccaactggggcgccctctggcacgcctctgtccctgggtcactccagcatcaccaccctacttagcagctgacagtctccagcaatttccctttggccgcagggtggctcgggccatctctgcacgttatctgtgttactggggcgtgactcatgtcatcctggtgcaggctcattcataaatgagacgggactctgaggccacttctggagctgctttgcccattcagagccgagctccgcagcctctcctgactcttccagccccgggggacaatcaccttcctatctgagacccagcgctctggcaaacagccctctttgtgcccatcaaaccctcaggcccgcttctctggatctggctcattacatttccctgaactggcttctcctttcctaaccacacaggtgcttttaaagtcttctcattgctttgtgagtctgtttttgtttttctgtaaaatcttgaagtctgtttacaattcttcacaccctcagggaggcatctctctaagaaactccctgtcctgttatctgctcttggcatcccattagccactcacttcaccatctctaaagcccaccatgttcataagactctagtccagtggttttcaaagtgaggggaggagggagtcccaggaacagctgaaacagcagcacctggaagcttgtaagaaatgcaaattctggcctggcgcggtggctcacgcctgtaatcccagcactttgggaggccgagcctggtggatcacctggggtcaggagttcgagaccagcctgaccaacatggagagacccccccccctcccccgccatctctactaaaaatacaaacttagctgggcctggggctgcatgcctataatctcagctactcgggagggggaggcagaagaatcatttgaatccgggaggtggaggttgcggtgagccgagatcgcgcctttgcacaccagcctgggcaacaagggcgaaactccatctcaaaaaaaaaaaaaaaaaaaaaaaaagaaagaaatgcaaattctgggccttgtctcaggcctgatgaatcagaaattctgggtgtggagcttggcagtttgtgactgagcaagtatcccaggtgattctgatgcacagtgaagtttgagaaccagtgctctaggctgctggttctcatcagggccaactcaactttgccccccaggggacatctggaagcatttttggtcgtcacaactggcatctagtgggtagaggccagggatcctatgaaataccccgcagtgctcaggacagcctcctgcggtgctcaggacagcctcccctctaagaacaatctggcccaaagtgtcagtagtgcggagactgggaagtctcgctgtgcctagggccggggcggcacagttccagggccaatgcacaagcacagcagctctgggtgacaaccggacaggcgtggggcacactcctctacgtggcgcaggtgccatacgcacttcattcctgatggctcactttacagaaggcgccagatgcctgaagcacagagaagccactaatccgtgatctcacagctggtgagcaccagggcagggttagggccccagagcaagtgaagccagagccggggtcctccctgtgatgccacgtacttgaccttgcatggagagaggcttggttcttactaaatgatctgttcgagcaagaaagacaaactgcaggcatcacagtccctgactcactcagtctagtcagtggctactgtatgctcctccctaagccaattattctactgtgtgctggagtagtcccaggatgcaagaaattcacgctccagctcacagtgatgaatgcacgtgagtgcaggtgcacacacaaacacacaaccctgaagggcaaggagatgtctcttctagtccctcccaaggtgcagagttgtaggtgctcaaagcattcagaaaaatagaatgggaatgagggtgaccctgttggggagctgggtattgaggtgtggggcagatttgcagagctgggaaaagaggccggaaaaccacaggcaagggacgtggccttggagttggacagatgtggctctgaattctgctccaccacttccagcagcgtgaagcttggccaagctgcttactccacaagcctccatttcccaatctgcaaaatggggacattgctactggctccgcagccttaggcaggataaaaggggaagctcagacaggcactctgcgtcactctgtcctatgtcagcatcagctggccctgaccaaggataatgctgatctggtcaccacaggctggaacccaaagtggggtgtgaaatcggacaaggcagacaagagagcaataagcctcatccccaggcagcaggaggcaagccgcacatttggttttgagcagccccgcagagccactgcggattagcaggtgttacagaggtgctgagtgccattagcacctaattacgcctttgtccttgctgtaatcaggtgaacagagaagggactgaaaaggggagcgccttaaagagaaagcaagcagctgtcaggcaggaatctcttccaatgtgtccactcctctctagaatgtggcctccttcccacggccagagggcctgggccattcaggtggccagaaaggatacagccagttacagactcttacatgctgcctcttaaacccacacggaatcgaagtctgggctcatcaggaaacagggagccgatgagggcctttgagaagggggaggcaattgacgaaagaagacatttagcaagacgagaattggacggctgtctgcagggtggatggaaaggtacggctggaccagaggggtcagttcggaatctgttactgtaatccaggcatgtgctaatgcagaggagtaccaggaacacatgagacttgacaggacctggcaaccagcacctccttccccggcattcgcttcccctgtcggagatgatgctggaaagctcaaaggtcccacaagaagcacagcagcaacttgaagctgactttgctcgttgccaagacccgcaccacctgctgtgcaacaccattgctctgccccgtctggctctgggctgctccttcagaccctggcctaagtagtctttaacagggcacacctggggaaaatacaggttagtgactctaagtcttcaacacaccctgagaatgaccctgggtggcagacgcacctgattgtgtgttctgaggtggggaatctgggcatggccaacccggagagtcactccttgtctatgagaaacatccgagccctgggcccatccagaacatgggctgtgcatggaattgaggccctgagttttgggttaactgaaggttgccaggtagaggttgttaagggtagagtgttaagtggccatgctatgtaaactggtatgccctttccaaatggttgctgttttcctgcccagactgccaccaccggactgtaggaaggcggacatcttatccagctagctgtcattgaactatttatttgtttatgtttatttatttatttttgggacagagtttcgctcttgttgcccaggctggggtgcagttgcatgatctcggctcactgcaacctccacctcccaggttcaagtgattctcctgcctcagcctcctgagtagctgggactacaggcgcctgccactacacctggctaatttttgtacttttagtagagacagggtttcgccatgttggccaggctggtctcaaactcctgacctctggtgatccacctgccttggcctcccaaagtttggattacaggtgtgagccaccgcacccggtcttaactgtttctatatgtaaggcatttctcctgtccagacagctgccactggaccctcccctggatgtaagcccctaataaaaccctatgtctcctttgctggcgccgggtctcttcttcagcttctcgaacctggtgccttccctattgaggttaacagggtttcagcacaacacctgccctgagctctctgctcccccggccaccagcacactcttccgggacgccacagtggggttgccagatttagcaaaaacacaaacacaggatgttcggttacacttgaacttcccttcagacccaaggctgttagagttggggtttgcaacagtgcaaacctgtaggacgtgtagaatactctcgcaaattggggaatgctggtgctcaaagatgaagcaatgtttatctgaggtccaaatttacttgggtatcctgtctcttatctggcaccctatctacttggagatgcaggtttacaagaactaggacatggcatggcgaaaggtatgagaggacacaaggagacctggtccccatccagcaccccctactcatgcaggcacatgactgagctttgcggagatgcttatctgtggggtggggcaataccagagggcagccatcacgcggctgtcaggaagcctcctcatcttcaaagagcatcaagcactaaaacggtaagagtggccaggtctggagtgcagcggagactcgaggagagataaaaggctgccaagagcacacccagcctctctggggacgtggggtacgtgctatgaatgcaccttgcagtttctcacccacatgaggggggagttgatctctgcggtccccttcagcttaaaaacctcatgctgatcccaggcttccggacttcatctgtcaataacgatgaatgcagggaactgcagcctgtctaccagtagcccttgcaccacagaaaaaggaaggtaaatccacaactggaagaaagcatcatgggctgcaggccacagccatgcctccgtgggcctggcactgtacacttcttggaaagatctaggcctctcggcccccatcatgccgaaattagaggctggctccgtgtggctgcattgcacctgccagcagggttacacctgtatgatcagaaatgtgtaagagcagattttactggactaataaaaattaaaatgaccaaaatggagtcagaacccagccaaagagggagtgtgggagggaaagagtctccagctttttattttttaagcaggccaaccacatggaggtggggacgacttcttccccatgcccccggcagcacctccagccatctgtccccaccacctcctggcctggttagctggcttccagaaatgtgactgtctggagtctaaccggggcacaccaggagctgtcaccctgagtcaagcctggggcatgaagacaggaagagagggccggggaagcgcgaggacagggaccttggtggctggctgaggatgctcagatgacgggaagacggaacagtcaggcacaccctggcggctccccatttccggaaggaggacaggaacggaggtccagggagagcctattgtaaccaccgtgcgtgacaccaagagctttggggaatctacggaatcaaagagtcacagacacatggcctggccacatgcccgtctcccaagcatatttcagggtttaacctcagctcaccccggtaatgctgtgtttgcagcgcatgggggtgtccgtagctcgccggtgtcacaggatcaccccagagtggtgtgggacgtacacttggagttcagccggtccagccagctcattccccattcgaggcccagggagggttgggtgggggggattgtttctaagcttaccgcgcaaatgccgtccctcctcctcctccccaccccagctcctgctgcaggtcttccctcgacaggctgggtaccccaccccaccctctgcctacgtctgtgccactggggggctgtgttcagtgtggatgtggggctctgtggtccttctgtcatccctggatccagagttactcctgggggcccagacacctctgtaattcaagttgctgggctactgtgaggcccaaaacgtttgtggggagcagagaatgaaggagcctcagcacccactccctatcctggccacaagagcatccttcctcctcattgtgcaggaaacccccacccaaaggaacagagatggggtgtggggggcttcccccagagaccatgaggcatgcgctctgggccctggggtaacctggacaacatttgcctctaagggaccaggagtggcccaggacaatagacccagaggcagaacacctagcttggaagggccagagccccccagggaaggagcagatggtacctcaagctgaaccccttctctgcagtgcccccccaaagtgtgccactcacatgtttactgatcagatttggggtttctgacatgcagtaatcggatcacggaaggtgttaactggattaggcagaaggcttccaggagacaccagctgaaagtggctattaaataacacaggggcctgggcggcagggctgaggggaccctgcttcctcagccctcttcttcttttgtccctggctcctcacttaccctccttggccatatctcactgtccgtccttctttgagcactggccatgtggccgagtctgtgttggacaatttggttgcattatctcctttaatccccacagggaatttacaaggtaggtttcaacctccccatgtaacagaagggaaaacagaggcttggaggttaagaaaatggccccacaacccacagcaataaatatgtctggaattccaatccagctttatctaatatcgtttccaactcaaaaactgtttccccaaacctggtcatgtcaggcctcccaacgtctgggagccagcaggtggttcactctggccagcctctgaggctgagtgttggacagcgggaaggcggcattgatggggattcgtgggctgtaggggaaggtcagccactggacagctccctcgacccttgaccccctcaggctggggtgctggccttcccccgggcagcagctgagggcctgagtctcatgtcctcagactgctccagatcagatggtctcaagcccttctcctgagtataaagatgcccttccctcccccagtgctgctccctaagaccctagaggcaagaacttggttgctcccctggaaagtgttggtggtggggatgaggagatgggaagagagggagggggagagagagagagagaatatattagatatcacagaagcaagctggagtcccagcaatgtgcttgctcctgcaagactccctgcctgcctcatgatgggacaatgaacacacacacacacaacacatacaaatacacacagaacacacagaaatacacccatagcacacatatgcacacatacatgtaatacatagcacacatatgcacacaaatacatgcacaaatacaaatacatgcagcacagatgcacacaaatacacttagcacatatgcacacacacaaatatacagcacatatccacacacaaatacacacagcacacagacacacatacaaatgcacacatagcacacacatgcacacatgcaaatacacacagcacatacatagcacacacctgcacatatacaaatacacacagcacacacctgcacacagcacacgtgcacacacacatacaacaggcctcactacctgcctgcttcactcccccagcccttgtcaccctctgctctgtggatcacctcctcaatcagaacgccatcaccacgagaaaagacttcggcctgtttctgttgtttctacctctgtacccacagctcctagcacggtgcctgaaataagtgggcattgggtgggcacttgctgaataagtgaagccatgagccacagaaggggtgtcagtgagaattcgagtgtgggtgaaggtgaggaggaggaggaggaggagggaggaaagggaggtctgagagatggggagaggcaggcctgggggagagcgtggccctgtgtcggagagacagagaaatagagtcggggtggccacaggtaatgaatgccgtttgtggtgagactctcttgccctatggctccagattgagggggtgtcccaaggatgtctgggcacaatattggtgtgtgccagggcctgggaaggaggcccttgtgcttccaagagatcccacacagcaccagcctcccacacagccatgagtctgggccctggaggggacccagcctcgggtcatcagaggaaacgctgtctcctcctcgcttggactggccagtggcacaggctccctcctagggaggtatggagtcaccagaaaggcagcctggggcccaggccaggcccagatggccccagctgttcaccacagccccagggcaggcaggaagctggggtgcggggagtagccgctgacccactgggaaccagcatgcagtttggaggggggcctggtgggggcagtgtcagttcaaggctggcatccactcctcaccggcaggccctggcaagggcctatcctccctagaaggcttggaggcagccaggggggctgagaggggccaggggagctgggaggacaggctccatcctgtggggctccctgctgcctagaagcagccatcaagcagcccgagagtgtggcagacatggcttaggcggcctgatggagaagcccttgacacataggattgcagaagtcagaggtcttggccttagggggatacagtgaggcctcggcactcccagtcttatgtcccaggcagacggccctcacctaccccctgtgcctgccccaacacgtttgggctgtcctgggcagggatgcacacacagggagtcccagctgcaggtggtggtagcctggagacctgggtcctgggcagctttgggacagagccactgggcaatctggggcggcaggggtagtggagagggacccgcagggtgagtggggaggcagtggcgacctctatgagagaaggcagcctggcatatggggcagtgatcagggcaaggtgtcaacacacctgggtccccactccaactggggacctggaggaagcctcctcccctccctggagaggggcatgacacggtatgaacattggccggagctccagtcaacctctgcgaccctcagtttcctcatctgcataatgggtttgtgtgaatgtacgaaaactcctatcagtgcattttacttctcaatatatttctgcatatacatattctgcattctctctggcctccctgtcccagcgtcccagcctctgaaagggggcgctggctcatgatgtatctgtttcccgcagtgacatgtccccggaacccacagccaacccccttcccagtggtctctgatgttccccccacccccagaagggagatgaggaggagcagaaacaggggacacaggacagggtggctggttccagcctccccgaccctcccagctccactctgatcttgtggcctctccagctctcatcctccctccatggcctccagatgacaagtccctggggatagctccctgccatggctggcggtgtctgagcaaaagagggagatgaagctggcttggaatgggaggtgctaaccttgtcttcggagttgcccgcttgctccctccacccctagtccaggatgcgcaggcagaaccccggccatttccattctggggactctggtcgggagtccggcgccctaggaatcgtctcctcacttcagtctgaacctgctccatgcccagggaccgggccagtgcacctggactcacctcatctgaatcatccctgtgggagtgcctgtcaagagccaagatgttcccaagctcatctgtctttctcttgtcctttaacacgtattctcctgatgggttttggatattttcattctccttcacctcaccggggccttgaagggtggagactctccctggtgctggctacccagcaccccactactgacacaagacggggagctgccctgggtggaagatgagaggatgcaatcagatttctggaagctgggcacaagaaacctgtgaccaagtctcagccctgccaggtatgaccctctgaccataggcaaattatttaacttctgtgatctcagttctataaagcaggggcctctcctgtgatactttgcttatagaactctgcgatgtggacgtatctgtctggaatagttcctgggctcgtgggagacacacaatcaacagaactatggacattaccgtcctgtctctcagggctcatggaacgacaggcttctgccgatcctgcccccagcccaccgctatccttataaatatgtattcataggagttttcactgtgtgcttctggactattttcttttcttttttttttttttgagacagagtctcgctctgtcgcccaggctggagtgcagtggcacgatctcagctcactgcaagctccgcctcccgggttcacgccattctcctgcctcagcctcccaagtagctgagactacaggcacccgccaccacgcccgggtaattttttgtatttttagtagagatggggtttcactgtgtcagccaggatggtttcgatctcctgacctcgtgatccgcccacctcagcctcccaaagtgctgggattacaggcctgagccaccgcgcctggcctatttcatttttatgatacccctacaaggtgaaatattccctttctacttctacagatgggaagagtgacgctcagagggtttgggtcactattctgaggttacatagccagctggtgtccgagttgttctcaggtgccccaaacctagaacttttccatcccatctccccagggggagggtgctaggatcccgtgccccaaccccagttaacagccaccctcccaccattcaccactgccatgactttggagccatctaagcatatacaggtgacaggagtaggccggacccacaggcagtttgctgggtttgggagactcggtgtggggcgtgagttcctagacgctaaccccctgtcctcctggctcaggtcgctgggtcattggccgacggcacctgtgcgggctcatgcagggcagctcagatggcacaggcctccctgacagccagctggccgaggcagccccatgcatcagccagttttgtttattctccagccttgtttatgactcgataaaatccataacacggacagtgcctgtctcccctggcttcccctctgcccggctctcgttccctggggatgcagctctgctctttatagaaaccacctgctaaactaggcccacctgaaacccatcactgtcagtaaatgaccctccaggagaggaagctgcccagtaagtgtgaggcagcgggcacgacgtggatcgctggcctttttctttacagaggttaaaaatagtcccaccgggagcagcccatccccctccagggaccacccctagctgtatacctatgtcccctccagcaggggaaggtgggagaggcactggacaggtgctgagaagacgtggtctggccagggcctggcacctgtgagctcgaaggcctcgtgtaagtcacagcacctctcctgctttccgtttccatttacacaataaaatgaatggatcaggcaccaagcgccggcttgcttcgatttttcttcaagtagtggaaccctttctttaagtaaaattttagacagatccccaatagatgagagtgctgaagaaaacggacttttccgggtaaggagcgagtggaaaatgtagcatccccctagaaagagttaccccttttcttgtttttccaactgaagtctccgagcttccagaaggctgaggctggatatttttcattgttgtgtcctgtgcaatgggcctggcccactgatgtgtctcttgtagtgcttagtacattcgtacagaaggaggaaggtaggtaggtaggagggagtgagaaaagaaaggagagaaggtgctgggcacggtggctcacgcctgtaatcccagcactttgggaggccgaagggggtggatcacttgaggtcaggagttcaagaccagcctggccaacatggcgaaaccccatctctaccaaaaatacaaaaattagcctggcgtggtggtgggcacctgtaatcccagttactcctcaggaggctgaggcaggagaatcacttgaacccaggaggcggaggctgcagtgagctgagatagcggcactgcactccagcctggatgacagtgaggttccatctcaaaaaaaaaaattaaattaaataaataaaaataaaggggagagggaaaagaggaggagagagggagcaaggaaggagggaggaaagggggaagaggaaaggatgaagaaggagggagggaggggaacacacattaagccagtttcttttttctctcacttcaagcatagctcaaaatccattccaccaccctaagccattcctctccatcctgagactcaggctaaaagcagaggctgtgccacagtccttgccaggcccaacctgttccccacttgcagggagctcagccagtggtctctgacacaggggcccaggctcctcagctgtgatggggggtccttcagtgaaggtaggtgccaagtcctgtctgccaacacagtcactctgtctcacacacctacggttatttgtcaaagtatgtgactgctgttgtgattaatacgctagacgtccatttaaaagtgatactgaacccgtagcagcccctcgtcactatgttttctcaaacagtggttgctaaataaacaaccacaagcacatggagatccctgactttcctggggaaaggggtccttgtgctggacaggaggggacctggtcccaggtggcctgagcccggggcagaccctcacccttccctggccattgcagctcccgccacttcctcggtcccatccagcagcactgggtttccctccaggagcccatggatggcagccgtgtgctgggccagaggccacatctggaattcattctcttcattaaattggtggctgtttcccaagctctggctctcttgatcctcccaaagccctgttcgtgctgctaacaagggcagtaatttgttcattaaaaacgggacgccttcccaacaggcctccctggcttctgcctcccctgggggaggcggggtgtggagagggcgacagcaatccttggtcccaggatcagagctgtcccacctagggggacacccagggcttctctggggcagagcctcacctgctctggtcactcagcccctagctccccaagtgactccgatggtgccagcagacagtgtggggagaggccgacaagagcccctgccagctcctctcctgctctgcgacagggtgttgtggccatccagtcgatgcggacaacttgatctggcatcaagtccctgtgcaaaccacagcccatcaagaggcatttattgttgtgaaaacaaacagtcccctccccagtgcctggtccatcctatctccactccccaccggataccctttccctgtccttggagcagctcagacggactaatccagagctgctcactcctctgcattccaatctctgctccggctggtctgggcccaccagggaacaggaggcaggataccagagtctggggggcaggactctgtgcacagaaacccacccaagagaggcctcagggcctttggtgcctttatgaatgatcttttcattttattatttaaaaaaaaatttttttttttttttgagatggcatctcactctgttgcccgggctggagtgcagtggcatgatctcagctcactgcaacctccgcctcccaggttcaaacaattctcctgtctcagcctcccgagtagctgggaatacaggcatgcaccaccacgcccagctaatttttgtatttttagtaaagacggggtttcaccatattggccaggctggtctcgaactcctgacctcaggtgatccacccgcctcggcctcccaaagtgctgggattacaggtgtgagccaccgcgcctggccttacgaatgatctaagtttaagcacatggaccctttgaggtggcatgctgggtggaatagtgtccccccaaattcatgtccacccagaacctcacgatgtggcctaatttggaaagaaggttgttgcatatgttctgaattacggtgaactctagtccaatatgctgtcctgtgaagagggaaatttagacacaggtacacgcacagagaaaagacgggatgaagcacagagacatagggatagggccgagggacaacggaggcagagactggagtgaggcatctctcggctaaggcatgtggagaatcaccagtagcgcccagagctaggagacggtcccgggacaagctctccttggagtctccagaaggaaccaaccctgccgacgacaccttgattttggacatccagactccagaactgtttttttttttcttttttgagacagagtcctgctttttcgcccaggctggagtgcagtggcgccattttggctcgttgcagcctccgcctcctgggttcaagtgattctcctgcctcaggctcccgagtagctgggattacaggcacccagcaccatgcccggctaatttttgtatctttagtagagatgggattttgccatgttggccaggctggtctcgaactcctcacctcaggtgatccgcctgccttggcctcccaaagtgctgggattacaggcgtgagccgccgcgcccagcccagaactgtgttttaaacaacccagtttgtagtgcttcgttgcggcagccacaggaaaccaatacaggtaggtaggtgagttggccacgtttgggaaactgaggcccagaagttggagtgcttcactccaaggtcacaaaaacaaggcagtgacacaactgaggctggagttgagatccccactcccactccatgaatcctctgtgaggcccagagactgagaaggagcccaggcctgcatgcctcagccactttgttaggaagaaagcgagggctgcgaggcctgggcagagcaaggacggggagcctcttcctccatggcatcctcagctgcacacacagacctgtaacagggccttggcaacagtgcaccatctctgactcagtatccaggattctctcattcttagcagagtgccggctgcctggcagacactaataaatgaatacatggatggaagaaaaaaaaagtctaagttcttttttttttttttaatgaagttcctttgcagaatcctccttttttgatgccagatagaaataaagttggatgacatttttcccattctcagtctcttaaatcccaagaaacccacacaaggaaatctatgttcgggtctgggcactgtccttaagtgagaatgttgatttaaagcagggtttctcaaccctggcgctattttgttgttgttgttgttgttgagatggagtctcactgtgtcactcaggctggagtgcagtggcgtgatctcggctcactgcaagctccacctcccaggtccaagtgattgtcgtgcctcagcttcccaagtagctgaaattacagggcctgccaccacgcctggctaatttttgtattttagtaaagacagggttttaccatattgatcaggctggtctcaaactcctgacctcaagtgatccacccacctcagcctcccaaagtgttgggattataggcatgagccactgtgcccagccaaccttgacactattgacagcttgggtgggatcattctttggtggaggatgacctgagacactcaccaccctcccaggttgtgacaaccaaaagtgtctgcagacagtgtcacatgtcccctggagggcaatgtcattccctgctgagaccaccttgtgctggccataggggtgcacaggtgaagagtctccaggtcccggcctcagagacctccctacttggtggagagtgaggggttagcagatcagtgtatctatcctggaagtgaccattgctgcctggccatgcgggcagaggctggccccctgcgctagagagagacttctgggccggactgagaggattcatactgaccgccaatgtcccttcccctagaagattcaaaaatgctctgggcatctatcacactgataagttggagagacgactcttttctcctctgaaatgtagctagcctgggtcccaaggtgatgcacacccaggggagcctaggatgctacaccaggcaggacgggcttcccagtgtgcagggagcttgggtccctgtagctcccactctcaactcagaatctataaacatggcagcagccacttacgcttcccagttctgtgccaggaacttttcagtgatccagttatagcttctccttaaagctacgctactagagaagacatattagccttgctttaaagacgaaaccaaggcttagagaggttaagaaagttgccaggggtcacacagcttgtgggtggcaaagctgggccttcaacctaggcctgtctggctccttctacaacacagatcctggcacacctggaaccttgtaaggatgtccccaacttgggacacttcctgggatcagaggtcagcggccacaatgagtgtcctcttagcagagccctggagaagaggtgtcataaagaggaggatggggagagagggggaagcgcagaacccaccaacgtcagctggcaggaggacaatgcctgtctcagaacccagggccaaatgggcagcagatcccctggagattgccacgcggagggaacgcccgcgccgggcagcgccagcgtcagccttcctggccaggagagtgtttatttccagggcgaggctaggagtggtttccaggtgggggtccgtggaaataacgtgctcacacacactctcttgagcgaacagagccccattcagcctgtccagaggagcggacccgcaaagctcatggcctgcattccgggcagggtggaaaaggcgattcagagaggaacgcccagtcagagccagctcctccaccacccccttgtccttcgcatcatctcccaggaggacaaaacaaactcagggcacagggaagggacctggcactcgggatacccctggtttgccagggaagtcaccagcccacaaaacacggcattgcaaccacacatgacactttacatccccaaaggccggtgggcagctggcttaaaggaacaaacagttgctctgggatctccactgccacctcctgttccttgccctgctgagccctgggactagagaggcaggatgacagccaggaggctgctgcaacagtccaggagaccttggtgacccagcatgaggagtgcggggctgaggggtgtggagagagaaaggatagcattagggtttcaggcctaagctagtgtgccaagtgggcctcacaacaggcatgtgggtatagaaatgaggaggctcagcttgggcggtggggctaagggaaggactggaagaccacgccgaggtccaggaggtctggagctcatcacagccattgcagcaggcgtggtgggcgaggatgccatcagcacagtgatggcaactaaagccacgtgggagggggttggggaacactggcacatatgcacatttagtggaccactgcgggagaggaagcccccagtggtcctggaaggagagttagagaggcaaccccagaaggctgcagtgttcctgaaagctgagaagaaaggagaggccaccactgggcaaggccaactatgggcaagggggcaaggccgtaagagggtccctctggtttaccaacatggagatcacaggcaactttgaccttgaagcttcgaaaaagggatgaggcctggggtgatgtgggcaggcaatgaggtgggggaaagagtgacggccccttcaagaggttgagtgaaggaaagatgtagggaagaggccggagcagtcaagagaaattgctaaggtttgagggacgtagcaggtcaggctgaggggaaagacttggcagagagagaggatggaggtccaggtgagggggcgggatccaggctcaggtggaggtccggccttgaccacaggaaatgggtgtggagaagaaagcacagggggtggaaaaagtcttgctagaaggaaggctggaatcccggagattctcacttgaggggttcttcatgtcttggagaaggcagttggggccttcagctaaggagaggagggagtggagagggtgggagagatggtaataatgacccataactcctgtgtcagattttcctgctctcctttcctgagtcagcccagcatcacctcctccaggaaggcctccttgttacctaatcctggatgagttccctgtcactcctccaaattcgggcaataccctggtgtgcctccatgcactgaccttggcaccgggatgacctgtttgggttcctcactaactatgagcatgtgccaagagatcggatgcacgtatacaacaccagccctttgtggcacgctcagcacgtaataagcgctcaaaatgcttgctgagtgactggcagatcggtagtcccttctctggactcagcctcctgctcttcaccaagcccgggaaagctgacaccccatttccctgactgcccagcaagaccacagcaaactgtagagtttggttttttccttcctgtgttttaaggaaaataagaaaaaaaaaaccccactcataccaaacaaacaaaatgagatggccttgttgacgtgctgatgggatctcactagcagagatggggctgtgttggttttcttttgcaaagattctatttattttgtagggtgcttggaggggcacaccatgcttgttgcttattattactttttgcttcacatcttgactagcacaatggactcatgatgaaaagaggctgacgttctcaggggcagcagcaggagcccagaagctggtgagaggcagctccctagggaagctgggctgggcaggagctccctggggaagctgggtggggcagggcccccctcccggaaagatggatggggcaggggctctgggtggtctgctgagcccctcctctgagggggggcagggcaggtgcttatgggtgctggggctg

SEQ ID NO: 499 - DNA, 40001 bp, Homo sapiens
catgttaaaaagttgtttagaagctgttgatttgaatttccttttcaaattttgcaggataatttttttttttttttgacagagtctcgctctgtcgcacagtctggagtgcaatggtgtgatttcggcccactaaaacctccacctcctgaatctaagcaattctcctgtctcagcctcctgagtagctgggactacaggctcacaccaccatgcccggctaatttttgtatttttagtagggatgaggttttgccatattggtcaggctggtctcaaagtcctggcctcaggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttcttacagaagatagtggttttcatccaaataagtcaactactctaccccatccctaagccacttgtatggaaagaaaaagaggaagaagccagtactgtgactgtgtaagcttcccccagcatcacccgctatgagatgtgtggcagctgagacccgggaactgctcaagggcaccaggccccatctgtctgcactcaccttcctcaggtactcgcatgggcatgtcactgactttatgtgctgctgcagctccttggtgagctggccctggtcatgggacaggaactgtggggtcaggacaatagagagcttcaccatttgcagaatgagaacaggagctcatgatgagtgcctatctattagataatttaaaaaaaaggtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcatgagatcatacctataaaacatccaagtcatttaaatgtatcatcatttctgtcataattagtgggatccatttcactattattggatatacagttctgtgcctgaaacctacaaaaaaagaaaatgtaaagtctaaaaagcattagtgatttctcatttttatgttactaattataaccctatttaatcacacaaggccttgtccgtggcaggtgctcaataaacacttgtcgaatcaatgcatgtgggctccggagccacactgtttagattctattctgcctccaccacttatcagctgtgtgatctgggtaagataattcacctctttatgtctgcgcttccctctccataaactatatataatgagaatccttagctcattcggttgtggtgaggggtgaatgatttggcactcaggaggggcttgttaacattagctgtgatgatctccttccaaatcttcattttcagagccacagatgaggccacagtgcaaccaggtgaccttagagtgtaagtatacatgatcgccagctatgctctatctccaccataggtccaagactgggtagttctggcctggaggtttctgctgcatctgccttctcagtgttcacctaaggacttttgtattttcctcctcacatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccggagagctgtgacttctctgtgccctgggcccaaactatgaagacctgacacactatgctaaaagtccaaggctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaacattagtgcaaatgttgcatcctatttctcatatgtccgcatgttttaggaaaaaaccctcaatttcctaaatatgcaagaaaaatcggtattgtaggacaatgtgactttttaaaaaatgttatttaaaaatcttccctacctccttttctgccctccaagactgccaaatacttgttgaacatatattattaaatgcctactacatgccagccatgattcatggtcttggggacacagcagggaatgaactgacaggattcctctcttatgtaactcacattcttatatgataatgataagggttaacattaattaagctgtcactacgtgttagtcacggtgcagtcattcccacacattattacacttaaacctgctagcaagcttgcaaggtagttagttgtttttcctttaaaaactgagtctcggaatgatgaagcactctgtccaatgtcacacagctagtaagtgtggagaccttgcatccaatcaatgcccgtctcattctaaaggccatgttatgtgttctccagcccatggagaataattttaacacagtcaatgaaatttctacacaacaatgttcttgtctcaagtccaagaatgcctcctacacctcctataatactggctttctggtgagtaaagatgccattctcctgtgtaatcaggtggcaaatggagatatgaccgaagtaaccatctgtctacactcataaccctgtacacactcttcctgtgtcgattcaattcaagtaccccttttgatcacttagcaaatgtgacctttaaaagggttgaggtttttatatccatgtaagtttttgtattgctttggaagtctctggttaaattaatactcttttaatagggacctgtgattctgttttgatcaagtgttttcaaacttgacgtctttgatgggtttctccagtgtcaaaatcctaaatcaagtctttttggcttaaaactaactttgggattttttcagctgcatcccttggggagtctaaagaatgtatctctcatcttgcagaggtattaagtgattcgatttatttggtagattaaatgggcaggcgttgtcaaatgtggcgatactgcatgggagggcactgtcaagtgaggtgacattagatctcatctcagttatatttatgggtatgttgttgatacacgtgttccaaaaattgcatagatttatacaaatttaatatgatttgtaattttgatagttatgctaaatatttgctaaagttatatttgtataaacatgtcatgaatggctgggcaccgtcactcatgcctgtaatcccagcactttgggagacaaaggcaggtggatcacctgaggtcgggagttccagaccagcctaatagagtgaaaccctgtctccactaaaaatacaaaaattagccatgcctggtggcacatgcctgtagtctcagctactcgggaggctgagacaggagaattgcttgaacccaggaggcggaggttgcagtgagccgagatcatgccactgcactcccacctgcgtgacagaggtagaatctatctaaaaaaaaaaaaagttattaattatttctgaagattgtatgaaatttataaaagtctggtggccctgatatgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctatttttgagacacagtctggctctgtcgcctaagctggagtgcagtggtgggatctcggctcactgcaaactccacctcccgggttcacgccattctcctgcctcagcctcccaagtagctgggactacaggtgcctgccaccacgtccagctaattttttgtatttttagtagagacagggtttcactgtgttagccaggatggtctcaatctcctgatctcgtgatctccgcgcctcggcctcccaaagtgctgggattacaggtgtgagccactgtgcccagcctaatttttgcatttttagtagagaggaggtttcaccatgttggccaggatggtctcgatctcctgaccttgtaatccgcctgcctcggcctcccaaagtgctgggattacaagcgtgagccactgcaactgactttttttcttttccttttttttttttttttttttttttttctgagacagagactcactctgtcacccaggctggagtccagtggcatgatttcggctcactgcaacctccacctcctgagttcaaacaattatcctgcctcatccttcggagtacctgggattacaggtgcgtgccaccgtgcccggctcatttttgtattcttagtagagacggcatttcgccatgttgaccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatctttatgcgttaaggtaaacatgagaaacttgatctaatatttaatatttattcagttctacactttattaacttctacaccagcagatttagacattatgtaactatctcaagaagtttcacttggatgtaatgcttcacgcttgtaatgcttcccagcactttaggaggctgaggtgggaggactgcttaaggcaaggagtctgagaccagcctgggcaccacccacctcggcctcccaaaagtcaaagtcaaagtcaaagtcaccaaaacttttaagccagagtctgctaaccaaatgtgactgaggttggggagagccccaacttgagaacaataatgaacaattgttgtatgaacaattgttagagacagctaacagagtccaggtcccacaatgattattagtcctaggatgctgcccaacagtccacactgcaggaagacctagagggaaaagactacgagctcttgctgcgatttgaaaacagagtcactgacagcccacgtgtcatggaagtagcagacagctaatcacaaacaacctgcgggcacaatgacctcattccacacatagcaccctcagacagcaccatcacacctgaggggccatgtggccacgcacgaggaaagaccctgtgggcagggagggaggggctggcgagggaaggtgctgtgctatggcaggctccccgggcttgcaaggactctggacactacaggaggggaccacgggtgtctacaccgccctgggctatgtgcaggctttcctgggaggactggcgctgtccctggggcttctggtctatcgttctctgcactttccctcctgcctcccaacagtggccttcctatctggcttggtggggctgctgggctctgtgccaggcctctttgtgctgcagacccccgtgttgcccagtgacctcctgagttggagttgtgtgggggcagtggggatcctcaccttggtctccttcacatgtgtgggctatgcggtcaccaaggcccaccctgccctggtgtgtgctgtcctgcattccgaggtggtgatggcccttatactgcagtattatatgctccatgagactgtggcaccttctgacatcatgggggcaggggttgtgctgggcagcattgccatcattacagcccggaacctcatctgtgagaggacagggaaggtggaggagtgagatagaacttgggagcctgggggttgggagggacagggataaataaaggcaaagactgaagacaaaaaaaaaaaaaaaaaaaaattaaggacctaaccattcagaggaaaaaaatgacctgtcatgaaaataaaaatcaatcaacagaagcagacatagaaatgatgtattagtgactagaaaaggagattaaaacagttagtataaatatgcaccacatgttcaaaatagtaaagcatccacaaaattagaaatataagagatataaaaatgactcaactcaaatttctagagatgaaaaagacaatgtctaagattaaaatacactggatagcaaataacaacttggatgaatctccagggaattatgcttgcggggagaaacagtcccaaaactttacggtataattctattgacaaaacattttgaaatggcaaaatttcaggaatggagaacagatcagtggttgtcaggacttagagatgaaagaggtggtagaggggcaagagagaggtggctgcaattataagaggacagtacaaaggggacttgtagtgttagaactgttcagtattacaactatggtggtgaatacatgaacatgcacaggtgatcaaattgtatgcaacgtaatagacacagatagagacacctatacaaagagtacaagtaacaccaggaatctctggataacattggtacattgtatcaatgtcagtatcctggttgtgatattacagtcaaccccctgtagcctgaggttctgcatctactgattcaaacaactacagatggaaaatatgtgaagaataaagcaataaaaaataatataatcaaaaaccaatacagcataacagctgccatacatagccttgacattacattaggtattaaaagtaatctagagatgatttaaagtatacaggaggatgtgggtaggttatatgcaaatactatgccattttatatcagggacttgagcatccatggattttggtatctgcgagggtcctggaactaatcctgcttggatactgagggatgtccctatagtacaacttagcaaaatgttaccattgatgaaaactgggcaaagcatacaaatgatctgtattatctctaacaataacatatgaatctagggccgggcgtggtggctcacacctgtaatcccagcactttgggaggccgaggcgggcagatcatgagatcaggagattgagacccccatccttgctgacatggtgaaaccctgtctctactaaaaatacaaaaaattagccgggtgtggtggtgggcgcctgtagtcccagctactctggaggctgaggcaggagaatggtgtgaacccgggaggcggagcttgcagtgagcagagattgcgccactgcactccagcctgggcgccagagtgagaccgtgtcttaaaaaaaaaaaaaaaaaagaacaaagtaccagttaactgtaggtctacatcaagccatctagtaaacataccatttaattcacaaaaaaaaagtggagctctctgacgggacgtaaaaaatacgttagcaagtaatggccaaaaattttctaaatttcatgaaaactattaacccagagatctaagaagctcaatgatgcctcacacccctatagatcttttcaatgaaaacacaatgccatattggcatgaaggtaaatctatagatcaatgaaatgtaaaaaagactctggaaatagaaaattggaggcaaagtaatgtggaaaagaataatctttccaaccaatgctggattgatagaaaagccgtatgcaaaaataaataaatgaataattctcaacccttacacttcacaccatacacaaaaattaacttagaatggataaaggatctaaaggtaaaactaaaaactgtagaacttctggaagaaaataaattcttagtaacctgtaaatagcatgggtttcctaaacagagtatcaaaagttggaactactacagaaacagaattatagacttcattacagttaagatcttttcatctgcaaaatacattgtctctcctctctgtctctatggacatgcctatctggatatttcctataataggaataacagcatgtgaccttttatgactggcttctttcatgtaacataaagttttcaagttcatccatgttgcagcctgcatcagtgcttcatttcttttcatggccaaataatattccactgcatgcatacactacattttatttattcattcatcttgatagacatttagactgtttccactttttggctgttgtggataatgcttccatgaatattcatgtacaagtgcctgtgtgcacctatgttttcaattctcttggatttatgtctagaagtggaattgctgggtgtgaacaccatttcaaatattgctgaaatattgtattcactgatttatgtaatagctattgctttgaaaagattaaagcaaaaagtggaagctggctttaaaaaaaaaaaaagaaagaaaatgaaaagaccagccaatgcctctgcccggccaccccatctgggaggtgaggagcgcctctgcccggccgcccatcatctgggaggtgaggagtgcctctgcctggccaccccgtctgggatgtgaagagcgcctctgcccggccgcccattgtctgggaggtgaggagcgcctctgcccagccgcccaccccgtctgggaggtgaggagtgcctctgcccggccgccaccccctctgggaggtgaggagtgcctctgcccggccgcccatcatctggtaggtgaggagcgcctctgcccggccgccaccccgtctgggaggtgaggagcgcctctgcccggccgccaccccgtctgggaggtgaggagtgcctctgcccagccgcccatcatctggtaggtgaggagcgcctctgcccggccgccaccccgtctgggaggtgaggagcgcctctgccctgccgccaccctgtctgggaggtgaggagcgcctctgcccagccaccaccccgtctgggaggtgaggcgcgcctctgccctgccgccaccctgtctgggaggtgaggagcgcctctgcccagccaccaccccatcttggaggtgaggagcgcctctgcctggccgcccatcgtctgggagatgagaagcgcctctgcccggccgccccatctgggatgtgaggagcgcctcggcccggccaccacctcgtgtgggaagtgaggagcgcctcggcctggctgccccgtctgggaggtgaggagcacctctgcccggccaccccgtctgggaggtgaggagcacctctgcccggccaccccgtctgggaggtgaggagcgcctctgcccggccaccccgtctgggaggtgtacccaacagctctgaagagacagcgaccatcaagaacgggccatgatgacgatggcggttttgtagaaaagaaaaggaggaaatgtggagaaaagaaagagagaacagattgttactgtgtctgtgtagaaagaagtagacataggggactccattttgttctgtactaagaaaaattcttctgccttgggatgctgttgatctataaccttacccccaaccccgtgctctctgaaacatgtgctgtgtccactcagggttaaatggattaagggcagtgcaagatgtgctttgttaaacagatgcttgaaggcaaaaaaaaaaaaaaaaaaaagggagcgggctattgattcgtgcaataatgatgaatctcgaaatgatgctgaacggaagaggccagacaaaaatagagtcctgctccatgattccatttatataaggttctggatgatacaaagtaatctattgtgaaagaaaacaggtttgccgttgcctgagatggattgcagacacatggagaatcttcggtggtgataatgttcatcatttcgattgtggtgatggtatcatgggtatacaataaacattaaaactcatcaaattatatactttaagcaggtactgtttatttttcataattactccccattcaaactggagaaaatgagcaaaaaaaaaaaatatttgggctcccctcctggtacaagtcattgtaactaggtgtgtggacatcataaattattttctcaatcacgtgagatcacattcaaacaacatgttttttccttcagaaaaaaatggggtccctgttccaatgcctacacattttccatccatcttcagaggtgacaaaaaccaaagagaaagaacatcctacacacagtcctgaaggatcgcttctatgtaagataggaatatcttcactaggtatgtatctagagcaattctgatacaagtataccagaataaatgcacagatgatttctcagcaacattattttaacagttccaggaaaaaaggctttccagtttggggtgtttttgttttttgtggggtttttgttttgttttgttttttgttttttttggctatgaaatggccataggagaaagtataaagaaaataagttgtggtcccatggtggaatactatacagcagtgaaaatgaactgtagctacatccctcagcataaataagtctcaaaactataatattaaatgaaaaaagaaaaatgtaaaaacactccaaactgagtatatcatttagagatacaaacacaggtggtaaaaccaagcatgatggtcaccaacgcacacagagtagctgtgctggttgtttatggcctcattccatctgattgtccagtgcccgtggcatactggttgttaaatattttgaatattgtccctcaaaaaaaaactataaagaaggctgagaaaataggaccacaaaattccatttcttcccatatcaggaaagtaatgagatgtaggaaacaaagacttaaaaattaaagctgttggttatcttctatttctcatacttggtattttttattttattattcttttactctatgtgctcacatgtgcatggcatgtgtatatctgtgtgtgctcttctggtttttaggggtcttttgcttttgttttgtgtgaaaccatttatgtatgaccataaattcgcttgtttatatatttcatgtggcaaccaggctccaagatcacttcagtggtcttgttttctgacattcatatcctgtgtactctcctcccccgacagtaagtgggataggctgtcactgcagaaataaatgagtgtgtgatgtccacatcaagggcataaaaagcaagttctcactcattctggaagaaaccagctgccatgctgtgaggaaactcaagcagccctgtggagagatccgtgtgtcaaggaaacaaggcttgcttccagcagccagcaacaacagccagccatgcgagtgaggcatcctgaaattgggtttgctgattccagataagtcttcaaatgactgtattccagctgacattttaactgccatttaataagagaccctaaggcaggaccacccaactaaatagtcatgccttaattcctgacccacagaacatgggtgacataataaatgttttttagtgttttaagcatctaggttttagggtaacttgttatgcagcagtaaataactaatatattttggaaggtggaggcgggatgttactgtaacaaaaacctaaaatgtgggagatgctgtggatttggcagtgggaggaagctggcaggactttaaggaatgttaatgaaagcctaaaggactttcaagggactgttagcaaaagcatggtgacatttgagaaggttgtctgtgagggcttaaaggaaactgaggcgactcattggaaacaggtggttatgcagtggcaaaacgtatagcaacgctgtcgtctacagaatgtggaaaatagaaaatgtatcctgtgaactgagttttaaaggtgcccctgattttttttcctgctatttatactagcaggaactgttggacattcccagcctctccatcttcagatggcaaagatgctaaaggtaagaactggcttcttatcaaagatcatacatatccagggccctctcaagaaaagaagatcgaaagatgacatccagtgtgtgactgcaaaatcccaaagaactgttcagtcaaacagcaggacttctgcatatgttaaaggtgttgccatttagcagtctcagtagcagcctaaaggtaaagagaaagatttattttaaagagatttacgggcgtgacttctgtcaaatggaatgagcccatcaaggaggctcccagctactggaaaagaattgctttggcagaaacaccagcttggactgaaagggacagaggtacaaatgaaaagtggctttgaaccctcaaacatttgcaggcaggaagactgaaagactactcagtttcaaacgtagtctacaaaggaggaatgacggaaacatggaaataaggccggcagggcagagccaagaagcagggagactcattcccagacaggagtaggactgagtcctattcacgtaactttcaaactgtgcccagatggatttcagaattggtatggaccagtgattcctgtacggctcccatttcccctctttttagacaggaacgtcttagcagctatcttgtgcctgtcacatcatcatatgttggatgtgtgacaggcaaataatttgtctctttcattcatagatcctcagatcaagagaaactggatcggagtagcctcaaccacacttgggcctgattcagatcttgagatcctggatttttcaaggtgatgcttttacaggatgagactttggggggcattgagatgactgtagtttgcatgcaggaaggacatgagtcactgggggtgagagggcagactatggtagccagtttccaagagaaacccaatgcccccgacctcctggtattcataccctcatgtattctcttccaaaatgagcatggcttaagggtgtaaccaataggatattgcagaaatcatggagtatgacttcgcaggctaggtaacaaaagatattttggcctacccttaagttctctgggatcactcattagtggggtaaccaatgaccatgccatgaggacacgtcagcagccctgtggagaggcccatgcagcaaggagctaagggcacctgccgacgccagccccattccagcctgccagtcatgtgagtgggacatcctgaaatcattgctttaagcatccaactcgtggggtgatttgttaatgcagtgatagacaactagtagattttggaatgcagaagaaaggtacctcagtaacaaaaacttaacatttgggagaagctgtggatttggtggtatgcaaaagctggagtgtccaccccctgtacaaagctctcagccactgtggtgctggtggggtcctggctacagcttcataagaagtttctagttaagccactcccaaattcctggtccactgaatcagtgcaaggtaatagatattgctgcttaagaccactgagtgttaggtaatttttttatgcaggaatagataatgtttcccaatacaaaagtatagggaagcaaagggaaattggagaatattgaggaatgaaagcagaggtagcacatgggatttaaaacaacccattgttttacataaatgggatcatattttatttactattctatgacatattttatacttaaattttatgtaatttttttcagtaaaaggaaatgacatggcattttcatgatttttaagaaaggaatagttattaaaattttattgtgtgtggttttccttttttttctttttttttttttttttttttttttgacagagtcttgctctgtcacccaggctggtatgcagtgacgcaatgtcggctcactgcaaccaccgccccccaggttcgagtgattctcctgcctcagtctcccaagtagctggaattacaggtgcacaccaccacgtccagctaactttttgtatttttactacagttggggtttcaacatgttggccaggctggagggccccttgaactcctgacctcagctgatccacccgcctcagcctcccaaagtgcacctggcctatgtgtgcttttccaaacagaaacattagttccagtgaaagaaaaaaaaagtggggtacactgcaccaccaggaaagaaatttaaagtataccacaatcaaaaaaatgaattaacaaccttattttattcttaataaataagacgagaggattttttaaaaatccacctacactcctaccacagtgatagttggttttattttcctcacgttttttccaggttttactcaaaagtatttgattttacacggttaaaatcaaacacacaagttttattctttgctcgcttaatggtacatcttacagatttttcatgttattccacagactttacgtgtatcattattacagatgtatgacagtcccttcagtttcttcaaaaatttatacatttctcactttccagccagatgtgcaaagaaaatgtgggttctttatcctttataaacacttggatattctcatgagcccactccaccgggagtaaggaaggacacataaactttgaacttgaaactttatgttaccacagtccctgcccaatttcacgagctcttgggtgacttctgaggcgggtaaataacgtttcctgcttcttccactctcttgctcttctccaagaggatgtgggcctggagtggtgcccatgccttcgcagcgctggaggcctgtgctccttccatgggtccccaccttggatcctgtcctgggtgcacattggctggttccacttaagtgagagtgaaatggaatccagctgagaaatgtgactttccctttagtacgggcatccctcccaaagagcctggctgtctcccactgctggcgaaccccacctcagctcctgctgtgcggtggggcctcttggcgtccacttgttacattgcaatcccacctgcccccagtccaggcagctcacctggccgctctcatctgcagggcccctccaaccccaccttggcagacttctagggcaagctccccagcaagtagctcagatctaccctgcatccctaggacgtcggggtcccttcccacgccacacagcagctgatgctgctctggcactcaagcttgtgcttcatttccatttgtaatctagggaaggcccttgcccctgtgctctcttcgcaggaattctgaaatgagcaaggccaaatgccctcttccacaggccttctagccaacccgtctaaagcacctccctgctgtgcttctgcatccctgcacctgcctcttctgctcccgtggtggcaggatggggagcaaaaccgaaaaacatctgggaaagaacgcaaaggaagacaaaaagcaagcaggacccttaccacaggaaataagcagctgaaatgaagggggaaaccaggagcattgatcgagagcatggggaatggtctagtgccccaaacaaaaagtgttaggtgcccactggcttcagcaacatgcaggtactgggggaccttgaaatgatgccgtttcggtggagtggagatgaggaagtcagccagcctgcagtggcttcgggaacaagtcgaggcaagaaaggaagacagtggatgtagacactgctttcaagaaatttgactgtgaagggaaggaaagatatgagatatggaatgcaggtggcaaatgcagcatccagtattttggctttttggttggggcaaaggtaaattcaacactgatgagagccagccagtagtgaggggaaggctagcaattcagacagcgtcttttctgcaggagggaggtagggttttctgctaagagagtaagcagcaggggcaggaggatcaaaggacccgggtaccaagaagtttggaaagagcttccatgcttaatgcaggaaaagcggaatgaagacatacaagaattaccaaggagtgctggatgcgcagacggcctcagccagcacgaattgactggggcagtgacctggaaggagatgggtgcacctgtgtgcttcccagcaaatcccgacttcagggtccggtcacagaagtggtaaaccgtccatggtgtggatgacttcgaccacctaccacatttgtcagttctcaccacaccgagcacaggagctcgagtaaacacgctagctggaatgtaagctccaggaaggcaggacggtgctgcccaccatgacacagctgaagggtccttagaaatcacctagtcaaaccactccattgacaaggaaacccccagtttggagaaggaggccggagtcaaaggcagacctcctgagctccactcccagacctttcgccagcacggggtgacctccaactccctcagagaacacagccctccccctttggcttccagctggagcgtgaattcccgaaggacagcttcactagatgcccagatttaggaaaactgtaaagcagaaatatcattccatttttaaagcaacacaacctccccacgtgatagctattagtaaatagctcacagctgcgaggaggggctccaaaggacacaacaccctgtgccatggggtttccacgaagatacattcctaggtgtgggcacggtactcctcccctccctgcggcaacgcgacgggatggcaccggcgcgctctggggttcggaacgaggccagcagggggcggtctacaccactgagtgttttcccagctcggtttgttgtttggaaggaaattcacgtgtgatcaatcacaccttaaatatcttctgtagctataaatatcaaacatatgttttctaaatggtttacactccttatctccccttttataagttcaatagtagagaggtcgtggtgagggacagagaaggaacaccagacctgggtccgctgaagaaacaagcccaacaggaaactgccaggcgagaccgctcagttgcctcccaaacacagatggaagacaggattttctggaatcacagcaaaagaaaaaaaaaagcctcagctttgaacatctcgacagcaaattcaatgtctagtctttattattgagcaagttccctaaaacttcaaagaggtaagcacatcaaaaaagtactaagtatgaaaccctgggaatataaacacataagagacatcctcctgtctttgaggaactgataacaaaggggaaagaagatactatctcaggagtgctctgagcgtggttaagggcgtgattcatccctatttaatcaatatagctagggaagaagattccaactaagcatgaaagaatagatgggactccaaccagattgtggagcactggaaaccaagatagtacatgtagccatttttaagtttgaatagcaattatctttctagtacgtaatcagggtgcaaagcttatacccctcataaaagagtttactgaagttcagctacaacttccaggtcaacacttctccccaaccaacccaccttttactttgtccctcccccaaggggctcaggcccactactgggggtaactcagcaggacataagccaaaattaggccatcagtatcgtgctttggaacggatttcattctcgatttttgaatcccttgaatctctgtggtattgttaggaaggatggtgtcctttatatagctttccataaaaagtgtctgatttgtctggatgtccagcacattttaacaaactcaagcctctagacctgggagctggaccattgcttctacaacaaaggcaagtcagacacagggatggagccagttcctctggtctcatgtgtgtgggggccttcctgtgccaatgaatctacctctaccactcaccccaccctagctgcatcccaatcaacagacagagcttggtgtggtggcaccacctgtaggcccaactactcgggaggctgaggtgcgaggatcacttgagtgcaggagttggaggctaaaatgagctatgatcatgccccccctgcactctagcctgggcaacatggaaagaccccatctctaaaaaatagatacaatacaaaacagacaccaaaaaagaagcaccagaatttactttgttctaagggatataggctttgtcacttcaacagtcaggtcatgggagttctcagaaagtgttttgacatttgctccctagcagaggaaagtcatttgtgaaactatttttaaacagcaaaactaaaaaggtggggtgccatctcagatgctcattagacattgagtccagagctgctttggggggtaagacagagacactgtgctctaaataccagcacaagcatgaaggacagcgaccacaatctgtgcagccagtccacttctttaggaaattcgattgtaaatactttggagctgatgagctctcctgtgtcatcttcatatcatgaaacctaataaaggtctccgaatgcctgcttccccagcacctccacacagtaacaatttcttgcagtttccatttccctcaaacctcccactgttgctgccaccctatggaagatgatcttatctcaaatacttcagagaaaatctgaagacgccggtgaggaattctgacgcatcctgacgccatttcaccagagcctgtgcgcagcaatgccactcactgcatctttttttttttaaaactaaaacgagagccctttcttcctatcaaaaggcagcacttctctagatgcttccgagtagccctggcccacccagcctcctcaggcactccactccctttttccctctttctcataaaacctcagccttttctcacaaaatgcctctccattggcatccgtgcctgctctcctttgcccctgggagccccccccccaggatttggtcccctccagctccttgctctctcttcccaccggagctttgttttgattcatctggccatccgtccgtccactcttcctcagccccactcctcagcaccccccagtcggacatccagccactaaaacactctcctttaggccagcagaggcttgcgtgatgataagcctgccatcttgctcagtttcttcatggctcttggaagccttgcacaccgctaagcttcttgaaacacccactccccggcttcctgaggaaccactctctgtttaccctctgaccctctggccacattttctgagtttcctttcagagctcctgctccttctccaagcctagtttgaacattggaatttatcaaaatcctgctttcaactcacttcagttctcactctgtgatctctcttcaaaggtctcacccactcccatggcttcaaacatgttcacaatgccaaatttccgtctctcgacccaatctctgctctgaattccagccctccagatcaactcccaactgcacatccccgtgtgaaggtctcacattgcctcaacctcagaaggtcccaaaaccagtgcagagtcagcctccccccaacacaagctcatcccacttcacaaaatggttcttccatgggaaagtcatttgtgctgaggacaaactcatccttgatccctttgtccctccgcacttgcatccaacatggcattgagtcctacccattctgtgtcctaaatatatttcaacctcatccacttttctccgtctctactccctgtaacctaaccaaagcaactatcatttccatggcctgacactcccaagagcatcctacaggctttctttcccccatccgtgctccaaacagcagctagttgggagaacattacttccacaaacttttaagtcactgaaaccgtgatcttcagcgtggtgtcaggccccatgcagtctcacctccagccagtcctcctctgggacacatgccccagacacagggctgtattttttattcttgggtgccaagctttctttgacctgggaggtttctttcatgggtttgctgtatctctaaccctcttctttcctgccctcctaattcccttctccatctctccttccctcctcctctatccaatccaaccagaccaattcttttcgtaccttagagtcttaacttgaatgtttctctcttagggacatttttctgatggccaacatctttagaaaagtttgtatcctcttatgtattcataacatttctccaactgtgtgattgcaactacccaattgtaattaagtaattacttgtttaaagtgacatctgcctttctaaatgaccagctccgtgatttgtacatggctgggcctgtacatggctgggctcaccattgcttccctccaccctagagcaggtcctaacactctcaagccagtaaatatttgccgaatgagttaatgaaccctcagctccagctattgtgtgagcaagagttgcatcacaccttctcatgcacctcttcagagcctcaaggcctcatgaatccttagtccagctcttcatgggctcaggaggatggttgcaagtcccagtctgcccaggaagcactcccagtcacccttgttgccctggcataattattgcgacgcccccccaccccggttcactctcaaagtgccctggtttgaactataaaaaataggctcaacgcatgctctgatgggcctgatgcaggcacagtgtgaaagaggccacatgcctcttgcccccaatgctggagaggtcactggttgacaccacaggtgatctcacccctggggtgcatgagtccaagggtaggggagttagcatcccaactggagaggagagccagtccaggaatccccctttttccatggcagaggaggcatccccggaacgaggttggtgtggcttctcagagccacagtcccaagctccctgatatgagctctctccctatctctcttctttatccccacccctccttccttctgcatcaggctttgatttctggagaacccagattaaaatgaggatttacttccatgtggccctaaaggaaagaattagaactgaagagtaggagagcaggaacacgagaagatacattttggttcaatatgcagccaacctgacagaagcacacatatggaattatcttcctgggggaagagttctctgtcattcataggtgttcagacagaagctagacagtcacagacaggactattgcaaggaagagctcagtatccgatggggctgggttagcttttcattgccttcctattgaggattccaagatgcaatatttaatgaaaagttatttcatatgtctaccttgcttagagaaagtaattgaaatgtggagagagatttaattggcaaaccttatccaaagtattgtttcccatgaatagtctggctcaccatgtgctcagagaagggcaaaatggccagaagatcctgacttaacattgaaaaaaggtacaattatccccaaacatttccagctgacataaatatgcacaccccatctaaaaagtacagcaaacctgaaagccccattggctgatactagtaacccatttctctggaatcagatgatttattttcctttgaatgtatcatttctgaagtaataggttaatattatttttaagttaatttttttaaaggtctgtctgaatgttcaaagataaagttcgcatcaccctcccatactggcaagatagagtttggtattgttttcaaatacgaagtcactttccttctcaaggaactggcctgggagtgtctcggagaagttaaatgcagtgtgggctcagccacaaaaccgaataatgccactgcaacaacttgattctcaggagggaaagaagactggctcggagtacatcggtggctacggaaaccagccctgtggacactggagagaagatgtttccatctaagtctattaaaaaaaccccaagactccagcaaattcaggcctgtaaatgttagaagcggtttggtacggtgattaggttaaggcatcaaggacacagctccaggacactgtgtgggtggcggcgccacgggtccagaaaccaggagggagggaaggggggtgtattcctcctgcccagcaggcaaagcagtccaccaggtgggtagtgtctccagcacacaagctgggttttcagggcagtgttccagcaccagcaagggtctggggtgctagacagggaaactgaggcagagacccacccacacaaactggaacaacttggcagaggaaaagaagacacaggcagatgcacacctcagtgccttcagcgggcacacaggcactccagcgcaccggggagaatgatgacaagaaccaggtcagacctcaccagataagattagcccaagaacgaagggaagaaaaatacccaggcgggaacccacagaaatgtcaatggaagcagctaagcaggacaccccttgacacttcttgaggcatgactggcatgtgcctggaccttgtttttattcgagtgcccatttgccattcccagggcctatgtcctaagtccacctagaagccccggctcccaagcctctctgaagtgcatcatttttcccactgcatgcactttttggcatctgctggagctcatgaaagcatccctgtaaactttacaaaattaatcaaggaataaaggaaggcgagaaatgaaaataaacccagctggcggcacactcagcattcatcattaggtcagcagctctctgatccactttctcatagctgtttggtgccagttgcctcagaatcccgtggaccctgttacaagattatagttccccttgactgccctatcgataacaacttcaacattacaaaacgtcaaatttccctttgagatattctttcaggtcctgcatatcagtgaaactgctgactcagctggtctgaaggaacctaggagaagctgactcaccaaggatggcagtttccacatcctaatgagttcctccccttttccccaaccaatcaatgactctaattttccagtccctcatcttccacgatccccttaagggtcccagcccagaacttctctgggagatggatttgagggtctcctcccatctctttgctcaacaccctgtgatcacgaaactcccatctctgctgcaaaccctgctgtctccatgtcattgatctgtgactgcacagcaagcatgtgaacctgttggtcctgtaacactctcattggaaccatttcatggaactacttttccttcaggttgagcttgtaacagggaccagagtcactgcagaattcaacagttgtcctcctcattgccctcttctcttcgatcaaccaggtttcattttcagcccagttctccaaaatgagtaatgtgccgcattttgagcattcatgtgagaacaagcagtgaacgagaattctgtgaacatcggttctccagctccagagccctcgggtctctcctacatccatctcttaagttctcactgaaggcactacttccctcacctttatacctttcctccctcgtggaaacaatgatgcttcttatagcatcatactgggattacgctaccagtatccacgtacatctattcaaaaaaccagatggaagcagcctgataacggtgatggtctggcctaaaatgatctaggtctagaatttataagtggaagagagccctgaaagtccttagtttaattcctgtattcataaatgtgaggattaagaattaaagggactaagtgacttgctcctttggatttgcccaaggacccacagctagctgccagctagtggcagcaatggaactagaatccaaatgaaagttttccccatctcacatactcccaatttttacagaacagataagggaaaactcatggcaccacttggaaactggttactccagatatcttcctctccagctcatgtccaccaaatgacagccaatcacatttgacaatgtaaaaatcaatgttcacccagcactttctatgcacttttccccaaagtccctactttggggaaaacaggagagtaagatgaagccattccattccatggctcaagagctcatgatctagttggagaagtgagacattcatccaatagttctggcaagtgaccacacgccaggcactgctggagatactgacaaggcatgagctaagcagacttggtgcgggacacggacaacgtgaaagcgaggcaaataaacagacaagaagagttcagatggagcccatcaggggcagtgtgagggagaatgtctgaccacttacaaagatggggaggctggaggccagctcttctcagaggtgtgatatttgagccggtatgcttggagaagaaatagacagtctgcaaaaacctgggagaagagatttcctgggacaagggacaaggaggcacaggccagaggagcaggtaaccaaggaggaggagggtgcgagttgaccctcagagagtcaggcacaaaaccaggacaggcagggttcatttagcccaggtgaggagtttggatttttttctaaggggccagagggctttatgcacaggacagacatcatctgaccatcatcccaaagctaaaacagaagtccacatgtagactgtgacaaatgagtgtgctgccaccacagagggacagctgagaggtagctgggaggctggctgagggtggcagacatgagaagggggacaaggtcaccacagaagcatcacaaggaaggcatctgtttggctgtttcggtgtctgagcacacatttgcttatttccggtcttggagggaatggcagcttttttgtgatcccagttacctctgtgtttccctctccagtgctgaaatatacaggccgaataatttccttaacattcctgttggttgtgggagcatatggaagatgttactaatttgggaagaagaggaaaagctttccaagaaggaggaaaacctttccaagaagtaggaaaagcatgcagagacacctggacaagaggcttcatgcaaagctggggggatgaaccccaagaggcaaaatgcatgacctgaagtttcccaccaggcacagagcagagtgggtggctggggaggccaccaggggtggactcctggccctcagcagtccagctcagggtgccgctttatcctgagagtatagtgggtttccacagaaatcaatgcctaagagtgagggaccgggtgtgcctgttaagtgtcattcaggctgtggtatggggacgaggctgaatatgagacagaatggaatgggtgaggctgtctgggggatggaacagtgattcaggtgagaatcaaggagcccccagctaggatggacgagaggtcattcaccaaacctcagagtggcatccagaatgtcacactgctctcttcacgtgggccagataagaaactgttaaaagtaaaatagccagatgctcagggccttactttgtggatgatgatttaacacgtaacacggagcacttccaacataaccagatgctagacactttccacctattgtctttatttgaggctcacagcagtcctgacagtagatagagactatgtcaggaaggagacccaggaagcacagccgtggctgtcagagcctggctgaggtggctgggtggtccccactgtgctcagagcgtgggcacattgggaccccttcaacaaagaagaaggcaagcggcatctcagtggactcctagccctgttaacaggggagttgggggaagcagcctttaaaagaatgctggggttgccaccgggtttcagacatcagacatccatggccaggtcctggcaccctcagcctgagccttccctggctccccttaactcccttcctgtccaaattcctcactgacaacctcctcaactttcttattttccaaccctgaagagcaagagcaagagagagaggtattaacaaaaagtgcctttttctgcctgcagagccctccctaggctctgaaaccccgatcgcaaggaaggctcttgaacctcaccaccctgcccctcgctttctgccaggctgtgggaaaccgatgcctcctcaacattgttgcacactcttgaggacacttcatggctgctctccatgcatcctatttttttaacataccctcatgccccttgagtcatgaagtttaacattctcttcaagttttcccaaaagaaccaacttacacaaaagcactggtgagcaacgtggacttttcaaatcggtgtgtctactccgatcctagcgggaaacctcaatgtccacattggacacgccctttcttctatgtcccttctcatctgcttgactcttgggtgagggggcagcatggcctctgtctcctctcatcccctgccaccctctgcacagcatccatcctggcaggctccatcccaaacgcaaagcgattcagccttcccattcctcacctggcatcacctccccaaacctggcagtccttcaagaaaggaacactccatctcagccctatgcagaagacaggggtagccataccttataaacaaggatctttacattttattactcatttttcttctggttcaacacatcagtccggcgttgggcttcatttttgctcaaagataagtgtcttctacgagggtccatgttgcaggagatgtgtgaagaccaccagccagccatggcttccaaagcgggttaatcctgactggctctcactctgaggaattatgcccttcccagctccaaacccaaggggtcttacttcagaggacaggtcatcagggtttgatcaaaacttctaatagttttccccctgacaagaatgcaagctgaggatattttgaggagtgagatggaaagtaaagagaatgggctcgaaggacattcccagaaagcatctggggaataaagagatgtgatggggatttgagaaagagcaagaaacgctgggcgacaggatcgccttcatgggtcttggtgtggccatatcactcctcacttcagagctcagtgtgtgtgtgtttgtcagaagcaaaggtgcacctgccccaagggtgggtgacagacagagcctccaggccactgaggaagccagctgggcttctccagtggcactgtccctgagtgagggactctgctggcacctgactgcgatgtttgcctataggttgtggtcagttgcaattaactggcttaggcagtaaatcataacctaagagcacacactaaatgtccctccagggccagcctacttgtcacccatgaaatgaattcaagcttcttcctgaacagagaggttacattctaaataggtaagaagtcagtctccaaatcatactgtggatccctttccttctataagggttttataagctttagctccccctgccattaaaaaacaaaacaaaacagaaaagttctcccaggatttagaaaaaagaaaaattattgtctcttgtcttctgagtcttcatgtccatctcagggttttcttatttttagtcctttctcagagctcacacttcagccaaccaaattttctctctgacaaacatgaataaagctaaactgtccaaaaacaaccaaagaagatccttgtcttccaggcagaaagaccagggaggtcctgcgtggagccccagctcagccctgaatccctcctgcgcctggacagctccagaatggagagcactcactgaccctcccccagccctctccgtctttccttaacctcagcacacctgaaaaagctgacatgtttcaaggactttaatcatctgattaaacaccgaaaagtgacaaagaaaagtcagttttataaagtctaggttttgagccccttgtagctcatccagcatgtggcttcccagctaccaagggtgttgtctgggctctccaccgagaaagttcaacttttaaaatctgcaataacctcgttgcatccacccttctcttggggaggatctcagcagcaagggtcacaaattcaaataacgacagggaccaggcaggagacataaaatggcccaagctgtcaccgtcagcctctctaaggaaaagaggacacggcctcagggcactctggggcccgttcctcagaaccagcctcttctcaccacagggacacacacgcccaaggccttctagtcttttccagagaagccagaaacaatttttttgtatgaaagtttcccattttaaaatgcctctaaccaattcaaactgtcttaaaatgctgtgggaaacaaatcccacatctgtgctgcctggggtctgcctgcgaggggctggcatattttgtggcttagcacaagggcccctcatgcgtccccacccaaaggggaggcacagctttcctggagtgaaaatagtgccagcacctatccaccaaagcagtcacagcaccaccgtgccttgcctctgcctctcttttgagaaatgctgaaggctttttctgaaattggctattgatctgattgtcattcagactcacgtttgcattaatgctctctttagtaagttaagaattttccttttgcttttttccagaaggatggaaagaaaggtggacagaagggcagatacgctttatttctgaattacagctcaagattcaggtgcttcatagccagaaaactccctaaagtagcttagatggaagtacaaaagatacgatttttaaatctgtccttttcagttcagtacaaggaatattaattctgcctttaacagcacagacctaactctgtgtcccaggactatccagctctcccacccctaggtcggaccccagtcaggtggagcattttgctttgggaaattttatctcagggattcttttgtttctggaggacagcttttaaaaatagccacataaaatgaggaaaatgactgaagtcactggcattatgtctgtcttttagaaatagtgtcatcatcacctcagtgccacccagcacgtgaggggctcacaggccagagatgcgtcacttcttgacctgtacaggttttatgtcttgttgggggcctacaaccaagcctgactttatgcaccagatccctcaggtgggacccccagaagtgctcctgatctttactgggggcttcgtgtcccatctgggccagcctgggccttgcttggaagtgtgatgttgtaacataccctggcagaaaaaaaataggcagttatatcacgactgacataaaggtgagctttattaagtgcgcaaaagaaaacacttagatttgttcactcaggcaaacgtctgaggacataccatttacacactactttaaattataaaagactggacctgtcttagtgttaactatttgccttttacaaaagtactgtcccagacattatctcatttgatccctgcaaaaccctccaagagagaagacagtgctgggctccccctgctcctgttttgccagtcaagatagtgaggtggcctgtctaagccactgtcatcaaagctgtgcaaacagagagctaaataccagctcagggcctgtggctcaggaaccgtggctctttcaccttcccttgatggtctttgggtgcgagggccagcaccaaacctaaacatttataagaaaatgcaacaattcctgttgcaaagaatattttgttgaatgggttactgcatctcagcaaacacactttggggagtgacagaacaaaatcagaaaccaatgtggagcacaacatcagggtccatgagatattagacatccatgcctgaaccagggagcacctgtgccttcggtagacatcagttgtcgacaaaagacatgtgattcagtaaaaataaagttcagtggcgaaatgaatcctgaaaataatttagagaaagagaaactagagtgctgtgtttggtagcaacaagtttgtcagcggggtctgagagagagagagagagagagagagctgtcagtatggaaaagattaggctaaagagccagaaatgccaggagcccccaaaatctgactggccactgtagtttcagcatataaaagtcaaagtcgccaaaacttttaagccagagtctgctaaccaaatgtgactgaggcaggagtctcaatcgatagaggtttatttaaccagagtttggggatatgcccaggaaaaacatgagttagaggagtatctgtaatccgagctttccaaagaaggttgtggagactcagtatttaaaggggaaaaaaaaacagcaggaaggaagggagggagggagtggaggcactaagacaaatggctacacttccttgtgagcaattcgtgacagaggccatgtgagaacctggctgatggatgaggctatgacacagggtcgtgaagttgtagctgtctgtctgggaacaaaagaaaggtggtattgtgtgactcacttcacaagcttaactttccctttggcatactgagtttcggggtcccaagattttattttcttctacaagactaatttgcaccttctgcaacacatgtacgctaagtgtggatgaaaaacacagagcctctaacagattgtgaacagacaaaggctcatactttatgataaggactagaaataaattaagaggatacagagccagagcgtggcagggaggcactgtgagataggaaaatgagaggtctttttgctgagccctagacgacatctgcaggaggcaggaactgactgtgggttctgaggcaggtgaccagccagcagggctgtggagcctaaggcaggtgaccagccatggctgtggggtctggggcgggtggctggccacaggcagcacagcagggctggcggcagacatggctttcgtctgttttctaattctaactgctttgtggagagtagattggagtcaggcaagcaaccaagaaaaacggccagtgcggcccacttgagagatgccttggtccagcagggctgtgagaatgggagtgtgggtggtggacctgagccccggggccccttggccctttcctcatttcagatgggctactcaagagacagaagccaaacacatttgacagacgctgccgctcaggcccgggatctccctagagacaccgtcttctccttttctccgccagccggccaggctggtcagcaagaccagacttgcttctgctggctgaggcttggccacaccctaaatgtgcagagtgccagcctgatgtgggagaggagggtgaacagggtggactgggcctccaatgccatgccctgcactctatctctgcctgctccctgcctttcagggcaactggaacccaccctgcaggctggcccctccggccctcctcatttacaccaaacacgtggctggggaaccgtgaagcatgaagaggaaggagttcgacagtttgccgctctctgtaccttccctctcccccagccccagcctgtggcgtgcagccctgctggcgctaaccttccctggttactgtcctcccctccaactgctgcggaaccagcctctaactgcctgcacttccaactgccactgactcagaaccttctcagggttcttgctgcgatccaagctgagctcagcccctccacccgtctttttcttcttactctccttgagctctctggtctctgcccagacctcgctggttctctcaaggtttctaactggggctgagggctggcagtcatcttcacgtgcggatcttgagctttctcaacacccaagccttttgaatacccaccgaaatacgctgtcaaaaacagctcaggaccacacgacaatctcttaaaaagaatattttgctacggaagcagaaaatcaaattctcacatcaaatatcacacattgtcacgtaaaggtgctctgaagccagctctgccctggatggctgccctctccctgccgagctcactgggcttcctgctggcctgggtcctatatcatttcatcctccccccagataccacactctctcctcttcatagccaaatttcttgaaaagtttgctaattgttaggcgctattaatatattttatcactttgggacgtagctctgagcagctcattctaagactctgttggcgctctttgtattgtcaagctctgtaatacacaatggtgctacaaagacaaatttagacacaacacctttaaggaattccgagggacctaggcaaagtgctctgtgaaaacacagaaggaagcaaccagcagcctagaaaggtctggagggtcgtctaaagaaaaggggcttgagttaaattgggaagcatgaagaggaagtccccaagaaagaaactgggaaagacaacaatgatggctctcactgtgaagacagtggagtgtctatcagacagcaaggccgagatcacggctggcttcagaagggcctgcagccgccacctggaaacccccagcactgtccaggtcttgcctctgctcctctttgagcatgcatttccttcttttctctccatgaccggggcgtcccctgatgcccctgggctgccccacagctcctgagtctgcacatcacgtgccaaaacagaggaggaatggctttcttgatactaattcttgtaccaagaatgattcatctacagtcaaggttccaccctgacccgattaagtatggctaaggggatggagtcagcatgaacacgccagccgggcccacactggtagaggggtattgtggcctccaagtgaggcaggcagtgggctgagcccacccatcagagatggataatagactggagctaccacagagcaggttttgattttaagtctttgctcctataataagctatctctgaaccgggagaaacaaactccctcttgcgcttgggtctttgccactaggctctctgggaaccactaaagtaagaatgagctgtgtatctgtacagatccggaggctcggccctccctgcctgcctcctgggtgtctggtttgatgcctgggtccagatgtggggggcaagggacagctttggccttagcccctgaaggttctctgaaaaataacggacatgaggcagattgattaacaggagaaaatgcatacaaatgtacttaacgcgtacccacaggagccttcagaatgaagtcccaaccccccagtaaggtatagaagtttctagaccatcttgaggttatagaaagaacacaggctcagcgcatgaccaaaaccaggttttagaggcaggacaggttatggccagcaaaggcggtctagatgaagcccctcataatacagccccagaggaaatagatggtaaatgttccctttcagacctttggaagtgtcagagtctcagtctctcttagattgaggaaaggcctagaaagggaaggcctggctgcaacaatggagattctctacagacgcaaatttctcccacaagacagctttgcagggccatttcagtctgctggtcctacggcagccatttcaaaagaagtcaaagaaatatattttggggcaaaatattttgactttcttcaatggtcagtcactcatttggtggtgctgttgttcctaggactgggagccctcccaaactcttcctaacaccacctccatagagggagctgctgccatgaacagaggcgcccatgctgaccaaagcagtgccgggcttccgcagacagcactgccgggaatctccctcaaccatttccaacactggatgggtgctgtgaactggacagctgccaggatgttgccaaagcctgccacgcccagtggacccactgtgtttctgatgcagacgaccctgtctctgtcctggagtcacgcgggaccaagctgtgcagctgcttttccaatacttttagggagtgggctccaccttgctcctttccccatgcatggcagggtgcattcctaaaactgaagcctatctgaattcccacaacacccctgacacgtaggtactccaggtaaaactgtaggctttactcatgccacatgtaatgggtactgacccccaacacattagagtgggtgcccaagggataaatggtagtaggggctggggataaagcaagaaagatgagaaatgaggtgtaggggtcttgcacagaccagggatgataatgggccaagaaccaaagagtatgaataattcagcctcatcttcctggggctaccccagcagagttgttgtctctgctctgaccatatcctacataggtctgtccccagcttctgcaaccttctgagactatgctaagaagccccttcagctaaggagccctttgtgctgagagctggcagtacctgggagcgtttggccccataagcagcccgcagccagtggtgatgaccaaggtgtgcaggtgtgcaggtgtgcaaaagccccgcaccaggactgcagaggaacttgggccccagggctccctgcggacccgcggcagctgacactgcacttgtatcaacctcctgacttggctccttcccagctggtgtcacctactctccgatttctcctgggggaacttccttaacatatcatttgcacctaagactctgtctctggtgtgcttctgaggaaagccacctaaaactatttccaggatgaaaaaaaactaaaattgctatcaccaacctcatgcatgcaaagaataaaatgtactttcctataactccaccaaatttaggtttagagacctcatctcccccacactgaatgaactgttcagccaattacaggtctgttcccaacggtatgctggcaagccaggatctccagggaggaaaagaggagaaaagaaaaaacccttatttctaatatttcctaatttccatgatgtaaatactcccacctgtggccaatcccaagctacaaatatgatgtccctgcactggggcagggtggcatagaaaaagttgcaaatgccaggcccttgcaagcccggggagcctgccatagcacagcaccttccctcgccagcccctccctggggatttgtctaagctgctgtgagccatgatgctggctgtgatgaccgtccatttcgagtcccctgcccacagggtctttcctcatgcgtggccacatggcccctcaggtctgatggtgctgtctgctacttccatgacacgtgggctgtcagtgactctgttttcaaatcgcagcaagagctcgtagtcttttccctctaggtcttcctgcagtgctggtgttgcacccaggaagcagggcacgtcaccttcttcctctccttccccacacttgaagaatctgctctggggatgggtggccagatagggtgggggatgccccactctccttgtgaatgcttctcagctctcttctcagcactttgcccagtcacttcttcctttgggagaccataattaaaataactttcattcattcactgctagacactcaggtttacagtgaattagaaaaaaagcttcctacttccaaggagcttgggtttagttcctgttccctgttcaagagtttcagccatgctaaaagccacttactgcttgggaaagctttccaggcagagaaaatggcaattgcaaaggcacagaggcagaaaccgacctggtatttaaggaaaagaaagaaagtctgagagagtgatggagacattttgcaaggggagtggcagagtggcatgaatcagagacgggcagaaccagagcttcagggtgcgcagtctggggagaggaggcagggttgtcattccaactgcaaaaggaaacaaaggtttagaagatgtagagtgacatcattgtatttatatttttaaaagattactgaagccactttgtactggaagcagggaaatcatttggattaagttcctacagaaaatcaagtgcaacgaggtagccatttgaacgagggttgagggaatggtgacagcactgggagtatctgaaatgcagactgaaggtggaagtgacaggacttgatcactgagttgatgtggagcaagagaaagagaaaggaagcctcccagttgtttggctggagccctggatgggccgtggcgtccttctctgagttagggaagagaggaaatggaatcgagttgctgggggcagtatgaatccactttgcacaggttaaaacaagacgcccattaaacacccaaaaggagatgtcaattaatgaagtataggagcgtggaacccaggggaagacatgaggactacagatggaaacatggggtcaccaatgtgtgggcagagtgtcttttacaaagcagaaggagtaaagcaagaaagagaaatccacagcagcagaatatacgggatcctctctaacacaggaatgacaccacactcagcaatggctcttcttggtatttaccaaaatgagttggaaagccatgtctacacaaaagctctcacacagtgtttacagcaactttattcataatcgccaaaatatggaagcaatcaagatgcccttccatacgtgaatggcaaactgtggtacatccaaataatggaatattactcagctctaaaagaaatgaggtatcaaaccaagaaaagacatggaagaactttaaatgcatattgctgagtgaaagaagtcactctgaaaaggccacacactgtatgaaaccaattctacgaccttctggaaaaggcaaacctgtggagacagtaaaggatcagtagttgccaggggttgggggaggaggtgataggcaaggcaaggaggacttttagggcagtgaaactattctgtatgatactttaatgatggatgtgtgtcattataaatttgttcaagcccaggaccaagtgtggctcatgctataatcccagcattttgggaggcccaggcaggtggattacctgaggtcaggagttcgaaaccagcctggccaacatggtgaaaccccatctctactaaaaatacaaaaattagctgagcgtgatgtcaggcgcctgcaatcccagttactagggaggctgaggcaggagaatcacttgaacctgggaggtggaggttgcagtgagctgagatcatatcactgcactccaacctgggcgactgaccgagactcagtctgaaaaaaaaaaaaattttttgttcaagcccatagaatgtacaatgccaagagtgaaccctaatataaaccatggaatctaggtgacaatggtgtatcaatgtaggctcatcagtggtaagaaatgaaccacttagctggggatgttggcagggagggaggctgtgtatgtgtggggtggggtgtgtgcgaactctctgtaccttctgctcagtttcactatggacctaaaactgccctaaaaaacaaagtctgtttttttaaattaattcatttaagccaataatactgcttctagcaacatttgctaaggaaaacatcagaatgaataacaaaaataacgtatgtctaatgatgaagtgttatgtaataattaatttttgtgttttcaaccatgtaataaaataggaaaaaaagatggaaaaggagtgaaaatatctaggctgaggccatttccttgtgaagagagagccccaacaattttcattaacagacggagggcaccacccatccaggtgggagcagatggaaaccgagagccacttctgaaagaagacaaaattgatcatgcaaatggatttgaatgtgatcagaggagatacttacgctggtggagggagcggggcagaatgtggagtggaattagtaataagaacatagaaaaccagtatagacaaaagggattacttactcagaggaaacgtaacagtatgtagaagtggaaaagcgattctgttttactaactggctgaccggtaaatgtgatttacctagtcataataaataccaaatggtgatgtaagtttcagtgacactctcttgggatttctgagagggcatgacaagggagtgtgacgtgaagggtcgggtttggcgtggagggtgagcaagaggtgataacgggagctgaattcccatcttccctaatgggaggcccaaagattatgcctgaaacggaataatcgagatgtaggaatgtcaacatggaaatcggaagaataaaataatttttttaaaaagaagagctaagaaagttgaaattggttgcttcctgagagtaagaaatgggtgggaagactggcagaggaaagctagtttctcatacacattagagaataatttgcctctaaatgatatgtatataactttaagaaaaataaaactgaacaaaaagagaagtttctgagagatgatgtgtcatacacagcactatagctgacaagcactggtatctactgacaagcactggtatctactgagtgcctagtgtgtgctgggcaatgttccaggcactagaaatacaccagtgagtggtcagacacacacacacacccttccaaacacgtacatgcccataggttatccagcagcccaccacgtgtagcgtgagtcatgacattgggtgctcacagcaggaggctggtgtgtgatgcgaagtgaccagaatgggagccaagagatctgaaaattgtgagacgcgtcaggcttcatcagcttgtccaaatgctgctgctctgtttcagttgttaaataattattttcatcacaaccatgatatttaaaaatatattcacagttcactgtttacacagttaaactttatgcccagtaattcatttaatacctcattttctgagtactgtgctaaagtatctccctgagcaattcaccatgatgatcttggattagataaatgaaattaccagaaaatgtctcgtgtaaatttcattttttgcaatattttatcaatcgttaaaggagcacatagttattaagctctccctttacttcctgagttccttcttactggaggtgtagcatttgggtggttgtttttagttttcttattggtgtttttctggcagagtccgagtagaaaaaaaaaatccagaatctaagtccacgtccacaagcgaactatgtggggtactacactagaacataaagctattttgcgcaagaaatattagcggctttacaattagaattaaatagattacattccattttttaaatttttaactggcacgaatttatgtatgtatagggtacaatgtgatgttttgatttttgtttacattgtagaatgattaagtcaagctaattaacatatacatcacctcctatacttactagttttttttgtggtgaaaacatttgagaatctactttcatgccacataaggaaggcttagccacagctgctcttatgctgatgtaggatgccctgtgactctcctggagtgttatgaggagttgctctcaggccatttctcacctaccttctatctcacagaaactatctctgagacagtttgcatctcttcctcctgagtcctgatgcagtctgacgattttgggcttgccttctcccgcacggtctagccgtagactatgacactgttagtgacagcatgaaattaactccttggccacgggcgctgcaccactcgtgttacattgtcacctgcccctgatgttctggtattgtctcttgttctggtgttgggacaagggatgtcgtgagtcatcacctttgctattcttgatgttgtggtccatgtaagtcataaaagaaaaaagaatctactcttagcaatttttaaatataaaatacagtatggagtttcctcaaaaaactaaaaatagaattgccatatgttccagcaatccctctactgggcatgtacgcaaaggaattgcaatcagtatgttgaagagctgtctacactcccatgttcactgcagcactactcacagtagccaggttatggaaaccagtgtccatcaacggatgagtggatagagaaaatgtggtgtgtatacacaatgtagtactatgtgtatattcaaatttttaagggtgcataaaaactgccttcaagatggaaagctcctccatgtccacgtgcacctgggtcaggttggggacagccctcatgacagcaatctg

SEQ ID NO: 500 - DNA, 20001 bp, Homo sapiens
gaatagtgcccacctgcattggtgagggatatcttttctcagtctactgattccaatgctgctatctttcagaaacaccctcacagacacacccagcaaaaatatttccattctgggcatcccttagcccagtcaagttgacatatgaaattaactattacacaagggcaccctaataaggattggggaaatagaccacctcttgattaaaagaactgcaaaatcacactgcaaatgatatggataaagggagggataaaaaactttaggacatttttgcaatttgtctatcatatactcaagtttctgggacctgcaatgcaacccagaagaagggggtcaagtgggttttattttcaattattttacatgattctttctcctttaatcttatttaattatatatttattatctctataattaagtatattattaacagaggagattatggggaagagaatagaccaaggaggatggagatgtatagagtctcaaacctatcttttttcagaaaataaactctaggaatgattgtctctctttcgtggtacataatatttaatttggaattcttcaattagtgagagatatttagcgccactttgggtttagcctgggctagctgctgtgtttcctagggaccatagcaaaaactcacatttatatataaagtatattatgtcccagaatatgaaaattctcagaacttctgtttaaggataagaataaaaggattggtcagaattgccactcttaaagtgtccttgagggacttttgcctttgtggtgacataatcttcagaagaccactatctctaaatgtctaattgcttgtaaatgactgattatggctcaggcattcagggatttatctaaacccttctttagtccatttaaccttccagcctgcacaatcttttaggagcatcaagtttcatatgtgtttggagagttcccaacccttcaaatgtaattctgctcccttgagtacaatagaaaagcacttggtacttgtggatttcaaatccctttacagaaaagaccacagtcccatagcttctgttagacacatgaaaaaacaacaacaaaaaaaacaacaaaaaaatcaaaataaaactatgtctgtctctgtctactagctttgctattttgtaagatgaattaagataattttctccttaaaatcctttgctaacttcatttgtttatccatattctaataaagttggtaaaactttatttattcaggttataaaaaagcaaaattgtccagcatttggattttctctgtgttccctcagccctggtacatgaaataatacagcaagttaccattttataattgtattattattcttcttttaagtcattttccgtttttctcctattggaaatgtgcaagaaaaaaaaatctcataacttccttacttcctgtgggagttaatggctgctaaggataatagccacgcagaatactgtaaggaataataattttcctacagcttccaggatgaaaacttaatttgatactcagtaatttgaactacagagtttaaatgataaaaattaaataaaaataaaaacttcaacaggcgactaaggtgattgagaatgtttcatgagtgtaatttgaaaagtgattattcaccaagaaagtggaatgagcaaataaaaattattgagaagaaactaacccatggtaggattaaaacattctatttactaacaaaattaagtataaacttatacactatacatatatacacctaaggtatagacacatacttacgtgcctgtgtgttttatgcctttatatctttatatagagagagggagagaaagagagagatctgaaactacaaaaaagtaaactggtaatgagagtattaactcaaatccatcttcagacatgttcaacaaagtacctgtcccagattttccaaagatttttttttttttttggttatacatcattcaccttttgcattaagtgtgtcaactctcccatctcttgctattctgcatcctaacatttactttcctgcattagagtatgtggtcaaattgtgaagatatccatcctaaatttttgtatcagaaactgttcaaagctcctatttatagcatccttcaaatatttttctaaagttctagttattgatttcctaatttgcctctgaagttagaaatccctccaatgaggaaatttaaagaaactcactctcctccaatgtggaccttaattctaaaaatgcctcttatatatatctaccattgtataattaggttgatgcccttcaccttgcagtcaaatcttcttgttttattgttgttgttttcagcttttattttggattcagagggcacatgtgcaggtttgttacatgaatatgttgtgggatgctgaggtttggggtatgggtgatcccatcatccaagtagtgagcatagcacccaataaggggtttttcaacccctatttttttagcccctatcctcagtgtctactttccccatatttacattcacttgtattcaatgtttagctcctacttataagtaaaaacatgatatatttgattttctgttcttgtgggttaaattgcttaggataatggcctccagttccatccatgttgctgtaaaaggtacatttttgttcttttttatggctgtatagtagtccatggcatatgtatgccaccaatggtatgtgtatcattttctttattcaatctactcactgctgatggacacctaggttgattccttgtttttgctattgtgaatagtgctgcaatgaatgtataagttcctgtgtcttttagatagaataaattattttcattagtagcaggattcctggtcgaatgggagttctattttaagttcttttagaaaactctaagctggctgaactgatttgcattcccaacaacagcatataagcatccccttttccccacagccttgcccatatctattgttttcttggctgcttattatttgccattttgactggtgtgagatggtatcttattattgttttgatttgtacttctgtaatgattagtgatgttgagcatttttcacgtttgttggtcacttgtaaatcttttgagaagcgtctgttcatattctttgcctattttttaattacatttttttttcgctggttgatttaagttcgttatagatccttgatattagacctttgtcagatgcatagtttgctaatattttctcccattctgtaggctgtctttttacttggttggtaatttattttgctatgcagaagctcttcagtttaattaggttccacttgtcaaattttttattgcaattgcttttggggacttagccatgtattttttttttttttttttttttttttttttgccaaagtcaaagtcaatgtcgagaaggatacttcctaggtattcttctaagacttctatagtttgagatcttatatttaaattgttagtccatcatgagttaatttttttaatggtgaaaggtaggggtccagtttcattcttttgtatatcactagccagttatcccagaaccatttattgaatgaggaattctttcctattgcttatttttgttggctgtcaaagatcatttggttgtaggtatgcagcttcatttctgggttctctattctgttcttttcgtctataagtctgtttttgtaccagtagcaatgctgttttggtttctgtagccttatgctatagtttgaagatgggtaatgtcatgcctctggcattcttctttgtgcttaggattgctctggctattctggctcttttttggttccatatgaattttagaacagtttttcctaatctgtgaaaagtggcctttgtatttcgaaacatcattgaattaaaaggcactgaatctataaattgctttaggcagtatggccattttaatgatattgattcttctaatccatgagcatggaatatttttccatttatttgtgtcatctccgatttctttcagcatgttttatagttctccttgtagagatctttcacctctttgtttagctgcatttctaggtacttcattttttagtgtggctattttaaatggaattatgttcttaatttggctttcagcaagaacattattggtatatacaattaatactgatataagtacattgactttgtatcctgaaattttactgaagttatttatcaagtttaggagccctttggcaaagtctttatagttttctaggcatagaatcatattgtcagtgaagagagattatttgacctcttctttatatatttggatgttctttatttttctctcacgcctgattattctgactagcacttcctattatattttaattccctacccaatcccatatctggccaatttagacagccatcaaatagctctcttggtttcacttcctatttctaaatgccaagcaaacacaggtgaagaaaccagtacataacattgggctccattttaagttgccactgttgccaccaaaagtagtctcccaaagctttgaggatattctgcctaaatcagatccctatgccaggcctggtgagtttttgcttatttttgtttttgaggaaaatgaccacattgtttttagtattatattcagttgagaaagtactttacttgggttcccaaaaatttagtccttaataagaattcacaattaatttgcatttatatatatgtacatacacacatatataaacacacacatttatatacaaacatgcatatataatatgcatacagacatgtatatgttatatacataaatacatattgcatgcatacatgttagatacataaatacatatgtattatatacatgcaatcatatatatgtatatataatttataacttattcattatgctcaaatactggctgaaaattcaaagcatctggatcagaaagagacctcttgcttttaacaaatgctgtgcctaaataaatcttcccttcatgacataagcggtcatgaatccaagtcactaattaggattttcatttcttaaaaggtgaattcctctttcagtttccatgaaggtcttatttggagccatcttaatctagcacagaaatttattataataacagtgaacctcaaaaggaaactcgctgggatcttgatccagaaggatcctcaccctttgcacagatgtatccacttattccccaggcctgtttcttgtatgccaaggaatactgaggaaacagtcttcgtcaaatcacaaaaagatgcggttacatataccccctgaagcaatgggtacctactcaccttaaaattatttttaagaggaaaagcgcaattgattcttcccataacagcacaaatctgctctcaggcggtttactgtctgcagctttagacagagaagtctagagaattttaaattctgcctcactgatcaacattcagtgggggccgtggcactgccttccaaccattttccacttataacacacatgaaaaaggaaaagattatatctgtgtgccacactgggatgaacttgaatgaatctgaaagtgtctatacagggcttggtgaaaaaaaagagttatatttttaatgtaatataatcatgttagaaaaatagaataaaagtgttagaaaggatattcaaatttggatttacataaaacttccaagtaaagtctttttaattttttgctttaatgagaaacttgagcttgctttcacaaaaatagatttttatgtttgattttatgattgagctggctacaggcaactcctaatcatgatttttaatgatgatctttctttaaatccttaggagtcacaatgagaaaaagtttatttacaaatagataataaacattttaaaaccattttttcacttttatagctgcttaaaaactagcaaattgaaattatattaaaaaaatctaaaagcatttgcttttctctcattgactaatggtaggttgaaatttcttatagtaatgaaactgaatttcaaacccaaaaaacatttgtatgtgatatatttcaaaataatgaagaatatctaatttgcagaatatgcatccatttttagaccagtcatactacagctagcttggatgcaccaacaaaacatatctgtcacaaacacacaaattcaagatctgctcctgaagtaacaccctccaggagctttctctgaccacctctgaccagctcatctggagccttgttccatttcgctaacataaactgcttcagcagcaacccagggagttttcactggatgctgaaataaatttcctcaaggtagagcatctctttagtgtatagaagattatattaaagactatcaaatgtgattccttgaactctggcctgataacctgctgattctcaaactagcggtccaaactaacatcaacagcagcatctcttgccaactttttagaaatgcaaactcacaagctccacctgacacccacagaatcagaaactgtgctggtgtggatttttgattcatgctcaagttgaaaaccacttggctgaaggaaatgatattgaaaatgacatctataatccactcaaaagcacaaaagctaggaagccctgtgtctgttttgttgttgccgttgaaattatagagatttctccaaccttttgtaagaaaaatcttcaaggtttgatgcccacgtaaagaaagctacacactgtgtaaaggtcattgtctgtattgcttcctgatgtacttttaaacttggctcagaggcccagagttttgtaattgctcattctgtgcccatttacacatgggcaacctaagtagagtaagtcactaccagggtaatattgtccaagaaggaccatgaaaacatattttttaccccccaaaaaaatctcatcaattcaccttctgtgatgcctaatattccagaattgacgattctaatctgagggtgggaaattcacctccagcaggactcctttcagatgtaaatggttttatgatgggggaaagcagctactatctatgattgcctttatttataagattaagtttgaaaaccaagtaacactgaaagaatgtgatatagaacaagaatggttgagatttggtgaagtggaaaataagatgaaaaagaagtcagaaaataaaagaataataacaaaaaaaaatctaaaaatgagagactgcccagcatgacatcctaatgagttaagggtcagtgtgaacttggccatttaagtgtacgttaaagtgaggaggaggaggaggaaaagcagagaaagaaagagaagaagaatgataaaaggaggaaaaggaggaaaaggggacttctacttgtgagttttctttaatacctgctctggttagatctttttatacccaccactcacaacagccaatgttatcttgcatgcacacatatcaccaataggaaatctgttttcacctcagagaggctttacttaaaagacagcaagaatttgatcaaccagtttattccacgcaatttttaaccatctctggaatatcagaaaccaaatggttcttacatagtgtggaatttaggaggttcagagcctgtttgcctgatgcctgtttgcctatctgtcaaagctctaaatttctctctaaaactctcaaaaagaaatagagaaatttggggaccaatggtggaatgaaagctaaaagagaagcacgctacctgcagacacattggaatactatactgttttgcttaccagaaatatcagcaggacttgtttgtgcctggagtatatgtgattccagggatatttctactaatctcaggcaccctgaaaacttaaacgcatttcggttatttttgaaaaggcaatgtctctcagtaatgcattcttaactttccatttccattctccaccagaaacatgcaccgctaccaacaacaccatcatcacgatccttaaatagtagtgaccaaagccattgtacaatatcatccggagagaaagcttagcagagacaggactgaacagaaccagtttaggtccacactggcttgaatacagcttgcattaaacaaacatagatgagaatgtgaataagattaaagtggagctacaaagtgaccgattgaataaacctatattctctgaaatagatgttcaggcattcctggagccatacttactacatttaaatgcatgccttaggttattcttgctatagtacccctttcctccaagtcagcagatacacagggcaaatatttgagaagaaacaagaaagggagttgagaatagtagaaagtgtttctcagttctgtttcccctgggttggctggaccatcacatgccttgcatatgcaggctcacagtatctcaacaccacaagcaagagagagcagttttctttctgaaatctccctcacgagtccttacattcactctgtttcacctgcccagattgagtcacatgcactttgacctgggcaggcatatatgaataggcttagacccacattaggtacccactgttggggttggagatggaattcccacttaaaaaaatattctgtgaatggaggcaggatggttccataaaagcaaaattgaagtactgttatcagaaaaaggagaaatgattactgggtatcataaagtcacacatgtcaactacagtataaacaacctttaaatatgagcttgttaaaagcagcatgcactggcacacagaaaactagcctagcagttgggaaacttgattggctctccatctaattcactgtgtggccttgcaaagtcccactgattagtcagactttattctgcaggagaacctgtaattctccgaagttatcctcagtctcctcagggatctaaagaagagggactccagcaaacccaatgctcagagataaccattggtaacatacatatgttattattttatacacatacacacagccttttttctaagcttaattatgctttactaattttgggcatgagataaggtcacaactcttaaatgttcattttttttaatttttaaattttatttatttatttatttgagatggagtctcgctgtgtcacccagggtggaatgcaatgacgcgatcttggcttactgcaaactccaccttctgggttcaagtgattctcctgcctcagcctctgaagtagctgggattacaggcgtgcaccaccacgcccggctaattttgtatttttagtagagaagcggtttcaccatgttgaccaggctggtctcaaactcttgacctcaaatgatctgcctgccttggcctcccaaactgctgagattacaggcatgacctactgcgcccagcctaatgttcaattttaagtgactttcattgtccttcctgtaaccgaaagagggtccatctgcttgctgcttataggaagagtaaggtatgataaaaagagagtgaattttattatttgttgacagcaagggggaaagtggccagaatcctttccaaaaattgccactttccaatttctggagagagggcaggggtttaagaaaaggggcttggaatgcagaagaggtatcagggctaggaagtgccaggcagtgtgggtggctctgatggcttatcttgaattactgttccatctggtgaaggggctggcagcatcatgggctcaaccatggtacaaatgaatcagtcagtcttgcagtcagtctctagcctgaagtgaactccagcctggaagtaatcccctgctagggagagaattctggaggtgcctggttcatatcaggcttcagccactgaagcttctacggagataggtgattagataagcgagcatggtgtgagcttaacaagcacacaggtaaataaatgtgcataaggcatgggagcataaggtgggaaagggaagggagaggagttttaaagcacattccaaggctgtatttcaagatgaaagaaaacacatctgtagtttgtctcaaagcacaccttgagactgggaagaaagaaggaaagaaaataaaagtttttgttttttattttttgggttttttttagacggagtctcactctgtcatcaggctggagtgcagtgccgtgatctcaactcactgcaaacctccgcctcccaggttcaagcgattctcctgcctccgcctcccaagtagcagggactacaggaaacaaaatttttaaaacacagtgtgaggctaagctactcagttacattgtcacagtcaggaaaatttttcttttcttttttttttttttttttgagacggagtctcgttccgtcgcccaggctggagtgcagtggcgcgatctcggctcactgcaagctcttctcccaggttcacgccattctcctgcctcagcctcccgagtagctgggactacaggcgcccgcaaccacgccaggctaaatttgtatttttagtagacacagggtttcaccgtgttagccaggatggtctccatctcctgacctcgtgatctgcccgcctcggcatcccaaagtgctggaattacaggcgtaagccaccgcgcccagccgataattctttcttttttactccgagattaccctcctgggcaaacactaataattccttaggcttattcagtctaaggattaacattttgttacctttttcttattactggaaatagaaccctcaagctcttggaggcttgaggatgccacaaccacaataaggcatcctagaatgtccagttgatgtgctaaaacacactgtcacggacccctgaaaccttggttgccaacaggaaaggctagaaattgtactccctttacccattgcttctggaaccatcagtacagatccaagatacagtcattcttcaagatcagagaaagaaagattcctgtagtgttaaaatgacacagaatccctaggttacaccaaaataggtggctatcttcctagagaatacccaggttccagcgttgagtgggcagagggtgtttctctgtcagctcaagactagctcctcctttgcactagtgaagcctttgtttacatagaacttgactctcttccttctcatggttagtttctctttgggttttggtgagtttgcttggtgtcctttcctgtctattgatctacaagggctaactgttcataacatacactcggtgtccccaaccccatcccaaagtgtgtcagggtcttgatttctttcttcccaagaagtttcttggctcttaataaaaactgcctaccctctttctcagcagccttcgtgctccatacaccaaggtgtaggggaggattgtcctttgtcatgaggggaaaaatcttcttacactttctttccacaattccgtggcctacttgagggcttttcctccagtgaaaatagtaacagaaaatatacaccacaatactgatttccctaaaatagaaataaatgttttggtaacttttcaatggaaactctgtaggtgaatcctagttaaaatagaagatgtactaagcaccagatgtctctctctctcaatctctctcttttatgcacacacaaacacagagacaacgcaatgaaaaataggaaactgctaattaggaaaaaaagagatttgaggttgagtggctggttgagttaaaatactcaaggtcagatttaattttcaatgttcagttattttaataggcaaaaggcatatatgtcaggatacctctattcagaggattattttcctacccttatttcttcttaaaccaaacaacattatacaacattctggttggcaaatcactcctatttccgtatttgccttatgtggtttcagccgtctgtttgtggtatgagtacttttttcacatgcagaatccaaactggattctccaccagtttgtgaggtagacccttggacagttcttgcctcccatcaggcaaactgcttcaaaagtgaatagctttcagaccccttttgtgacatgcctaggccagcaagatttttgatgacttccaatcccaaatccattgtctcgttaaaggagggcttagtggcaaggcattctttgacaatagcattaaatagtaatctgatatagatttcttgctagaatttggaaatcattttataacttaatttgtttcaatgctgtaaaagttaccattttcagaagaatccacatggatctctatcagctctatttgaagacaggagtttatcatcattactttgtattgctatcttcttccatggagagaaaaattactaaatgtgttatgagtattagggagctttgggccataaaatgcaatttgaacacttagtgaaacattccacatcaatatctttcttattgatttggaatcaatgacaaaaatatttttatagagacaacattttcctttattctggcttttttaatacctagaacactttttcaccagatatatcttctctacctttctacatttttttatttctttgctcaaagttacctttaaataagatctaacctgaccacatcattaaaatttgtaacctgttctacaatatttccaatctgccttatcccttgctatattttccccacagcatttatcatcttttaatataacaaataaaattatttagacaacttgctgttcattatccatctctacgttctacaatgtacactgtaaaggcaggaatttttgactgctttgttcagtaatgtttccccagtacatggtactgtgtttgacatgtggtgactccctcaataagaatttgttatatgaatggatgaatgcctgaacttatgaataaataactaaaaaccaaaaaatggtgacaagttatctatctaaacaatttggtttcacagtgaataatctactgaaataacaacatatgatttaacaagaaaaagaagttaacggctgtcaaataatggtaccttttaattttacttataaaagtagatcacaatttacaggtagaatcatttaattatgcaatatacgattgacttaatagtgttttcagtttataatttcgagtctctttttatgttaacattttaatataaagtcaaacttttttttttcattgaaacaggtaagaaagttacagataattttagtttgtcagttatgataatgctatttgtggctctcctgacccttgactcacaaaagatgggacaaattatcattttttttaggtaataagttttactgctaattcagatctttgtgttatgtgtcccaaatctctcttaggttctaacagtgacagatattgattcatttaaataaacatcatgtataactttttaactttatgttacatggtttttaaattcttttatatttggtaggataattataaattatgttttgattatttgtattcactgcattgccttaggtattgggcataggtagtgtgttagtcaaggttctccagagaaacaggagcaataggatatcttatgtatgtgcatgtgtgtgtctgtatgtgtaaagagagagacaccgagatttattataaggaattggctcctgtcattacagaagttaagaagtttcaagatccttaggtggcaagctggagactcacgaaagctgatgctgtaagttccagtgtgagtctgaaaacagataatcgatgtccagctggaagacaggaggagagagagagaatgaactctcttttactcagtagttttgttttattcaggcttccaagatgaaagctctgccacattgcggaggacagtctgctttactataataactctatggattcaaaagttaatcttccccagaaatatcctcacagacacatccagaataatgattaaccaaatatctggtcacccgcaccccagtgaagttagcacataaaattagctatcacaatagtatgttaggacagtctggctcagtgagcagtcaggttcccgaagtttaagtagcgttaagtccaagccaccacccagcaggtggcacccacagccactctgtcagaaagagctattttatctcaaaattgttgttttaatcaattacttctgtattatcttaattttacacagctctactttttataggcagggagcaattcagatgcttcaatatttaacctttatatatgaagaatacctttcgtattcatttgataagaaccatcttgataccttgtgtatattaccagttttacatatctgatgtttttaccttggttttacatggctcaatttctagatgggtaagctatcttaaattcattattaaacagcactactataatactttaaatataaaatttacaaaataagcaatcattatttctaaagaatactatgtgcaattaaaatttttatatgtcatctttgagtgttagcctaggggtagtataaattttagtgcatgacttgtggaacaacatataacactttagtgaacaccactgggaactcatatgtctttacagtttgtaatgtctgcccctgtagagtataagagtggagaggccgggcgcagtggcttacacctgtaatcccagcaccttgggaggccaaggcgggctgatcacttgaggacaggagttcgagaccagcctggccaacatggtgaaactcggtctctgctaagaatacaaaaagtagttggatgtagtggtgggcacctgtaatcccagctactcgggagactgaggcagtagaatcacttgaacccgggaggcggaggtttcagtaagccgagattgtgccattgcattccagcctgggcgacagagtgagactccatctcaattaaaaaaaaaaaaagtggacaaattacctgtatagattcaacttttctctatatctacaaatctaattattgctagtcagtgtagaagcctcttcaagtccattcctttgtccttattatattaccctctgatattttcagaagaatttggatagaaaaaaattcttttaggattgaactatagtctaaaagctatggtttcattagtgaaaaataataatagaaatcaaaatatgggtgctacgggtcacattttattattcacataaggactgggaataaatcaattgctattttattatctgaacgttgtgccctttgataagaagctcctcccctctcccaagagtatagcgaaaaatacaaagacataggacacacagaattttagacagcatctgcatactattaaggaagaatagaaagaaaaggagaccagccatattcaattctttgaaatgtcatctacatcctccattaagtttttagtttgcaataaactatatgctacaatgtggatgttagtgtgtatgtgggtatttggtttagaatatgtgtctgttgtaaaaccaatttatcttacacatgcacacaatctagcaaccaactgaggaagtggtaaatgttaggagtttggtataaagtctagtaatttagggacattttaaggttataactatagctgcttttataattttagcttttatgcaaaagtctgagtcttcatggattaaaatatgtcatgtttgtatttttcaacttgcagtcagcgacaaatgcgcctttacttcagtaagggaacaaagataatctgaaaaaaattaaagctctccaaaaaaaattgaatttacaaatagaggccttattgttttattctagaagcattagttaagaaaaaatctttaaatagagtagtcataaaattctcaaatttctcatatatgtacacacatcttcatttaatgtaaaattatctaactttggaattagaacttttcaaaataaattttcattgcatttaccgaaggaagtaatgtgacagtttactctctgattcggggctcaaccacaatttttaaagtgacacccagattttttttctttttaagattttagccttggggatagtaagaagggctataacatccagtgtcatctacattctaagcatgttgtcatcatttattcaattcaggatgtactgtcaatttcttgaaaagtcattcagaaaattaaattttgtttcgagtgtaagattagagtgaaaaacaaaattattggtttaaaacatagtttaatttcttgattgcatttaacttgactgactggcctacactgtaaaacagatcatgtaacaatacttcatatttttgcatagtcactgacttagtctgaattgtgctaaatttttaagaaacagaaatttattttctcacagttctggaggctgagaagtctaaaatcaacactggaatgtggtgagagccttcttgcagtgtcgtctcatgacagagggtaagaggatgaaaaagtacatgcaatgaagaaagaaaagggggctaaattcatccttttataagcaactcactctcatgataacagcattaatctattcatgaaggcagagctctcatggcccaatcacctctcatcagtctccacctcccaacactgttacaatggggataaacttccagcacatgaactttggaggacacgttcaaaccactgcaatccctatatacattaaatcattccagaacaatcatacacttacctttggaaaaaattttaaaggaaggttttacattttgctggaagaagtttttctaagtgcatttaaaaatttgtttccacttaaaaaaattatgtttaccaaggttttttccctgcctatgcttgccaccaactgcacagaagagctctacaaaccccagggcaggaaaggaagtagagaatattagagtcaataataatccagcttccctgtatctctagcaagctcctgcactactagctgcatagctccatgccttttaaaatttgctgaggtactgaaaccacactttggctgtttctgccttgctaccacattgtggccagctgaccgcattctctatattagatctaattttaggatgcttaatagcagcaatatggcagagattttaagatatcaggggacatagggaccagttaaattgtgattctactgcctctacagtctttgcaaacacaacattagataacaatttgatagtccgaatatcactcattctatccatagaatgtgacagttatttcctccttcttgaaatatacttcttggcttttatcaaagcagttctcctttggttcttcttcaagctctgctggcttttctcatcttctcacactatgcagttttaagtgcctgacactcagtcctcaggtctttacttattgtgaattcattccttagggaatctaatgaatccatggttgcaaagaccatctgtatccactgatgcaaatttgtatgtgcagccccaaaaaatccttaaacttcaggcactatatcattaaacagtatcaacatttccacttgaatgtccagtaggcctctggacctcaatatgcttaaatattcactcctgatcttagccaccatcatactttctgcatacccttctgtgacccacccccacccctcacctccatgtccccaggacttcctcttctgcagaaaagacacttatctttctctagttgcctaagataaaaagatattgccttcatcactgactcctctacttctcccagaactcaattcatttgcaaattttattggcgctaccttgaaagtacactgaaaaggtaatcattccacttcatctactcttgttctcattgacctttcacaatatgaggttgatcataacatgcctctggtcagaaacactggatggtcgtctgtttcaccgaacatcaaagccaatgtctttacaaggtcctatataaattatcccctttacatcctctcaaatttcatttcccacaactttctttcactctattctggtgatgccagtaggtctggccctctccaatgccagagccattttactttttgttttctctgtcagaaagtggtatcaccacatatgcaatgcactcactccctttacttctttcagattttaacttcaatgtaatttgttcagagaagtctccctagtcactttctcattccccctctcattctctccatatacctactctttttccccatagcctttctcatgatcagatatatttatattcatatttggcttactgactatcctaccactgaattataaactataaaagttgggcctttattccaagctgttttttcacatctacaaaaatgtctggtatacaatagacagttttttcatatatctaaaccagagagagatactgcgaacctaatgaagtttaaccgtcagtcctcttatttgacatgggcccctataagtactgagaagtgttgggaggtgtttagtgttgtaggtgttcagtgtaggtgagaggaaagccagtttagaattatgaagtatgcgagcatatatggaaatttgcctgaaggaatgtcagatgaaatctgcatgaatgacttcagtaaattgtcaagatttctttcctcatcctaaataaatattctttctcatctcaaatttttggttacacaatgtcgtattctgttttcttaagaagatcccctcaaattctataacaaccccataagatgagcatatgccaacatagatcaccgagcttttcagggaagagacagcagacaagtttgttggcaatcaagtatcttcttcaaaagaagatatccagaccctgtgtgactactcttggatcacaaatgattcatcctgacagcattaccaactctaaggttgctttaatgagtcagtgatttctgatctttaataccaacattaaagaataaattagcatgaatagtacacaaatataagtattgcatgtatctttagctgcaacaatgcacaattacatatgcagaactcacttctaaaaaggagttaatacacattttttattttcatatttttcccaaaagataacaaaaatttaatatatatgataaatattaaaggggtatttaggtccataagaaaaatttatctaaaaatattttttaggctgggcgcggtggctcacgcctgtaatcccagcactttgggaggccgaggtgggcagatagcgaggtcaggagatcgagaccatcctgactaacacagtgaaaccccatctctactaaaaatccagaaaaattagccaggcgtggtggcgggcacctgtagtcccagctactcgggaagctgatgcaggagaatggcatgaacccgggaggcagagtttgcagtgagctgagatcatgccactgcactccagcctgggcgacagagcaagactccgtctcaaaaatatatatatatattttttttaattacggatttctccaaattgtctccatttttttatgtgtatacttcaaacagttctaatttttgttttgttttctaaatcatcaattctggtttgttttttcttttgcttttcttaggtcttccttgtgactatggttaattatgcctaatgagaatatttagttgattttaattgttttattagtattaaggaaattacacaagtttagaaattttatctcttggtcgggtgccgtagctcacacctataatcccagtactttgggaggccagggcagaagaatcacttgaggccaagagtttgagaccagtctggtttacatggtgaaaacccatctttactaaaaatacaaaaattagccacctgtggtagcacacacctgtagttccagctactcaggtggctgagacacaagaattgcttgaacctggaaggtggatcttgcctcagtgcaacttccacctcccaggtgaggctgaggctgaggatgaggatgagggtgagggtgtgagagagagagagagagagagagagagaaaccttttaatgagactaggatttcccttatatttgttttatgtgatagctgctagtttattatttagtggtcagaaattatatcctataaaatatctgctttttaaaatgtataacatttttgtcatgagtggatttttataaatgtc

SEQ ID NO: 501 - DNA, 87298 bp, Homo sapiens
atagaaaagtggcaaaataacgtgagccatttttctctaaagaaattatgctgaaagtcaaggatgacttaaattcttcacaaggctcctaacacactctgtagttttattcacatgtataaaaaacaaagcaaaagaattatactttctaagaaaaacctgacaaaataacaaaatgcctgatattagtataataaattgatataaattagtattcaagagattgcacttcttcaaggtataaattgactcccacaaataagagccaaagagttgtcttgaggctcttttgttgatttacatattaatcttcctgtaactgaatataatttaatttagcatcatttaaaaacatatgcaaaatggcatactttataactaaatgattattttaaaatgttttattccaattgacataattctacgacactcttttgaatgtggagaaatcatttagtcttggtaaaatgcaccaattttctagcatcatagtttagtttttcccatttattatagttattgctactgtgcagagtcatgcaaataaaaacaaaaatgaaagataattttaaacaatagtaatagttaacttttattgagcatttgttatgtgcatgctactataaggtaaatttactataaggtaaattctgagatactgggcattaggactttggcataggaatattgggcaaatacaactccacacataataattgttaaagtaaattaaaatggagctcagtcctgaacactcctgagcccacaaagccagttaggtaggcctcagaagtgaccttaaccttgctcaatttgcaaacgtaagcaaaacttaaggtacttctcataaatgcctatgtaaaagaaaaataaaacttaaggataaccaatcaaaagttaccaaatagttcatataagtaggaattttccagcaggatagactaaataaggcaactatgcgactataaccaatcaaatattttctttgctttacatccatgttcatccaataaaagccttccccttgtgttcctttgcagagtccaaaaccaagtttggtttagtgcttcctgattcatgagtcgctgtttgctcaaacaaactaaaattgattgtgcctcagtgtgccttttaacacaacagtcaacccaactctataagacagcatctttgtctttttgggctgccataacaaaccataaactgggtgggtggcttataaacaacagaaatttatttttcatagttacgaatgctggaagtccaagatcaaggaagattaggtgtctggtgagggcctgctttctggttcatagatggcaccttcttgctgtgtccttacatactggagggagcaaggaagctctctagggtcacttttataagggcactagtagattaaataaggtagccatgtgactataaccaatcaaattggttacagcctatcacttcccaacactcactatcccccaccaatactatcacgctgggggttaggatttcagcgtgtgaattttttttgggggggggttggtgcacgaacattgaggctatagcagggaggtatatttgttttctccaataattagacgggaaaactaaggtagagagagactcagtcgcttgcccaagctagaggaaaaagcaacagtgctggaatttgaatacaggcagtcgagcttcagagcctacagtgtctctattttattattcttttaaagtgcttcaggatttattttaatattttttactttcgcattaatactcaaatgagtttattctatctaagatcaattttccacttgatcactggattttttttttaacctcaaagtcttttggagtttactttttaccactaactacatgttcctcttaatgctatcaaaaattcatggcagtcttgctttgcttatgatcttggtaacaatttatgtatttattttagaagcctaattgactaacttatctaaaatatcaaatcaagttgatctaaattgaatcaaatgtatgaagttgcatcaaaccagtactctaggtcacaacctacttgtgctgttcttgaagacattttgaaaagaaacaaagagcaaacactatacatcttctgctcctctacttgatatgtgaatgagaattcacattattcttccaagaaggcaaaagctgctgagacacactctacaaacaggcaggactttgtgcatgctgtagaaataaacttcctcactcttgggagtttcaatgtaaaaactgtcaggggattggatggtagagttggcagtcggtcaaaggatacaaaatttcagttaaggggaaagaattcaaaagacctattgttccactattgtggctatagttaataacaatgtattgtatgcttggaaattgctaagagagtagattgtaagagttctcacacaaaaaaaacaaaacaaaacaaaacaaaaaaccccaaacgcccaacctgtcaaaagtacagaggggaagtaattgatggagttgctgtttcaaacaccagcagaatatattagataatgaacagtggttttgtcaggaaaagaggccacccctgcatcccaagttagagctattggctacaacctccacattccaacctgcagaaagcgggatgggaagggttaacacaacctggaagttgcacaggttccttttgctcacatcttattagcaaaagctttgtcatatggctacacctagttgcaggagaaggcaggagaattctaagttgaaaattttattaataggaaagaagagaacacgaatattgagagaggtgaatagcaacgtctaccgtaaatatgatcaaaataggccctgtggcaatacaatttcacaataaaggagtgctgtactttgaatggaaagaaacaatctgtcatttgtaataaaacgtagtaaacctttcaagtacacacaccattttttaaaaatgatataatacattcaagtacccattactcatctttaaaaattattagttctgacataagttcatctttcccccactcaaatgtaagccccttctctccactgttttggagcaagttcctggcattgtataattttatccataaatagataagtatatatttccataagactggtgtattttaaaaaacacaatcacaataccattgctgtatttctaaaatattaaagataataatttaataaaatcaaatatctattcagtggtcaaatttccctgattcgtttcataaatgttttcttatttttatagttatttgttcaaattaggatctaaatgaagtatgcaatttggtggacatagcttaccttttaacctgcaaattgtgctttcatttctttttcttttctctcagtttcttttgttgaaaaatgttatttgatatagaatttcttatattctggacttttctgatagcattcctgcagtgtttctcaatgtatttctccctcccttatttccatagattagtagtatataatatgtggttgtttcttcatgtattattagcagtcattgacaatcatcacctagatccactaagcatttgatattgcacaggagcaatattctaatttttgtttttaattagagacagggtctcactgtgtcacccaggctgaagtacagtgatgtgatcacagtgtgtccagaattagttccttccagtgggttcttggtctcactgacttcaagaatgacgctgtggacccttgcggtgagtgttaaagttcttaaagatggtgtgtccggagtttgttccttcagatgttcagatgtgtccagagtttcttccttctggtgggttcgtggtcttgatgactgcaggagtgaagccgcacaccttcgcagtgagcgttacagctcttaaaggctgtgtgtccagagttgttcgttcctcccagtgggttcgtggtctcactggcttcaggagtgaaaccgcagacctttgcggtgagtgttacagcttacaaaggtactgcggccccaaagagtaagcagcagcaagattgattgcaaagggcaaaagaacaaagcttccacagcatggaaggggacctagagggttgcggctgctggctgcggtggccagcgtttattccctcacttggccctgcccacatcctgctgattggtccattttgcagagtgctgattggtccattttacaaagtgctgattggtccgtttttaaagagtgctgattggtgtgtttacaaacctttagctaacacagagtgctgattggtgcatttacaatcctttagctagacagaaaattctccaagtccccacccaattggtgcgtttacaaacctttagctagacacagagcgctgattggtgcatttacaatcctttaactagacagaaaagttctccaagtccccacctgacccagatgcccagccggcttcacctttcaacagctcactaccttcttgacctcttgggctcaaatgatactttcatctcagccttccaagtagctggacctacaggcgtgtgccaccatgcctggctaatttttttttactttttatagagtcagggttttgctatgttgcataggttgatttcaaactcctgagctcaagtgatcctcctgcctcggcctaccaaagtgttgagattacaggcgtgagccacagtgcctagcttggtaacctaattctatcactcttcatttgttagccatagtgcttctataaaaatacttctctatgtgtttatatattctatatttaaaatttatttaaatatatatatcttctatatatttaaataaatacaaatatacataacatataaatgtataaatatatatttatatatttaaatacattttaactttatatatttaagtatattaatcttttgattaccccaaattatattctatatagaaaagagaataaattcttaatttcccttatgtgccagctcagaaaataatcagttggtttcctaatattgtccaaaggtaatcaatgagtttcatttttcttttggaatattatggacatagatgtaaatatatttgatatttttaagtccattgtagatatgcttatagatacccaaattttaaacttttgcagggaaagagtctcttgtagaattacttcagagtcctataaagaccttcataacgtgcagatgcttcttggctttttgatatgacaaaacgtttcaggcttatcttgtacattttctgttctccatttaaaaataaatgaatgaatgggatcaaacttttgtatgttacttactgaaatgctctacacatttcttattaaatatctcataatgtattttttctagaacattattttaatatttgcatagtagtcccattgtatgatataatttatttaaataactctattgtttatttccagttcagaattataaataacactgagtgaatacccatgtgttaaatatttgcatgtatcaatactgatacgattgctaagaaaacagtatgaacagcttaaaggtttttgatacatattgccaaagtattttccagaatatttgtgttaatttgcatttcaaccatcgttaaaaatctttgaaaaaattaaatgttggcataccatttcactacaccacatggataattttcatttaaaaattctggccaatgcaataaacacaaattttattccttttattaccagtcagatgaaatgttttcattatcttttgaataatcaatttattcttttgtgaattgtcaatttatacctctctagggtttttttgtactgggtttttttatttcagtagttatttatgagccctaaatttattaactcttggtccattttgtggtttgctaacatttttcccagtttttaatttgatttttaattttacttttcataattttgacatccaatagctttaaatgttcatatatttatcaatttttatctttattatattagtcttttgtttggaacttaaaaagatctcaacccaacacaattcctgataattcttaaacaactcacttcaaagtaacacactttcagtgacatttaccttatattgtcattgcttgaaggcagctgtacaaatttttctttatactcgatatattcttcaactcaggataaaaaccactcagagatgtataacccagatattttatggacagttctaaacaaactttccttcaaggcatgacaaattacacagaataccagtttctcttaatattttctactggaatatttcaaaagcaaaggaaagtgattgtatacatccagcagaagtgtcagcagagccttagccaagtataacaagcaaaatgattctttgaatttttattttaaagcataaacacttatgaaaagtttacctttcacttccaaagacatctgtttgtttgtcttttaattaaaagtcgggtttattgtggtatgatttatatacagaagaaattatcctttttagttgtatagtttcatgaattttgactaacgtatatagtcatacacattcaccataatccagacatagaatatttttttatcatccctggaagttcctttacaccctttttaaacggtaacctatcctcacctccagccctcggcaaccagtggtctgatttctctctctgtggctttgcctttatctgaatgtcacacagggacacaaagaggggaacaacagacactggagcctacttgagggtggaaggtaggaggagggagaggatcagaaaaaacaactgttgggtactaggctttgtacctaagtactaataatctgtaccacaagccccgtgacatgagttcacctatataacaaaactgcacgtgcctctgaacataaaagtttaaagaacaaaactaaaaaatttaaaaaaataaaatcgttactcattaaaaaaaaagtgaaatcctatagtatgtagcttttcatccagcttttttccccttagcataaatggttttgagagtcatccatgctgttgtgtgtatcagctgcttgttcatttttattgctgagtagcactccattacatagctggtatatctgctccccattgacatttgacttgtttcctgtttttagctattataaacaaaaatactgtgagcatttgtgtacaggtctatgatcggacatatattttcatgtgtcttggctaaatggtagggataacattatgattagtatgacaacagtttgtttaactttatacaaaattgtcaacatattttccaagttccttcaccatttttcatctctgtgagcaatgtgtgaaagttttatttgttccatattcttgcctgtcagtcagatttaggagttttagccattccaataggtgtgtagtaccatcttattgtggttttaatttgtactttcccaataactaatgatattgaacatcctttttttgtgtgtttatatgtcatctgtatctgttctttgtttaaatattctgtctatttcttttgggttgttttcttattaataacttctgagggtttttatacatttagatataacttctttattatatgtatgttttgcaaatattttatcacattctgtggcttatatttctatttctataattgtatcgttcaaagtgcaggagttgcaaatttttttcaatatacttctgattttggagaacattcggatttacagaaaagttacagagagttcctcacccagtttttacctgttgttagaactttatattgtcaggggacatttgttaaactaggcaaccaacgctggcacattattgttaactaaagttcaggctttgtttggagtacctcaataactttatttaacgtttgttgtttacacaatacactggtaacaaagactcttagaacttacttgtctgaaagtgctttattttacctttaattcagaaatttattttctatctcaatataaaattattggttaactatttctttcggatattgttccattgtcttctagctggcaaagtttctaaaaataagtttctgataattcttttatttcttcctttaggtgatgtaaccttttttcccctattttttcacactgtatcttacaagaatttctctttattatgccagtaggggcaggagctgctgctagggaggtttcaccagctccaattgtgtagatgccccagattgtggggttggccagtgtcttgataaatgagataaagggcgggggctggcaatattaatctgtttacttctgttttagaaaagtgaagagtgactctgggattgctcagatgtggataataaataatttgtttcctgtattgtttttgtcagttctctaggtttcacttttaatctgagaaaattttgtctttatgaggattgctaaagaatctaagttcaaataaacattgtactttttcaccttaagctattctgtgcttttctacacatttgatttttactgagctgttgttcatcaaggaaaggaaaacttatttagctgatgcatgacattcaccactaaaattttgttttcataataaaataatcattaagtttaatttaccagttttatttgtcaaaatctctttgttaatttgtaagtctgatgtttgaattgcaatgttaaagccatttaaatattgatgagctttactttattcatgttttcttttaaagctcattttttgggtatattttggagattcttattggtttcttctttagtgagcatttcttaagttcattaatatttactttaaaatagatttttcatgattgctttttattatcctaggacagtaacataattatctctgtaagatcatctcagtatgtcagtgggtgacttcaaaaactatttataaattatgatcatagaggttcattcaatatagagcattagaaaggctcaagaaatttaggaaaatactgtatgtagagctttaactcaccataattttggtataatgtggaaataataataacatatatctataatagctaaaataaataattcatttactatatatttacccattcactaattcttacccatatcataacactcacgatgataagaaataagaagacatgtattaaaaaattattctatcctcaaagggcttatagttttgactatgagattaaaaaattatggtcaataagtattatcatgaaatcaaaagtgatgagttgcatcagagactcacatagattttatatatgtcaggaaaggttagcttgtgctaagataacaaacagcccccaagtcataatggcctgtaatggcatgtgtttatttttcatgcatattatgtgcctgttctggggccactggaggctctgctctgtgtctctttacacttgcacccagcctaagggagactccaccacctggaatgttactgttgtgtgccagaggaaacagcagggataggggaaacatgaaaatccactggcttttctagtcttctctccacatgctattggtttaagacaagtcaagtgggttactgattttaagggcataagcaagttctacctaccatgttcttggaagcaggaaaaccagaatatatgtgagcatctttaatgactacaacattatagaagtttaaagcaggagagattgtatcctgatggaaatgacaagaaaagcttcagggggaaggtgacatttaagttggaatattattgaggagtatcattttagcatctgggattgaggtagctttgtgaaaatcatgtatcttgtaaaactaactaaattttgaaaacaaatgttacttgaatatagttgactctttttatgaacctgtctcagcatgatattaccattcaaagaatcattagtcctacatggaaaaaatattaaagacttttgtgtggtgcaagtatgggagattcttttcagagaacacattttaaaaacttagcaatttttcttgttttctctctctcactcaaaaagcacagaacctgcctccagaaggtcatttgcccgctctttcggctgactccacgctgcatcagggtgattccacattgtgttgattactccgcacctcccctcctctttcaggattccaatctgttttcctgagcctgtctccctatttcagcgtaaataagtcaagcctttctggatctttttcaattctcctggctattggttttgtagatagtctcaccaaaacatgccaagcccggtagttctcaaacaaacactcctttcttttggaaggtggggaggggacaaggacgcgaacacacctatattgatatcttgatgtgttttacacaatgtcatgtgtgtgactgtgctgttttcacagaaatatgcctcctaaggctggatagaatcttaggttatcagctggtcctgctctttgctttcaaatcattgaggcattatcactgtcacattactgtgagacctgaagaggtggtttgataggctaagggtcatggatttatgtaatgaatcatggataaactcccagtcactgacatcctgacgtttttaccacactgcactatctgaaattttacgctttctgttttttcagattgtcattcttcaataattaaatttcaatatacatcaattaatatctaactagcaaacagcctgccaaattctgaatctcttacttaagagctagggatgaaaagagctgatttctatatggtcatggtcccgaccttcaaggcattcacagtctagcgaagaggcaaatcttcactcctgttctcacacgatttagtgaacagatgattagaagaataaagaaaatggaacaggaaaaccaaggacaagattctatctgaacatggagcaataatagtcataaaggtggtctgtcacatttctgatatatacaaatagagcccttggagtagcaattggaaggtccactttcaagtcatggtaatgccactgtctcagcaatggcactctattttgtaatcttaagcatatctcattatttttccattgtttagtttcttcatcagtaaaatgggagagtgtgaaggtccttcctgaaaggccttctgtgacattttaaataaaaagcaatctatgagtttgaatttgagattctgagagataagattgatttcagtgacaccccacagtttgttgacagccagactaagaagtcttctctttactcaggtgctgcttctgaaaaataatatgattttattaatcaaaaaagggctttatgaaagcatgtactcaaaaactctattaactgagtttaggataatttttctttctgaaaatactgcaaatgcattctttaaaaaatataatagctaatgtagtcaggcaaaaaagaaataaaaggcattcaaattggaaaaagataaacaaaaatggctctgatatgatagacactgcagaaaagccaaaacatgtccgataaaagctctggatcaataaatgagcttagcaagatcacacgatacatggttaatataagaatgtcaactgtatttctatatgctagcaatgaataagtagaatttcaaatgttaagaaatgcatttaacaacagcacaaaaatagtaatgaatccagcaaaatacatgtgtaacctatatgttgacatactgcaatgtgctgataaaggaaatcaaacaaggctaaagaaatggagagataagctgtgttcatgaattgaaagactcaatattgttaagatgtcaattcttaacaaaactgacaagcgatattgatagaaaaactggtgaaatctgaataaagtcccttgtttagttacaaagagagcaaaacaaaaattggctcatttcttctagttagagaaagtgtacataatatcagaatacacatcaataataagtaaactgcatgatatttgcttcaattatttaattgatagaataaattatataaagtaaatagagatatgttgtgctgtgctttgtccctgatacagattcagcattcccatcaaggcaaattaatttcttgaagaatcacagttaaatttacttgtatgaagcactaagtatgcccaaattacaaataaaatactgaaaacttatgtaaaagatggcattttacaccaataaataattgttgatctgcaattcatgttaaaatgcaatggtcaaaatatttaacctcaggtacagtacaatttggtggtttcatttttcccttaagtaatgcatttaattgctcatggtatatgaaatatttgtgcaatcagaaaaaatcaaataaaaaacaggacttcaaaggacttagttttctaataaagcaacaaacataaaaggtatggtgtttccctactgggtgttagaagcaatgcttggcacctataggagattaaaaagtgaggagggtaatttacagtccattgcccccttccccaaatcaaatagttatatttcatattcttgctgaaggaataaagcacgtatatatgaacaagtaggaaatggtcataaaaacagatactaaatacggtttccactgtacagatactttctgataatgataatacctaccttgagagttaatcatgaaagttaattaaatgacatttatattaaatcactacataaattgctatgagtgttgcaaatgttatgttatttcattattattaggaatattattatatgagggagtagcataatggagaaagagcatggactttgatgttacacacacttggcaaagtttggctctaatgcatgctagatgggtgattaaagttactttatttctttgagcctcaatttccccctatgtgaaatggaataactttttacctaatagggttgtacagatgatgacatgatatgctctacgtttggtgcttgtcactgaatcttgcatatcgtaatagaagttcaaggaatgttaacctcctttctctttcttgttattataagtgattcattactaatttgttatgaagacattgccattccccttgtctgctttatttttaacccattttctcagagggtaaacaggctagctaaacgtaaagaatcattagggaaataacctcaaaatctttttttcttttttggacatgagcaggatattttaaaaagtagcctctgggatttacccagcccctacatttctatttatctctctaccctccttagagttgtcccatcccgggctgatggtggctcagctaccttggccttttcaatggtgtcttagctgctgaggtcctgcaaatggtgcttcctcattttgagcctatggaaacatttttaaacttctcattgtaatgattgcacattgggattaggggataaggaaagcaaaaacatatataagcctgcataaagaaatttctgaagaattttgtcctggatagcaatagcaagtctaggattaggtatggtgcatgctttgtttgtaaatgtaaaataaatgagaaatgaaattatgctagccagcgggtcctggctacaagaagacttttaatttctaaatgttagttaattcttcttctctctaagataaaatatttaaactagtgataattggaacttcacttctctggccatgtcttaggaaccaatgaaagataagtcagttcttttgggaggctgaggcaggtggatcacctgagatcaggagtttgagccagactggccaaggtggcaaaacctcatctctactaaaaatacaaaaaaatttagctgggtgtggtggcacctgtagtcccagctacttgggaggctgaggcaggagaatcgctggaaccggggaggtggagtttgcagtgagccaagatcgcaccactgcactccagcctgggtgacagagcaagactctgtctcaaagaaaaccgaaaaaaaaaacaaaacacaaaaaagggtaagtcagttctgatataactacttttggatgaggtgatacagctgggagctggctttgctcccgtagatgggagccacaggatggtgagggattgcggtgggaagtggggaagaggggttagggagcatggctttctaaaaggggtgagccctggtcacaaactggggtggttgcaattattggtacaaacatcccctttcagatgatggcctgaatatttttcctactgttctcaatcctcctctgaataaaaatgttgaataaaaatcaggttttgtttttccttaacctctaatcccagtatgcaatcattatgatatggtttggctgtttccttactcaaatctcacctttaattgtaatagtctccaggtgtgatgggtggggccaggtggagataattgaatcacgaggcagcttccttcatactgttcttgtggcagtgaataagtctcacgagatctgatggttatataaatggggcttcccttttacaagctctcttggacctgcagctacgtgaggcatggctttgttgttccttctccttctgccatgattgtgaggcctccccagccatgtggaactgtgagtcaattaaacatttttcctttataagttacccagtctcaggtatgtcttcattagcagcatgagaacagactaatacatactacaatgagaaattaaacatttttttacataggttcaaaacaaggaagcactgtgcaggacctcagcagctagaacacccttgaaaaggccaagatagctgagccacatcagcctggggcaagaccactgttcccctctaaggagcgtagagagagaaatagaaatgcaggggctgggaacatcccaggggtgattttaaaaaatatcctgcttatgtccaaaaaaaaaatgtatgtcccccccacaaaaaaccaatgactatttagtcttagctagcctgtttaccctctgagaaaattggctagaaataaagcttcagacttccctagaggtctcgaaggagtcattaatattgcattttcagagttacatccgtgccaggggaaagtatgccaggacacttggctagctatgctctgggccaagatcagagaatgagaatggggttaatccttcgtttcccagaccagtgaggaggatctctttttaaagcaccctatgcagaaagggtatagctaaattaggaaaaactgaaacatacgatttttctatatttaaaataagctgttttacatcaatttaggtcagaacccctcttcaacactgaataacattcatgtctaactgcatgtatgtgctgtctcttggttttggtgtttctcagaaagaatcacaggcagatgggaagcaggtagaacatgagagaagcagacaagcaagaatagagggagaatgtgtggctgccatgctgcatttgtgacttctaattttctgatttaatgaaagatatcagtgcccatttgtttcatttgcgtgtcaaaactgtaacccctcttcccacgtcaaggcatctaagggcaaggaatgtgactactgctgaaatcagacatcacaagaactagcctcaacctttaaagctgaaagaaactttcagcattttcacaaatatctctatcaacttttttctgtaactaaactgtgtttttcttaagcagcagcatttagttttaaaaagaaactcatacagttagttctattaattttttttaaggtttgcattgggcctgacaatacagcaaaaacctgcttattttctttaaaagggcgtgcttgcattcatttgtgtagcaccactgccagcggggagaattccagatgttttccactttattggttaagtgggtctgtgagaggcagacacaaatctaccattgtttctatagaaaattgtgcttcatgttcccaacagctgatctgctggcaaagttttgatgccaacaaaatattgaattaaaaggttttgtttatagttaaatactgtattactccatatagatatgagagatgacatgagaatgactaggaattcaggcaggctggaatgtcagcagaagtctttatggagtgtaatggtttcatgtgacccttgaaggataattgtagtttaaaaatatttacatgatttagatgagaagcttgaagaggattttttgttttgttttgttttgttttttgcagctgggagagacgagattaaaggcagacaattagaatgaacatcttgttgaaattgaggaaaaactcactgactagactgaaaaattcttatttggaaaaagaatttgggaacaagctttgggatagaaggttggggtttggatagattatggtaaggatttgcactcagagcgagtctgaatttttttttttgagacagtcttgctctgtcacccaggccggagtgcagtggcgcaatctcgctcactgcaagctccgcctaccgggttcatgccattctcctgcctcagcctcccgagtagctgggattacaggcgcccgccaccacgcccagctaattttttgtatttttagtagagacgggatttcaccgtgttacccaggatggtctcgatctcctgacatcatgatccaccctcctcggcctcccaaagtgctgggattacaggcatgagccaccacgcccggccggagtctgaattttttatgttaaatatgaaatggtctgtttctgcatagagaagtgacataaaaatgtgattaggaagagtaatcatttttaaggttctttcagggaaaaattggagagggacgagattagtgtctgataaatcaacttattctgcagcttggcttgagcagttctttttttttttttttttttttaaacaatttcagggaaaaatccctaaagcagccattacacaccatccatttataccacaaactctcagttcggactcttgacttctggaagattacctcatcttttttttttttttttaattgaaaagataaaaactgtaaattatgaactccctctttttttttttttttactactcttactgcaatgtacctttttttctttatggtctgaaggatgtgtattttaaattttccctcccctctcctccctccctccttctttccctccctccctcccttgtatctctgtctatcatctgtctaattcatctcaatcatctgttttccctaagctctctccttcacctgtatgtattctagatattcttccccactttttgaggcaattttcttgcttccatgtctccctttaactcatctgacagagactgtttaacttctatttgccatgtagttataatttcttttgtatctttttaattcctgaagttcttgataattactctattttttctcaccattcctgccttcagtgactctagataaatcaaaaagtcatctctctgttcatcttattctttatttttacttgacataaaccaatgcataatcactccttttttgtgtttttaaaaattaggatttttttgtcagttgttttgaaaactcaaaacgttatccagtatgtctccctatatttagagttattctttgtcagcttaaaaaaaaatccctcttattctccccatgccctaactctagcggtgagttcagtattcccaaatcttctctgtctacatacagaagacttaagagatcagtatgtcccaaactagttggagtaaggataatatcaaaggtagaaaaaaaagataagctttttggctatgggataaaatacaagtaaacgttaacagtggtccttcttgcttcccaccttcttcccaaagttcccaagtcttaggagaaaaagaaaaatccctacctatgtgtgatgtggagtgcaagttttatttctcactaacccaggcagaatgcagagtgtactgattgtgaagagaagctggtgagttagttgttttagcagccaatgattccccaaggatacttactgagtcctttctgttcctgctggaggaagacgtcatttccatgctgttagcatgtgaaacaatagtggggctgacaacggaagtgccttcgtttgttggttaactgacttatacttctgactttaattgagagtggtcaggcatttattggcttagaaagctcacacataaggaactcacatgtcctctaaaatggtaatgtagctgcttttatttttcaaacatagatttgacacctagacacaaaccatgtcattataatcaaattgcaatagtcaactttatatttaaggcattcaaactcccactaatttagtagatagtctgatgaccaaggaaagaccatctcattacaaaatggtgtttacttaaaaatgtgaactgcccaaaagatattgtccctaaaatttctactgacactgtcattcagctttctccagagaaacagaaccaataagatatatctcctatatcactagtatatttagttcttacttattttagagatcaaaaaattggcttatgagattacagaggctgcgaagtccaaaatttgtaggacaggctggtaggctgaagattcagataggagctgatgtttcagttttaaagccaaatgtcttcctccccaggggtacctcagtcttgcttttaaggctttcccaactgattgaatgaggcctactcctattactgagaataatctttacctaaagtaaactgagcgtagataaccacatctacaaaattcctttgcagcaacatttagattagtgttggattgaatcactgggcactgtagtcaagttgacacataaagcttaccaggacacattttcctcaggaacaaactctactttccaatctttacatttccaagatttgagaattcttaatgttaaactcgatgtgaaataatttgttgaacgttcttgtttattttttcgttccccaaatgtctctagatttattcactctaacagacatattgtaagtgactactatatacttggcactggcaaggtgtaaggccacacatacaccgggaactgtgcctgtcttccaggagctgtctaccatcatccttgtgtaggttctccagcctgatgttgaaattattgcaataaaaccattcatttgatgttgcttctcccttgccctcttccttgtgttgtctggcggggaatgattgcatgtcttaataggctgtcaaaaaccagtattagtttgtacatgattgatctgaatcataattcctttttttttttttgcctgagatttgtctgtgtaagtaaacttgctaccgaggaacacatacacaattacttagcagtttaaattcatattaatatttatagcatttattcttgctggaatgaacatatagtttgtattcctacatgtaagaatattattggaaaaaagtaaatttgcatgaaccaatctaagagcaaacatacatcttcatctacttgttgctaccctagtcttccttagctctcaaaaatctagtagttaataaacccaaaaacacatacacgagttaattttttaaattggtacataatatttgtatgtatttatggagtatctgtgatattttgttacatgcatagaatgaataatgatcaagttaggatatgtatggtatccattctcttcagtatgtattatttctatgtgttaggaacatttcaagtcctgtataattattttgaaatgtgcaatacattgttgtcaactgtagtcagtcaccctatatgacacttcatctggaaatccttcctgatttaattctaagaatctgagttgcttttcactacaatttcctaagtccagacatcagtgacttcctcgggggctaatttgcaagggaaataatgaggaacagcaggactcttaggagctgcaaaggtaatttgcttatttaactattactaagggcaggaggaacagccaggccaaaatggcctgtgcttttgcatagcatcatggctattagaataggggcctaccatcccattttaaaaagtggtgaagaaataaaacaggataaaagacaagtaaagaaaacctgaaattgagcagcatccttaagacagttatgaaaacagaatagttactgacatagaaaaatcctattcatttcattgctttttctttaaaacattttctactgtggtaaaataatataacaatttctgttctccctttattatctagctatttggtaatacggaatgtctttgtatatagaaaatgataatataaaaatcatatagccagtctctggtcccagatgctgttcttctccatccatttctttttcttctaagagatgtgcagtccattaatctgatatttaggaatggcctattgtgaatgttcacaagtgattgtggtgaatctaatctttattagtttgaaactcttttacatattatataattagtaagcatttattatttctgtatcctggtggataaattcaatattaatttctttgatagttacaatgcattctttacagtgaataattctgggcaatacgttctttttctaggcactctctatgaagcagctgcagattgtatattattttattagtcatggtgaccttaactgagatgaaacatttcggaatttatgtcctgaaccaagtaacagtgtttaaattacttaactctccaatatttcaaacaatgcaaccatccatcaaagctaaatgttattaatataaaactaatgccttgagggaaaaaagggaataggagtactaggtacgagacagtctttggttctctcttggcaagtttatatgcatatttttaaacttttaaaaaattttggatccggtttgcttcagtgtttagaatattttagttgaaagtatatatttttaaaaattgtactcatctctacaaaattaaatgacagaagagctatttgggggtcattatactagaatagcaatgggtacaaatcgcagagttaagttgaaaaactatagcacatgttaattgagtttacataaactcaattctgatcctgcacccattgaataggttccttttttggagtttcttctctcagagtcatcctaagctcctggggctaaggaagggccacagtttcagggaagcatctcagggccttactgatcactgatgagatacctgcatttctctgcctgttgagttgggttttgtggcccttcttgttgtaaagcctgctctcatctttggcgagactaggaatctggctgcccagcactgattcttacgaggtgctccatagacccataccactgagggcctcaggaggggatgggagtggagacagagcagaagcccagattgctccctgcagtcagagtcctcctcccctgagagcctcagacttggatttctctggggcccctggagcatctcttcacttcttgtaggcttcagaggtacccaccctctctccaataaaatgacttacagtcttttaaaaaggctttccagctgggcatggtggctcatgcctgtaatcccagcactttgggaggctgaggcaggtggatcacttgaagttaggagttagagaccagcctggccaacatggcaaaaccctgtctctactaaaaatacaaaaattaggcgggcgtggtggcattcacctataatcccagctactcgggaggctgaggcaggagaattgcttgaacccaggaggtggagtttgcagtgagccgagattgtgccaccgcacttcagcctgggcagcagagtaagactgtctcaaaaaaaaaaaaaaaaaactttccaaagacctagatatacacatatatatacacatatttacacatatattcacatacacacatatatatatatatatatatacacatatatatatatatatttttttttttttttgagatggagttttattcttgttgcccaggccggagtgcaatggctgatctcaactcatcgtagcctcgcctcctgggttcaagtgattctcctgcctcagcctcccgagtagctgggattacaggcatgtgccaccacgcccagctatttttttttgtatttttagtagagacggggtttcaccatgttagccaggatggtcttgatctcccaacctcaggtgatccacccacctcggcttcccaaagtgctgggattacaggcatgagccactgtgcccggcccaagacctagatattaaaacaaaacaaaacaaaacacacaaaaaaactgtgttcccagtcacatgccctcagactcctcacagccagcgatggaagtgagaccccccccagtaacagagggggtggcgactgctgtggccactggatttcagcctctttccagcagcgactctaagaagcgcagcgaaactcaaccgtatccaatccagttagttactggcccagaattatagcttccacctgcaccttctagccaccatggcaacctcctctgaagaagttttgctgattgtaaagaaagtgcgtcaaaagaagcaggatggagctctatacctcatggcagaaagaattgcttgggcacctgaaggcaaaaatagatttacagtcagccgtatgtatgtagatgttaaatgtcagaaaattagtccagaaggcaaagctacaattcagcatcagctggacctacatgaaggagatacaattaacttccgttttcccagtgaaaacacagcagtgaaagagcaagatgcagtaaaggaccttcagcagctgcttcccaaattcaagaggaaagcaaataaagaactggaagagaagaacagaatgctgcaagaagatcctgttttgtttcagctttataaagatcttgttgtgagccaagtgatgagtgctgaggaattctgggccaatcatttaaatgggaatgcaacagaaaattcttccacatccaatcataagcaggatgttggcatttctgctgcatatctggctgatgtctggcccgaaaccgatggctgtaacggtctgaaatataatttaacttctgatatcattgagttcatatttaggacctatccagcagtgaaaatgaaatatgcagaaagtgttccccacaacatgacagagaagggattctggacacgttttttccagtcccattattttcacagggattggctgaatacagggtcaaaggatctctctgcagaatgtgccaaaatagatgaaaaaggccttaaaacaatggtttcattaggagtgaaaaacccactactagaattaacagctttgggaaataagccattagatgagggctatggcatttcctctgtgccatctgcttccaattctaaatccatagaagagaatagtaatgctgccatcaagagatttaaccatcacagtgccatggtcctggcagctggactcaggaaacaagaagcagaaaatgagcaaaatagcccagcagcatggatggaaattccagagatgcagactgctttcagccagtagtcaaaagggcgaaatcgcaagagtccagtgaatatgaagacttggggaaagataattctataaaaatgattgcactaaacctcaagaagtcaggtaggtattatcatggtctaactccagtctagtcactacagtatgcaacaataaggacattattcttttcaaagtattgggcaagaaatggaagcttatatacccaagttaattgaggttctcttgagtagtgctgccagtagtaccatcatagcactgtcacctgcaggggaccttatgcagggaggaacacagcaaaccataaaccagatggtgccaagtgatattcagtctgaattgaaacacttgtatgtagctgttggagaacttctatggcatttctggtcctactttcctgttaatacaccattcctagaagaaagggtagtgaaaatgaaaagtaatttggaacgattccaagttaagaagatctgcccattccaagaaaagattcggaggcagtatttaagcacacatttggtaagtcacatagagatactccaggcagcctacaagctccacacatggcaattatggtgtctgatgaaagaaaatgtgaggtggctatgatgctcacagcttttgtgagattgagagaactaggacctgcagcaactctggaaaccctgcctgtcagacaagcagatgacctcacaggagtgataagaaacatctgctccatgctgactcccagggctgatgctatcctgcttgcacattggggactgaaagtaaagaagggactaaatgctggcgaggtaaattagggcagaaccaaatgagctaagttgcaaatatatacatgtatacacacacatacacatatatatgtaaatgtgtatgtacatattttaaaagactttactgcagttactcaggaacagcttttcattcacatttgagctgctttcagaaattaaaaccacttttttaaagggtgcattgataaaatctgaggttttttgcttgttttcttctgtgtaaactttttttcctgtgtggcacagggtagaccttaagtatttctcctccatcctttatcctccacactccattagatcctcaagttttactgaattccaattataccttccatcagcaagttaaaaagagtactttaaagcaaagggagactgctgctcaaccatcaggaaacagttgtcagaagacatcattggtcctgtgtttcctacagaaataagaaacaataaatattgcactgaatgtttgtggtttggagtccctgaataataaagagggaatatatttgcagaaagttgcatagggttttttatgtagaattttgtcagaagacaatgttgctgcatgtttttctttgagtgcaaatgtacatggctaatttttaagatggcattgctttgaaaagacgatattgcatttttaagagtttaaaaatcttatgagtgagaaatataaaaaaatcttattttcacctctttagaagaagtaaaagatatttctcctatctcctttcctctagtatttgactgttactgtccttggcaaaccgataatcattgcatagagactgaaaagcttaagtgcaaaaaaaaaaaaaatttttgtttctggaattcatgtcatattttgttcctgatgggatcaactgactgtttaagactttggatgtcttgtattaaaaattacacaaaaaagtgtaactttttatacttactcctttaactcttaaaaaaaaatctgtgttccaaaatcctggaggcaagaaattagaaactcatgcaaccttgacgtgagtggggatgtgtgggaagcataatttatgaatactaaattaattaccattttaatattaataattaatgtgtcaacatagaatcctgctaaaaggttttttttatctgcaccttaaaagtgcaggggtgattttgtggcttttcaacacttctaatggccttccttcaatttcagcttcttctttccctgaacatggcctgccataggaatctgaactgaagttaaaacaagaaagaatatctcttagtacattaaccagatgcctcttttccaattaaggactgaagtgggcattataaatgcaaataactcaatatacttgtcatatagacacgataaggcttacctgataagcataaaatccttgaaccatagacccaagagaagacaaaataaaatgttttgatggccataaagctgcatgagaagaggattgtgatgaaaaaacaaatgtgacagctctgtgtagaggaggcttatgctgaggaggactgtttctgaatgttgggttacatgacttggaatattgatgtttctgcctcttattttgcattccttattaattcagagcatgttaatgcacttgtactccttacatttatacagacaaaaaagaggaaaaaacaaaataaaccatatgttaaaaagtataccttcatatatttttcaatgatgcaaagggaggtagagaatgaacctttggtgaacatttgctatgtattgggctctcgcaagtaacttcaaataacttatttaatcctcacaatgaggtatgtaggagggatacatattcctatgttacagaaatggcaaacaaggctcaggtaggattaatagatactccacaccgtattgacgttcaaaatgtaacagtttgactttgctgtgtactgaaagcttgcaggtttttcagtcctgcccattcatttgtaaagtgaaaaattgcgaagttatagtgtgttatgtacttaactcagatgttccatacttaagtttaatttgttgatttataatcctagaatgagactgaatttcccattcatacctggcagtaaagatcataaatattagttgtggtagttcctaaaaatagatatttggggaagacctactgaatcagaccctccaggtgattcttaggattgtcatcagcagactagtttgcctgtgctgtgttgggtgccaggctgagtgctaccaggcaagggccatggttataatcctgacacctaaagcctcccaccctcactcacccaactgatccctatacagcttcaatgggctagtaaatggcctcataaatgctgtcttaacacactgagtttgctgtttcgagtacgtgaaaccacaaacctagaacctctaatgtttagttatgagaaagagaatttctaggtgagtctagtggtttcctttgggtttcctttagttcattgatctaacaccacctctaccccaagagaatcacctgcttctcattagcaggtgttccaagtgggaactctttcctctcttttaagatcaagaacaacagggtggggcttccaaaatggctattctcataaaaaggaatgagttaatggcatttgcagcgacctggatgacattggagactattattctaagtgaagtaatcagggatggaaaaccagacatcatatgttctcactcgtaagtgggagctaagctgtgaggatgcaaaggcataagaatgacacatggactttggggactcggaaagggtcgaaagggggtgagggacagaagactacaaaaagggtgtagtgtacactgcttgagtgatgggtgcaccaaaatctcactaatcaccactaaagaacttacataatcaaaaacctctgttccccataacctatggaagttaaaaaattaaagtgatagtaaggaataaaaatgctttttcatgaaaacaaaatggcatttctaaaatctaagaacaaaaggaggtggagggcttggaacaagagtatgtaggaataaaagtatctagcatataccattaataatggaggtatataccaaagttccatttccattcagtcccactagatcattcccaggacacgcagaattattccattccatacgctgcctacaacttgaattttgaagggtgcttacaactttcctagatttcttttttagcctagcttcctacactgttttatgaccctgggttaggaatgtggtcagcaccttttcacttggtgaccaagacaaagagagtcctggggccctggctttctcacgttgtggacgactctggactgaggcacatgtctcatccccagttgacttccatgtgaaaagtctcattctccaggggtgtgccagcctcttacatctaagatttgtactctcctttgctcagatgtacaaaaaccttaaaggcactggaagtaccataagtatagtgctattagaccctgggagaggggagaagcattcctccaggggtgccttcttccctcctgttgattatggtggttttgcttctgattgtaccctatgaaagaccatctattcactctttcctcagcagcctggcttcctcaagagaaattacccttgtactgctgaggttctggaatctaacctccacatcgtccatgaactctgaatagtgctactgtcgaactcctcatttaacaaagccatttctctgccttttcaaggctgtagaactagtcacagatggttttcaaccgtctttcacttaggaggtttccaataagttgtctgagattctcattaacccagtcttcccagattactaacaaagaccacaaagttgtgagctgttagctgctgccctggccctgtgttgctgcacaagagaaccttgctgcctcctgtcccattcctattgcttaacaccaaggaaggttgacaggtcccaggaccttagggaactgtgttaccattgttgctgcctctgctgcagccctgagccctcctatgctgcctggtggctgtcagagccatggtcactaaagaccaggggaactttatcctttaagaaatgacctctaagtaaacagtcacccagttatacatcagagaagtgacggagaagtccttactccacataagtttaacctcaaatcagctttgtgcctgcatgctccttgctaccctcttgtctgttgtggtctctctcattgcccatttgcttctaccgtctaattttgcaccctggctgataaggcttctctggttcttagcccctgcttcccttccttgcttcttccctatttcattaactactaaatcaatttcttctattcttattctttcaaatctgtattctacactatgactggtacaatttttctgaacttcaaatttccaagtgtaagctcctgttcacaatatttatatgactcccttttgcctgcaaggtgaagccaaagctcttttatgcattgcacagagtcttcctggtctggcccctccctagtgccctgtcctctcccttccatgctaatgtgcgagccatcacttcctcttgtgagttctcaccacacattattgccattgcatgtgttcttgtctcttcctagaatgcccatctgtctcctgtcttcctgaaaacactgttcatgattaaatccctgctgaggcattactttttacatgaagtgctccctgccttccagactccattaattgttttctccactgtaccacttgtgaatctcacaggctttttggctttttttgtgcattgcatatcacagttttatttgtttacaaatatttttaaaagtctttttaaacatctattttgtgggtacataggtgtacatatttatgggtacatgagatgttttgatacaggcaaacaatgcataatcacatcagggtaaatggggtatccatctcttcaagcattatcctttgtgttataaacaatttttaaaactctttatttttaaattacaataaattattgactgtagtcaccctgttgtgctatcaaatactagatcttttttatctaactatatttttataccaattagccattcctccttacccctcctgtcaccaactacccttcccagcctctagtagttattctatctccatgagttcaactgttttaatttttagctcccacaaacaagtgagaacatgcaaagtttgtctttctgtgcctggcttgtttcacttaacataatgacctccagttccatccacattgttggaaatgacaggatctcgttttacggctgaatagtacttcgttgtttatattatgtttaccacattttctttattcatctgttgatgaacacttaggttgcttctaaatcttgcctattgtgaacagtgctgcaataaccttggaagtgctgatatctcttcaatatactgatttccttttttcttggtatatacctagcagtgagattgctggatcatattaccatgtaatctatttttagttttttgggaaacctccaaacttctccacagcgattgtcctatttggttggtacaaaagtaatcgtggttttttccattaaaagtaatgtgtcagcctctgcgatgtgttggtgagcattcagaggcataagtgagagaagaggagtaagcgttgcattttctgttagttctagtacccaacatttaaggaattctggggagtggttgtccagccccatccactgcttagtatatattggcaagaaggaaggaggaggtttttgccattaaaagtcatggcaaaaattgcagtaacatttgcatcaacctaataatttagtcagcagtgtgtgccggttcccttttctccacatccttaccagcatttgttattgcctgtcttttgggtaaaagccattttaactggggtgagatgacagctcattgcagtaatatctgtctttcttatcagactttgtctatgaaagtggaaactatgtctacctcagcatggtgctgagcaggctgtagacactgaactaaacttcagtagctactccgtgttgaactgaatcccaagaagaatgcctgttttccagcccttgctctgggcactgaaacatctctcctttccattgtgacttcaagacctgacctctagcaggcagacctgtgaggtatcaattggcatttctcattctaaccctcctccttccctcttgccaacatatactaagcagtagacagagctggacaaccactcccgagaattctttagatgttgggtactagagctattagaaagtgaaatgcttaatcctcttctcttacttatgccaatgaatggtcaccaacacatcacagagactgacaccactgcctttattctcaactgttttcaaatgctattatttttatggacattgtaactctatgtgttttgtacatctatttatgcttctctgtagataaatatcctactgacaatttctgggcagagcattgctgtccatgggcttcacaaggtggtcttgtgttgtaaatctattacttatataaaagtggctaggaggtattgcagcaatgtggtcactaggacagctggactaagagctctcctttctctgggcccttgaagtaaagccacatatttgtcaagccgggttagaagattcactgtgactttttagggctgtctctttcctcctttatggagtattcttagcctgtgttcttttctttccttctgttcaaaattctgacagctcacctcaagcttcacattgacctgccaaatcaccctaatgtctactttgtgcttttggtaacatcatgaactcctagttttaccctttgcctgtcatttagtttcttaatttcccaaagcctttatagagactgatatcactgctcaaagtgtaagctctcacagataacacatacaacttaaaaagtcttcaatgcttaatccaagagagtgtctagtggtgggacagtgtctaaggtgggaataccttgtgggatgggcagatgttgggcagcagtttttgtttttttttgtaggaagtaaattctaattacctttatattatggggaataaatcatttcccctaagcgtgtttagttgtggtaccaacagaaaatgacatcatttgcacataacagtgtgcaaacaataatgatttaattttattagttttcttagaaatgtgggcagccatgttatttcatttgtagattttaggggaaagatttagaaacatgtcttacaagaaatctctaagtatgatcaactttgaaaagagaaaggtctaaagcaagattttattatggaacaagatgatctctgaaaggtagtcatggaatgaagggcgacagattcttaggggttgttttagaaaactgagctggaaccaatggtttacagttatatagagaaaaaatataggctgtatatatttttaaaaaaagaacagaaaaaaacttggaagtggaccaggttatcctggggtagtgaggacccctttatctgaaatacttatgaagtagctgaaagattaacagggattctgaagataacttacccaaagcatgtgtttggttgatgtacatgatatctaagagcttctatgattccatcaattgtcattttagtttggtgtatgtaacatagcatatattgattgctgattggtggtgagttgtctcatgttttatttgctaaatcatttatttgtagatgtttatgaaatctaccagtgtttctaaagttcaatcaccttagcgttagaggatatatgagaaggaaaagatgagttagtggtgacaagaaactggagaaaacatcatgagaaaaataaataataacaaatagattttgaaaagtaagtggtgcaaaaacaatgagttttgttaattatatattgaccaaagggaatgatgagaggaaaaacatttttatttaaaaattacatttgtatattttatttttcagttgtcaaaagtcatcttctgtagaatttctactgtttggtcagcaactattatgatgtatcaaacataaaaatattgatcaaatgtcctggagaaacaacatacatcttagtatacatggtgagctgcactgatgcatggttagttacaagcacaggtaaaagagagctttccagaatgcgggatgattgaagtagggcctttgtctctcctgctcacatgtgtatttctaaagcctagcataaggtttgagatagagaattgctcaataaatgtttgttgaacagataggtaacacatggtgttcctgtgtgcacaggacaattgaaagagcctccacttatctttccataatttccacagtttgcacaacatcttgtctccagcagaaatattttcccaagttccagcttgggttctgcctttcccttgactatcctaatactcatcgatctccttctttgaattcttatgatatgcatggcctcaattgtttcgtttaaatttatcatatagttaacattgtcttatttcattgtctttgccatgtttgtattggacccagaactaaattatcattgccctgttgctaataatatcttttttttttcctggtaacagaggacagggcattgagtaaatgcttactaaacatgtgttcatttgatggcattaagaacctagaagtatttggcaaaaaggtaggcttacagaaacccccattcattttttatttttattttattttttgaaacagggtctcactctgtttcatccaagctgtagtgcaatggcacgatcacagctcactgcaacctccacctcctgggctcatgtgatccttctacctcgtcctcccaagtagctgtgactacaggcacgtgacactgcacatacctgtagtcaaactttaaatttttttgtagaaatgggattttgctatgtggcccaggctggtctcaaagtcctgccctcaagtgattctcccaccttagtttcccaaaatggtgggattacaggtctgagacactgggcctgactaatgcccattaatttaaaaccaccatagaaaacttattaccaggcttgccacagagatttgatggatctttgatgtgaaaagaggagataagagtgggaagatgagaagagaaataatggtgggttctccccagaaatccttttctgaaataagaggtaacttgcccccgcccaatatccatggtgttgatttcattcaaaataaggtggccgaagtaagcttcccgtcccaatatcacccccaaaaggcttgaagttgactgtatttagagtatctactctcctaccgtaagacaattagaaatcttgaagtttcttccaatccacattcatcagtcattccagtggaagtggagcctcctcagaagctgtgtagcatggtgggtgttaatgacacagaagaacagtgcaaggcaacaggccaaataaaaaaagatgatgcttatggcctactttgcctttgttaaatctactttagccagtcccctctctaaggtcacttgtgccaccagaagcaaagaaaggcccacttttctagagaaaacatacttcagtaatttaatatgctttctatctagagaaaattctgtggctgtgtctgtgttatagatgctgctttactggttcaagaatatttaaaatcataaaaagtagcttcttgtgacatatcattaagtgacaataaatcaggtggataaatagtatgcacagtatgattctaaatgaaacctttctgcacaaacacacctgcataatttatttattgttgtgtatttttatttagacgaaagctgaaagaacatgcatcaaactttagtattgattatctctagtgcttttagtgttcatcataaacttttcctgcattcagcccattttttatgttttcgcaaccaatagacaacactcttcgcaagtggctttagtcagcaagaaaacagggctggggataaatcaaaactacaattactcttgctttttaaatgtagaaactggagatcaagccagggtcatcattacaatgcaatagggaacaggatattctaactccagggcactccaaacatgcaatagatatgaaccaattctttgggtttaataaagaaagtaggaactgagggacatataacagaagctgtctaggaaataagtttgtcttggtttggaaccagggaagctgtggagatagaaaatcttgctctacacttgatattttccttatccagggagcttcaacacttcatgtgacatggtagaaacttgaagaattcatagggagtgatagaaactgaactagaggtcacagctcttggaatggggaatgtgaaggacttgggacagctctgagacctggaagtcactggcacaaacaagtgtgccccatagatgcaggtcaagcccaaatgatgagaagggctacgcagactgcaataaaggggctgggtgtttttgcttccattctagttcaatcttcttttcaatccagggtttttgtgtgcgcgtgtgtgtgttaacttctcacgagaagtcattcacctttcatttgaatatttctaagattgttgtttactaatgctagatatagcctgttattttgttagctagcccattagatactatttctcttgtgaaaattccgctcattgcttctaatgcccaggtaagttctatcttcctcctcacaaccctttatgctcttgcagttgactttttttgccccttcaacactcaacttcaactttcttctctctggtttgtgtctactgtcaagactgtaagagctgaagtcttgatttcctggtctcccttgcaattaggggtgccctttgacatagctcttgccaacgagatacatgttgaaatttataatataatctcttcccttttcttcttcttcctgtgaatacagagcccaagcagctatctggaaaccacagagaaaggtcatgataactttgagttactaaacctaagcagacaactgcttacttccagacttcttcatatgagaacaaatcaacctctctttgcttaagccactataatgaggtttttcttttacttgtaggcaaacacagtggtaactgatgaagtttcatgtttgatgccccaacattttcttatgtactgtggatgctaacaaatcatgtccctcatccctgacaggtcttagtgcttttctgcttctgagtaaacatacccttttctctctacctgaaggctcttctctcttgaccagagtctacttatccttcacatctttcttagatgcagatccccagctaacaatattttcttatttcttacactgaactccctgcagctttctgaagtgcctctctcttgctactttcccaattctgccataaagcttagttacttgtatattcatcttccttatgcactcctgtgttgagattaaagctgctttgatgctgactgtacctcctttctctgtatcctcctatctctaagtacaggttgagcatccctaatttaaaatccaaaatctgaaatgttccttaatccaaagtgttttgaacactgacatgacaccacaagtagaaaatttcacacctgacctcatgcgatgggctggagtcaaaatgcagtcaaggagaaagggaaaccctcatatgctattggtgggaatgcaaattagcacagtcactgtggaaagcagcatggaggttcctcagaaagctttggtgagtgtttagattcagactaaatacttgattatacaagaaattttatttccttattgtaaaaatgttatttaatttgattcttctgggaactagacaatctcaagggcaagtcttcaatatcatccgagtttgattaaactgagtactctttaaaaatcaggctgtttttcttgagctattgtaatactgagataaaacatacttaaggagaaggaggggaagatgggaaaagaagcaaactgataatgatacgaggggagaagtagctgcttctgcgtttggatatgtgctcactaaggtagaatattagagctgaactgattagaaaactctgctaataaattttacagtgaaatgtgttatgtggcttaggggctgaaatctccccaatgcatagcactgttgttctgtgaatcctaattcatttcaatattaattaaagttcatttgttaccatttatcttaatattttaaatccaaacttaaacttttcaagagttttattcaaaaaataaaagcaactagtacaggtagagaatgagatatgaaataaatcaagcaaatacaatactggaaacaaaaacatataactaaaccaatagagaaggacttccgtttgctgtctaattattttgaatatacattaagttgtgcaagaattaaaaggaaaagttaattttattttactgctatcaaagacatcggtagctgctattttcaagtttgacgtatttatacctgtctaaacatgaaatatgaataaaccatgatctataaaaatatagtttatcatctcttggtatcaggtgcttttaaaaatattttcgattctctaatcagatgtataaacacaaaccatttgagtcagttgagaagtattacatagaaacataaccatgtgtcttcatggtttatgtatctttaatatatctaatttaggacaataatgaatatagatgcgattgttgctttggcctagaggaattcctctgatagaaatagccattgtaactgcatctgcataaaattaatctcagatttgagagacttggctgattaaaatgtaatcactgagagtttagaatacaaattgtctggtttactttaaaaaatagttgtaaatattaactgttaaaaattaactataaggaaaaggcattatttgaaaagtaagtaggtaaaaaaatttactgtttcataaaataaccaggcagtatttttacaggatttgaggaggtggtaacctgaaaaaccaggtaaataacacaagaggttacatgactgtatataaataaatgaggaaaattctagatgctaaagtggctaacgagaatttcagagctctgtaaagactgagcatttatagctaaactgtaaacttctaaataaaatgattactaaacacacacatttacacagactaatatattttattatgtacatatttgatatatattctttatcagctaatattttgaaacttcaacatgtatacatacatatatgtatatgtataaatttataaattatatacaagctctgttatactgattttataaaaacacaaatagagacattttaaaaagtatagtgtaaaaatggcaaaacccctggtatttaacttttcttattcatttatggtacaaaaatgatttttctcctactcagatcttattagtggtgttctggtggcttcttaaatgtcttgctcatactgagtctcatacaaccataggctacttttttggaggctgaatatgcatttagtgtgaagcttatcactggttctgctggaggcgaatttatactatagatagtcttcttcttatcagagattgaggatctcaccttttctcattggatgattataattttacctttgaattggggttccgggatggtaaaaatagcttattttttcagtaggagaaatatcagctcttatattttcttgttgatcacatgtaccttacattataaatactatcaacaacctctgctttctttgtatgcaggtttttaagctgtgtgtccattttgttagagttgagttaagatagttcatataatctataaatactttttccagaagtctactttgtaatattttgatgacaaataaggagtaaaaactgcaacttcagtgagtcttctggtagaactccactcctccctcagatttctcctgtgtcctccttgacatttgactatatgatatatatcaatccatatagtaaatgttagtaaggcctaaatacattcttaattttcaagaagtctactactaaagcattacttttccccatggcccagtggattatcttggcacatcctgggatgaacacactcatggcactttggaggctctgatatgtacgtgtaatggtaagtaaattagctttctggggaaagacagctatttgggctgcctgtatgcaaatagcatctttaatttatcctttttttctaaatagagacacacaaatatttgtgaactcaggagtcttgtcttgagtaagcacagtacatcgaacacactgaccattgctcagacgaatgctctatattaacacagaggacaaggaaagatcgtgatatggtttggctctgtgttcccattgaaatctcatgtcaaattgtaatcaccacatattaggtgagggagctggtgggaggtgattgaatcatgggggcagacttcccctttgctgttctcgcaatagcgaacaagttctcatgaaatctggttgtttaaaagtgtgtagtgcatcccccttcgccctctctcttctgccaccacgtgaaggtacttgcttccctttgttcttctgctatgattgtaagtttcctgaggcctcccaagccatgcctcctgtacagcctgcagaactgtgaatcaattaaacttttcttcataaattacccagtctcaggtagttctttatagcagtgagagaacagactaatacagcaatgattgcttggctggattcatacttggatactctgtgctcttctatttagtagagttctaccactctatttagtttaattctctctccttggttatctccagttctgtacttattagattcaaaggcagatagaatcttgaagtttaaaggcatctaagataactctaatctaactcctattcaaagcataaatcctcccaacgaatgccataaagatggatatccagtttctgggtttccacttatagcacgagcttcttatttcttcagtaagtttggtgtaatggctcccattatgacttctaatcctcttaaggccaaatattcccagttctttagttgggacaaagataacaaaaagttgccagtatactgccgtttctcttttagtatcctgtggtttactttgccggtatttataaaataaatatgtgtgaaatagacaggaaataataaccaaaaatattccaaggtttttgtacagaataaagtgattctgttaggtcctttgatttggtcattgtactgctattaatgtagactaaaaacacactttttttttgtaggagacagaatttgatgattgttcaaaatccattaatccaccaaatatgtctacttttcctattttaagaatttttataagcattcctgctaagaggcatccctttctatttgagcatctgacttttggaaagaatgaaatctcagagcttttttgtttgtatctgtcactgtggtctaattatgtgtttttgaatttttattctggtcatgtgatgaattagctctatttagttttgtatctgattagttttgtaccatgtttataacttttcccctctgatttgactttaagttttcttgtaaacagagaccttaaattatgcatatttggccaggtgcaatggctcatgcctgtaattccagcactttgggaggctgaagtgggcagatcacctgaggtcaggagttcaagaccagcctggccaacatggtgaaaccctgtctctactaaacatacaaattagccggccatggtggcatgtgcctataatcccagctacttgggaggctgaggcaggagaatcactgaacccaggagctggaggttgcagagagctgggatcgcaccactgtactccagcctggtagagagaacaagactctctattaaaaaaaaaaaaaagcctgtttgccaagacacatagtataatattttgtaatattagattcttaatttgtcccgatttggttgtcaaagtgatacaaaattatgttgcagcaggattatcctttactaatttgaaatcaggtaaggctggctggccacatgttgctaataaaagagggaagtgttgaaagagaacatgggcagcagttgttacgatgacagcatagaattgtgaagaattaaagtccaagatgtaggtaaaattccagtctggaacagctagttctggtggactagcatattctgaaaaagacctgtctacatggtctttgtacagagaatatttgaatattagactcattggacttctgtgcctatgagtactttctttttttcctgtagcatctctaacccaaagactagcctatgcagatatcacttatgcttagaattgctgaagaagggcttattccccaacaccattgcccacacatacatacaactcttacgcctcccttgatatctgctaagacactctatgggcctggtgataacatgggttttgttagctgtttgaaccttagagtggattaaattgaggtaggttttcattgatgaatccctaattgtccatgggaatgccacagagaaggtgtgtattatgggagtttggagcctctctagcccaataattgtggtattaatctttcttcctggggtcatcctacctattagaaacttccagactgattatgaggcctgggtaatcacttcctgcctctgtttcagaagggcacttgaagctttaaaaaagtaaaaagttggtcagacctcatcagaaacgtaagcataaaccttttccaaatgtttccaataaacaacagcaacaaaatgatagaaaatgtaacattattctacttacagaaatggttttcagaaaaatgtagctttgtgtctgcctgtctgtcatgccaggatttactgggtgccaccagagttgtggtgatcaagggccaaacaggctgatcttagatttgttgcagaaaggtcaggttcaaataatgtgaagggagagaaatctgggattttctctacagaatcgccacataaggcaattcggacttacttgatcattcatctttttgtcattgccaggaactgagagacagtattggtctgctgttgctaggaagtctgcctaccggtctaaaatctcaaaaatgtggcaatcttctgttctgagacaatattataatactccagatttggtcaatacaggtcatgtcttaattctgttgtcattagttcccgtttgttaaatgtttacagcgtggcaggtataccaagcacagtttcagcagaaactgagaccacagggtagagctcatacatcctcaagactcagctgcagtccccaaagtccccacaccatttgaccagtagggctccattctctgaattacgtgcttcttactgttgacatcaccatcctgaaaaagtgttgtatttattaagctcctaccaggtaccaagtgttgtcccaactaaacagattatttcatctactaccgtgagttagctaccattattatcacaaaactatcattatcaccatctgaggttatcctggcccagaggtatcaggtcgcctgtccacacccatatagctattaggtggcagaacctggaacaaagtgagtcttcatgcagctcatgctccttgccattctgctcctacaagtgtgcataggaacctggtgaaaagaaaccatgactagggagatgtttacttctaaaatgtattttaaacttttatgtgaaatatccaaacacattgttgtgatagttgttatggcataacaattattcaactgcctaagaactgtcatggtttagcccaaatcctagcaagtggttagggagatcagcatgcaaagcatgaatgggtgatgtaagacttgaagttgagaattgattcagagggttgctgactgtataacctttgaaataatgtattcctatattttataatgcctgtcaatgttaagaatattgtcttacaagctaacatatttgttttgttaataagtttttttcttgtctatgctcgtggattcattttgtgtcagcatactaaaaagttttaccatgtactgcagtcaaattaattcagaaaacattagtctgtaacatatattctcacacaggattattcatcaaccaacaattatgaacttagaatctaatatgtatttatagctacactagatacacaggaaggtaaaagatttcctattttgttgggagcagcaaatattgttctccacttgtcttttacccatacaattttccctgcttttggagtacaagaatagtatctcctactgatttatattccatagcaatggagaatatactattggagatacagtgaacatacaataaggatattctaataagaagctaaaataaacagaaatcaatctatttgctttttaaaattgccaaccatttattcagtgtgactatgaaaatgaattttcagccacattgaaatattttaattaaggctctgtcctccctccagccaggttgatagttctgcctaaattgactgaatccagttaatcatgtatagccgcagttggtggcattttaatttagaattactttgtagaatttgaataatttctcactaagatttgtaccctgactacttaattgctttttactgttatcacgtcttctaccctaacagagaatgagaatcttaaaaaataaagtacctgtggtttgctttttgcatttgcggtactgatgaattttgtagaatgcttttcactctttcttgtcaaaggatatattataacttaatgaatccttattaaaatctcagcatgtcacattacagtgataaaggagaagaatagtaagagtgaagatttgagggatggagaacagagagaacagagctggtttctaaaatagttccatgctggtcaggtcattggaagaggcttcctgttcttttataaacattctaacatggagactggcaaagcagagtttttgcgagaaaagaactgattttaaaaaggtggcttcttagattgatgtgttttaactttgtctgctgaatctaaagaataaggagagatcatcgcaaagtaaatggaattggatatagttctctgaattacttggggttagtccagattatttcggttctaagcaacagatactgatactgactcttaccaaacaaagcatgagcaaacaaagatttatcagaagggtgcttgttagtacctgtattcaaagggagaactagtcaaacctcaaaggggcaaggccaaccaggaccaacctagcagggcaagcatgtctccacactgcctatcttcagatgagcatttttttcctttaggcaagtttttccaggtggtagtgggaatgaccaggagcagctcatgagctacatctgtgattcagagaggatgggactctttccccagctcagactcaaacactcctcgaagagactctgactggcttagctttggtcatatgtgcctccttcatggagaactcagagggttgtggctaaaagcacaggctctggagctggagcacctgcttcctacctctgtggtcttggaaatgttacttaaccactctgcacttcaatttctttatctgtaatatggtgttaatcataagcttttaaaatgagggaaatttgtagacctgggcaaaagaggttcctgttcaggtcttacactgaagacggttatgatgggctgcattgtgtctccttcaaattcatatgatgaaaccctaaatcttcctacttcagaatgtaactttaactggagacagggtctttaaagaggtgattagattaaaataaagctgttaggttgagccctaatccaatttgactggtgtccttttaagaagaggaaatctggacccctgaagaaatgccaaggatgtgcaggcatcagggaaagatcgtgttaggacaaagggaaaacagttatcacaagccaagaagggaggcctgagaaagaaagcaacactgttgactgacacctcaacctcagacctatgccctccagaactataagaaaaaatgtctgttgtttaaattacatacgatatggtttggctctgtgtccctacccaaatctcattttgagctctaatccccatgtgtagagggagggagggggttgattgaatcatgggggtgggctccccccatgctgttctcatgatagtgagttcttacaagatctgatgattttaataaatggtagcttttcctgcactcatatgctctgtctctcttgctgccttgtaagatgtacctggtttgccctctgccatgattgtaagtttcctgaagcctccccagccatgtggaactgtgagtcaatgaaaactctttcctttgtaaattacccagtcttgagtttctttacagcagtgtgaaaacagattaacacacctagtctgaggtatttagtcatgggaatcctaacaagataatacaagagctttgcaaatatcgagctttgaaactctctggatttttgtttttagtcttacagaaaggctttgaaacatcaataaccaaatgggcaagtgagaattaggggagaggacccaaacactcaggggagtgggcagagcactaagtgccggggaggggctatgcacagcctctgctttgagaaaccaggaaggcttctcttgctttgccttggatgccccaaacgaggtggctgagcagaccaggttccccagataatagcaccacctcctccttcccttctgctagggtgggagaaggtttggggaggcttttagagtggtttgaaaatcctgaatgggaagtgagatattagagaggagtttgtgcactcctgttccctgggggcacgtttagtccctaatttggttatgggtaagtcctttcatgttaggcatagggtttatttataacattaaaattagacataaaaaatgtagcctccatttttattctcgcctgggacctcacaaataactaaggatgagtctgaatgaattaatacatgttagaacaaggcttggcccttaaaagcatttgagaatttttattttatcatgatatttggaccaattcctgcggcagggtttgaggtctatgatggccacatcttcagtcatctattctgctctatggtacagaagttgattactataattagcaaccctcatctgaactatatggattatagaatacttttctataggaatggaaaagctctttttagaaaatgaaattttaattttagaaaatgacattattccctaaaataaggagtttatatatttttctctttgatgtatagaaatgattttgattttatatttactttattccaattttatatggaattttaataagcaccttaaggcaatttgcagcctcaaaatttaaatttaacattataaatgttgtgcttgaaacccaaattttaagacactagggaagatgagataaaataaattatccaatttatgtaattgcactccctcattttcatagaacaacatgtttttaaatagagaaaaaatgttctataatctaggttaaagtcccggaagtatctttaccaccttaaacttctggggaagaaaatctgcagaagaacttttgagaaaggagaagaaagctattatttctgataaaaggagtaggaacgtagaaaacattttgtatcattaacattcacctctttcactgtattgcagactgttaccctgaatttccaaacaataaattcattccagccaaatcactaagacacctagtggatgggttgggggagagctgtatgacatttaaatttggcctgcagtgatataaaacgtgaaacataagtaataaattatagattggatttagtaatttatgagaagcattttattttccttttccaccttgattttcttttattatactttaagttttagggtacatgtgcacaacgtgcagttttgttacatatgtatacatgtgccatgctggtgtgctgcacccattaacttgtcatttaacattaggtatatctcctaatgctatccctccccctccccgaccccacaacaggccccggtgggtgatgttcccctcaaaagcactttattttatatgaaaagaaagtactctctcttttcacctgtgtcaaaattgccttacaaaagatctttcacactttaatccaacattttactttttaggtagacttttgaaacttactcaactgcaagcaatatcattttatttttttaaatattgatatgtaatatttgtacatattatgaaatacatgagatattttgttacatgcatagaatgtgtaatgattaattcagggtatttggggtatccatgacctccagtatttatcatgtctatatgctgggaacattgcaagtcctctcttttagctattttgaaagacacaatacattattattaactagagtcaccctactctgctgtagaccattagaacttattccttctatctaactgtacatttgtacccattaacctgtttctcttcatcccttaacccactgacacacccttcccagtctttggtctctattgttctactctcctacatgagatcgatttttttttttatagcttcgacgtatgagtgagaacatgcattatttgtccttctgtacctggcttattttacattacataatgacatctagttacatttatgttgctgaaaatggcaatgattttattcttctttatacctgactagtagtattccattgtgtatatatatatgaaattttcttcatccgttcttctgttgatgaacacttaaggttgattccatatctttgctgttgtgaacagtgctgcaataaacatgggaatgcaggtatccatttgatatactgatttctttttctttggagatatacccagcagtgggatattggatcatatggtagttctattttttttttttttttgagaaattgccatactgttttccatagtggctgtactaatttacattcctattagcactatacaagagttcccttttctctgcatccttgctaccatctgttattttttgtctttttaataatagcgttctaactggggtgagatgacattagtggttttgatctgtatttccataatgttagtgattttgagcatttttcatatacctattagccatttgtatttcttcttttcagaagtgtacatttgtgttgtttgcccactttttaatggaatacttttgcttttgagttgtttgagttccttatatattctggatataagtcccttgttgaatgactagtttgtacatattttctttcattccataggttgtccctccactttgttaattgtttcctttgaagaagctttttagtttagtatagtctcatttgtctatttttggttttgctgcctgtgtttttgtggtcttagccaaaaatgttttgcctagaacaattttctgaaatcttttctctgttttcttctagaggttttctagtttcaggtctttcaattaagtcctcaatctatcttgtgttgatttgtgtatatgatgagtgaaagaggtctagtttcattcttttgcatacagattgtgaattttcccagcactatttattgaagggggttccttttcccccatgtatagtgttgatgcctttgttaaaaatcagttggctgtaaatatgtggatttatttctaggttctctattctgttccactggtttatgtgtgtgttttttatacccaaaccatgctgtttggggtacttagtcttatattttgaagttgggtagtgtgatgcttccagctttgttctttttgctcaggattgctttggctattgggctcttttttggttccatgtaaattttagaattctgtttctatttctgtcaaaaatcacattggaaatttgataggaattgcattgagtctacagattgctttcggtagtgtaatcattttaactatattcatttttccaatccaagaacatgggttatctttacatttctttgtgtcctctttaatttatttcatcagtgttttgtagtttttcttttagaggtttttctcctctttggttaaatttattcttagggtttgtttttttttggtagctatcataaatggaatagattgcttgttttttttctcagctggttcattattagtgtgtagaaatgctactaatttttgtatgccgattttgtatcctgaaactttactgaattcatttataaaatccaagtttttttgtggagtctttgggtttttctagatataagatcatgtaatctggaaacggagaatttgacgacttttccaatttgaatgtcttttatttccttctcttgcctcactccactggctaggacttccagtactatgttgaataggagtaatgaaagtggacattcttgtcttgttccagattttagagaaagggctttcagctttttaccatttattatgatgttagctgtgggtttgtcatatatggcctttattatgttgaggtacattccttctatgcccagtttgttgtgagttttttccatgaagggatgttgaattttatcaaatgctttttgtgtatctattgagatcattatatggtttttttcctaaattctgttgctgtgatgtatctcacattaattgatttgcacatgttgaaccattgttgcacacctgctataaagccaacttgaaaatggtgtattatctttttgatgtactattgcaattggtttgctagtattttgctgagggattttgtgtctatgttcctcaggaatattagcctgcagtgttctttttttgtttgtccttgtctggttttagtttcaaggcaatgctgtccttatagaatgagttagggagaatttcttccttttcaacttttttgaaatagtttaaagagaattggtgctagtttttgaaaatttggtaaaattcatcagtgaattcatctggtcctggagttttctttgttgggagactttttttttttaaacacagattcttgctctgtcttccaggctggagtgcagtggcacaatcttggcccactgcaacctccacctcccaggttcaagcaattctcctgcctcagcctcccaagtagctgggactacaggctcatgccagcacgctttgggagacgttttttcttttcttttttttttttttttcactgattcaatctcattactcattattggtttgttcacactttccatttcttcctgattcaatcttggtagattgtatgtgtctaggaatttatccattttatctaggatttccagtttgatactatatagctgttcatagtagtctctgataatcttcttaatttctgtggtatcacttctaatcttttttttccatttttgattttgtttatttagatcttctccctttttttcttggttagtctacctggcagtttatcagttttgtttatcttttcaagagagcaactttttgttttactgatcccttgtatttattcgtagtgtctattttatttctgttctttgcttctattttgggtttggtttgttgttgcttttctagctacctaaggtttatggttagattgtttattgagaacctctctactttttggtgtaggcatttattgctatggacttccctttaaccaccacatttgctgtacaccataggttttggtatgttgtgttttgattttcatttgcttcaagaatttttaaattgtttccttttctttcttgatccaattctggagcatgttgtttcatttccaaatattgtaatctatttgtacagttttcaatgttctacttgttattaattactagtttttttcctttgtggtctgaaaagatagttgatattatttcaattttaaaaaatgttttgtgagttggttttatgtcctagcatatggcctatcatagagagtgtttcatgtgctgataagaagatgcatattctatagctgttggattaagtcttctataaatatttgttaggtccatttgatctaaaatgcagtttaaatccaatttttttggttaattttatgtgtagattatatgtctaatattgagtacatgttgaagtccccagccattattgtatcggagtctatttctgtctttagatctattaatgattgcttatatatctgggtgctccagtgttgggtgcaagtatgtttagaattattatatgctgaattcctttatgattttataatgacttttttcatttttttttactgtttttgacagcatatgttttgtctaagcatagctgtttctgctttttctatcctttaagtttcagtttatatgtgactcaggtgagatgagtttcttgtatgcagcatacaattgggtcataatttattaatccattgatccattttatgtcttttaagtggtaagtttagtttatattcaacattattattatggcattgtcattaataagccattttattagttgatttctggttgttttatatgttccttattcctttctttctcttattgtttatcattgttgttttggtggttatctgtagtagaaacatttgagtactttctcttctttgtgtgcttgctttaccagtgggctataaattttcttgcattttcatgatagtagatattgtcattttgtttcaaggtataagattcctgtaagcattttttggttggcttagtttaatggtgatgaattccttcagcttttgcttgtctggaaaagactatttctccttcatttataaaagataactgctggttatagtatcccttgactagcagtttttttttttcttttggcaacctgagtatatcattcataccattctctcccggctttttaggtttctgaagagcattctcctgttagtttaatggggattcttctctaagtgacagcttttcccttactgcttttagaattctgttactgacttcgacagtttgactctaaggtcttgtggagaagacattttttcaattgtattttttgggggcatctctgagctttttatatctaaatttctaaatctcttgctaaatttggaagttttcaggtatcattttgtgaattaaattttccatcccttctgttttcatcttgtcttctgggacaccaaaaatttgaatattttgttgctttattgtattttatatgtcagtaggctttgtttattcattttttaaaattttgtctcactgagttatttcaaaagacctatcttcaagttttgaaattctttcttttgcacgatctagtttattgctgaagcttataaatgtattttgtatttcatttaatgcattctttacttccagaatttctgtttagttcttttttatggtatctttccttttggtaaatttctcattcatattctgaattgtgtttctgattttttttgcgttctcttgtttgttgctgagcttttaaaatattattattttgattttttttccttggatttcatgaatatctttttcattgcaatctgttgctggaaaattattgtaccccattggagatgtcatatttccttgttttttaatgtttcctgtgttcttaaatggatatctgtgcatctggtgtagcagttgcatcattcaatattttgaatttgctttcattggggaagactttttcctgacaatgtatctatggtcctggctggttaggttactttggctttgattctgggtgcaggcagtagtatagtctccatgtgatttctttgactgcaaacagcatcaatgccatctgtggttttctcagtggcttagggtgtggttgttggtggaatccatggtgaaattttgctgaggatgggagcacaaagtgagccagtccttggggcccagtgttggcagtggcaggatgaagatgattccttgggcaacaaggtggtgtaccttgccagtggtgttggtgggtccaggtggactgattcttgggcctacaggcagcttgtttagatgtcagtagtggcagcgatgggccaggtaggtgagcaaatccttggttgacttggcattggacatggtgtagttgatggcaatagcagtgatgggacaactctctagctcccaagccatctgtgctggtgctggtggtggctggaatgggctgggtaggccagtccccagacctgcaggtggcatatgcaggtgggtggcagctctggtattaaaagctggttgggtgggtccaacctcaggcccctgggaagaatgcccatataacaatggtggtggactgagctgggcaatcccctagtcctcacgtggcatgtctgggcactggaggaggtgtggctcctggctggtaggacctgtccttaggccccctgtagtgcatgcaggcactggctgtggtaggaggggagggaagtgatcctcaagcccctggtggaatgcttggatggggtgatagtggtttcacttcagccctgctactggggaaggtggggttgttttcagtggaaacaactgtatgcatgtgggtagggagcttgttcttcactcatgcatcagccttggcagtggcagtctacagtggtggcagttagaggtgttgggatctgtcttcaagtcacatgaaaatgcatggtggctccactgctggggacaatgaggtcattgacagtggcttgcactttcgccctgacaggagaagccagctgcagtgttgtctacggatgagggatttcaatggggctacagggtcgcaagagattcagggcctgttatgccgcagtgcaggatactatctggtagaggcagggctgtcaaaatggtaccttgctgtagctgcttagaacttagcgggatatgtgggacctggcctgagctctctttttagggcaatgccatcatgtggtctccagtcagcctccaatgttagtctcagagcccatgaagttcgaggggctctctttgcctagaattgcaagagtccatgataggcatgtggatgatcgggtgtctctccattaccctttccttgcactggggaacctctctgggttcccagcttatccaagctgagaaggctgtcttatttccctctcctttcttgctttaggtatttcctgtcacttctctgttgaattccagtgttctctctgaactgatatattcaaaatgtgatgatctatgcttttgcttcttctttgtggagggggcaagtatcagatacctctagtcagccatcttgaagctgctcccccattagtcagcaatatagctttaaattggtcacctgtataaacaggcaatgctcagtgatatttgttccattttcatctctctcccaaatgtggcatttgttctgttatctaaatgagaagaacgcagggcaaaaatgacattccagaggttgagacttttagttatgtaattggaaatcaagtgcatccatataaattgtcattttgttgatctatggatttatatagttcacgggttaggccattttgtgttgctgtgacggaatacctgaggctggaaaatttataaagaaaagagatttgtctcatggtgctacaagctgcacaagaagcatggtaccagcatggtgaggacctcagggaacttacagtcgtggcagaaggtgaagggggagcatgtgtatcatatggtgagaaagagagtgtggagtgggaggcgccagactttttaacaaccggatctcacatgaaataatagagtgggaactcacgcatcactaagggaatggaaccaagtgattcacgaaggatctgtccccatgacaaaaacacctcctcccagtagaccccacctccaacaatggggatcacgttttaacgtgacatttggaggggacaaatattcaaactgtattagttcctaaaggtggaattttaaggctttggcttatttcatttctaagctctaggaagggcttgtggggaggagctaaaagtaatattaatggtaatcttataattaaaaattggttatagtgtgttaaaatagtagtatgaaagacaatagtattcttccattaaaaatattcattggggtttcactatttgtcagccattgtacagggtgatattaaaaccaagcttgatctctgctttccttgtgttaacagcttcatgagtgaagcagcattaatttaaaatgccgtgtgacacctgttaccatgaaaagttcatgccactattcatgcccatactgtgggtactggacacagacaggtgttcccagaaagatttttctgcaaaagtgaccctggagctgagttctgaaaaaggagaaggaattgactaagctaagtggaaagcaaaaagctttcagggcatcaggaacagcatggagcagagccctgaaagtaggccagcagactaaggcagagataatagaaggaatcatagtgtcatcggaggctgataattcatagtagagtattagtgtttgggagtgaaaagtctctatgtgaagtgatgtaatttgctgcaaattctgtggattacaatagcaacactaagtgcttaaaggagtgatatattagatgcactggtttttaaaaggactctgtctctgccagatgtactacattgcactgacgtctgctggatctagatgacccattgagccaaacaattaatgattttagttccgcaatacttggctcgttttttttccatgcaatgatctattatgtccactgagggctatagaatgttagagacagagaaattacaggcgtcccatgggagatcaatcttttcttcagatagagaaagtaaggttgagaggaagcggaaactttccatggttttgtggttacttagttacgaagccaataccaacctatcaattgattaaatgtaattctatagcttttgtccatcacacacaaatgatgattacaatgttaactgttttacatgattcattattcccagaagagtttgtttgttcacttttctgcagcctccaaaagaacatcatatgtgtgaaaacagattaacacactctggctctgatattgatgatgagctgttataatattaacaatgctgcatattgtggtggcagaaatccaaatgaacaagagattttggatatagcttgctgcaacacggaataaatgctttatacaaatgggaattctttaaaatcagtcatgaaaccagcataaattggtttcttgctgtggggggtttcttactgtgagtaggcaagtttgatttagaggcgtggtgcagaaatttaatgatctacatcaaaatacagcttacagataccttgattctttataaagatcacatatgcttgtcttgaattctcatacatccactcaaagcaacacacacagtcatttccatcacatttctttcaaattggtgacataatgcagcttttgggaagctgaacttgagctgaaaactactctattaattgcatatcacaaatctactttgttgtttaaatagaagatcctcagtgctgtatttagtaagatggtatagagatttcaaatgtgtcttcataatttatttattgtagaaagactacagatcactttgattattttaattctttgattaattttctgtttttgagatggggaagggagatgtcttcaaacagtaaaattagacttgatgggaaaggccactggaatatttaactggcctaagaattatttccacaaagcaattgtgtgtttttctgttttatttaaagatgaggattgttttctatgctcttcattgcaaatgcagtgttttggtgagatcatttgcttaatgcatcattgctcttagctcctgtgtgtgacctctcttgttttcagcctctcagctgttatatggatcacaacactgcaatgaggtttaaaaatgttctattgaactataagaccagtaaccaatttaaagcaaatttctgtgttgtttcatgtctagtacattttaataaatttcatttctttcccacactgtatttcccccaataatatttatatatatttgtcttttttattatgtgttaagacctttgaggacaaaaactgtgtcaagttaattttaaataaatgtataatccaaaatccaacaaacttataaaaccatctttcagctgagagcttccttactataggtgcatgtgtgtatacatgcacacacagcatcatacaatatggtgcatctggatttatataaatatataaatacaagcatatatgtgcatatgttttatttttacaaataaaaatgtattcttaaaatatctacattcatgtcggcaaagatatgaaccaaaacatctaggtagttgttagtaatttgttctactcagattaaaatattattttgaatttttactttgccattcatatttctatttttttttggttcctttagaaaaggcatttattttttcatttgcaacaagatgaagttggtaaacttcagggcagtaataagaggatatttggaacagtgtaatagtaagtgaaatatacataccagattttcctggcgatatctttgtttttgttcaaagatctgtttattaattgataggttcaaagatacactacttgactttgggggctggaagaaagtggtggtagaagctgtagtttttaccagaacctgtctttaggaaccaagttatgagtggttctctagtcctgggaacagctatgtaatagattgtatttatatatttccagaaatttatctctagcaaaaattcctaaattaaaggaatgtggagatgccttcattcatttcttcatctagcatttactgagcacaaattttattctaaacgctgtcttaaactctaagaacacaagaatgaattagcttcagttctcctcttaaacgactctcagctgaagagtctgagattcctacatagcaattgatattcctatgtgtcaaatgtaggtgtttgcgtgcatgggctcatgcatgtatatgcgtttcagttgtctcatttaggtatgagttttcttgtaggagtctattattttttccatgaaaatatatcctaggagaaaagatctttgagaagctaaaacccctggtgtctactccaagtcaccataaggaagctgttttgaggaacagaaaggatatgggtttaaaaagtaattgaaaaaaattgtatgtatttatcatgtacatcatgatgttttaccatatatataatatatgtgcacactttgcacagtggctaaatcaagctaattaacatataaatatttgaagacttgggttttgaagccatagagtccttgcttgaaacctaaggtctggcagtcacttttatgatcttcttcaagcctctcaacccctctgggctttgccaatgacctagggatgataaaaccccactcccagtgacatgccaagaaattgagataatttgggtaaagtgtctagcatgtgggtggcacttgatagttgcttggaataatttgagtccaattgtaaattaataccataatatttttatgtggaagagccagtctatcattagggtcaaaagcccttttctggaacaagcctgcctgggttctgatcctggtcctgctctagtttatacgattgtgggaaaattactgaatctctttggactactgtttccccatggtattatgaaggaataacaaatgagttagtgttaacaaaatgttaagaacagctcttgatacatggtaagtactacgtaaatgttggttaaaatgaaatagatgtgctttattttgttctatcgaatctgtactcaagttagatataaacataaacctttaatatttttgaggcatttaaatttattttttaacaatgacgtgacagaatctgtcaaactactgattagattatctctaggcatgtatttggtgtgtctcttagtaataaaaattaatgagtagactaaaaagctttcacataagtaattttacttcccttctcatttcgggtactgttcttttatttagtatttttgttgctaaatgtcttcgagcttatattttagaaataaattcatagaattatgggtgttcagaatttaagaagaatttatttcaatcaccatatttcattgctgggtataatctaataaaattccagcgtgatgaattgacttgttgcccactctgaaaatgtctgaaggtgagagatatcaaaattagtggttacaatgtgacttttcaaattatcattgtggatgtcaagatttctgcaactgctgttgttcatgattacaaatactggggctgttcatagtttcacaagcagcttcaccaatatgactcacctgaaatttacattaacattctctaggtaaggagtcacagctgttatcatgatattgcagagccagctgttatagttaagttgctgaaggtatttgagattacagcagcaatattgtttgggtgtattactaagtcaagaagctatttatcttttactgccagtaatgtaaatgtcagaagcctaatttatatttctgttttttcctgccaaagactttagagatatttgggaaaacaccaataaattgtaagaaacatttggaaaagagaacatttataatatgtgttatctaccctttttagattctaattatctagtttctaataaaagattcatttgttatttaattttatctctccctgtacttactttttgaatgatattgttaagtaattaggtttgccacaaaaaatataagatatccattcaacgttaatttcagatttatagtaaataatcgtacttatactataaaattattcattgtttacctgaaattaaaatctaactgggattcccgtatatacatttgctaactccggcaatccagatttagatttagcagtgtgaaatttggagtaaagaacaaactcatacactgatttggctactttatggctttttgacagtatacaaattatctgagctttctaattcttacttttttggtttatttttatctgcagtgtggaaaaaataagacctattttgcatacctgttctgtatacagcaatgttggtttaccttccatttgccatcctaaatgtttgaaaacagatgatttactcatataaataaacctacttttttcttttggtttagcataggttactttaaaattctcatcaaaatcatcttttaaatatatatatggtcgatgaaatctgtttagtttcaaatcaaacacctaggctatacaatacaggcactgatctgtgaaaatttcactacaaaaagtttgttttaacaaatcaattgaatatataattatcacattaaattacatttatatatttcctgaaaagttgtatgaatccgtgctatatgctcatcacagactagcaaagcccattacatttgaagaattacaccttcatgaacggaattattatttttccatttgtgctaaaataacctttgcaaattagaattctgtgtcgaaagctttgtgatgtgcaaacgctgatttacttcaggctggagaaagaaatgctttagagaatggaaacctccaagtaagtatgttttctaggtaattaaacttctgtaatatttacatttctataattataaaggaggttaagaatcttttaaaatattatgacttatttaacgtgcaaaaaaggttaaactattatacaatgaatatatttgttcataccatacagttcagaaatacaatattaccaacttattgaatctcccagtattttcttccttcatcatattccccctctctttccatttactgaaatttggagattatcataccatgtattcttttttaaatgtaactttaccttgtaagtttacattttaagcaatatatgtagcctagatttgcatgtttataaactttatatataatgtccactcttttatcctactctttttcctgcttagtgtcagtttggtaggattcatctatgttacacacatatctctagttcacttctttctacagctgttatacatttgccattactcaattgatcgacaatcaggttagtttcaggttattttttcagttgcaaaaattgctgccataaacatgctttgcttatctctgtgcatatgtatgtgttttgttagtctatattcacacatatgagtgaaatttccggggcatgggaaatacatctttatgagacattgaactgctcaccactatcatagtatccatttaaacagaccaacaatgtataagaattccctttgttttacatgctttccaatctgattttgtatgactattgtatgcacagttggatcaccttgtggttaaattttcatttcccaaattggtaatgagtaaaacatcttttcatgtatgtaatcgccatttacaatttatcttctgtgaatggcttctttttcctactctactatttttttctccttttgttatacatttgtaggagttacttatacatggggagttataatcatatctgtgtgtctctgtatgtgtataattgttgactctgatttttattctcttatgtacagaaagttgaatcttaacatggtttatgtcttagttcattttgtgctgctataacaggatacccaagactgggtaaaaatttataatgaacagaaatttatttctcaagggtctggaagctaggaagtccaagatcaagggactagcattttgcaagagccagttgagacagattctttggccacaagacccttcttataaaggaggtcaaaattaaatattctgtacctttcaatcaaaggtgtattggagccagcttatccagcttgcaagaattgactgccaaattttcagaaattttgcaatctggttgttaagccatccgtacctggaatcagtcatggcgggagtaattatagcatagaaattagcaaacactgtgaagcagagcttcccctatctttcccctgtctctctccaaagagccagttactaaacatttactgtcacattcctttcattccagcttttttcagtcaactcccagttgttagacctctagcacttccatcaaaccttcacctactagagtgtccaaaatgcttttcagcatttttggctacatatgcaggtctctatccatcctattcattcttttcccacctccagatacctccattgtgtccgtcactcctccattagcaacatccgctgcatgatcacctttccttttagcattctttccatctctattcaaatattacattgcaatgatgatatctacagatcttatcccaaatagcttttccaacctcaccactctcctttgctctttttttcacagaaattattattaatgattattatattacataatatgcattcttatatttactttctttctcccaccatggaaatgtaaactccctaagtgtgagaaccttgtttctcccactgtatttctcaaacttagaacaagttttggcacatgagagatatttgtgtatttgtaaaaggaataaaagaagaaaacagaaagggaagataaatttcctctatttctttgctgtaagtaaaacttttttttttaccttgaggacacaggttctcctgaatctgaagtggtagctgttgtttttttgatgttccacattcactgagaccaggaggtagacaagtatctttctttcttttcactgcaattctaggtttttactcactcaagacaaaaaaaatgtttcttttttctccttttgttttgttgttgaggttcttgacatttgctgtaccaccttttcccatcctcactgttgttaccctgtgatgttactgccttcctctccacccagtgctctgtcatcctggtggttgtgatggttagcaatcacatgaccattcagccaacaccattttttcttggatctcttgcccctgccctaatccttttatcctttacttcaaccatccattcccatattcacacctttggatcttgctattctcagtaattgctccatttccaaaatcactgattcaataatctaactctgaccatagcctctctccctccaacttgctggaataaccccactacactcatcctccaacctctttaagccatcaaaccattgatctgcgtaatttctcccatttctgctgctacctgctttctccatttctctcctaacctaaattagaaaccatgacctgcaattgcaacattactcctgaaaataccctaaaaatgcctggtccttctattttctctgcagctcactggaccaactgtaatttggatgaatttagctcttcatttttttttttttcatgactgagcttagttgtcattttctgagtgctcccggagaaattcacataaaagagaacattagtttctgtctatgtttatgtttcattgacttccaatggtcttttcgtactgcttgacagtccaattaaatcgctgtacaatgtattctccgattttcaaaatagctatttcaaattttctttactctcttgaacattccaaatcccattctccatcctactccttattcttagcagtcttgccttcctctctcctttttagagaagacggaaggcctcagaaactttcattctctatatcaaataaacatacctccctacccctgaattcactgtctcattccctcctactactttataagagtttaagtatgcaggtcatcgatccttgacaatttttaaaaacatatttattgagatataattgatatataaaaactctgcgaatctaatgtatagaatttaatgagtttgggtatatctatacccctgtgaaacaatcatcacaatcaaggtaataaacatcaattacctgtaaaatttccctatcccctgctgtgtgttttatttgtttgttgcatgattttttgtgtgtgtggtaagaacacttaacatgagatctaccctcttaacaaaattttaaagtgcacaatacagtattgttaactacaggcactgtattgtacagtagatcttatattcatcttgcataacaaactactccatcgaactacaactcctcatttccccttcccaccagtcttcggcaaccatcattccagtctttgtttctatgagcttgagtattacagatactttatgtaagtagaatcatgcaatatttgtccttctgtgattggcttatttcacttagcataatgtactccactgtttatttatgtcatatgtcagaattctcttctttttaaggctgaataatattccattgtatttatatgcccaattttctgtatctacttatctgcaatggacatttagtttgtttccacatcttggttatactgagtaatgctgcagtgaacgtgggcatgccgatttgtctttgagatctttatttcaattgtttcgaatatgtacctaaaagtgggattgttggatcatgtggtagttccatctttcagattttaaaggaaactccatagttttccacagtggctacaccattttatgttctcaccaacagtgtgcaaatttctccacatcctcaccagcaccgattatctgtttattttttgaaaatagtcatgctgacaggtgatatttcattgtgaaatatatcactgtggtttagatttgtatttccctaatgattagctatgttgagctttctatatacctgttggccattgtatgtcttctttggagaaatgtctgctcaagtcttttgcccgtttttaaatcagattatttgattttttgctattgagttgtagaagttccttattaatctttgatattaatttcttattagataaatggttggaaaatattcccttttatcctttaggttgcccattcattctgttgatggttccctttattgtacagagctttttagtttgatgtcatatttgtccatttttgcttttgtcatgaacccttaacaattaacataaattaaacgacagcccagaaagaagaaaaccaggaaggttttctccgtgcctttcccttccttctgacactattgaatgtttgctgtggcttttggaaatattaagtacagagttagggaccataaatttgcctgggattttaaggggagatagtgccaagatgtgatacttgagtagactattgacaatctgaacttcttaaaagtgaagtttgtaagacatacttaatactgaactaataacactgagacctaaagaaacccatttccttgagagacggttcaggctatagctgctcaaagaactcccagtatgcatgagctgtaaaagtcccttctgctgagattgcacaagataggaaatcgaggaagatgttcattttttggacttttaactcaaaaaagcaagtttttttcctttttaacttttattttaggttcaggggtacatgtacaggtttgttacacagttaaattgtgtttcatgggggtttggtttacagattatttcaccacccaggtaataaatgtaatatctgataggtagttttttgatcctcactctcctcctaccctatgccatcaagtaggttccagtgtctgtttttccttctttgtgatcctatgtactcagtgtttagctcccacttgtaaatgagaacatgcagtatttggttttctgttcctgtgttagctcactttggataatggcctccaactccatccatgttgctgcaaaggacatgatctcattctttttttaaggctacatagcattccatggtgtatatatactacattttctttatcaagtctaacatttatgggcatttaggttgatttcatgtctttgctattgtgaacagtactacagtgaacatatgcgtgcatgtgtctttatggtagaacaatttatattcctttgggtatatacccaataatgggattgctgggtcaaatggtaattctgctttgagttatttgagaaattaccaaattgctttccacgatggctaaactgatttacattcccaccagcagtgtataagtgttcccttttctccacaacttcaacagcatatgttattttttgatgttttaaaaatagccattctgacaggtgtgagatggttttcacagggtcctcattgtggtttcgatttgcacttctctaatgattaacgatgttgagcattttttcatatgcttgttggccacatgtatgtcttcttttgaaaagtgttgatgtcatttgccaactttttactggggttgtctgtcttttactagtaagtttatttaagttctctatagactctggatattagatctgtgtcaaatgcagaatttgcaaatattttctcctattctgtaggttgtctgtttaccctgttgataatttcttttgctgcacaaaagctctttagtttaattaggtcccatttgtcaaatttgtttttgttgcaattgatttggtgtcttaattatgaaatctttaccagatcctatgtccagaatggtatttcctaggttatcttccaggatttttataggtttatacatttaatctttaatccatcttgagtttatttttgtttatggtgtaaggaatgggtctagtttcagtcttctgcatatggctagccagttatcccagtaccgtttattgaatagggagtcctttccccattgcttgtttttgttgattttgatgtagattagatggctttagttgtggggcattatttctgggccctcagtactgttccattgatctatgtgtctgtttttgtaccaataccatgctgttgtggttactgtaggcttgtagtacagtttgagtccaggtgacatgagaaagagaatatgtgcctggaggtataggcttataaacagcccccccaagtgcgcctgtctcttatggtcgagactgcagaggtgaaatagactctagtctcctatagcgctcctgggcttattaggaagaggaaattcccgcctaataaattttggtcagaccggttgacctcaaaaccctgtctcctgataagatgttatcaatgacaatggtgccgaaacttcattagcaattttaattttgccttggtctgtggtcctgtgatctcgccctgcctccacttgccttgtgatatctgtgacccacacctattcacacactccctccccttttgaaactccctaataaaaacttgttgttttttgcggcttgtgggggcatcatggaacctactgacatctgatgtctcccccggctttaaaattattctcttttgtactctgtccccttatttctcaagctggctgacacttaggaaaaatagaaaagaacctacgtgaatattggggcaggttccccaataaaataggaagtcctttccccattgcttgtttttgttgattttgatgtagattagttggctttagttgtgtggcattatttctgggccctcagtactgttccattgatctatgtgtttgtttttgtatggataccatgctgttttggttactgtaggcttgtagtacagtttgaatccaggtaacgtgatgctgtcagccttgttctttttgcttaggtttccctttgccatttggtccctcttttggttccacgtgaattttaaagtagctttttctaattcgtgacgaatgtcattggtggtttgataggattagcattgaatctgctttgggcaatatggccattttaatgataatcattcttcttatccatgagcatggagtgtttttccatttgtgtcatgtatgattactttgagcagtgttttgtaattttatacagattttttacttctatggttaactgtattcctaggtgttttattctttttgaggttattgtgaatgagactgcattcttgattttgctctcagcttggacattattgatacataggaatgctattgatttttgtacactgatttttgcattctgaaactttactgaagttgtttatcattatctaggagcttttgggcagacactgggggtgtttcctaggtatagaattatattgtctctaaacagggatagtttgccttcctttcttcctatttggatggcttttatttctttctcttgcctgattgccctggcctagactatgttgaataggaatggggagagatgacatctttgtcttgtgttagttttcaaggggaatgcctccaacttttgcccattcagtgtgacgttagctgtaggtatgtcataggtggcttttattattttgaagtatgttcctacaatatctagttttttgagggtttttaacatgaagggacattgaattttatcaaaaagccttttctgcatgtgttgagataatcatgtgttttttttctttagttctttttatgtgatgactcacatttattgatttgcgtatgttgagccaaacttccatcccagagagaaagcctacttgattgtgatggattagctttttgatgtgctactgaatttggtttgctagtttttgttgaggatttttgcatctaagtttatcaaagctactggcctgaagttttctatttttgttgtgatactggcttcatagaatgagttagggaacagtctttcctcctcaattttttagaacagcttcagtaggaatggtatcatctcttcttaatatcaactcatctggtggagtttggctgtaaagccatctgttcctgggctttttctggttggtagaaaagtatgataattttccttcatactttacatctcttcgatttagaaatctttggattttaatttttagacagatttaatcttcagattttacttttccctgggaatttgctggggtaggagtcatagccaaatctgaggtatcttgggttcattgtacttttacaatatgaggtatcttcatattatcatttaatttcattgcagaaattctgatgagtattggccaatgggactggaaataatttgtgataagaaatagaacagagatggaatgtccagacttagaaaagatcatcctgactttattagttaatatacatgtcagagcattgtgggggtgaaatctatcctgatcaccagtagcctcaggtggatccacagtggagcaggagtttggtgttcggagagtagcctcataaaagtagagactagacttccctgatagtctgctgaccttcttgtccaatgcgatgtctaatatccttgctttatcatgggcttaatagttaaacctcgtgcattaagtgaacaaaaagcaagatgaggtagggagggatatattcctctcctctgattccagctcaaagggtcactattgtagtacctttctaacttttctctacccctcacttgctcctctccagagggaaaggagtaaattatacaatcgagaaaaggaatctggttgagaccttttctaccttctctttactgtttgctggatgactgctcctgcctatgctgcgagcttagcttagacctgtggataggtaaatatcaagtaggttttatcccctggatggaggttgattcaacatacacagatcaataaatgtgattcatcacataaatagaactaaaaaaaaaacccacgttattatctcaacagatgcagaaaaggctttcagtaaaattcaacatcctttcatgttaaaaactctcaaaaaactgggcatggaaggaacatacttcaaaataataagagccatcctatcattcagaacaggaaactcactgttcttctctctgtctccaactgagtttttaactaacaatcacactgatattttgatctctctatctttgactccttagtctcataattggtcaatcatctcttgcctggattattgcagtgcccctaactcttctccctgcttcccgtctggcccccagtctctgttcttaacacagtagcctgagcaattcttttaacctaacttggatcaagttgctttactcttcctcactctccaatggctacatacctgggtaaaaatctaacgtttacacaatagtgtatcagactgcacagatgatgcaaccgttacctctgtggtttcaactcccaggcctgttcccaagaccactctcctcactctctctgtctggccttactgtctccttgtttttcttaaacacttgtcaggcctctgcactctctgatccatgttcctgaaacatttttcccccagatggttgcatggtcatctgcctcacctcctcagggtctgtgctcagatagcagctcagcgaaaacttgtctcccttaattagaattgcactccctttccttgtatacaccctacctccctacctcactttattttcttcatagcttatgtcactctctggcaaagtatatattttgattatttatgtatttattgtttgtcttctttctaaaatggaatgtaaactcagtgaaggcaggggttttgtctgttgtcttcaccactgtacttccagcacgtaaagtaagttcataaaaacacatcagttaagtgaataaaccacttgggtgtgtttttaagaaaatggagagagtcaagttactaagaagagagtaaacttagatatgaaatctaaataacactgtgttaaggaatgatgctctatccaatttattcaactataaattgacttatagataacctataacttgtagataacataatttagcctaataatttattaatttgtaaatagccgaaacattctttttacccctatgctgtataatattgtccttaaaaacagctctgaaaggacatcagcacttctcaaaagaagacatttaagcggccaataaacatatgaaaaactcaacatcaccatcattagagaaatgcgtatcaaaaccgcagtgtgatgccatctgacaccagtcagaatgatgattattaaaaagtcaaacaacagatactggtgaggctgtgtagaaataagaatgcttttacactgttggtgggaatgtaaattagttcaaccattgtggaagacagtgtggtgattcctcaaggacctaaaaccagaaataccatttggcccagcaattccattactgggtatatacccaaaggaatataaatcattctattgaccaggcacggtggctcatgcctgtaatcccagcactttgggaggccaagctgggcggatcacgaggtcaggagatccagacaatcctggctaacacagtgaaaccccgactctactaaaaatacaaaaaacttagccgggcatggtggtgggtgcctgtagtcccagctagtccggaggctgaggcaggagaatggcgtgaacccaggaggcggagcttgcagtgagccaagatcgccccactgcactctagcctgggagacagagcaagaatccgtctcaaaaaataaataaataaaaaataaatcattctattataaagatacatgcatgcgtatgctcattgcattgcttattcacaagagcaaagacaaggaatcaacccaaatgcccatctttgatagactggataaagacaatgtggtacatatacaccatgaaatactatgcagccataaaaaggaaaaaagatcatgtcctttgcagggacgtgaatggggctggaagccctatcctcagcaaactaacacaggaatggaaaaccaaacaccacatgttctcacttataagtgggagctgaacagtgagaacacatggacacagggaggggaataacataccctggggcctctccgtggggcctgggggagggagagcatcaggacaaatagctaaagcatgggggcttaatacctagatgatgggttgataggtgcagcaaaccaccgtggcacacatttacctttgtaacaaacctgcacgtcctgcacatgtatcccagaacttgaaataaaaaaaaattaagaaaaagccctgaggcactgaatgactctgaagttccgaaggaatattttaagtgaccaagtgatcagaaatgctgtggggctaaatgcagtttcaagtatatgaattccttgaaatttggcaacctagggttcatattgtcttagctagtcaggaaatccagtttgccataacactttattcatgcattcaaacttacttgctgcgtccctactaaatgccaatctcttaggtcaggcaatggcagcatgaggtggacaagcttggtccttgcctgtgagaggtgagtggtctgtgaatagggaagtctactgtgttttactttgtatctcatcccctgtgatggagacttgcactcatgtatgcctgtcccgcagtcttaccttcaggaaaagttaaattggttaaagttcattctgtttctcaagagcatcacttactagtagagaatattctcaattaaaaaatgactaaaggccgggcgcggtgcctcacgcctgtaatcccagcactttgggaggccgaggcgggcggatcaagaggtcagaagatcgagaccatcctggctaacacggtgaaaccccgtctctactaaaaatacaaaaaaaattagccgggcgtggtggcgggcgcctgtagtcccagctactggagaggctgaggcaggagaatggcatgaacctgggaggcggagcttgcggtgagccgagattgcgccactgcactccagcctgggcgacaaagtgagactccgtctcaaaaaaaagaaaaaagaaagactaaatacacaccatcttctgcattgttacatgtggtgtcagaaattgttttttcatctttcatattcacttgctccatatagttaacatcatttcctcaaggaagaaaagaaagaaaaaaaagtggcagtacttcctttctgtggaacagtggccccaattggtataggttatgttgcttagagcatgagacagacatgccgatgagaatatttatctgataagttgcttcctaattttgggtttatcagaccatcataattatattcattttctttgttaaatcaattcaaatctatattttttctttctttatagtcagcctcaggagatattgatttcacctttgatacaatagaactgaaaaattgtgactaacattattgctttggctaatggcagtgctttaaaatgtatggtttattctatgtgtaactaaaacactttacataatttgaaatataaatatttgctagatatcaacagattaattcttccagattatgattgtgtctgtcccctaatctctgcttgtcataattattgtattgctggaatcaacagatgaacactatcaaaggcagttttgatttcctaaaatgtgcagttaattcaattaattcataatccaagttatctgatttgtttttagggatgatctttttgagactctgtacacctggggatccttatagctgcaagggaggtatcattagcaacagctgtagattaggagttgggaggtgaaaccaataagcggttttgtggttctgggccaatctcttaatctctgcagctagtttcctcttttaaaaaatggaggtatctcctcaacttttcttaagagcatttggagacagtacaatgggaaagatcattgaatattataagagctgtatctatgcaaattttaaaaattgttaaaagtgatgctggtacaaatacaagatatatgttattatcatagttactgtgtttatattacctttaggcaaatattaatattagaagagtctttgaaaatctgcagagtaatagaaagggaagatttactgcaatcatatgattccattaaacacgatctttgtgtttaagcatttgaaaacacacttctagattaagactctaaatggtgcttgataatgatggatttttatgtaattaaaatagctttatggaattaaaatatgccacctcattgctgactgcaaatgaggaactgaaaataatcatttgttcgtgttttcatttttcaactggaaatatctctttctggccatgcatctgtgaaggcttagtacattttgttcttttaatctatgcaggaaggcccttgcttataaatgggttgcgttccaaaagtacattttaagtaagttttttggaacagagagagctcttttcttctcccagttaaaaggataaaaacaaaaaacaaaccctaaaggctctgggattttccactttcttggctttgctcaaactttctcacctgcctagaataactttgaatcctacctgttcatcaaggccccaaactgtcagttcgttgagagcagagattataccacgtttattttgtattttattttattgttttctgtagagacaaggtcttgctatgttgcccaggctggtcttgaactcctgggctcaagcgatcatctcatccaggcctcccacagtgctgggattacaggcacaaaacaccgtgcctggcccatgcatcatatttatttgtgagaactgaagtatccccaagttttcagccctctcaggtcatccatttctttaatgtagaaatgtagtagcaaaagcctcactccacaggacagaaggagcctatcctcttccctgtgactactgagggtcctgggggagggcttttgtctctgttgttgctttttctcctctgctctgcctactccacattcctctgtaggttttacctaaacaacagaccagggccaccgaaattgaagaaaaggctgtggagaattagcagatcttggtgatgtaacactttgcaaaggaagaacattgaaaattgtgtgtagatcgtatgcttctagagaccagcccatgccagacatggcatccaccacaatctctgcgtgtccaccattcatggcctttgtgtctccaaggcccactcttctttcccctatgggagtgccctgggttctcaaagcccaagctccagtattccttcttccttcttctggctcattagtaaaacaaacaaaaatcagttgacatatctctcagaaacctgttgccatctctatccccaccagtatacaccaggaagaaaaaacattagtatccagaataattagcctgtttgaagctttggatgattttgccagtgtttaagactgcttcaagactatgcataaaaaatgtgactaacagcagctgcatcactgaaagtactcaagagcgatcccttgagaacaaataagaaattggcttttcttagaaatcacaggaaataaattgcttcctcccattgattcatttatttccctcatctcttttggccaatctgtctagaagttttgttgattgtgctacttagaagtctctcaaatatgtgtttcctctgtatccaccatgccacttgttctggaatagacgctaacaacctgaaccattgcaatagttttattatataggtctccatggtttcagtctcttctctgactcatatcttttataaagggacagatggcaaataacttaggctctgtggccatatagtctctgttataactacttaaatgtgccattgtaacttctaaagcagcatacacaatatataaacaaatggacatgcctgtgcttcagtaaaactttatggacattgaaatttgaattttgtgtgtttcatgtgacataaaatattcttgtttccatttttaaccccctttaaaagtacatgaaccattcttaactcacaggttgtagaagagcaggtggtgggccagatttgacccataggctttagttttaagtctctttatactgtcataagtgacatttccaacaactgcagaaagagtcaagcttaaattgctcagcagagcatagtggccctttctttgcatcattgcctataacctatattgctattcttatctctgaccttttcctctagctttgatactccctatactttggtcacactggattatcatttgtgactctaaaaatactgcaaggatgtgaacacctatatgcccttccttatacaatttgtcagaaaaactcttctcctccataatttgtctaattagcagacttccataagatacttaccaaatgttgtattttcattataattttctctgaattttcaactcagcagaaagtgatactcttttatttgcattcccatggcacttgtatacacacagacacacacgcgtgcacgcgtgcacgtgcgcacactcacactcttttgtgatagtgtctggctctgtcacccaggctagagtgcagtggcatgattgtggctcacagcaacctcatcctccctggctcaagccatccttctaccccagccttctgagcagctgggactacaggtgcacgccaccatgcctagctactttttaattttttttttttttgtagagatggggtttcaccgtgttgcccaggctggtctcaaactcctgagctcaagcaatccacccctctcagtctcccaaagtgttgggattacagatgtgagccatcatgcccagccctatatttttctgcacagagattatctttaaactttaatagtttaaagaaactataaaaagtttcttgcttctttttctttttgaaaaatcacttatctttattcctctggcaatgaactacttagcacatagaaaagtgctcaataaatttttgtggaacaaacagacgacttgccgttattgtttattggtgataagttgacattatcatcattattttatttttcagattgtttatgaggaaaacaatgatctgtgtaatcacaagatatgtcaataaccaaatcatgagatggggctaaaaagctattcagtatcatctcttataattaagtacattttattagagttcttttttttctgagcatttatccttattcttgcctcacgacttttggaaaatattcctctagctcagtgtatctgtacagataatgtcgactgtacccagaaaatcaagaactctttgacattgagatttgagagctcctggggatatcttccagttcttattttacttattggttggtgtcttggcatcatggtcattttgatgatttttttttttccaaaatgggtcctaataaaggaaagatacatgtgaaagaagtgacacattaaacttctattaatcatacaaattttagtatgaactaaaggggaaaaataaattttacatggaggattatcaacataccaaagttctgagctctcctggggttggataagaccattgtcttaacaatcgtcgtcattctgtcatatcgtgtcaatgatatcttagcataatgaatataggtagcagtctatcttttcaacatgcagtactcttgaatactaaaacttgtgtagttaatttgcatataatttttcttcatgtaacagaatgatgcaactgtcatgtaagatgaaccctataattattaataatgctttttataaaaatagctcctctatcaatttccctcatcagttattctgggagctgctacattttgggttattctctttccaataatctatagtcctggctcatttggcctgaagtgatagatagtaatgtgtcaacactcataagtaaggttctaagaggaaaaataagaaaacctttatttacctccttgatactttataattttataggtgatatttctaggttatcaggtctgctaatgtatttctcaagtggttttaaacacacgctaacttaatattttacttactctttaagctaatatattaaaaaatttgtgtgtgtgtgtgtctttagtagtgaaaagagttgtttttttttttaaatggtcttcaatattttccatggtttgaatgtatctcttaaagcttgttttggaaacttaatccccaatactaatgttaagatgtgagaattttaacatcacacaccggggcctgttgtggggtggggggagtggggagggatagcattaggagatacacctaatgtaaatgacgagttaatgggtgcagcacaccaacatggcacatgtatacatatgtaacaaaccagcatgtggtgcacatgtaccctagaactttaataaaaaagtatattaaaaaagaggacaactctaaaaaaaattaaaaataattaaaaaaaagaatttaaagagttggttaggtcataaaggatctgtcctcatacatggattaaggtcattattgcaggagtttgttagagcaagaatgggcttgttataaaactgaattgagccttccctctctttctctctctctctctctctctctctctctcacacacacacacacacacacactctctctctctctctctctctctctctctctctctctcacccttccacctcctgccatgggatgatgcatctagaagtctcttgacagatgctggcaccttgatgttggacttctagcctccagaactgcaagaaataaatttctttttaaatcactcgatctgtggtattctgttacagcagtgcaaagtagactaaggtaatgtcccatgttctttgattctttcaagatgccatataacttattaaagtcagaattcctgggttacttacttgatctgccatttactagctttgtgatcatgggtgagtttcttaactgccctctgcctcattttactcatcaataaaatgggataataatagtatgtcataggttgttgtaaagactcaatgaactaatacaggtaaggtgcttataacagtacctggtaaatatcaaaagatcaatgaatgctttttattgagtattttattgttattctttgtggttattatatttcctcttaacaagctctttcaccgagttactataacgtccaaccagatgaccaaaagagtgaaaaatatgtaaaaattgtatttgatattatagaagtaacagtataatacttgttttattacaattctaaattttcaactcgtgtttttcttagatacgtatcacgttgtactatttccaggtcattgctctttttattttctgtttttttttttttttcgtgcctccaaatccacttaaacttctattaatatattattgaggctggccatggtggcttatacctgtaatcctagcactctgggaggctgaggggggcggatcacttgaggtcatgagtttgagaccagcctggtcaacatggtgaaaccccgtctctactaaaaataaaaataaaaaatattagctaggtgtggtgatgcacatctgtaatcccagctactcgggaggctgaggcatgacaatcacttgagctcaggaggtggaggttgcagtgagccaaaattgcgccactacacttcaccctgggtgacagcgtgactctgtctcaaaaaacagaacattattgacacttaatagacttatgttttcttattttcatttattcataagtacaactcaccttgaattattgttaggcatgagtaaaaacatcacaaaaatattctggctgagacaagctaaaattaactccagtagaaagaaataaaatttaatctagtcaaatggttatttgccatataagagaaaaaaagtttgtagaattctaacttgggaagtttttagacattatttctttgaattttttttcccagtctcactctcttgcttctctggttctgcaattctggtaaaataaatgttagaaattttcttcaagtctcacaggtccctgagcctttttcatttgttttgctgttccttttctcactggtgttcagattggatagtttctattgtcctgcaaactgactaagtatttcttctctcctctccattctactgtcaagtctgttcaatgagttttaaaatttgagttattggatttttcagttatccaaatgttgcatttggttcttctttatatcttcactgagattattttttttcacgtgttccaagtatgtttgtatttctcctttaaagcatgttcatgatggatgattgccttaaaattgttgtcagataattctaacatctctgtcatctcagtgttgacatctatttattaccttttgttcatattaggtgtgattttcccatgtcttaatataagtaattttaaaattaaaattttgaaatttggggtattgtggcatgaacctttgaatcttaaatattccattttacttggcttccttggacacggctccagcaggggaagggattggttatgaacttgttactgacagtttgtggggaggtctagagtcctcacttagcctccattggcatgaggagctaggaggtgggatgggaggagggtctcttcattactactgaacaggctcctcactaggcctcagctgataacaccctggctggttggggcaggaatgccttagggtgggaatggacagagattgagagggactaatctcattggcaatgggcaatggtgaaagtcttaattctttaccaggcctcctttttcactactgggtattagaaaggatgaggttacctcactaccactgggtggggtggaaatcttgcttgtatgaggtggggatagggttgcaactttttcttggacattcggctggagtaaagcaattattatctaaacattttctttcttgttaggctttccctttcctgatgttggtgtgagaaaggcatatattgaggctttttttttttttttctgtctttgcccagtgatgtttcagggtcgctgactttcccagctctaaatatgggaagtatgaaaccaaatgaaaacacaggaaacctgccactgtgtcgttgcttgggacccaaatgcctagctggttggcgatcttctttccacctttcagtgtcgtctcatgtttgttatatatatataatgtgcagagattttacttatacgtagaggaatagggaaagtggaaatcagccaaccaaccaagacttctaactaacatgaaaatacatttgaatatttgagatttgtggacatttccagcaaaattacaccaaattgctcaaataagtccaataaaacttttttccctaacctgtgatatagatccaccatgtaccagaagtagaaaagaaaacaatgctccacatttcttataccacaaggtgacattttcataatgagaataatttttattttatcatcagatcttataaaatcctattagcactttacatccaagccgataaaaaatatctctggaatattctatataccaatggggttgactcagttataatagacatgattttgcatttaggttacatttcttttttaccagaggagaaaatagcaatgtttgatgaaaacaaccagatttgtggacttctctacacttcaaccattagcccaagaataagtcaggacaaattttttataaagcaaatctaacacgtaacataccaattagaatgaagacatgccatgacaattttcagcatatttcatgttttccaatatttttatcctaagttcaattatatgacatatattcactatttatcaatcaactgtaagttccccaaaactgtattggatgttacctaatactaggtaagagtttgtcatctgttctcctcagcctgtagattgtccttttaatgtgtctgtggcacattggggttggggtactgtttgtcgccatggatcagtttttaacattattgagctaaatgatctgtgtagaagccaatctcccatttggatggagtgtcaatacatgactgtgtaaaaccaaggcaggatgttttatatatctgatcttgaagagtcatcctagtgtatccttgggagaatttgattatatgggtagttacaacaattgctcatggccacagctgttttgggcatttttgtgagaatgttagaaattaatcctgtagctaaaattcagtggatcaaactgaattgctgactgagtctcagaatgtaaaattaaaaaaaaaaaaagaaaacctccctaggtaaattccttgacagccctgtcaatgaggtgttgaaaacattttaaatttagtcccgtatctgctgcatagacgtggtccatgagctttggtatacatgttttcctgtctttctttaaaaataaaagaaagctagttccctttggctactattaacttccactgaaaggatataaaatactagccagtatagatgtttttcaaatgtgcactgaccaaaatatcaaagaatagcaaaacctcattttatgagacttttattgatactatatgtctcctcaaatgtacagtttatattatgaacaagagcctttgcctgattttgattcattgcaaatttataccacaaaaaggatacaactggaaaaatgcattgaggaagtcagctgagaataatatacccttatttatgttttctctttttattactattcagtatactgaaatatactgcccattctaaggaggagtatgttggcaaaataagtggaataaaaggaatttatctgttttatattttataattggtagattatgtttgtttaaaatgatatgaattcatcaaaaccattgcttttaaacatacatagcaaattagtactttttccaatgaaaagagagtgctttaaaatgttgccattaaaaacaattaaaaacaaaacccatatgatcatctcagtagatgcagaaaaagcttttgataaaatccaacatccttcatgataaacaccctcaacaaagtatgcatcaaaggaacatatctcgatataatgagagccatctatgacaaacccacagccagcatcatgctgaatgaacaaaagctggaagcattctccttaagaacaggaagataaggatgcccactcatcattctcattcaacacagtactggaagtcttaagagcagttaagcaaatgaaagaaagaaaaggcatccaaataggaaaagaagaagtcaaattatatctttgttgacaatatgacttcatacctggaaatcccaagagactccaccaaaaggctcctagaactaataagcaactttagtaaagtttcaggatacaaaatcaatatgcaaaaatgagtagaatttctatacactagtagaattcaagctgagagccaaatcaagaatgtaatcctatttacaatagccacaaaaatattaatataaagtatgtagcaacacaatctctaaccaaggaggtgaaatatatctttacatgaggaactacaaaacactgctgaatgtgtttttagatgacacaaacaaatggaaaaacatttcatgctcatggactggaagaatcaatgtagttaaaatggccatagtgcccaaagcaatctacagattcaatgctatccctatcaaattaccaatgccatttttcacagaattagaaaaaactattctaaaaatcacatggaaccataaaagagccttaatgccgaagatatcctaagcaaaaaggacaaagctggaggcatcacattacctgacttcaaactatattataaggctacaataaccaaatcaggatgatactggtgcaaaaacagacacatagaccaatgcaaaagaatacagagcccaaaaataaagctgcatacttatgactatctgatcttcgacaaagtcaacaaaaataagcaatgagcaaaggactccctattcaataaatggtgctgggataactggctagccacatgcagaaggatgaaactgaacccctacctttcaccatatataaaaattaaggtggattaaagatttaaatgtaagatgtcaaactataaaaacttaaaacctagaaaatatcttgttcattaagccttaggcaaagaatttatgactaagttctcaaaagcaattgccacaaaacccaaaattggcaaatgggacctgattaaagagcttctgcacagtcagagaaactattaacagtgcaaacgggcaacctacagaatgggagataatattagcaaactatgcatccaacaaaggtttgatatttagaatctataagaaagtcaaatcaactagcaaaaacaaccccattgaaaggtgggcaaaagacatgaataaacacttctcagaagaagacatgcagtggccaagaaacatgaaaaaatgcccatcatcactaatcatctgagaaatgcaaattaaaatcacgagatactatctcacaccaattaaaatggctattactaaaaagtcaaaaaataacatgttggtgaagctgtggagaaaagtgaaggtttatccactcttggtgagaatgcaaattagttcagccactgtggaaagcagtttagagatttcacaaagagcttgaaagaggactaccatttgaccaagcaattcaactactgggtgtatacctaaaggaaaataaatgattacaaagaagacgtgcacttgtatggtcattgcagctctattcacaatagcaaagatatggaatcaacctaggtgccagtcaatgttggactgaataaagaaaatgtggtacactgttgaatactatgcagtcataaaaagaatgaattaatgtcctttgaagtcacatggatacaactggaggtcattatcccaaatgaattaatgcaggaacagaaaagcaagtactgcattgttctcaccaataagtaggagctaaacataggataatggacattaaaatggaaacaatagacaccagggactactagacagtggagggaaggaggagggcatgggctaaaaaagtatgtattgggtactatgctcactacttgggtgatgagattattcacaccccaaatctcagtgtcttgcacatctaccccctgaatctaaaatataagttgaagttataacaaaatacatcaaatatgttctaccacaataaagatgtttgattacaagaatatttgaaacatttctggtttctaattgtttttgtaataaatgtgcattaaaacaaacatcctctgctatagcaaatctttaggttttgaacgtaggttgctacgtcacttgaaacaaagtctttttaatttttaatacttaaaaatcatgttgtagtttatgaggagctggagaactatcacaatggggaagcaaaccacaaagtcagtttcctacttttaagttgtgttatagagaaagttgttcaattttctacagaacgaaattgattgaccttttgtgatgaattagacactaactgggccattgacggtggatagaacacccactagaatgccttttcttaagatttgcaaacacttgctttttcattttgggccaatgatggtttccattgtggatgaggattcaggtcttctgtaaacatgagatcttaacattgcttactgtgttagtcaggaacacattatcttatgattttttttttgcaggagctatctctaacactcaaaaattcaaggtccagtctataaaaaatgttatagagtttgttatctttaagagtatatcttgagccatcatttaaagagttatataattgtctacttggatgtaccaaatctctgaccttttcaagttatctgtcttctaagattatgatcatgtatctttaacctccctcattatttttgtcagagaactctggtttttgccattatatgattgttgtatactttttcttatcctaactatactgtttctggattttataagtttttctctgtaaataatgatgatttttgtgttaaatgcaacaaataacttgataatatacttcaaattttgcattaatcttcacttgtcttcttcagcttaaataattttctaaacgcttattacatgctagagcagaagtaggaattaaaagagataaacaagagttgatacctccgtattcatggtgtgaggacagggacaaaggagcaagtcagataaataacttgaacatgatttaaggaaagcagtaagaagagaactaaacagagtaccacaggaagtcaaaagaggaaatgattcattctgtctgcagggactggaaaaagttttacagagataatgcatttaaaccaactcttcccaacagtgatcaaatggagaggatcggacatcttaagaaaatggaataacaaatagcaaatctgagtagatcgaaagcaaatgcattgattttgggacaatgacaaatcatataatgtaattaaattatgggtgagagggtgtgtgtgtgtgtctgtgtgtgtgtgtgtcatgctattgggaggcaggtcatagctgtggatctcagggtgacaggaaatgtacagaacagaggctggtaatctatttttttccaataaaaatacagcaattatataaaattaaatggaatcatatgcataaagtttaaatcaagcttgtccaacctgtggcccacggtctgcatgttgcccaacacaaatgcgtaaaccttgttaaaacgttgtgaaattttttgcaatttttttttttttttagctcatcagctatcattagtgaaatttatgtgtggcccaagacaattcctttacttccatgtggcccagggaggccaaaagattggacaccctagtttaaatcattatggactgaacattgccacaccctagaaatcgccaatatgcttttcctgattacatctcccccgccttcttccagcattaattagaatgtgttaataatttccttgctttcctctataatttctatctttcaagtgtgtatccctaaactacaatgttgcttttgtgtgtttttgaacttctatgaatggaataattttatgtgtagtcttgtgtaacttgctttattatttattattaatattatttttgattgacaaattgtaattgtaaacatctatgaggtacagtttgtatacaacgtagaatgatgaaatcaagctgattaacatatcacctcagttacctatcattttttatggtgagaaatttgaaatttgctcttttagttacttttaattatacattattattgactatagtcaccctgctgtgcaatagatatcaaaacctattttttctgtttgaaactttgtatcctttgattaacagctccccatacctttcctttgtccatccgcaagcctctggtaaccatcattctactctctactttgatgagttcaactattcaagtgtccatacataagtgagatcccgagttatttgtctttctgtgcctgacttatgtatgacttgctttaattgataaatagtatgtttttaaaatttctttgtatggatatattataaggagcagaattctcttgtaaagataatttataactttcataatttccttagttttataatctcacagttgatgggcacaatggttgttttggtttttatgagcaatgcttctgtgcaatctctccttatttatgtgtaagagtttagggtatatacctaattatggagtatataataaccttctaatgttcctttgagaaatatttttgagtaaggagggttctgactcccccaaagaaactaaagatacatattctgcccattgggatggatggccatgctctaatcctccttttatctccaggagaagctgaaagcagctccagctaaccatgacttagctggttggaggtaggttatgcagttgttcaattttgctagagaacattttcctaagtggttaaaacaatttatactcccatcagcagtggtgaggatttatgttgtttcttatgcaaatgacacttgttattaagtagccataattttttgctaatatggtatgagtgtgaaatgaaatctctctgttttgtgtttctctgattataaatgagattgaacaccttttcatatgattattggtcattggtggtcttctctgaaatttttaatcaattcttttttatcattttttatggggtcacttttttcctgtgtatatatagaagttctttgtgttttttgaatactaatcttttgcccatttttgtgtcacaaaattttctcataggttgtagtttagtctttctacattctatatggtggtgatttgtttatattttagtttacctgagtgttttccctttttaataggtgaagtatgttggtttcatattttaagatccttcttacagtttggactttattctgatggtaatatggagtcatcaggaggcactgaatctagagatgggagaccagttagaaagcatcttcaaaaatgcagattatgagggcgtgaaagtaaacacttgcagtaggaattcaaagga

SEQ ID NO: 502 - DNA, 20001 bp, Homo sapiens
tagtcaatgataatgcaactccatgccacaggtgactagtgtcccaccttccctctgccagaacatcatcactgtgtgcccaaacagatgagcaatcccgttccatgatcttgtcttaaagatctgattttggcactaattcttgtatgaagaactctattattcagagtccaacttgaaaagatcattccagtatttaaagcagaggaaatctaatgtaaggaattagttataccggtggcagaagtgcagagaaaccaaatcaaggacaccaacagggataagcaacacaagaaggtactgccatcctgggctagaaggaaaaaggggttcctggtccaggatgcagggccatccggtcaaggtgggaaccagagcaggcctggcagatagaagctagcaccacagagaagatgcagcccctgcctgagaccccacacaaaacagagggaaactcctggctcctcccttccccatctctccaacctcctgccattgtctcaatggccaaaccaactgttctgagagtctaaaaaattaagcctgcattgaaggctgcaaagaagcccgggtgatacagagctgagcaggggacaagtgaggaatagatctgattgcagaaaattccaaggaccagcagcccgtagggtggggttaggataaccagagtcaacatgcataaaggaagtttcactcaaaaaaattagctatggcctgtgtggattcttttgactttgaatgatggttggaataaactcttgtgacttgtaaatagaagtactgaatgtgagtcaacaacaggcagaaagaaaactgtgatgtcggaaaaatcaaacaagcaaatatttatgtcagataagaagttcatcaaccccaatgtgatgatctggacagagtgggtccctttaatatacaaaatagatggatgtggactggctgggtataaacttgaaatgggggctgggagtctcaccaccaccctcacactcaccatccctgagaaccctctgagtgccagcaggtgtactgagaaccacacaaaggtaagcacggatcacagatttaacacaactctgcaaccttgtatcattttcaagacacatgtggcatcccaagagatgtcaaattcaaccctcagtactgcacgaggctaaaatagtgcaaaccaaaattataaagctgtaaggggtcttagagataaacttgcctataaatgagccgtctgactccaacccactatctaatttcaggaggcagaggtcacaaatgtccctgatttcaagttactatttctttcctttttttaagggatatctgtcaaccttggttctcttaaaactggctcttgtgcaacaaaatgttgcttgttaccggttcaatattttactgttgaatacatcggggcctaaagaagttatgtgacttgtccaaggtcacacagtaacttaaaggcaaaatcgaaatttaaaacctgcccaccaacttctaatcaagcagcaacccttctgtttcagcaaacggtgggtgtggagaagcagagctgtgctgccacccgcaaccctcagagttatgaggcaacagcctgtcgctttccaaaatgtcccatgaggtcagctctgctgagggttgtaccagtcaaacctgtgttgcaagatggcttcaaatatcaattaagattgtaacatgctggactacaaatgaaaaattcatgtgagaagagatctgagtttggataactctgggtctcgttcagaaagaaagtatgttgtgtttcaaatatgacattttaagtgcatttacttcttttttggatcagcctctgattctgggctattctagaatttagtgcaaacctctgccatagcacacggcccacttgattgccttttcttcatgcaactgccttccacctggccttggtgcttgcaactctgtatctctagtgattagcatagatttcaacccatagtagtacctcatcaatatttactcgacaaatgagtatataaatgagtaaatgatcaatcatcacaccttctagagattgacagctccaaaatttgtcaatatgatgtgtcatgtgtacattttttcctgatgtattccttcaaccaggtgatacatgtaaagcagtaacaaattagattaacagtccttaataaagattgctagaaaactaagagccaagaaataaattcataatttcaaaaatatctgcttgaagagtatttgtagatagtttatcaccatatatatatactatatatatactgtatatatagtatatatatactatatatactatatacagtatatatatactatatacagtatatatatactatatatataccgtatatagtatatatatactatatatactatatataatatatatactatatatactatatataatatatatagtatatatatataaaaaaacataatatatatatagtatatataatatatactatatatatactatatatactatatataatatatactatatatataatatatatactatatataatatatactatatatataatatatatagtatatatataatatatactatatattatatatatactatatactatatatatactatagtatatatatatactatatactatatatatactatagtatatatatataatatatactatatatatactatatatatagtatatatatataatatatatagttttttgtttttgtttttgtttttgagacagagtctcgctctgtcgcccaggctggagtgcagtggtgtgagcttggctcactgcaagctcctcctcccgggttgacgccattctcctgcctcagtctccagagcagctgggactacaggcacctgccaccgagcctggctaattttttgtatttttagtagagacggggtttccccgtgttagtcaggatggtcttgatctcctgacctcgtgatctgcctgcctcggcctcccaaactgctgggattacaggcgtgagccaccgcgcccagcgtttatcaccatattatatccgccttatctgtggttttagttaaccgcattcaatcatggtctgaaaatattaaatgaaaatgtccagaaatcaataattcacaagtgttaaattgtgcgccattctgagtagtgtgatgaaatctctcaccatcccgctctgtcctgcccgggatgtgaatcaccctttgtccagcacatccgtgctgtatacactccctgcccccatttgtcattttgtagctgccttggttatgagactgaagaaaacatggtatagataggattcagccaaggtttcaagcatctgctgtgggtcttggaacatataccctggtgataggggggctactgtattaactccatataaagtgataatatgaaaatgactaattttaattcagaaatctgtcttaagtgttttaacattgcctttgatattctgtttttaatttattaaggcttcattgagcgattcatttagaaaattatttttaaatagaacaatgaaaagatgaactccaatgagagcattagcactaataccaatttgatggagtctaaattaatgaggttgcattgttgccagacaaatacaagcctttcaaactcagcaccccctgaaagtagaccctgggacaagtctgcaagtgcaaatcctttatttgggaggtgaccccagagtggggacgtgaaacaggggagggaagagaggcaatgaagcctgggacagtgccacagacagctggtgctcaccctagcaggggctccagagagggcatggagcccgggcattgtccctggtggaagggaggaagccagggtatttacccaccaactcttgcccttgttgactgagatcactcctgggggcatcacctccctggccctctgcgcctgccagtgatcatttcatggcagagccagagagtgccctccctcagggagagagatgcaggaagccaacagccccaaagggaatgccccaaggtgatttcctggtagggagaggacctggttggggtactgagccaggcttgggaacactggagcagctacacatacttaggtaccatcatcccttctagttattttctagaacccccataccacagagttattctcccctagaacttgaaagggccccagcttccctgaatggctctggccacccaaggtgcagtgaggtgcatggtctcatgatgacagtgttttctgctatattataattaatgaaaaccatgcattccagtgatctatacttctttactagaatgccattttggaaacaaatatgaaaaatccaagagaccaaaagaacaggctcacgcttcaaaccaaaacaggaaaagctgcttattatctaatatacgtaatataatgaactattcaaataatgtcaattgtactagaaaaaaatatcctttaggcctggtgtggtggctcacacctataatcccagcactttgggaggccgaggtgggcagatcacgaggtcaggagtttgagaccagcctgaccaacatggtggaaccccatctctactaaaaattagccaggtgtggtggcgtgtgcctgtaatcccagctactcaggaggctgaggcagaattgcttgaacttgggaggcagaggttacagtgagccgagatcacgccactgcactccagcctgggcgagagagcaagactccgtctcaaaaaaaaaaaaaacaaaaaatatcctttagctcaaccactggctgcctacctactaagaattaccagtttgccccttttggcacttcagggaaatcaaaaaggagaaagaaatgctggtgatatggtttggctgtgtccctacccaaatctcatcttgaattttacacgttgtggaagggacccagtgggaggtaattgaatcatgggggtaggtctttcccgtgctgttctcatgatagtgaataattctcacgagatctgatggttttaaaaacccatcgttttaaaaaagtctccctgcacaatctctcgtctcctgtctgccaccacatgagacatgcctttcaccttccgccatgattgtgagatgtctccagccacgtggaactgtaagttcattcaacctttttttaattcccgggtatgtctttatcagcagcgtgaacatggactaatacagctggccttccctgctcaggtgagaaggagagaaggaggggcccgagtggggcagggaggggaagtagcccaatagcactgcctgggctcacgtgaggaccagtgccagtccctttccatcttcacacaggctgcgggcagggggtgctgcctgagttgggaagtaaggcaagttttactgagaaaggggcctgtgtacagcagctattttcaggcgctcagaggtatttttgttttgtgcattcacagacattttcacaaatggcctacaggaatattgtgcttacctgaacacgtgggtttcctgctttacggacagctttcagtttggtctgtgctgtggtgaacatccccatgagtccctgggcttccagggcccccttcctgtcagcgtcatgcagtcagcaagctccccttcttcccccatgctgggcctgagacccccagctcctcccggggctctcccctcttccccacttggtgcccttttggaaattagaccaaaaatacactttgtaggcccccatcaggatcagatggctttagatcctgttctccccacttgcaaccttttcatttaggactttcatctaagactggttgtgaagacgggaattcagcgcgccatgcaggggactcactaggccccaggtgggaaccccatcccctcctcaggcgtttttgcttcatgcttatatccgtgtcatcatcgggcctcttatgctggcattttgtttgtgtgttctctctcgcttaacaaactcactcctaacagtttaaagaagtggcctctcaatttctagagaatcaaaacagcagtaaatctccttcttctgaaaacgtattccaaaacgctatttggttattctcgtcttttctgtggtaagaatgcaaataggactctacttcattcagagagcaaaagactcacggaagttaaataatttatggaaatatttagaaaagaaaaagaaaggtacagatatgagctttctgccaagttttttctttttctttttttctttttttaattataggcctttattggctccagacagggaggttctgataagcccaggaaggaaagctaatgaaaatctcttccttagggtacctaccagttttctcattagaaagcatatctcaaatatcaaagattcattttcacttgtttttatgaaggacttggaaccttggtgaaaggttattttacacgttcaaatcttactttagaataattaatttagtcattcaacaaatatttgaatgcacaccatatgataggcacatgctggatcctgctgatggaaacctaaacaagtcagacgatgccacccttgtggggctcagaatgtacccatttaattgcaatgtgaagtgtttcatattcttaaccacctagaggctcatctgtaaatgaggtcctatactttttctaatctactgaaacgtggccatccatcgacctccaggaatataaaacagaggcagggaaatcaagccaatccatttatacaagttttaagtgcatacaaaaaaaaaaaaaaggaaatttaggctatcatctaaaatgaccttgatgggtccaataccaagaaaaataggatagcacatagtaggtgttcatttttttaactttttctttgcaaataatttcaaacttacagaagagtctcgagaaaaacaattgctcaaaaaacacccccacacccattacccagatttcttacgattcacattgtatcccatttgctttctcacttgctattactgtgtatataatttttctgaaccatttgagaatatgttgcacacgtcatggccctttccccctaaactgcatttcctcagagcagagacagtcttgcatgacgataaaacaatcttgttttgtaattcttccaattttgtaattgttccactgaagttctttatagaattttggcctccagggcaggatactaccctggatctggtcctgcatccattttcgtgtctccttagtcatctttcatctgagacatttgcacagcctttatcttttatgacattgcatttctgaagaacagcctcctcctcccattttaaatagaattgctttcatgtggagtttgtctgatgcatttctggccagtgaatgacataagtggtgctgcatctttctagggcatcctacctggagatgttcgccatccattgtccctccttggtgatgcttattcatagcacaagtcaaggcatttctcctctgcatacgtactatgagtttccttgcaatgagaaaccagtctatggagagacactaggagaccacatacatatcatgatcctcataaaaatttccccttagacttagtatccacccaagattcctgcctgaaccagccttcatggtgatgatgaaaatgatgatggaaatgattttccatctcccacaccactccatgtttaccatcagcacttgccattcctaggcacaagagccctcctctctccccgctttatttttccttttattatcgttgtgtacctgaggattcctatttttccagtggcttctcaggcattcctggacttcattgtttgagtgctcaaattgtgcccgactcggtcaatgggagaccttcaagttgtccccctgcccaccagcatatccttctgataggccccagctttttatatcactccttatgttgtggcataagggactccatattgaccctatctctaccctgtcctagccataaaatcagccattctctgatggacccctggctcctgttagtggggaatagcactacagaccaaggtgcgggcactgggtgtgctcatagttgctgaggggcgtttgcttctgggccctttcaggggacatcgtgctcaacaattgttggaatgcatgagcaaaggcatgcattttattgagatgtccttaccaagagctcattttgtctgaaccagcactacgaaacaagagtatgttctctcttgggaacagagtcctagaggttgggagaacagtagaaagttgaccagaatctgcgatacaggctgggggttccctgcacaggcgctgaagcgcatggcctccgtggaggaaaccaatgagaagggctccactcgggacagaggctccaagaactgttccctagctctgcccacttggctttcatctttgtcgtggttttggacagaaagccaccaggttgctttaactagaaaacagagcagtgcactttctgggacactagtggaatcaggggatccacaagaatcctccatttgctgttgtgacaattacaagaattcagtgacactccaggatgccccatgccccacgtgtattcccaggcacgaatctagatctgcactggcaccaaagagcacacagtctgtttgtccttttttaaaaaacattttattgtgaacaatttacatcatggaagaacacggaagaacgtgtagcctcacctgccattcttatttcatctaccacccctatccccacccatgctttcgtcaagaaaacgttaaggaaaattgtaaacacacatccatttgcatctaacattaaggacaatactgtccttatagcccacaaaatgtaaagtaatagtctaattatctaatataattatctaattatagtactgttaactttaaaagaaaacctataatacatatatttagaaaaggagaaattttattttattttttattaaagggtttcagcctgcaaggtggccattcttctggctgggaagatgcctccagccaagaccagagacaggcacttccaggagggtttgggataggagctttatgtttaaggttaactagacatacatattcagcaggatataggaagagctatgaatactcatgaaggcggtcctgacacgtgcatatgtaacatgtatcaacatatgacccgtgttcactttgggctggagattaacgttcacatttattgcaattaggccgtatgtgtgaaaagggctgttcaggaccaaaggttctcaggtgtgcagcctctgtaaacttatcaggagaaagttattgaaatcagtctcttgtccaatcagagctgtagctgtgactggtggaacaggggtcaattagtcagcatctggtgcaattgatttaacagtgcttatctcaaggccagtgcttgtttggctgctagagaaagagaaaaccttgtggcagtgagaacatagcttattctttcagcataaggagcgcgacttaacccttgcctggcagggccctaggtcctgtttctaatttgttatcttactgcgtgctgtcctatcagtctttctgatctccattttagcattaatgctgattggctgttgtgtctaaactgcaaagaaaggggttataaccaagcatgtctgccttgtcctgtagtcatggctgggcatgttttaaagttttttctggggtccccttggccaagagggggtccattcatataggtgagttaggatgttatttttagtttgtagtgtccagcccatgcttcacattcttcaattatctcataaaatgtctttttacactttgtttaaattgggatctaaacaaacaagacgtatacataacactggatggatacacagcttgagtatttcaacccataatagtttcccttttatgtagagccatttatttgttgaagagactgtgggggaccttatcaaatttcccacagccttgacatggctggttgtcaagtagctcctcatatataagggatgtttaggtcaggaaaaattgtccagaggcgaacccgaataaatgaatggtgaacctggtgggtgatgcggcgacaagaagcatggtgataaaaatccatgggaatgggaagaaaggaaggggagaggcagactgcatttctgaccaaggaaaagcctctaggaaccatgacaccagggtctgctgaaagaaagctggtagctgatggccaggcaccagtgagctggcgcacattgattacaagaaaatcaaagtcctaaaaaaaaaaaagagagaaaaagaaaatcgaagtccttcctgtaaaggttgtggaaggaggtcaggctttctacaggcttccatggtggaccttggccagcattcagtctggtcatcgttctctccaacgtggctcatgttaccaggaagtatctgtgttggaattattcttaccatggaaagaaaactcctcagcttacctttacagcctttcaaacaaataaaacccatcttaaaaccacttgtctttttgtgttcatttttatttaatttacacctttaccttaatcttgttttcagtatctggatatggtatgaggccaagatccacgagaacaggcacaatgtggctaaagacccagtgaccatgcaggacgataaggacaattctgaccctcccagaccgggcgtcccaaagaggacacacccatctcttttctggattcatgtcctagggctgccattagaaaacaccacaaatggggtggcttgaaaccatagacatgggttctctcatagttcaacggcccgaagtctgaaatccaggtgtcgtggggccgcgctccctctgaggcctgtaggggagaatccttcttgcctcccggcttctggcatttgcagtcaatccttggcattccttagcttgcaggtcactccaatttctgccttgtcatttggaatgctctgtatgtctctgtcttcttataagggcaccagtcatattggatgaggggcccaccctaccctagtataacctcaacttatgaatttcaccagcggcgaccctagttccaagtaaggtcacattgccaggtactaggggttaggacttcaatgtagacataattccacccatatcatccccctttcataagcgagcttaatatgacttaagcatgcagctgtagctccaaataaaatgtagaccatcaaactccctctccccttacagtaatgtatctgccttgtccagactcacatatgcaattctacaggctaccaatgttttgaggtattgtacgatgccaccctcgtggaaagcagcatgtcaacgttaagccatccacctgcacagtgtgaacatctgagctcccttcctgtatgccagggttaaaaggctctaagagaagtggtcaaggagagagtatagagctgcttggtgctggaggggaaaaaaatgaactcagaaagcaaagccaggctccctgaaacctgcacctttgagaagaaaggaggccaggcatgcaggcccgttccagtagtcccagctactaggaggctgtggtgggaggaccaattgagctcaggagtcctgggctgtagtgcactatgcagctggggcatctgcactatattcagcatcaacatggtgacctcccaggagcaggggaccaccaggttgcctaaggaggggtgaattggcgcaggtcagaaacagagcaggtcaaaactcccatgctgatctgtagtgggattgcatctgtgaatagccaatgcactccagcctgggcaagataatgagatcctgtctccaaaagaaaaaagaagtagcagcagcagcagcagcagaaaggtgacaagagtgaagaggtaagaattagagatacctgggccaacatgctaacatgtcctgctgagtaaccttcaccgagttacttaactcttcggaggttccatttcctcatctgtaacaatgaggcaaccacaggagcctggcagggctgctgtcaggattaagtgacgtgatgaatgaatgatgcttacttagcacgtagtgctctggaaatggcagggcttgttacccaccttgggtccatcccagacaggcacacagggatggttggaacccgatccacaggggatgcattccctgggtgaatgtctactcccctacttcctgccaggctttttggggtgcactgaggtggtgagtgcacactagagacaagcttagcagagatgctgttcctgttcatgggcagagcagatgaacaggagagcagcctcattcagcccagctgcaggtgggtcacaggtagcacagagaagcaatcatcatgtggtttgtgtgaactgaagaccagcatatgagagccttggtggacctaatcgcctccatcctgtggatgtaaactctgcctccgtcacgggcccatggagccaactgtggatgtaaactctgctctgctggatagctatgggagcaacgaccagaggacatacgtgtggcattcacagccagggtgagatcatcagccagtgtgtgtgtaagatgtctgtgaaaggtgaagtgcctcatcacctgaaataagaaagtctggaagactctactaatacttcctgtgtatgaggacatagagacaaggtggttggccatgagtgcaacataaaggatgttagaaaggggagacctttctgaatatattggggcacaaaagcatattaacccatacagcaattgccctaaatgcatgcaaaaatgagcaagctggatgcggtggctcacgcctgtaatcccagcattttgagaggctgaggcaggcggatcacctgagttcaggagttcgagacgagcctggccaacacggtgaaaccctgcctctactaaaaatacaaaaattagctgcgtgtgctgccgggcacctgtaatcccagccactcaggaggctgaggcaggagaatcacttgaacccaggaggcggaggttgcactgagccaagatcatgccactgcactccaacctgggagacaagagtgacagactccactgcaaaaaaaaaaaaaaaaaagagcatgcatgcaaatgtttcacagtctatttccccacccaaaatattggactcactctgaactagagtttgtgacaaagtgttaccaaccattgtatcaaaggtctaaattacagtgcaagaatcaagagcaaataaataaccaggacacagataagaaataacaagaaaacagtcatggccagatgccttccgccagccatgcctgactcactccaacacacacttagacacatgcgacttccctagctaggttttgctcagcggcttaatgggtttcaccttgcattcagcacctgtgacttataggcttctcatagattctagtggaatagtctcctccaaatgttgtacatttttaaaaagttaggggctggctgggcgcagtggctcacgcctataatcccagcactttgggaggccgaggcaggtggatcacctgaggtcaggagttagagaccagcttgaccaacatggtgaaaccccatctctactaaaaatacaaaaaattagctgagcatggtggcgcatgcctgtaatcccagctactcgggaggctgaggcaggagaatcacttgagcccgggaggtggaggttgcagtgagctgagactgtgctgtcacactccagcctgggcaacaagagcaaaattccatctcaaaaaaaaaaaaaagaaaaaaaagaaaaacctaggggttactacattccagccaggcaacagaatgaaaccctgtctcaaaaaaagactaatataataccatcttaatcagaaataaggttcatagatgatatagattatcaaaagaattgtcagaacgactaaacctaatataaggagaaaataaagtgaaagcaatttataattaactaacactatttgtttcaatctgtaaatgcttgggtagaattacgccagaagacaaaaggttgccacacatttccaaatcagccctgtttttggaagacagtgtcaccctcactgggctggctctgtgacaggcccactgactgcacctgagagattacccgaccaggacggcacatcttggaggcacgaagtctccagcagctaattcgccaagccaaagagaccagctccgccagcacctatgctggacaatgccaagcctactggccggtcagaaggaaggaggggaaaagccacctcactgaggaagtacgggaggcagagcacggtagagaaatagggagacccagtgcctggagacggctctgctcctgccggcttccagcttcaaccccatgcactgtccgcttctctgctttttctttaagatgtactgagtccagttctgtgccttaaaatcaacatggtcaaaattttggagtgaggttgggcacaatgactcacacttgtaatcccagcaatttggaaggccaaatcgggaggatcccttgagcccaggagtttaagaccagcctgggaaatgtagtgagatcccggctctttaaaaacgtaaaaataggccgggtgcagtggctcacacctgtaatcctagcactttgggaggctaaggcaggaggatcacaaggtcaggagttcaagaccagcctgaccaacatggtgaaaccctgtccctactaaaaatacaaaaattagccaggcatggtggcgcacgcctataatcccagctactcaggaggctgagggaggagaatcgcttgaactcgggaggcataggttgcagtgagctgagattgcgccactgcactccagcctgggtgacaaagtgagactccaactcaaaaaaaaaaaaaaaaaaaacccataaatataaaaatattggagtgaaaaggaatttttgaagagtttctctttaaactgttagaaagctcaccccatcactgtcttgggggaagtgagcactagttgtggagagttgtaattttctttttctttttttagagacagggtcttgctctattgcccaggctggagtacagtggtgcaatcatggctcactgcagccttgaactcctggactcgagcaattctcccacctcagcctcctttctgggactacagtcatgcaccaccacatagggctaatttttaactcttttgtagagatggggtcttgctctgttgcccaggctagtctcgaactcctggactcaagtgatcctcccaccttggcctcccaaaacgctgggattacaggtgtgagccaccacaaccatcccagagctgtcatttttaattctttgcctgtcacaaactcaatacaggtaaacgtatgtaacattccatccattgcaaatgtcccttcccccagttaaagactgaaagtctgaattcaagtgacaactagtgaccccagggataggagctacttaatcccaacctacatgcccacctgcacagagagagtgcctcccacaggcctggcttgctttttgcctgttagacacatggtacatttctggcaatgctctgctcccagctaactgctgagtcacctgcatgggactgccaagtaggtacggggttttcaatttagaaatggcagagccaggtgaagccacctctggcccgaaccatggtgcaaggtttaacaatgtggaggaatggggtcctgttctgggcatcattctgccaagttctagcgctcttcaacctgtggaacaggcacccactcttgcaatgctgctgaggttgcctttcactcgcttcacctttatacctggtccctctctgttttcctgggtttttgtttgtttgtttgtttttgtttcttgtgaggacaacactgtagggccagacagaactcaaggagctggtgggctccagagtgccctgcccttgagcagctccatcctgcatcctccagggcaaccaggatgtgggtgccactcgggccgcaccctctgaccctctgcagcgagcagatccaaactgtcgtcaagatgcaactttgccagaacagaagccacagtctggatttgggcatgtttccttctcactgttttgcttcccccactatgagtggtagaacccatttctggtacagcacctttctgctttaaacaattaattaatttaaaaatgggcccaggacacattgcccctgaatatctggtccaacattaggtttacttattgttatggcttgaactgtgcccaaccaattcatatgttgaagtcttaacccttagtatctcagaaggtgacctgatttagaaatagggtcctcagccaggcacaggtgcttatgcctataatcccagcactttgggaggctgaggtggaaggatcacataagccctggagttcaagaccagcctgggcaacatcatgagacccaatttctacaaaaaatacaaaaattagccaggtgttagctaggtgtgatggtgcatgattgtaatcccaactacttgggaggccaaagcaggaggatcacttgatgttgggaggtcaaggctgcagtgagctgttatcatgccactgcactccagcctgggcgacagaccgagaccctgtcaaaaaaaaaaaaaaaaaagaaagcaagaaagaaggaaaaagaaaaaagaaatagggtccttgcagatgttattagttaagatgaggtcatactggagtaggacaggccctaattcaatatggctggtgtccctattaaaaaaaggggtgaccaggcgtggtggctcatgcctgtaatcccaacattttgggaggccgaggctggcagatcatttgaggtaaggagttccagaccagcctggccaacatggtgaaaccctgtatctactaaaaatacaaaaattagctgggcatggtggtgtgtgcctgtaatcccagctacttgggaggctgaggcagaaaaactgcctgagcccgggaggcagaggttgcagtgagctgagatggcgccactgaactctggcctgggcggcaagagtgaaactctatctcaaaataaataaataaataaaaattaaaaaggggcatttggacacaggaacaccctgtgtagacgaaggcagagatcagggtgctgctacaagctacagaacaccacagatcaccagcaacccccagacgctgggagtgaggcctgggacgctactcccttactgccctcaggaggaaacaaccccgactgtaccttgatcccagccagctctctccagaattgtgagaaaataaatctctgttgtttaagccacccagtttgtgctaccttattacggcagtcctaacaaactaatacattcatttgaatagagcttttaatttaaacattgaccatgtaataaactgtaacaaactattagtatttaatacataaaattcataatgggggtcctttctcgtcacaatgcttatagtttgtatttaagaggaagaggaaagtattgtctatcagaaacgccaccgcatgactgctcatcacaacctgatttttttctagtcatttccctggcaccccaaatatgcccattcagtgggttttaaacagatataatggaaaggccacccagctgcacttctgctgtaagaaataacccctcgattctggcccaatataaacagtagactacaataattgccatttaactccatggtgtccaaatcaatgaatatgatatcagaagatttcttctcttgtcctctgctcctggactttccagagaaggttgacgatgacatgggtctgtctcacatcagttccccaaatatcttactgaatccatttggcatatagcctttgtcgtttattagctattttagtattgtatgttttattttactgatgactggtggttgttaaagcattagttctaggttgccattccagctcgcatgattttgaggaatggtttccagaagggctttctagcacatttcccccacagaaaaagcttagtcgattctttcctgatagcaacagatgaaagctttatgtcataggaaatcatagtgatattctggtggcaacatgtacaaaattattatataaatcttgcttattatataatcctttggctatacttaaggacagctcttgaggcaggcacactgggagccacgtggcattaaacagatcatctttctttcacacccacgcaagaatcaaaagcaatgctaaacaaagtgttcatccagcccttaatctccaaggggaagaggttacaataaaaataatttcttcacctgagtatcaaacagtcacaattctggggaacccaatttccacttcagaaaggcaaatgctaaggaattctcaccatctgactctcacggtaaaatcccgtgcaattctttatgtttcacacttgagaaaaagaaagggcatcaactttaacagctccttgaacttcggcccttgcaaggaaagtgattgcataacagggtacatatcaacaagtgaggctgttctttatatgttttggctcaggaaagagcatgtgaacttttttctggggtcagcatttggaacagacataccagtgggaggaacagagggtgataatgtttaaccaataaactgagctgaactcaatctcctgccttgacaggggaactatgcaaggtcctttgctttgaaaggcttgggctctgagcattcgtcagcaatgggttgagtcatatcattgtgttgaagttattattcgatgattgggaaaatgagaaatgcttggaggcctccactgacttttgacagactgagaaaagccagagtttcttctttgaaggcttatgaagcaagtccttcttctgcctgggggttagtgcctgttccagcaagggctggcgaggggtacagggaggtaaagacacaagcataggggaagtcatctgactggggaagtcacactggctatgcagtgacacgtcggagactctcagtcaatatgaatgaataaatagatacattacacacaggaagagtttgtatgcaaactctggtatgactcctccaaaaaaaagcaaaagcctattacctgatgagacatgatgtgttaatactacttaattatgacttcaaggccgggcgcagtggttcatgcctgtaagccaagggaggccaaggcagatggatcacttgaggtcaggagttctagaccagcctggccaacatggtgaaaccctgtctcgactaaaaatacaaaactgagctcagtgtcgtggcacagctacgtaatcccagctactcaggaggctgaggtaggagaatctcttggactggggaggcagaggttgcagtgagctgagattgtgccaatgcactccagtctgagcgacagagtgagactccatctcaaaaaaaaaaaaaaaaaaaaaaaaagatatggcttcaagttcaggctgtagttgctttacagaaaaagaaacctgttgaacaacatgagcagaaaaatcaactgtttacatcttgtgcattctaacctagaaaacctcccttcagcctatgaaattggcactggtctgacttacctcaccatgtccaaatccttgctggcggtttccaaatactggcttgaggtttttaaaaaattcaaatatctctttgcaacttgaagtcccttcaatctattctctaacaaatgtatgggaaggcatcaattttaggccatgccgatgtttgaggtgagagaatgtccaccttggatgcagctgacagctgaggctgctgtcataccccacatgaagtggggctctgagggctaacccacttccatttgctgaactcagctggattttgctcagaattatagtttattcaggctggggcagaatccccagggactgtcaggaccagttctgttggaaacctgaggccagttggtctgacccctcgggcagggccataggagccagcagtggtctcggcagcagcaaacttttacatctctgtgcatcacctgagctttgcagcaggaggagtgaggggcggcagcagctgcgcagagacaggttctggagcaaccagttcccgggacatagggatacacacactccttcctcagggac

SEQ ID NO: 503 - DNA, 20001 bp, Homo sapiens
agttgcaaaaaaaggtaaaggaaaatctcctgcagtgtgattgtctcttctgaagggaaggccatttaaataacctggaaaatttgaatactcttttcaaacctgatgaaagctgtattcaaatttaatcagacaggtttatgagtgtacactatattatggaggaatataaacaagaaaactagtaccttgagaagcagaatacatgattcttagtaacagcatgggaagtttcctggttacatgaacaattcagacatattgagaaaagccaagagggcagggtcatgtcatactgcaggaaaacattgcttttccagaccttccacataaacatatcggtgtcaggccataacagcagagctggaactagaggggaaaaaatgttatagagttgacaagcagagagttatcaccccagccaagcaaaaacacattccttttcaaggagagaaagaacaaaaggcaatgaggactgacctgcagatcatgtgcagtaagctacagaaaggtgagcttctgagatataaatctgagaagtttggggaaaaaaatttacctcaagaaataaaattggtattctgaataaaaaggatgacaattttcatcctgaaatagagaaattaattagatcacaggaagaaataaaaactttcagtagtttagaagatggctgttagaaaaatgtcaaaatgaaaaatcaaaatgcctgtggttttagtaagagctaatcagtactttaagaaaacctgttgttgaggccgggcgcggtggctcacgcttgtaatcccagcactttgggaggccgaggcgggcggatcacgaggtcaggagatcgagaccatcctggctaacacggtgaaaccccgtctctactaaaaatacaaaaaaaaattagccgggcgtgatggtgggcgcctgtagtcccagctactcgggaggctgaggcaggagaatggcgtgaaccctggaggcggagcttgcagtgagccgagattgcgccactgcactcccgcctgggccacagagcgagactccgtctcaaaaaaaaaaaaaaaaaaaaaaagaaaaagaaaacctgttgttgtcacataggggaccaaattttttggctttgtattagtgtctttttttttttttttgagatggagtctcgctctgtcacccaggctggagtgcggtggcacgatctcggctcactgcaagctccgcctcctgggttcacgccattctcctgcctcagcctcccgagtagctggaattcaggcctatgccaccaagcctgactaattttttgtatttttagtagagacagggtttcaccgtgttagccaggatggtcttgatctcatgacctcatgatctgcctgccttggcctcccaaagtgctgggattacaggcgtgagccacggtgcccggccgtattagtgtctttttaatatcaaagctcaatctttagaaagacttataagttacaatcatagccaagtaaatcacgtacaaaattcctttagtaaattctctttttgtgaactttatcacaacttaatgagactattaatgacaggcttggactttctaagttttcctattattcttcttttcaaaataagcagtcattttaccgcaggacagaatttaccacaggagattctttctcaaacaaaagtatttcttttctttttaaccttccttgtcagaaatacatcttcatatctataacttttctcacatctccttctcctacttactggttcctttttgttttgtttgatattttgaaacaacctctaaataacctccaaattcaacaaaattattttttcttaatcaagaacatatttatgcctttctcattaaaacacacatcttattcttttggcacattttatgtataaacacatataactcttagtaaccctaaattttagtgaaaacttagaaggaagaagtcttgaattgtctgtcatatatcagtattttatagatgacaaccattttatgacgtttagaaacatgtttccctataacatttttatgtatattagtaaacccaagtatgtttaatctttctataaaatttaagaagccaagaacaaaattatgtatatgttcagcaatttgttttcattgtttttaaatcttatttagaaataacctagacatttaaaatttaccaattaatttaacataatataactttaagatttcaaatggcatataagattagtttataaacacttatcccatttacatttacttaattaatttatttttgaacagtttacctagattacttatgagaactggaatacaagacaatgttggtcatgatttcaagttatttccctgatactcatttcttatttttttttttaaattttttgagatggagtttcatactgaagcccaggctggagtgcactgttgccattttggctcactgcagcctccaactcctgggttcaagcagttctgctgactcagcctcctgagtagctgggactacaggcactcaccaccacacctggctaattttttgtatttttaatggagacagggtttcaccatgtaaccaagaccaccaggctggtcttgaactcctgacctcaggtgatgcgcctgcctcggcctcccaaagtgctgggattacaggtgtgagtcaccacacccagccctgatattcatttcaatagcctgtgaatatcagatgttcacttaggtaagaatcttaaatacacaggcattttgccaataatgcagaagatacagaagtttttattaaaccaacaatattaaattagtcttatcaaaaaatttacacaaagattattttgttttaggctggttttatatttttataacctttacatcaaattctgacactttaaaatatttagaatagacaaatataagactgtctgactagtaaacctgagcaaaaatgtatgctgacaaatctgaagacatttctatttttattttaccaataattttaaaaccagtttgtctgttaaagttttacttaagtcacatgaactaaaaagcatttgtgctaattactatatattttatatgaatgttcatttatctttaaggcatttctggccaactacccagattttactatgtggacatagcatataacataatacatgtatatatgtgtaaagaacatctaaatgcatacacacaaataaagatcttatatctttcacttaataatttagtcatgaaatagtaatacaaactcaccagtttataaaagagttgaattcaaataatatttgtgacaaaattggaagctattcatatagctagactttagttgctctgataggtaatctaatgaaagctgtacccttctgggtaaaggagtttccatggcagtttgatttttaaaaacttttcacccctttttttcttttagtttcaaataagttaggggttaaatgttcaatgtttgcattttagctaggactggctgaattgtgtaagaaaaacaaaatctccaagtagtgttgaactagtaacaaatctatcttttgtttgctggcctggtttgcttgattagcaaatgtgtgttgggaagacttccagcagtttgtttttctttttttttttcttttatccagcctttctttttggactctgcatgacagcaaaagcaaaaactgagaaaatcaatgaaagaaagaaatcctagatggcaccaggatgtaaaatgggaggactctgaagaaagatggtgtaatgtgtgaggagcagcactgtggggaggaagcctttccctggtcatgaactgcctggatcgctacctgtccagcatctccacccaatggcacagttgcagctcctgggtgcagtccacatcctgctggcctccaagctgggtgagaccttactcctgaccatcaaataaccatgcatctgcaccaaccacgctgtctctcctcgccagttgtggctgtgattgctctgatttcctgaccctgattctgcaccagctctctctgccctgtgaccaacagatcttggttgaaaagcactccttgacttttttgtccctgtgtgctagagcttgcacttttgctgtgtacctgtcaggcatgattgcatcaggcaccactaaggccatgtgcaaggccggggtgactgctccacaccaaggatgagctcacagagctgctggcaggggtcacatgggtcactgaagtgggctgcctgcaggccgctgcacccagactgggaaacaaaaagtattttatcatcccaggagtgatgtatggtcctttattaagacagccttatccaaacagatcccaaacaatatcaaaaaacctctaccagctgggtgcagtggctcacacctgtaatcccagcacctcgggaggctgaggcgggcagattacctgaggtcaggagttcgagaccagcccagccaatatggcgagaaccatctctacttaaaatacaaaaattagtcaggcgtggtggcaggtgcctgtaatcccagctacttaggaggctgaggcagaaggatctcttgaatccgggaggtggaggttgcagtgggccaagatggtgccactgcaatccagcctgggcgacagagagaggctccatttaaaaaaaaaaaaaaagcctctaccaaaggagggggagactcagtctaagagaagacccccgccacggcagaaacatggagctgtggacacagagagctccaacagctcacatgagaacagcgcaccgggtccaagaatcaccgatcttttttccaacaacgattttctgcaggtcctgatatcatatatgtcaacctgaacaacaaacagagagagtctctctaaaatgaatgatacttatttgggaacagagcattgcaatgggaatatgtgtgccatcgtaaacgatgtgtgaattcagggaggtaaaggaagacaacggttttcaaaaaggaaaaatgaggattgcataattgttttgaaataattatgcttggctcctaagacaatgccaagggtgaggccagtgcaagtttggacaggcagttgctgggcagatgtccttgcagagccgattctgtgtaaggttgcaagggcctttgtgcaaggttgtgggttttgcagtcttttgtgatagtttctgttctcaggcacataagcatgaggaccctcctttccccaactctgtttatcagggttttcttaacattagggattccattttgattctggcaactttcacatgcccatcccccttatcaaaaagcaaaacacgtaagtatttctgtaccacctcctcacataccagtgaggttgaaagtgtgtcgtttctatttttcttccagactaatctttgtgttaattttaacctgattctctgcatagacaaataataattattaacatttatggtgtctatgtacacaaagattgttttggttgactctcatcatgatcaatcaaattgatcttattatttctactttccaggtgatgaaacttggaggtttattgactttttcatgaaggagaaaagaggcatgaaagaacatagccagcttttctgaccctgtaccattaccattccaacagactgtcattgtagtactgggggagtgcagctgaggaaggactccgtcatcatcccattcccatgaaaggccttcaaactcgtaacaaccaactttggaagcttcaaaattggtagtcatgttcagagccagacctctcacaattcttttaggaatccaattcttcttcttcttttttttttttttttgaggtggagtcttgctttattgcccaggctgtagtgcagtggcgcaatctctgcttgctgcaagctccacctcctgggttcatgccattctcctgcctcagcctccctagtagctgggactataggtgcccgccaccatgcctggctaatgttttgtattttttttttttttagtagagacggggtttcactgtgttaaccaggatggtcttgatctcctgacctcatgatccgcctgcctcggcctcccaaagtgctgggattacaggcgtgagccaccacgcccagccaggaatccaattcttaaaaccattctccttgcctcggtacctgtttatttattttagagagagggtcttgctctgttgcccaggctggagtgcagtggcatcatcatagctcactgcagcctcaacctcctgggctcaagtgatccacttgcttcagcctcctgagtaactgggactacaagtgccccgccatgcctggctaatttaagacaatttttttttttttgtagagatggggtctcactatgctgcccaggctgatcttgaactcttggtctcaagtgatcctcccgccttggcctcccaaaggactgggattaaagacaacagccaccatgcccagccctttttgccaataaataatttttttaaataagaagaaaagtcttttaaagatgtcacacatttaccatttctgatgtccttggggcacctgtgggtggagccctccataggcaccatagccaagggcttgtgcacggtgataggtgcgtgtcaccttctgcaggaccacacctgtagggccgtgctccaagagcagttattcacaatttagagtgtcacacgtattacttcttcatttgaaaatattatggacataaaaacactagaaaagtttgctaacctagtttatttcaagatatcatgtattttgttgtaaatgttaaaaattctttaaacggacatgcatcttcttatttggagaagggtttcatgtgaagcttcacatgaaaactaatctgtaaagacatgcagaataccacgtgctagagtgtgcagctgaatgagctcaagctcaacatgggagatcaacgccggcctcaccatcacgccaaagaacctgcctgaaaacttcttttgcagccaattagttattactcacacaatagccttcagaaaccagatctgttctctttagtaggtttaaagttcagcttcccaggccagatctgcgtggtttgcttccagctttgtctaatcacctacttcccgtctggcgccttcaattgtcccttcagcttgactgataatatcactatgtcacaatatcaaggaccgtggtaacttaaaagagctgaacttaatttataaacttctcatgatgatcctgtgatgtaacagacatgaggggttggaccaaaattaacatttagagaggagaggatgttccaatagaatcataagcaattatgtaatcttttgaataaatcaggtatttttctccaggttggttgttacatgaccataaaggacagcatcagaaataataaaataattatattttccttttctaattaaaatgaggatggaaaaaatttcagaaggtaacatttgcttggcaggaggtttgcaagcagctagttctatctccagggggctgtgtggtaacccaatgacattgactggaaatgtctcctgtgagctgcagatcctgaaggtggtaccttctgagcaatgtccctagatatcttgttgttgttgttgttgttgagacggagtctcgctctgttgcccagactgaagtgcagtggcgctatcactgcacactgcaacctccacttcccgggttcaagcgattctcctgtctcagcctcctgaatagctgggattacaggcgcccaccaccacgctcagctaatttttgtatttttactagagacagggtttcaccatgttggccaggctggtctcaaactcctgacctcaagtgatccaccctcttcagcctcccgaagtgctaggattataggtgtgagccacctcgcccagctgacatctttttaaaaatgcagttgtgctcggaagggcaaatgagaaataacatcaccatcaacatgacggatattttggcatgacttcattaacaaatggatttctgacctgtcagtttcctaggaaccgggctgggaggttggactcctaagtttgtcaggtatcaaacacttgggattaatactaaaaagaaataagccgtcaagtcatgaaaatacacggaggaagcttcaacatatattcctaaggaaagaatcccggaaagcctgcatcctgcggggtccagctgtatgacactctggaaaggtgatgccatggggacagcaagatcagtggtcaccaggggtgggagagagggaggaacatataagagggacactgaagctgtttagggcagtgaaaatactccgtgtgttactgtaatggtgggtatatttcattatacatttgtccaaacttacacctgtacaacttatacaacaccaagagtaggccctgatgtaaactatgcactgtgggtgacagtggtgcgtcaacgtaggttcatcagctgtaacaaatgcaccctctggtggggggacattgatcatgggggagagcactgcacatgtggggacaggggttctaggcgaactctgtattttctgctcaattttgctgtgaacctgaaactgctcttaaaaacatttatttaaaaatggcaatacgtggtagcatcttatattatgagattaaagcatttgataatccttctgcagcaaagtaaattgatcatatgcaattccaataccgtgcttaaacatgatgatgcgttgaatttatggttcatttccgaatctaagaaatttattgacaaatccggttgctactgccgcagcagaataaagtatttccaaattgaaattaacaataaaagccatctaagggctataatgactcaaaacagatgatctaatttggcatttctggcaatagagcacacttataatccaaacagcacaattagcaattttgctgagatgaagacaagaaaaaataaatttacaataacttatttaaatgaaatttaaaaaattccaggaactccagttccaagggaaggggagatggaactagggccttccaacagccaggaaggactccttaggggcctgaggtgggaaggacctttgctcctgcagcacgggcaggctgcccctggaatcacacgggtcgagacccagggacccagcagtgtccagctctcctccttgcctcgtaggtgaggaaggggcacccaggagggagggtgacgacgcagctgtggcacggctcactcgctgcctctgtgtcttgctcacatgcttgcttgcagtattgattttttttctgattaaaattagatgcttctcatttcagaactctaggaactatagaaaagcctaaagagtaaataaaaacaacaagaaagatggttacagacatgagcatagtaaagtgacattttcagagctgcgagatggggcctggagggtccggctcctgttttgtcttcagatgacccttgtgtctccagagacgtcagctgacctcgctctctaaccgccttctcctcccactctgcgactggctggccagggcacctcctcctgtcgtttgtacatgttcacggggttttttgctgtcctccttcctgcaagtgctatgtcacgtgtctctgttctggggcacgagaatccagcctacccgcttagggggccccgcggtgcactgctaagtgtactcatcatccgcgtggccaaacactctgacaaaagcttcctgcatttcaaaaggcaacctgtccattttccattttaagatagatacttttggaagagtacagacacaacaaaaacagtaacattattctatttttacaagatatgtaataaaaatgactacattttcaagagagtcctataaaataatgtgtgccaaatcctcataaacgttccattttaacagtgggctggccgagacttttagaaagaatttatctggaaaatgccaagccagcttataaatattttccagtagcatcactgccaaaagcgtgatgtgtttattgcaactgttgcacgttgtgcggactaggccgtttcacacggtgagcgatggcgagctgggtctctcgctgtattttccagtctgttttctcgctttgtacttctcaaaacgaagctgtcactttccgtaagaggccagttctgccttgactctgagaagctctgctgtaaatacttctgaagtgctcgtgtggtcttgcttttcctttcttcttttttttctttttgcgcttgaaattgattttaggtgttcctatcaaaaggaattctttcaatcttcctgcatcttatatagtaataatcgttgcactcacctcaaagagggccttactgcccgacaactggtcaacctcattaaatgacccataacacaaaccctccaggagccaccgggggcacctgccgtggtggctgaagggtcacgagtgccttcaatgtctttgtcgaaggctgtggcatgggctggatgtgtccttgcttcctgacgggccgtgtcttcaccttttcctctctgaggctgtggctgcctgggccgctgtccgtgctggaagtctcccgtggaggaggaggcctgggggtgccgtgtgtggcctctgcgtgggcaggacgggggcaccgcacagtgcagcactgtctttccaggtcctctctgggacgtgactgtcagcatgtgcagaagaccagccaggtccccctgctcctctcggtcagggagccaggccatcccacccgcacccctaccgtcacactgtcctgtgaggccaacagcactgctggccacagctctggctcaccatgtccctggctaccgtgtttgttgggttttttaatgattgtggtaaaatataaagacatagaatcaagcatgttaaccatttctaagtgcacaggtccgtgccactaagcacgtctgcactgatgagcagccaacaccaccctctgtctccagaactttctccttgcccccgacggaaactctggggtaccttgttttatgaattatctcttttgttccactttgtctccctaagcagcttgtgcatctcttgagaacaggtcctatcacacggcccgaaccgtacctagcaggagcgcagtgggcccttgatacctgcggcctgtgtctcagggcctctgcctggctcctgctcagaaaactgcctcctccctccctgagcccctgttcattacattaaccagaacgcgccgtctgtcgctaagtggaccagggctgagtcctgacccaagaagggccaactgaagtcactcttcaaggccttggacttggaacagaagtcaaatcagtcctggaagtgactggaaatgcaacatttgaactgaaaagccatggagtcccccaaaaagcagacatgggaataggcaatgagagagagaaaggaagtgggtgggagaaggaggcttcacgtcctgcttttcttccttttccaaggcctgactcacgttctcttagcccatggaataacccagcgcctcatatgaaatgcctcttttaactaatgcagttttattaagaccgacctgcaggtggtgggactagcccagcagtgtgacgcttgcggcaaaactcacgactcgagcttccaatggcaggagtgaagcacaggaaactgggctgaagctcctgaacgttgttcctgcccgggaggacgcctgcagccgcgctctgctcccacagcagctccgcatgggctctgtgaccaccgtcctctccccggcacgggtaaggggcagcctgcagaatcgcctgggtagcaccaagcgccacgcaacccgcagggcgctcgcagatggaggccacgcggcctgcagagaagcccctctggctcggttgttgattgaaccgtgaactttctgcttccatctcctgcaggaggctgagccttccacttgcaacacacatctccacatctcagcaattcgccattcaggtttctctcgctggcgtcagtgtccagtgtgtgtctgcagctgctgcccaagcagggacttggggccccgggctccgttctcctcatgtggccctcagggtggctgatgggagaggagacaagcacggatgcacaggccagacttttttttttttctttttgtctttgtacaagattttattaaaggtctttacagagcaacacccagactccagaatacagttgccaaggagaccctgttagctgtggggcctggccggggcgtggcaggaggctctggcttcccatcttctcttctgagatgggggtggtgggcagtatctcatctttgggttccacgatgctcacgtggtcaggcaggggcttcttagggccagtcttgccagctgggccccagggaagcatgatcttcaccttgatggcaccggccagacttttatgtgcagagctggggatggcaaatgtgacttccctcacacacatttgccccctgcctatctgccaggggtcagtttggctgtttacccaggaggaaaacaaaatgggtttggggagcaggtagcactgcccatcacgcgcgtgaggaaggtcattctgagcatttttccccctagaagtaatacacagactatttttatttttattattttttattattatactttaagttctagggtacatgtgcacgacatgcaggtgtgttacgtatgtatacatgtgccatgttggtgtgctgcacccattaacttgtcacttacattaggtatttctcttaatgctatccctccccctcccccaccccatgtcaggccccacttttgatgttccccaccctgtgtccatgtgttctcattgttcagttcccacctatgagtgagaacatgcagtgttctcactgcatgagaaatgtgccacattttctttctttctttttttgttttgagatagagtttcgctctgtcccccaggctggattgtggtggagcgatctccgctcactgcaagttccacctcccgggttcacgccattttcctgcctcagcctcccgagtagctgggactacaggtgcccaataccacgcccggctaatttttcgtatttttttagtagagatgaggtttcaccgtgttagccaggatggtctcgatctcctgacctcgtgatccgcccgccttggcctcccaaagtgctgggattacaggtgtgagccaccgcacccagccatgtgccacattttcttaatccagtctatcattgatggacatttgggtgggttccaagtctttgccttttttttttttttttttttgagatggagtcttgctatgtcacccaggctggagtgcagtggcgtgatcttggctcactgcgagctccacctcctgggttcacgccattctgctgcctcagcctccccagcagctgagactacaggtgcatgccgccacacccggctaatttttttgtatttttagtagagatggggtttcaccatgttagctaggatggtctcgatctcctgaccttgtggtccgccctcctcggcctcccaaagtgctggggttacaggtgtgagccactgcgcctggccaagtctttgctattgtgaatagtgccgcaataaacatatgtgtgcatgtgtccttatagcagcatgatttataatccagtaatgggatggctgggtcaaatggtatttctagttctagatccctgaggaatcgccacactgacttccacaatggttgaactagtttacagtcccaccaacagtgtaaagtgttcctatttctccacatcctctccagcacctgttgtttcctgactttttaatgatcgccattctaactggtgtgagatggtatctcattgtggttttgatttgcatttctctgatggccagtgatgatgagcatttttccatgtgtctgttggctgcataagtgtcttcttttgagaagtgacacagacgtatttttaaattcacttactttagggttagataggaaaacagctgtctccttcctaagtctcactttccaggggcaaggagccatttcttctagtatttatcccatgatttctaaatgcaagacaaagatgcagctctcgtaacaccgtcactttctgtgtacttttctgtcctttttcccaccactttgagtgtgtttattcctctactttgtgggtgtttattcctgtgctttgagggtgtttcttcctctgctttgagggtgtttcttcctgtgctttgagtgtgtttcttcctgtggtttgagtgtgtttattcctatactttgagtgtgtttattcctttgctttgagtgtgtttattcctatactttgagtgtgtttattcctgtactttgagtgtgtttattcgtgtgctttgagtgtgtttattcctgtggtttgagtgtgtttcttcctatactttgagtgtgtttattcctgtgctttgagtgtgtttattcctgtgctttgagggtgtttcttcctgtgctttgagtgtgcttattcctgtgctttgagtgtgtttcttcctgtgctttgagtgtgtttattcctgtgcttggagggtgtttcttcctgtgctttgagtgtgtttattcctatgcttttagggtgtttattccaatggtttgagtgtgtttattcctgtgctttgagtgtgtttattcctgtggtttgagtgtgttttttcctatactttgagtgtgtttcttcctatactttgagtgtgtttattcctgtgctttgagtgtgtttcttcctgtgctttgagtgtgtttcttcctgtgctttgagtgtgtttattcctatgcttttagggtgtttattccaatggtttgagtgtgtttcttcctgtgctttgagtgtgtttattcctgtgctttcagggtgtttattcctgtactttgagtttgtttattcctatgctttgaggatgtttattcctatgctttgagggtgtttgttcctgtgctttgagtgtgtttattcctgtgttttgaaggtgttgattcctattctttgtggatgtttattcctttgttttgagggtgtttattcctatgctttgtggatgttcattcctgtgttttgagggtgtttcttcctatgctttgagggtgtttcttcctatgctttgccagaggggtttccaggagacctgcagcctccacgaggctggcaagcttgaatagagcccttttctactcttaggttgaatcaacacttcacttgaaaataaagttccaggttgaaatcatgtcttttcagaatttggaagacattgtttcgtcgttctctagcatctaatttgtttctgtaaagtccaacgtcattctgactgctgaccttgttaaagtaacctgtgtttttcctctttctctttctttctgggaaaccctaggaccctacgtttaccatcaccattcttaaatgacacagcagcgtaccctatgtctgtctattcaacaggtagagacttggtgggttctagtttttgttgttgttgtttttgagacagggtctcgctctgttgctcaggctggagtgcagtgggacaatcatggctcactgcagcctagacttaccagactcaaggaatccccctgcctcagcctccctagtagctgggtctacaggtgcgtgctaccacgccttgctaatttttttttctttttttttttttttttactatttttagtagaggttggatctcactgtgttgcacagactgttctcaaactcctgggctcaagcgatccccccaccttagcctcccaaagtgctggaattacagcatgagccaccatacccggcccttggtagcttcttttaatattttatgtccttttatttagggacttttctgtaattatttatttggtgattttgtcctctctatatatttttttctttctggaaattttatttatcagcagttgaacaccctgaatcaatccttttttcttttttcttttgacaggatctcactctgtccttttatttgaggggcttttctggaattatttctttgatgatttttactctgttttttttttctttctggaaattttatttatcagcaattggacaccctgaattgatcctctattttttttttttgagacggggtctcactctgtcacccaggctggagtgcagtcgcatgatctcatctcactgcaacatcctgcctctgcttcccgagcagctgggattgcaggagtgcaccaccacgcccagctaatttttgtatttttagtagagacagggtttcaccatgttgtccaggctggtctcgaactcctgacctcaagtgatcctcctgcctcctccttccaaagtgctgggattacaagtgggagccactgtgcccggtctggtcctctaatttggtcttctacttttatatctgttttcttgttttgctttttgagagatttcttcaaccatacctcccaatatttctattgaattattttgtttctgttttcatattttaatttccaataacttttttattctttaatattccctttatacagtatctttttcctgtttcatgggtaaaatagattctcctgtctttaccaggacataaattgtagaattttttcgaagtactctttttctccttatgcttttttttttctgagttcctcatctctgtcttgctgaaatgttttttcagatatctagtaatatttaattgtccgtgtttaagaagagtaagtcgtgattggaagagggagagttaaagctgatggaggttctctggtggacccgtggcttgcattccagggtaggagtcagaaaacgttttctataaagaaccaatagtaaatgtttcaagctttgtgggccacctgctctgttgccaactccacctccacccagccctcgtagtgtgttataatgcgaaaggggctataggcaatacaaaaggggatgagtgtggccctgttccaacagaaccttgcaataacaggcggcgggcctggcagggcccatcagccggactcgccagcccctggcattgtgcccggcctcctctctcagctgtgcctggagactttgaggccagagcctccctgagacagggtccccagagaataactcccctctgtccctgtttgggtcagttgttgccggtacacacaaactgtgggaggggaactgggagctctgctgaccaacttggtttcagggtatccttgaacctactctcagaggctacgctgccttcaattctgagggtttcacacctcagccacgtcctgttatttcccactaggcaacaggaagaaagcttcagctttctccaactacaaagtcaagtactcctctgccatttactccccatttcccaaaatcacagatattgtatttttctttggtttttttgtttgtttgtttttgttgtgtgtgtgtgtgtttttttttttttttttttttttttttgacagagtcttgctgtgtcgccaggctggagtgcagtggcacgctctcagctcactgcaacctccaactccctggttcaagcgattctcctgcctcagcctcccgagtacctgggattacaggtacgcaccatcatgcccagctaacttttgtatttttagtagagacatggttgtgccatgttggccaggctggtcctgaactcctgacctcaggttatctgcctgcctcaggctcccaaagtgctgagattacaggcatgagccaccacacctggcctcattttctttgttcttatgggcttataacattttttccccttatggtcattttggtaaggtttcaggaggatgctgaagtaacacgtgtctgcgatctaccatgtttaaccaaaactctgatttgggaacctgtgatgttttaaaaaacggatgagagtcacagggaatgaaatgagaaggaaaatttttaagagaaaagaaaatgggaaagaaagacagaatggaaggcaggaagtaaaataacatttagattttaagtttttccgctaaacacagagccatgaaatgttaaaacctcttttactttacccttcattctctcaacataaaaagccagtaagaaataaagtaataaatagcattgagaggtacattttgccttagagactggagctgaaatatagagaggttactctaattcactttctctgtgtttgcactcagaggaagcaaaaaaaaaattgtactaaatatgaaatacgactttcagagaacattacttctgacaatagcattatttttgacaatattgcagaatctttttttttccttccctgggaaattttcaggcggcatcacactgagatcagatgtaaagtaaacactgcttcagggtgacataagtgttaatcactgcagagacatctgccaaggtagtgttcttattccagccattccggaggagcacaatggtttgatcggaaaggttcccgaatcaggatttaatgtcatcttgactaattttgtacagttaaaatgccatgggactctttcagaattaaataattgatttttaaagtgctgttctttagggaaagaagagaaaataataatgttccaaaaacaaagcatggcatcaccccagctgcctcctcctccccatcttcctctctctctcgctgtctctctctctcacacagacacacagacacacacacacacacacacatgcctccaaactggctgtctttccattgcacaaaattgtattgctcgatttacagttgagctaacctcaaatgtagtccattcagaacctgacagtatggaggagtattcaagccagaaggtcggaaacaggactcccccagtgcccatggtggcctgagcgagcctggagatacttcacagtggcaggggctgaaggagagaagggagagctgcgtgaagctggggaaggcctgcccgctgtgtggcaggtgcatggcactgtcatggcgttcaggagtccttggttgtgggtgaaaaagtgaaggacttcagcttgaccttggggtcgaccagctgtggtcagacaaggtgagagtgggagcgaactcattaaactcttggccccactccacgggaaaagcaatgtcccagtccctgctaagtaggtaagacctgagaagcagagagactaagtgacttgcttgcagtcaccctacacggtgatagagtttgcgcccagacagtgtggctctagagtccagagacatctcaaatgggatgagagtcacaagctttgtgcagttagatgaagtgaaaacaaaaatccttaaagctgaaaaggtaggaggcaggaggagagagcgtcttcattggggtagagctgcagcctctgaagactccgggacctacataggattcaacctggtcatgggttctggatctgagcccctaaacagctgcttgtctttgggaagtcactgggcgctctggatctgcgccctcatctgcagcgtgaagaagttgaacccaacgatctccacggtctttttccatgagaaaatcctagagttctaatatgctcatcatctgtggaattcgctgtgatctgttcttcttttaaaattattttctgtcaaacagaacacaaacttttttcaagagtgaaagcgctgtctgaggccaggttatatcacttacggggctgtttcctctttggtttcttcaatacacttaataggaagtgtgcacattttaaacttggcctccttcctttgcccctatattcaacccatcaccaagtcttgtaacttctaccggcctccacccctaaatatctaaatctgcctacatctactcattctcacagccaccactcttgtctcagcacctgccggtttgggagctgcgttggctgccagttagtctttacgctttcatgcctgacccctcaaaccacaagaccgtaatagccagagtgggtgcttcctgagcagccatgaagccatgtgattccctggctcacactcatagcgactcctcagtgcatggccgtaacaccaatccctaacttcgaaggctctctaggaacggctctctcctttcctggcttggtgcaatatactcctgccccgtggagaattctgattctc

SEQ ID NO: 504 - DNA, 20001 bp, Homo sapiens
ctggcagggtctctgctcaggggagcccagcccgggactggtgtgccgggcagggggtctctgtagggagagtccctgccgaaggggctggaactgtgcggggcgcccctgaatggtcgaacctggagagctttgttgctcagatgaggaagggccagggaggccaccctggaccaaagggtcacgtttctattcttcctggcccagaatggacagccccagaagaagctgacagtcggggtgcgccccgcaaggggaggagctgagagaggggcggggctgagagaggagggggctgaggaaggagagggggctgagagaggggaggggcttagaggggaggggtgagggaggagaaggggccgagagggggagacgttcagaggggaggggtgagggaggagaggggggctgagagacgagaggggctgagagaagagagggggccgagagaggacggggttgagagaggggaggggctgaaagtggtaaagctgagaggagaggggcggggctgagaagaaggggcgaggcgggaaggggcagggctgagagaaaatgggtggggctgagaggagaggggcggggctcggaggcggggggcgttgtggggcagggctgagtggggcggggttgagaggagaggaagctgaggttggggaggggcgtggagaggggagggggggctcttcgaggggcgggaacagggctcaaggaggctgagtggggcagagggggccgcctaagttctgtcctcccctggggccccaggacacagggtcaggagtgtatcaagtcaccgggtttctgaccatccagaaacctgaccgcgtgcgtccccggggctcggggtcgcccctatcccatgctctacctccctccctctcctcgggccctcctggctccctctgacctccccaccgccagtcagctgtgtctgtatttagagcggtgcaggcctgtgtcactttacttccgaaagggattttgcatctcttagtgctgccttcagaacccccaacacctgttgcggcgcgagcccgtgccacggggagggggtggtctcgcttctggagccactgtgggggaggaggctcagctgcctcccctccccgagaaccttctccctttgtgcaccccctcccttctgagccccttctctaagtccccatgtccccctcccgtcccggagcccccccttctctaagtccccccggccctgccccctgccctctcggagccccctctctgcacgccaactcagagccgcctcgttcccaggctccccaaggccccgagccctgcctgtccccctcctcccctggcctgtccattgtcctggtgagggggtcctggaggctgggcgggccggggtctgcatgcagggggcgggagtcgcctgctacccagtcgtctctgggcaacgctggcaaacctcacgcctagacacagaggctgcgctgttctctgggaggggacagggggcacaaggtgactggggagatgctgggggtgacggctgtggatatgagttttcaggcagggggtgccagaggcagctccaactgctccaggtgggagaaaggttcgagagcgtggccatgggaaacgttgtccccctgctgtccccacggcgacctccaactcactcgacatccttccttcctctgcaggccctcctgctctgccccatcccacagtggggtcttccatgcctgctctgatatgttcatcatcacagccttcccagttggattttgcaattaaacccactttacagatgagaaaaccgaggcccagagagcatttggtgattgaagcagtgaggagaccacacttttggggctatggcccaggacccgagccccaactctcctgttttctctccacatgacctaacagcttctctgagcctcagtttactcatctgtaccgtgggcagatggtggtacccatttcctgggctgtttttactgtgtggggaataagatgcttaaacagtctagggttcaaacttgggtgccagttaccagctgtgcaactggtcaggccatgttgccgctctgtgcctcagtttccccgtcaacaaaatggggtctataatagcatctacttcataacgtggctgtgacagtgaaagttaattctaggccgggcgcggtggctcacgcctgtaatcccagcaatttgtgaggccaaagtaggcaggtcacttgaggttaggagttcaagaccagcctggccaacatggtgaaaccctgtctctattaaaaatacaaaaattagctgggtgtggtggcggccacctgtaatcccagctactcaggaggctaaggcaagagaattgctcgaacctgaaaggcagaggttacggtgagcgaaactctgtccaaaaaaaaaaaaaaaaaaaaaaattaattctagtacatactggcttgtagaaaaccctttataaatgttattgttactatattttttccttctgagtttgtgccttttttcttttttggtgatagggtctccctctgtcactcaggctggagtgcaatagagtggtctcagctcactgcagcctccaactctcaggctcaagttatcctcctgcctcagcctcccgagtaggtgggactacagatgtgcgccgccacgcctggctgttttatttttttgtagagacagggtctcgcaatgttgcccaggctggtctcgaactcaggcttaggtgatcctcccgcttcggcctctgaaaatgctgggattccaggcatgagcctccgcacctggcttgagtttgtgctttctatgaggttcagagaggcttgtgtgtggggaggtcatcgtcccaggcccttccaggccctcaggcttggagttagggattgagggtgtgagatggttccctggggtaactctatctgggaaccagtccccgtgcctgttgagtgatatagtggattccactgccacaccttctgtctcccctgcctgaactgtgtagacgacccagggcccctgatggtgaggactctgagtctgcccctgtcagggtaattgccagagagtgcacagagcaaagcctccatagctcccaccctggactgtgactccctgggtgcagagggggtgcagaccctgttttctgcacataaacaggtgcacctgttgggtcctcacttgaggctgctgggccagcagccccctagctctcccactacaagcagaggggagaaggggcatagctgccccctccgcctgccacagcagtcaccaaggttcctgccagctgctcccttctcagagttcactgggcatcagcctgtcaggcactcacagccgtgccctacctcctggggttaccataaacatacattaacagccccatccagcacttattgaacccgatatgcaacatgtgtaattgcatgcaatcccccccaacagtccccaaggaggcaggtgctattatcagcctcattttatagatgggaaacaggctcagagaggttctgtcacttggccaaggtcacacagcagggaagtcacagagcagggattcaaactccaggctgcattctttatttttttattttttattttttctgagacagggtcttactctgttgcccaggctgtagtgcagtggctcgatctcggcttactgcaacctctgtgtcccgggctcaggtgatcttcccacctcagcctcctgagcagctgggactacaggtttgcaccaccacacctggctaacttttgcgtttttttgtagagacagggtttctccatgttgcccaggctggtcttgaactcctgggctcaagcaatcctcccaccttggcctcccaaagtgttgggattacaggtgtgagccaccgcacccagcccaggctgcactcttaaccaccaccctttgctgtctgtcacaacaaataacaactgtgtgtggcctgaggccactgtgcaaaacttggaggtctgtgctctcatcagcctcactgtgcagaggaggaaagcaagggccagagacagggagggcctggctcaagggcacaaagcaggcagggggaggaataaagatgagcataagggttagcctgcctctgagtgaatgagtgcatgaggtagggagggagtgagggtggttggatcggtggatggatgggtagaaaggtggtgaataggagctgggcgtggtggctcacgcctgtaatcccagcactttgggaggctgaggtgggcagatcacctgaggtcaggagttcaagaccagcctgaccaacaaggtgaaacctcgtctctactaaaaatacaaaaattagccaggcatggtggtgggcacctgtaatcccagctacctgggaggctgaggcaggagaatcacttgaacccaggaggcagagctttcagtgagccgagaccgtgccactgcactccagcctggcagcctgggtgacagagtgagactccatctcaaaaaaaaaaaaaaaaaaaggtggtgaatggatgggtgattagatagatggatgtatggatgagtgaataaatgaatggatggattatggatggattatggatgaatggatgagcgggtggatggatggatggatggatggatgaatagagaggtgggtgggcaggttggtcagtaaatggatgtatggatttgtgaaatgatagttgtatggacgatggatggatggatggatgaacagatgaatgtatgcattatgggtgagcggactgataaatgggtgcaggtgtggattacggatggatagatggatggatggatgaatagagaggtaggtgggtaggtaggtgggtaagtggatgtatgtatttgcgagaggatggatgtatggattatggatggatggatgaacaggtgaatgtatggattgtaggtgggtggattgataaatgggtgcaggtatgaattatagatggatgaatggatgtatggatgagtggatggatgaatggattatggatggatggatgaatgggtaggtggatagatggatgagtgaatggatgggagggcggatggttatatggattatgggtggattaatgggtgggttagtggataaatatatggattatggatggatggatggatgagtaaatggatgaatggatgggtggatagatggatgtgtgggtggatggatggatgggtgagtgcatggatatatggattatggatggatggatttggatagatggatgagtggatgggtgggtggatggatggatggatggatggatggatgggagtattgatgggtgggtggatggatggattgatgggagggtggatggatgggtgagtggatggatatatggattatggatggatagttggatagacagatgagtagatggatggatgggtagattgatgggtgggtagatggatggatggattgatgggtggatggatggatgggtgagtggatggatatatggattatagatggatggttggatagatagatgagtagatggatgagtggatggatatatggattatagatggatggttggatagatggatgagtagatggatggatgggtgagtggatggatggatgggtgagtggatggatatatggattatggatggatggatctggatagatggatgagtggatgggcgggtggatggatggatggatgggaggattgatgggtgggtggatggatggatggattgatgggaggatggatggatgggtgagtggatggatatatggattatagatggatggttggatagatagatgagtagatggatgggtggatgggtgagtggatggatatatggattatagatggatggttggatagatggatgagtagatggatggatggatggatggatgggtagattgatgggtgggtggatggatggatgggtgggtgtgtggatggatatatggattattggtgggtggatggatggatgagttagtgggtgggtatatggattactggtggatgtattaatgggtgagtgaatggatatatggattactggtggatggatggatggattgtttttcacccttcctctgtagggagctctaagcttggttcacacagcagatggggtgagagggtggtgggtgggatagacactactggagtcagttccaagtaggtagagaaggattctggaatcaattccagggcagcatctaagagagcatccagccattcactccttcagcaaacacgtattgagcacctgctgcatgccaggtgctcttctaggcactgggcgtctgtccggcagggaacagagcagacaaaatccctctcctgtggggctgacaacttcaggagggcgtggggggtgtgagagccccattggagcaggtttaggagggaacaggaaatggggaagtggagacagcaagtgttgatgggtctcggaattttactataaaaagaaccaggccgggtgcggtggctcacgtctgtaatcccagcactttgggaggccgaggcgggtggatcactctacgtcaagagttcgagaccagcctggccaacatggcgaaaccccgtctctactaaaaatacaaaaattagctgggcgtggtggcatatgcctgtaatcccagctactcaggaggctgaggcaggagaattgcttgaactcgggaggtgaaggttgcagtgagctgagatcacgccactgcactccagcttgggcaacagagtgagactctgtctcaaaacaaacaaacaaaaaatcattaccctaatgcgggttattacaagttcctgatgcttcagacaattctccaatggccccagagtctgtcgtgccctttcccacaaggttaaaagtgacagcaggcctgtaatcccagcattttgggaggccgaggtgggtggatcatgaggtcaggagatcgagcccatcctggctaacacggtgaaaccccgtctctactaaaaatacaaaaaattagccgggcgtggtggtgggcgcctgtagtcccagctactcgggaggctgaggcaggagaacggcgtgaacccgggaggcagagcttgcaatgagccaagatcgcgccactgcactgcagcctgggcgacagggcaagactccgtctcaaaaaaacgaaaaacaaaacaaaaccaaacaaaaaaagtgacagcaggcagccagggcctcacagcccaaggtctagtcccaagggtctccatttagaagttgttggtttttattttaatgtgttggtttgaaagtcctggaggctgcaggttcttgcatctcagccctagaggagtaatgaagcttctccagggagaatgagaagctggaaacagcttcaagaaatcgggttactgaggcagggacaggcctgatgaaggctgggaggtgggagacccctgtctggcctatcccacctgccagtttatagattatgtgtgacagggggcagcacccaggagccgggctgaatcctttcagctaatggacatttatggcgtgcacagcaggtgcaaaggctctggggccacgtggagcatggactgttacagaaatggttacaggttcctgaattagcccattttcttttcgtctcagagcctcatttaccccatctgtgtaatggacataagagaacctatctttctaagttgtgtgcatatgttttcaccacgttcagactgtgtgtgtgtgtgtgtgtgttacctgtgtcctccccaaaacactttaacattcactcgtttttttccttggagacagggtctctctgtcacccaggttggattacagtggcacaatcacagctcactgcagcattgaactcttgggctcaagcaatcctcctgcctcagcctcctgggtagctaggaccacaggcatgtgccaccatgcctagctaatttttaatttttttttttagaggtggggtcttgtggtcaggcgtggtggctcgtgcctgtaatcccagcactttgggaagctgaggtgggcagatcacttgaggtcaggagttcgagaccagtctggacaacatggtaaaacctgtaatcccagctactcaggaggctgaggcaggagaatcacttgaacccaggaggctgaggttgcaatgagctgagatcctgccactgcaatcactccagcctgggcagcaaagcgacactcttttttttttttttaaagatggaatttcgctcttgtggcccaggctggagtgcaatggcacgatctcggctcactgcaacctccgcctcctgggttcaagcgattctcctggcttcaagtgattctcctggctcagcctcctgggtagctgggactatagacgcccgccaccacgcccggctaatttttgtattttcagtagaggcggggtttcaccattttggtgaggccagtctcgatctcctgacctcgtgatccacccacctcggcctcccaaagtgctgggattacaggcgtgagccactgcgcccagcccgcaacagtctgtcttaaaaaataaaataaaataaaataataattttaaaaagttagatggggtcttgctattgcccgggcttgtcatgaactcctggccacaagcaatcctcccctctcagcctcccaaagtgctggaattacaggcgtgagccactgtgcccagccccaatgttcacttttttaaaattaggtttactctctctcaccatttgaatgtcagctctacaaggacagcaatctgcgtgttctattcactactgaaactgcacagcctggcatacagtaggtgctcaatacttgtggaaatgcataagtgataacctccacagaacactaagtacaggctagagccgggcttcagcatttcctaggcatgcatttatttaattaccccaagaagccccgtgagaaaggtggtattagaggctgggcatggtggctcacacctataatcccagctatttgggaagctgaggtgggtggatcacctgaggtcaggagttcgagaccagcctggccaacatggcgaaaccccgtctctactaaaaattcagaaattagccaggtctggtggtcggtgcctgtaatcccagctacttgggaggctgaggcaggagaatcacttgaacccgggaggtggaggttgcagtaagctgagatcgcgccactgcactccagcctgggagacagcgagactcggtctcaaaaacaacaacaacaaaaaggtagtagtattaggatcccattttatagacgggaaaattgaggcatagagctgttagatttgagcccccccactcccctctcctccccccacccccgcccccccaccaccccgagtccagcccctgtgtgctaccacctctggctctggacctgtgggtttgtcaacacgtgttcttggcatgaccaggtgcaggaacatcacacataccaggagcttgcacgggtctggggtgggggccacatcagcctccggaacctgagcctgcagggcagcgcgtgccccagtcccgggggccacaggagggagcgcgtaggtagaggcggcgggtccaatctccacgccttgttccctctccgggagccggcttccctcccgcctgcctcggcctggacccggcccagctgctgacctcgggaactcgagtgcccccagggacgcagacaatcaattagaattggcagcgcctgcctaagtaaaaggcctgctttaatgaggaggctgtggctctgccgtgggcgcaggcgctgggctgagcccggcgcgggctggagctgaggggtcacgtggccaccagggcccacctgcctgtcacaattatgagtccccgtgtgtgagctcattatgtttatcattaggccagggctatttacagatcggggagagcagccccttgtcatgcaagccgcagacatttattgagcaccagctgtgtgctaggtcatgtgctgggttcgaggaaacagtagggacaagacgccctccagtgggggccaggggagacatcagggtgggcttcctggaggaggcaacacatacactgagattggaatgatgactcgaaattcggtcctgaagaagggaagggaagaggattgtcgaggcctggttaagaatgaggccaggtgcggtggctcacgcctgtaatcccagcactttgggaagctgaggtgggtggatcacctgaggtcaggagttccagaccagcctggccaacatggtgaaaccccaaatctactaaaaatacaaaaattagctgggcgtggtagcgggtgcctgtgatcccaactactcgggaggctgaggcaggagaattgcttgaacccggaaggcggaggttgtggtgagccgagattgcgccattgcactccagtgtgggcaacagagcaaaactccatctcaaaaaaaagaaaaaagaatgagcgcagcctgggttgtggcggggggggctcctacctgtaatcccagtgctttgggaggctgaagtgggaggatcacttgaggccaggagttaaagaccaacctgggcaacatagtcagacccccatcacaaaaaaaataaaaaaattagccaggtgtggtggcgcacatctatagtccagctacttgggaggctgagatgggaggattgcttcagcccaggaggtcgaggctgtagtgagcaatgattgtgtctctgcactccagcctgggtggcagagtgagaccccatctcaaaacaaaaaattgaattagttcccgtgtacgggttgttcaaagcaagataacacagcaaaggaccatgaagcctgcagatgaatttcatctcgaggtcctgaatcaattacatctgcaaagaccctatttccaaaaaagctcatattctgaggttctgggtgtgtataatttttttttttcagacagggtctcactctgttgcccaggctggagtgcagtggtgtgatctcggctcactgcagcctttacctccccggttgacgtgattctcctgcctcagcctcctgagtagctaggattacaggcagctgccaccatgcccggctaatttttgtatttgtatttttattacttatgatctttttcctgagaccaagtctcactctgccacccaggctggagtgcagttgtgtgatcttggcttactgcaacctctgccttctgggttcaagcggttctcctgtctcagcctcccgagtagctgggactacaggcgtgtgctaccacccccggctaatttttgtatttttagtagagacggggtttcatcatgttggccaggctggcctcgaactcctgacctcaagtgatccatctgcctcggcctcccaaagtgctgagattattacaggtgtgagccaccgtgcccgacctatttatttatttatttttgagacgcagtctcgctcgtcacgaggctggggtgcagtggcgcgatcttggctcactgcaacctctgcctcctgggttcaaatgattcccctgcctcagccttctgagtagcttggactacagccgtgtgtcaccatgcctggctaatatatattttttttttttgtattttagtagagacaagatttctctatgttggccaggatggtctcgatctcctgacctcatgttccacccacctcggcctcccaaagtgctgggattacaggcatgagccatcgcgcccgggcttttattttaatttctatttatttatttattttgagatggagtttcactcttgttgcctaggctggagtgcagtggcacaatctcagctcactgcaacctctgcctcccaggttcaagtgattcccctgcctcggcctcctgaatagctgagattacaggcactcaccaccatgcctggctaatttttgtatttttagtagagacggggtttcaccatgttggccgggctggtctcaaattcctgacctcaagtgattcgtccacctcatcctcccaaaatgctgagattacaggcttgaaccaccgcgcccaaccgaggtgtatgtatttttttttttttttttttttttttgagacagagtctcgctctgtcgcccaggctggagtacactgggatgatcttggctcactgcaacctctgccttccagattcaagcgattctcctgcctcagcctctcgagtagctgggactacagacgcgtactgccacgcccagctaattttttgtatttttagtagagacggggtttcactgtgttagccaggattgtctcgatctcctgacctcgtgatccacccgcctcagcctcccaaagtgctgggagtacaggcctgagccaccggtcccaaccgaagtgtatgtaatttttgaatttatttttgcaggcaggcactactcaacatggtacaatgtgtgcttgttcctatctgcctcctgctctggaatgtcaactccaggagggcagacttctgtctgtcttgaatgccacagtgtcccctgtacctcaaatactgtttggcacacagtaggcactcaatacgtgtttgtttattccgcaaacaactatgaagcacccactgtgttgttctcacacggaggtggagtttttcatgctccgaggacttggggcagagagaaggacaagtaggagccacggtgactgcgacttccttttttttttctgcagcctcaggtgccagcagcaataacacaggacctctaggcagaggaagggaagaggcgctgagggaggcagggcttctgcggcggggaggggggggcagagcccctggggatcaggccagggaggcgggagtcctgctggagtccctggggtccccagcagagaggctggctggctgccctgccctggcctggctgctttttctggcttggacgggaagggctgacaccgccagaggagggcagggtggaggcggggagggggcccgcacctggacccaggaagaggtgggggaaagaagtggagcctgggaaggggagacagaggaggtgaggagagaaagagagaaaccaagagagatagaaagagacccacacagagaagctgagctggagtcagacagataaaagacacggagagactcacgcagaaggtggcaaagacagaaacacagagagatggacagagacagtcagagataaagggagactcagagagacagaggagacccacagagatacagactcagagagatagagagacacagacctagagagagagagaacaacagagacagagatagaaagagatagtcagagataaaaggagactcagagagatggagaattagccgggcgtggtggcgggcgcctgtgatcccagctactcgggaggctgaggcaggagaatcgcttgaacccgggaggcagaggttgcagtgaaccgagattgcaccactgcactccagcctgggagacagagggagactgtccccccgccaaaaaagagagagagagagagagacaaagagacttagagagagagagagagggaaagaaagacagggataaaagtagattcaaagagacagagagaaaacaagagaaaggagaccaatagagatcaaaagaggtagtcagagataaaaagagactcagagagacctagagacagagaaagacagagacagagacttagaaagagaatggggaagaaacagagagatagaggcaggcgagaggctccctagcccatccccctccccaattttcctctctggggcacccctggggtctggggctctaaccctgtcctggtccccacccctccccctagctggtacttcagaccccctccacaaactggctgagtgcccccagtccctaactcagggtctcctcagctcagagctccggggctcagccctgagaccttctgggattcaggatccgaatgcccagtggagccagaatctgaatcccagaggcagggacaccattaatcctggaaagagggcaccccctccacccgggcctgagctgagagcggggaggctgtctatatgaagcccccacttcacacttcccacaggagagattcaccctgtttcacaggggaggaaactgaggcttggagaaagacgggattgtggagaggtacacgtttgttcatccagaaaatatgcactgagatgggcgcagtggctcatgcctgtaatcccaacactttgggagcccgaggtgggcagatcacctgaggtcaggagttcgagaccagcctgaccaacatgatgaaaccccgtctctacttaaaaatacaaaaattagccgggcgtggtggcgggcgcctgtaatcccagctactcaggaggctgagggaggaaaatcgcttgaacctgggaggcagaggttgcagtgagtggagatcacgccactgcactccagcctgggtgacagagtgagactccgtctcaaaaaaaagaaagagaaaaaaatgagagcgggaaagaaagaaagaatactgggtatcatataattgactcataaatatttcaatttttcaatttgtatctttttttttttttttgagacagagtttctctcttgttgcacaggctggcgtgcaatggcgcaatctcggctcactgcaacctccacttcctgggttcaagcagttctccttcctctaactgggattataggagtgcgctaccacgcctggctaattttgtatttttagtaaagacagggttttaccacattgatcaggctagtcttgagctcctgacctcaagtgattcacctgcctaggcctcccaaagagctggtattataggcatgaccaattggtatctttaaaagataaggaggactatgctgaaaattttaacaatggccacctgcagtggctcatgcctgtaatcccagcactttgagaggctgaggcaggtggatcactggaggccaagagttcgagaccaacctggccaacatggtgaaatgccatttctaataaaaatacaaaaattagctgggcgtggtggcaggggcctgtaatcccagctacatgggaggctgaggcaggacaatcatttgaaccagggaggcagaggttccagtgagccgagatcgtgccactgcactccagcctgggcaacagaatgagacggagtcttgctctgtcacccaggctggagtgcagtggcacgatcttaggtcactgcaagctctgcctcccaggttcacgccattctcctacctcagcctcctgagtagctgggactacaggcatatgccaccacgcccggctaatttttgtatttttagcagagacggggtttcaccatgttagccaggatggtctcgatctcctgacctcgtgatccacccaccttggcctctcaaagtgctgggattacaggtgtgagccaccgtgcctggccaacaataattttattctatcagcaaatatctcatcggcctcaaatttctatcaaaagtgtcataattttttttacagtttggagcatgatccaaatacagttcacacatgtatttggttgatatgtcttttttttttttttttttgagaccgagtcttgctctgtcacccaggctggagtgcggtggcgtgatctcggctcactgcaatctccacctcccgggttcacgccattctcctgcctcagcctcctgagtagctgggactgcaggcacccaccgccacaccctgcaaattttttgtatttttagtagagacggggtttcaccatgttagccagaatggtcttgatttcctgacctcgtgatccacccgccttggcctctcaaaatgctgggattacaggcgtgagccaccgtgcctggctgcttgatatgtcttaaagtttcttttagcctataggttcctatccatcgctttctcttctttttttttttcgtgtaatttatttgctgatgatgcattattttattttaggtgtattcaaaagaacatacacatggattttgtttattctttgttgtttctatgtatgcaatctgacagcctatgtcttttaagcgatcagtttaattcatttatatttattgtgtttgccaacatatttggctttattttcatcactttctttgattgtattttatagttaatatgaattttttctgctgcttccttttcatcttctcttcaaccttctgctgaatttgccagattttctttgttccttctcttttttttttttttttgagacaagagtttcgctctttttgcccaggctagagtgcaatggcgtgatcttggctcactgaaacctctgcctcccaggttcaagcgattctccggcctcagcctcccaagtagctgggattacaggcgcccaccaccaagcctagttaattttatatttttagtagggattggggttttactacgttggccaggcttcaaactgtaaaaaaaattgggtctcaaactcctgacttcatgtgatccacccgccttgacctcccaaagtgctgggattacaggcatgagccaccgtgcccggcccaagcccagccaatttaatatttaaagtagagataggattttaccatgttggccaggctggtcttggactcctgaccccaggtgatctgtccgcctcggcctcccaaagtgctgagattgcaggtatgagccaccgagcctggccttctttgttcctttcttattccccctcatgatttggaagttatgcattccatttctgcctttgagtagtcacccttacactcttaccatgtatacttagcttacaataactggaagttaatcaacatctctttgttcctccgaatgagacaaggacttcagatgtgtacatactggagctttcctccactctgcatgtcacttttatcccatatttgagttctgccttggcacacctaaggatggagatgaggacagggggtggtgtgtgcccatgtgggtcaccattctcccagatggatggcagatgtggagatggattccagagaccctaactgtctgtgagttcaggcaggttctgcattgggcctcagtttccccatttgtaggacagcactgagtccctctagggctaatatctgaagactgtgagctcccaccctctcccttcttcccaccactcaggatgaccagagtgcaggggcctctggttacactgcagataatgaggggcctctgtcgctaggcccaccacaaaatgagcttgcaggagaacgcgacagctaatgtcattatttacttcactgagctaaataatctagggaattgctcatcaggacctgataatttgattggatttcatgcacaattaggtcttcagagctgaggcattagtcggcgagttcaggaaagacaccaacctccctgctggagaggctcaaggtaaggggacaacgacggagatccccagccccaggaaagggtcaggcgtgcaggccagagggaggcctgaattggccaaattcagtggatccagcctaggctggagctggagacccaccagtcatagtcaacttgacattgcttacttacgagttggttgatattagcagaattattattattattattattatttgagatggagtcttgctcttttgcccaagctggagtgcagtggcgcgatcttggctcagtgcaatctccgccttctggattcaagcgattctcctgcctcagcctcccgggtcgctgggattacaggcacccgccaccatgcctggccaggagaatgatatcacgggagaaacaaccatagtgaacacagttaggtttggtcacttttgcttgagatgtttatttttcttcttacatgaaagaattcaagatgaccccttaaaatctaagtcagggccaggctcagtggctcacatctgtaatcccgacactttgggaggccgaggagggtggatcacctgaggtcaggaatttgagaccagcctggccaacatggtgaaaccccatctctactaaaaaatacaaaacttagccaggcaaggtggcaggcgcttataaccccagctaccctggaggctgaggcaggagaatcgcttgaacctgggaggcagtggtggcagtgagccaagatcatgccactgcattccagcctgggtgacagagtgagactccatttcaagcagaagaagaaaaaaatctaagtcagatctgtccttctcctgcctacagccctctggctcccacctccctccaggtcaaagctcaagtcctcccagaggcccaccaggctctttacaacctttcctgcccccttcctgccctcccctcctccctctcttcgcctcgttcactctgccccagccagacgggcctcttcactgtccctccaacaccaatacaccaggtgcggtcctgctccagggcctttgcatgggatgcaccctcttcccagaacagctgtgcccccagatcccctcagagttgtctcattttcctgttctaggtctcagcttaaacgtcacctcctcagagaagccattcctggctaaaataacttcatccccaccatttgctatgacgtcatcttgttaaattattacctaggctcagcaccccaatccaaaaatccaaaatccaaaatccaacatgctccaattgaaaatgctttgaccgacgagttaatgggtgcagcacaccagcatggcacatgtatacatatgtaactaacctgcacattgtgcacatgtaccctaaaacttaaagtataataataatttaaaaaaaaaaaaagagaaaatgctttgaccgccgacatggcactcaaaggtaataaggctccttgcagcatttcagattttggattttcagattagggatgctcagctggcaagtataatgaaaatattctgaaatccgaaaaaatccccaatccaaaacacttcttcaccatggaaaaatgcttctgttccaaaggtttttttttcttttttctttttttttttttttttttgagacggagtcttgctctcgcccaggctggagtgcagtggcgccatctcggttcactgcaagctccgcctcccgggttcacgccattctcctgcctcagcctcccgagtagctgggactacaggcgcccgccaccacgcccggctaattttttgtatttttagtagagacggggtttcaccgtgttagccaggttggtctcgatctcctgacctcgtgatctgcctgccttggcctcccaaagtgctgggattacaggcgtgagccactgcgcccggccttttttattttttattttttttgaggcagagtcttactctgtcccccaagccggaacgcaatgacgcaatcttgactcacttcaacctccgtctcctgggttcaagtgagtctcatgcctcagactcccaagtagctgggattacaggtatgcgtcagcacccctagctaattttttttttttttttttgagacggaatctcgctctgtcacccaggctggagtgcgatggtgtgatttcggctcactgcaacctctgcctcctgggttcaagcgattctcttgcctcagcctcccaggtagctgggattacaggtgcccaccaccatgcccagctaattttttgtatttttagtagagacggggttttgccatgttggccaggctggtcttgaactcctgacctcaggtgatccacccgcctcgtcctcccaaagtgctgggattacaggtgtgcgccaccatacttttgtatttttagtggagatggggtttcaccatgttggccaggctagtctcgaactcccaacttcaggtgatctgcctgcctcagactcccaaagtgctaggattacaggcatgagccactgcatccagccatcccaagcattttggataagggattctcagcctgttttatcccagggaccagtgtctggtgcccccactctcttcccaactctgagctccccaggattgtccctctgtcccagccctgacccctcagtcagtgtccagctgtgtccagttttacttctccacagcctggtggctcctcatgagccaaaccaagacg

SEQ ID NO: 505 - DNA, 20001 bp, Homo sapiens
agaagaatgtgggaagatttttctctgtaataaatggtgctggaataatagctaacactatgtagaagacagaaacttgaccccttcgttgcaccacatacaaaaatcaactcaagataaaataaagacttaaatgaaaaacttaaaattataaagaaaccctgcaagataacctaggaaataccattcttgacacagaaacaggtaaagacttcatgatgaaactacaaaaaccaactgcaacaaaagcaaaaattgacaaatgggacctatttgaacttaagagcttcttcacaggaaaggaaactatgaatagagcaaacagacaacctacagagtaagagaaaatagttgcaaattttgcctcttacaaaggcctaatatacacaatttattaagaactgaaatgagtttagaagaaaaaaccaagaaacctcattaaaaagtaggcaaaaaatatgaacggatgcttttcaaaagacatacatgtggctaacaaacattatgaaaaaaaggtcactgctaatcattagagaaattaaaagaaaaacacaatgagaaaccacctcactcacacacgtcagaatggctatttttaaaaagtcaaaaaataacagatgctggcaaagttgcagagaaaaaggaatgcttatactctcctggtgggggtgtaaattagttcaacaacttaaaaagcagtgtggcgattcctcacagaactaaaaacagaattatcatctgatccaggagcctcaaaactgggtatatacccaaagaaatataaatgtttatattataaagacacatccacatgcatgttcactgcagcactattcacaatagcaaagacacggacaggccctgaatgcttatcagtggtagactggataaagaaaatataatatggtcagatgcggtggctcatgcctgtaatcccagcactttgggaggccacagcaggtggattgcctgagcttagaagttcgagaccaacctgggcaacatggcaaaatcctgtctccacggaaaatacaaaaagaaaaattggcaaggcatggtaacacacacgtttagtcccaaggttgaggctaaagtaagccaatatcatgccatggcactctggcctgggcaataaatgaaaccctgtctccaaaaataaaataaaataaaagatttagtaaaaacaaaatatggtacataaatatcatggaatactctgtagccattaaaaaataattatcatgtcctttgcaagaacatagatgaagctggagaccattattcttacaaaactaatgcaaagtctgggcgcggtggctcacaccggtaatcccagcactttgggaggcggaggcgggctaatcaccggaggttgggagattaagaccagactgatcaacgtggagaaaccccgtctttactaaaaatacaaaattagccaagcgtggtggtgcgtgcctgtaatctcagctacttggaaggttgaggcaggagaatcccttgatccccggaggtgaaagttgcggtgcgctgagatggcaccactgcactccagcctgagaaacaagagcaaaactctgtctcaaaaaaaccaaacaactgggccgggtgcggtggctcatgcctgtaattccagcagcttggggggccctgaggagggtggatcacgaggtcaggagatcgagaccatcctggctaacacggtgaaaccccgtctctactaaaagcacaaaaaattagccgggcgtggtggcgggcgcctgtagtcccagctactccggaggctgagggaggagaatggcgtgaacctgggaggcggagctttcagtgagcagagatcgcgccactgcactccagcctgggtgacagagcgagactcggtttcaaaaaaaaaggacaaaacagcacaacaacaacaaaaacagaaaactaatgcagaaacagaaaaccaaatgcatgctattatttttaagtaagagctaagtaataagaacacatgaacacaaaaaggagaacaatggacactgaggcctagttgagggtggagggtgggaggactcagaggatcagaaaacatacctgtttggtgctatgggtagtacctcagtgacaaaataatctgcacaccaaaccctcatgacataattttagctatataacaaacctacatgtgtacaccaaaccagaaataaaagctaaaagaaaaaaaaaaatccctgcgtgggagagtacaatgcaggtgtatgaactgattttggctacagatagtggcccaggtggaaatgtactctgattgatttcggtgtgcatgcaggcagatgagattaaacaggtggctcagaaccttagggtggtggagaaaacaggttgctgctgcagattcagtgtctgggggtggggatatgccaggagacttgtagagacttgtgggttcttggcaagaaacacctggatcaaaaatgccatggtggccaggtgccatggctcacccctgtaatcccagcactttgggaggccgagacagatggatcacctgaggtcaggagtttgaggacaggaattcaagaccagcatggtggaaggcgcctgtaaacccagttactcgggaggctgaggcaggaggatcacttgaactcaggaggcagaggttgcagtgagccaagatcgtgccactgcacaccagcctgggcaacaagagtgaaactctgtctcaaaaaaataaataaataaataaaaatacaaaaaattagccaggtgtggtggtacacacctgtagtcccagctactccggaggctggggcaggagaatcacttgaacctagtaggcagagattgtgtaatggcctaaggcgttcaccttgccctttgcctagacagagcccattcatcaatacaggagaatttgtggagaaaatattaaacgttaaatttcaactcaattgaacatggacacaaacaatggttaccaagtcctgggacaggttatgtgagccccttgaggcattcatccagcactatttttgagaaatctctgtttgaaatgcttgttccttggtgccataaagaaatagcacttgaacataaatttaatttactcagtaaggccatttttactttctgcagaaagggtacacttaccagcagttttgccatgagtgtacaccgaacaaaggagacagggtcacttataaccagatgcatcaactctactcctgtgttgttttcactggctgggactggacctcacattctgtatttgtctcgattggctagcaatgtagaactttttaaaagaggcaaacgcagaggagaacagaggaaggaggaagtaacttgtagaatgctgagaaaggtaaaaacaccttcaaataaggaagaggaacaggctatgacctaatgcttgcttggaccagtataaacatgccagagcaaatatttaggctaaacagtgggagctaagaacataaagtacattgatttctttattatggctagcagatatttaagaatattagcacaggtctttcaatacattttacttctaagagaagttactatttactcctaattagatggggaggaaagtctttgaagagaaacctctactttacttttacatctctattttaatctattcctctacgttagttattgaaaaacaatagacaattgcaaaaaaacaagttcacctatttgtgttcctggagcccattcacaaagggccctcgtgactgggcctcatgccaaacaagttgttacaaaaagagctagggccgcagactgccctagcttcaggagacctctcctcatctgtgcacggttgagtgtccgactctggagcccaggctatcacttcccggtgtggtggtgaatcctccatagtctgatgagtgtttttgtctgactctggagcccatactgttgcttcctggtctggtgaggaatcctccatagtctggtgagtgtaaacatacacacacacacacacacacacatatatacacacacatatatgtacatatacgtatatacatatatgtatatacgtatatgtatatatacatatatacgtatgtgcatatatacatatatacgtatatacgtatgtgcatatatacatatataggtatatatacatatatgtacatatacatatatacatatacatatatacatatatacatatatacataatacatatatacatatatacatatatacataatacatatatacatatatacatatacgtgtgtgtggtcatgtgtgtgtatatatgtgtgtgtgtgtgtatatatatcacttttcccttctcccctttccattgcaattttcttattatatcaatttgcttattatatctgcattgccatttacataagataaagcttctttacccttaaaggtattgtgtgtgtgtctttctttctcccctcatgagtttcctgaacagaacaccatatttttcagaggctttatttgtttcttattattcttttttccttaatcttgcctgcatgcctaattttgacaaggtgctattcaaactctgatatcctttcttctgcttggtgaattcggcttcaaatacttttgtatccttcatgaagcataaaacaaaaactaactgggcctttggccaggcatgatggctcaagcctgtaatcccagcactttgggaggtcatggtgggtggatcacgaggtcaggagtttaagaccagcctggccaagatagtgaaaccccatctctactaaaaatagaaaagttagccaggcatggtggtggaggcctgcgtcaggcctctgagcccaagctaagtcattgtatcccctgtgatttgcacgtatacatccagatggcctgaagcaagtgaagaatcacaaaagagaaaatggccggttcctgccttaactggtgacattatcttgtgaaattccttctcttcgttcagaggcttcccaactgagcaccttgttacccccgcccctgcccacaagagaaaaaccccctttgactgtaattttccactacccacccaaatcctataaaatggccccacccctatctccttttgctgactccattttcagacgcagcccacctgaacccaggtgattaaaaagctttattgctcacacaaagcctgtttggtggtctcttcacatggacgcatgtgaaagcctgtaatctcagatactcaggaggctgaggcagagaattgcttgaacctgggaggcggaggttgcagtgagccgagatcgtaccactgcactccagactgggcaaaagaatgagactctgtctcaaaaaaacaaaacaaaacaaaaacagaatacagaagatctttcttccattttgactgtagaaaatgaatgtatttccactggaaaatgtggtagataattgatgagtaacatagattcgtcaaactatccgtttctctttttgcagggtaaatttgtgacagtgactatctcggttctgtatcttgtcttgatttcttagtttaatgctaaattatatgtggtgaaacgtggtactgttagatatgagttctaaatgtcttttcaaagagtcaatatgtcagtatgttcaattctttgccttctacttataaacttaacttcctcgtaaagcaaactttttcaattacctgctccacctgactcatttcaatcacctgctccaacctgactcattcccattacctgctacctgctctgccctgactcattttttccccacataaccattttttttcccgccaaaccactcacccaatcactgtctttaaattagctaagtggaattagtttagcctatgcagtctaaccctagccaataggggaacgacacagcaacaggggccatgcgcgtcagggataagaacccctttccctcccttgtccaggtgtgcactcaccattgctccatttgtaaaggcacacccttctatagaattaccttgccttgctgagaattaaaaagaaaattttatattcgagtgctatttcttttgcggcacagaaattttatttataacaatttgggggttcgcttgtgattacattcccctccaggggtggtctctggttctctctcatgaggaggtttgccctgcccccttgtggtggcctcaggggtgagaaatccagacccactcagtgggaaaaataaccggagctctcagcaacgaggggaaaaaaaaactggccagtaacctagcttaaaggatcctcatatactgtggcaacaactctgtgcacagacccaggaaggagaagctgcgggagccagaaaagtacttcattggtggtcaaattctggagagctaaatgtgtttgtgcgtgattgatcacaaacaaccctgcttgcgatgttgttcgtgtggatggtgacaagtcctactgctgaatggagtgagtgggtcctctctgtggttccgtagctacctcatatgacttagggtggatcctgccatgagatttattctgacatgccaacactaagaggggcctaattctcccttgggggagcagccagagagaacaacacgaatgggaagtgcgcaaggaaagagggggaaagggaggaaacaggttaactttctgggacaggcaaggagagacatttctggtgtcaggggttgagacttccgggacaggcaaggtgagacagccctggtttgaggggttgaggcttctgctaatttcaagggttgaacctcacacaacccccctttccttttatcttgggggaagaaagagtagctccactcccgctggtccctcccctaggggaaggagaaggagaggacagaacagcagcataagcatctgggagaggcacggaaagaccagaagagagatgagacagagagaaagacagaggggaaagagagagaaagagaggcagagagagagagaggaagagacagagacaaagagggagtcagagagagagacagaaagtcaaagagagaaagaaagaagtagtaaagaaaaaacagtgtaccctatttctttaaaagccagggtaaatttaaagcctataattgataattgaaggtcttctccgtgactctataacactctaataccaccttgttgtcagtgtaaacaagggcgcagcccgaaagcactgaggtcactgacaacctgtagccttcctatcaaaaatccttaacccagaaacctgtggatgaaggtaattcattcaatctgtagtgacaactgctttgcccgtaatgcccaaccttgtttttactaaccctgtttttagactccccctttttctcccttaatcacctagccttgtttccacatgaataaaaccctccctgggccaggtgcggtggctcacgcctgcaatcccagcactttgggaggcctaggtgggcggatcacgaggtcaggagatcgagaccatcctggctaacatggtgaaaccccgtctctactaaaaatacaaaaaattagccaggcgtggtggtgggcacttgtagtcccagctactggggaggctgaggcaggagaatggcatgaacccgggaggtggagcttgcagtgagccgagatcacaccactgcactccagcctgggcaacagagccagactccgtctcaaacaaacaaacaaacaaaccaaaaactctcccttagctgagaaagctagacaaactccatctggcccccttgatttataagacgttaaggactccttacccacccccttcttcaaggagttaacttgtgtaaacagattctcaacatatcaaaagagtccaattaactgataaggtactgaaacaaacaatgtatgaagttcccaggatcttgctcaaaagataacaccacaaagccttgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcatttgagctcccctccccttcctaaaccaaagtataaaagaaaatcaagccccctcctcatggccgagagaattttgagtgttagtcatctctttggccacaggctaaataaaggactcttaattcatctcaaagtgtggcgtttttctaactcgctcgggtataacatttggaggccccagcgagatatattccccaccgggtgagagccgggctttctccaggctcccccagacagatggctggcttattggggggtgccacctgaaaaatttttccaggtccgttaaaagtgaccatcttccggaggagagcagattgactaccgtgtgtttgcccacaaaattccacctctgagtcctcaacttctgaccctggggtcaggtaagtcaggcttgactttgccctggactcagtccatatcccaggtgctgggggactgagtcctggtttctggcaggccagtctctctctctctctctctgtctttctctctctgtctcattaaagactagtctcactctctgctctctttctcactctcactctccctctccctttttctatttctcatccttctcttgttcaggtttcttggagatctccgggaaaaaaaaaacaaacaaaactgttataaactctgtgtgaatggtgagtgattgggtgattgtggaagacaagggcttgtgcttgtcttccagtttgtagctccatggcgaaagctacacagcttgagtgggccctcacctgtggttccatggtgacctcgtaaggcttaagaggcatagcttgatctgagccgggggtttataccagcctgccagtactaagaggagcccaagtcccccaagggggagtggccaggtgggcatctgaatgatcccatcatgggaccccctccccttgtctgtctaataaaaactgtcataattgtttacatgccctagggccaattttttgttttatatttattgctctgctcagtgtctattgtcttgttcagtggttgtcaaagttttgtatgtcatgtcattgatattgcccaagacatctgggtaagaacttcttcaaggtccttagtgttgattttttatcacaggaggttaaatttctcatcaatcatttaggctggccacaacagtcctgccttttctgtcagaaacaagtgaggtgttgttacggaaacgagtgtggagaacattcgcctgattgggatttctggcagcgtgaaggttgctggtatttagattgtcataccctacatccaagagctgggctgcctctaggttaaactggtggtgggttgaaaatagccaccctgcagatttccttgcttacctcttttgtcatactgtaacttttcccatgcccttaaataggacactgtgtagggaaacctacacctgtactgctttacttcatttagatccttactctgttcctctgtggctactctcccaccttaaaaatgatccgagtggcctcatccctgccccttaccctgtacatctcattttccagtgccacagcaagttcagcatctccaggacttggctctgctctcactccttaaacccttacagaaaaaggctgagtttgagctatttgcctttgagtcatggagacaccaaaagtatttagggtacaggtccagaggaagagggagaacgcctagatccaactgacccaggagacctcagggcagcctctagtccccctccctcaatcttaaagctactgtaatgtggcaagtggtattagctgttgtggtttttctgctctttctggttatgttgattctgttctttcagtactccagccccctagggagtgagtttctctgtacatgctgggtttaatatctattctcaaatcttaataaattgccttcaaaaaaaaaaaaaaaaaaagagggaaactccttctctggccttgtaagtgttggagccctctccaatgtatgccacagaatttttctctcggtttctcagaggattatggagtctgccttaaaaaaggcaagctccggacactctgtgaagtagaatggccaaagtttggagtcgggtggccccgtgtagggtcactgaaactcacaattgtccaggctgtgtggcaggttgttactgaaactcccagccaccccgatcagtttccctacattgatcaatggctgagtttggtcaggagcccccctccatgggtgcgctcatgcaccattcataattctacctccaaggtcattctgagccagaccgcattttcacctcgaccctcagccagtctgacttccctgtactgcctccctctgaagaagaggagagtctccctcacccagtcccgctgccttacaaccagcctgctcccatagaatcatcctttgtctcctcaactacttcccctgtaggctcaccgcctattgcttcttgactgtgaccacggtaggaggaagtagcccctctactaccactgagagaggcacaagtccctctgggtgatgagcgctcatctcccttcttggtttatgtccctttttctacttctgacttgtttaattggaaaacccataatcctcccttctctgaaaagccccaggttttgacctctctgatggagtccgtactccggactcaccggcccatctgggatgattgtcaaaagctccttttaacccttttcacctctgaagtgagggaaggtatctgaagagaggccaaaaagtacttcctcacatcagccaataggccagaggaggaagctagagacctccttgaggaggtctttccctctacccggcctaattgggacccaaattcctcaagtggaaggagagctttggatgatttccagtggtatatcctcgtgattattaagggagctgttcagaaacccataaacttgtctaagatgactgaagttgtccaggggcctgatgagtcaccaggagcatttttagaacgcctccaggaggcttatcagatttacaccccttttgccccggcggctcctgaaaatagccgtgctcttaatttggcatttgtggctcaggcagccccagatgttaaaagaaaactgcaaaaactggagggatttgctggaatgcatatcagtcagcttttagaaatagcccaaaaggtttttgacaactgagagtttgaaaaacaaaaacaagcaacataggcatctgaaaaaggtgctgataaagtattcaaaagacaagcaaaaatcttagtgatggctatccaagaggggaaaaagaaaaggcccccatcacagagaaatggccagggaaccttgggttcccaccataaaggtaaaggagttgaacaggctcctctaggaaaggaccaatgtgcttattgcaagcagactggcagtggaaaaaggaatgcccactacgaccagaagaaaaatcagaaaagaaaaagtcctcaccctacctgtaatggaagagcctgatgactgaaggggccagggctccctcactgttggctcccaggaacccatggtaactgctacagtggggggccagcctgtacgcttcctagtagataccagggtggagcactcggtactgtagacccccttgggcagtgtctcaaataaaagtgactgtacaagtcactggagcaactggagctattcaagaagatcctgtcacacactcatgagaagtgagcttgggacagaaaagagtgacgcagtcatttcttgtggttccagagtgtccttttcctctccttggatgagacctgctccataagttacaggcctcaatctctttctcagctcaataggctcacctcacactaggaaatacagctccctccactgcccaatttctgctaagtacccctctgtcggaggaatagcttttagtttcaccatcacaatcaccggaggagaataataatcctcttcttttggacttacagacactttttccctgagtttgggccgagccaaaccctccaggactggctaaacaccattcaccagtggttgtagaactcctggccactgtcatgccagtccaggtgaaataataccccatgagtcagggggcaagacaggggattaatccccatatttaatgactgttacaagctggcatacttacaccatgtcagtctgcttggaatgctccattattgccagtccagaaacctggaacaaatgattactggctggtacaggacttaagggaagttaacaaatggactgttactgtccatccaaccgtccctaatccttatactctacttagcctgctctcaccagaacatacagtatacactgtccttgacctaaaggatgctttttttgctattcctctggaccccaaaagccagccgatctttgcatttgaatgggcagatcctagctcagggaacactacccaactgactttgactcagttacctcagggttttaaaaactcccccaccctttttggggaggctctccagcaagatcttgtaccattccgagctagtcaccctaactgtactcttcttcagtacgttgatgatcttttattagctactggaactatggacagttgcctgcaacatatgagagacctactttacctccttcaggagctcaggtatcaagtctccaccaaaaaggcccagctctgtcttcccagagtgtcttacttgggatacgagataaaccaaggaaaaagggcactcaccagtgcccagaaagaagccatcctatgaatccccgctcccaccaccaagagacaggtacatgaattcctgggggccatgggatactgctgcctctggatattggggtccacagagattgccaagcccctgtacactgctacaggaagaaacggcccactggtttggacagacaccgaagaacaggcttttcaaaacctgaaaaaggcattaactgaagcccctgctttagccctcccaaatatctcaaagcattttcacctgtttgtccatgaaagccagggagtttctaaaggggtgcttactcagactttaggaccctggagatgcccagtggcctatttatctaagaggctggatcctgtggcctctggatggccaagttgtctgcaagccatagtggctagagcaatactagtccaagaggctgataagttaactctgggccaaaatttaacccttatggctcctcatcccatagagactttactatgaagtgctcctggcaaatggatgtcaaatgctcacatcttgcagtatcagagtttactgttagatcagccttgtttgactttctcccccacaaggtgtttaaatccagctacactactccctgatccagactccactactcctgttcatgactgtcaggatctgttggaaactaccaaaactggccaacctgatcttcaagatgtgcccctagaaaaggcagatgccactgtgttcacagatggtagcagcttcctcgagcagggagaacgaaaagctggtgcagctgttaccatggagacagacatgttgtgggcttaggctttaccagcgaacacctcagcacaaaaagctgaattgattgccctcactcaggctctccaatggggtaagaataaacgtattaacatttacactgacagcaggtatgcctttgctactgtacatgtacatggagccatctaccaggagtgcaggctactcacctcagcaggaaagactcaaaaacaaagaagaaattctagccctgcttgaagccgtatggctccctcagcaggtggctgtaatccactgcaaaggacatcaaaaagaaaacacggccattgcccgtggtaaccagagagctgattcagcagctcaggacacagcatgactttcaggcacacctctaaacttgctacccgcagtttcttttccacagccagatctgcctgacaatcccacatactcaacagaagaagaaaaactggcttcagatgttggagcaaataaaaatcaggaaggttggtggattcttcctgactctagagtcttcatatccagaactcttaggaaaagtttaatcagccacctacattctaccacccatttaggaggagcaaaactagcccagctcctctggagcctttttaagatcccccatcttcaaagcctaacagatcaaacagctttccagagcacaacctgcacccaggtaaatgccaagcaaggtcctaaacccagcccaggccaccatctctgaggaaactcaccaggaggaaaatgggaaattgactttacagaagtaaaaccacaccgggccgggtacaaatactttctagtactaatagacaccgtctctggatggactgaggcatttgctacaaaaaaagaaactgcctgcatggtagttaagtttttactcaatgaaatcatccctcgatatgggctgcctgctgcaatagggtctgataatggaccggctttcacctcatccatagctcagtcagtcagcaaggcattaaatattcaatggaagctccattgtgcctatcgaccccagagctctgggcagatagaacacatgaactgaaccctaaatacactcttacaaaattaatcttagaaacctgtgaaaattgggtaagtctccttcctttagctctacttagagtaaggtgcaccccttaccaggctgggttctcaccttttgaaatcatgtatgggagagtgccgcctatcttgcctaagctaaaggatgcccatttggcagaaatatcacaagctaatttattgcagtacttacaatctctccaacaggtacaagatatcatcttgccacttgtttgaggagctcattccaatccagttcctgaccagacggggccctgccattcgttccagccaggagacctagtgtttgttaaaaagttccagaaagaaggactcactcctgcttggaagggacctcacaccatcatcctcacgacgccaacggttctgaaggtggatggaattcctgcttggattcatcactcccacaacaaaaaggccaacagagcccaactagaaacatgggtcccgaagcctgggtcaggccccttaaaactgcgcctaagccgggtgaagccattagattaattctttttatttacctctcttgtttctttttgcctgttatgtcctctgagccttcctactcctttctcctcacctctttcacaacaggacgtgtattcgcaaacactacttggagggccggtacctccaaggaagtctcctttgcagttgatttatgtgtactgttcccagagccagctcgtacccatgaagagcaacataatttgccggtcataggagcaggaagtgtcgaccttgcagcaggatttggacactctgggagccaaactggatgtggaagctccaaaggtgcagaaaaagggctccaaaatgttgacttttacctctgtcctggaaatcaccctgacgctagctgtagagatacttaccagtttttctgccctgattggacatgtgtaactttagccacctactctgggggatcaactagatcttcaactctttccataagtcgtgttcctcatcctaaattatgtactagaaaaaattgtaatcctcttactataactgtccatgaccctaatgcagctcaatggtattatggcatgtcatggggattaagactttatatcccaggatttgatgttgggactatgttcaccatccaaaagaaaatcttggtctcatggagctcccccaagccaatcgggcctttaactgatctaggtgaccctatattccagaaacaccctgacaaagttgatttaactgttcctctgccattcttagttcctagaccccagctacaacaacaacatcttcaacccagcctaatgtctatactaggtggagtacaccatctccttaacctcacccagcctaaactagcccaagattgttggctatgtttaaaagcaaaacccccttattatgtaggattaggagtagaagccacacttaaacgtggccctctatcttgtcatacacgaccccgtgctctcacaataggagatgtgtctggaaatgcttcctgtctgattagtaccgggtataacttatctgcttctccttttcaggctacttgtaatcagtccctgcttacttccataagcacctcagtctcttaccaagcacccaacaatacctggttggcctgcacctcaggtctcactcgctgcattaatggaactgaaccaggacctctcctgtgcgtgttagttcatgtacttccccaggtatatgtgtacagtggaccagaaggacgacaactcatcgctccccctgagttacatcccaggttgcaccaagctgtcccacttctggttcccctattggctggtcttagcatagctggatcagcagccattggtacggctgccctggttcaaggagaaactggactaatatccctgtctcaacaggtggatgctgattttagtaacctccagtctgccatagatatactacattcccaggtagagtctctggctgaagtagttcttcaaaactgccgatgcttagatctgctattcctctctcaaggaggtttatgtgcagctctaggagaaagttgttgcttctatgccaatcaatctggagtcataaaaggtacagtaaaaaaagttcgagaaaatctagataggcaccaacaagaacgagaaaataacatcccctggtatcaaagcatgtttaactggaacccatggctaactactttaatcactgggttagctggacctctcctcatcctactattaagtttaatttttgggccttgtatattaaattcgtttcttaattttataaaacaacgcatagcttctgtcaaacttacgtatcttaagactcaatatgacacccttgttaataactgaggaatcaacaatttgattccccgaaaacatgggtggtgaatgtaatgcccaacattgtttttactaaccctgtttttagactctcccttttgctctcttaatcacctagccttgtttccacatgactaaaactctcgcttagctgagaaagccggacgaactccatctggcccccttgatttgtaagacattaaggactccttacccacccccttcttcaaggagttaacttgtgtaaacagattctcaacatatcaaaagagtccaattaactgataaggtactgaaacaaacaatgtacgaagttcccaggattttgctcaaaagataacaccacaaagccttgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcgtttgagctcccctccccttcctaaaccaaagtataaaagaaaatcaagccccctcctcatggccgagagaattttgagcgttagcggtctctttggccaccggctaaataaaggactcttaattcatcccaaagtgtggcgttttcctaccttgctcgggtataacatgctaacagaagagagtatgagattattctgttaaaaaaatgatttatcattaaccaccgtaaatccccttaacccagcaggtttcccaacagggagtctaaaccttaattaccatagaaaagtctgaccagacctaggaggaactcccttcaggacaagatgatagatggttcctcctgggtgattgagggaaaaaggcacaatgggtattcagtaactgataaggaaactcttgtagaagcagagttaggaaaattgcctaataattggtctgctcaaacgtgggagttgtttgcatccagccaagccttaaagtacttacagaatgaggaaggagtcatctataccaattccaagttaatacggactgaacaaggtcttattaatagcaaataataattgaaatcccaaattgacaaggttttcaacaaaagtaaagtttgctgaaagttaacagtgttaacatgtattatcctaacttctaatcttgtggccttaaacagtctagtccacagacaggaaggaagttcgcattggagaagaatggttatcatctttgaaagaaaaaaaagggggggaggagaatttatgtaaaaagggatgttatatggtaaattcttgttctaaaataaattaactgtttgcttaaagaaagggatgtttgcaacaagtcagaaagttgaggcatgtgaagaattatttttgaaagccttgaaaaatgttataaagggaatttatgcaggaaatgttttataatttaaaagtaattaggcgtcctgaatgtaaaactattgaagaaacaatttacttgcaaggtgtgtaaggaaagtaaaatatacttttggtaaaaggattataaggaggcataagaatgtggatttttacctacacttaaaggttaaaaaaatttattttaaaggtctcagcaagttttgaaacattaattgtaaagaaaattctgtgtgtaaacatatgagctaaagttaaaggggtatcatccagtttttctgtgaactggacattaaaataaaagcacaacaggtttttcttaacttgctctttaacaaactttaacaactaacttgctctctaacaaaaattataaaaggttaaaaagagtctataaaaatcttaccttatggtcagacattaaaagttggataaatatgtctacaaggttttattaaagttaagtttaatattaataacactaaatttagcttatctcatataaaaatcatatgggaagcattttaaaatataaaatggtgtttgactttctttggtctgaaatctaataaaaataggtactaaagaaaatttctcaacaagaacgcaccaaggactataaagtccactgttgaggtccccacatttaaaacaaaagatcgatttcttagaaatcttatactaagcgtatcttccactttactttccctcaaaactaaaagtcttttagcacaggtaccacccctagaatttctggtaaaccagcaccagccttgggatcacgttctcatcaaagggtgaaaagaaggaaaactcaagtcagcctgggaaggaccctatcttgtgctgctaactgaggctgctgttcatactgcagaagggggatgcacacatcacacctgagtcaagcaagcgccattatcatcagaatcatgggccattgttcctggatcaagccctaccaaattaaagctaagaaaagctcagtctagctatactttcctttcctttcttaacccagtgcttatattcattactattcctaccactatcaactctaaccccactttagagcacttctatgatttaggagcagaggtcactggaaaggatcctatacgattctttaagatgcgcatttttctccctcctccacctcctacatctgccctgttcccaaacctatgacaccaaactatgcctcacctcatgccaaatgacaaaagcaagctctcggtagtagaaataggagatctgaggcaaaccatagccattgaaacaggatataaagatgtaaatgcctggataaaatggattaaagattccattcacgctttaaacagaagtggctgttatgcttatgcggatggtaggccagaggcccgggctgggcctttccactggggtggtcctcaaatcaagtggacacggagtgcatgaccgctgtttttcaagattccactgcctggaataacgaatcatgccaagctttctctgctatttcctgaagtccaacaccctgtgggtcagcccctgagcgccatccagcctccatcttccaaaaccaattttacatcgtgtctccaatgacaagggaaaaaatttggcattccgtggaaactttacaggatgcagtgaagtccggcatttcc

SEQ ID NO: 506 - DNA, 20001 bp, Homo sapiens
ctattgacaaggccccacctggcaagctggcatccgaggacccaggcaggacctgagccctgctgcctcagcagccagcttcctgtaggcccctgaacacactttccaaactgaggactgattctcatcatggccatactcctgtctcccagctcctgctcccacagagcttcctgctctagaaccaagctttcttagagtctccccgccctgcctcgacccaggctggcctttgcagtggaggcagccccacccagagccagagcttcaccacctctgccaactgcaagcagcccccgccttgtgctggcaggtatggcgaaaatgggagagactgagttccagttgggaggagagagagacaggagatgaggagaacatgagctcagtaattcagcttgagtacctaacacagacatggggtgagggggctccgtaggaccatgggagcgttctgcactgacctgcataggatagggcttgaataaagttttactcgaatcacttttcccaccattgaacatggactgtatattcagctctgcaatttgcacttccatttagtatttttaaaaaaggtttccatgtcaatccacactgacccataatagagctgcttcgagcatcatcagattgggagctgcagaggggcgggggacggagctgcccctcgtgctccttcctcctttcccccaccacacactcagacacatacacagagagacatacacagacacgcacacacacacaaacacagacatgcacagagacacacacaggcacacacacacacagacacataaacacagacacacacagacacacacacagagacacacataaacacacagacacacacacaaacatacacatacacacacatacacagaggcataaaaagatacacacaaagagaaacacacacagatacacacagagagacatagacatacacagaaacacacagacaagtacagacacacacagaaagatactcacatagacacacagagggacatacacacaaagacatacagacacacacacaaagacacacacatgggcacacatacagtgcagagtttctttacagccagagttcagccagagcttgcagaaaagggggagacactgatgaccttagcggtgccaccctgtcagagtatacagggtcatgtttctctgcagtggggttgtcagtaacagctaggccctgtccctttcctggagaagcaggtgtgaaaagtcagagttaccgtgtacagccagctctgctgaggcactcaagccggcacctccacctgacccggcacagccctgtgccccagtgccggtaccatcacctgcccacaccacccttgggctgcctctccctgtgccgaagctgagtaatctatactcagaactttcctggagatgggtttacagtcacaggcatgcacaggtcgtcttttccaagtagctgtgtgtgtgtgctcctgaagacctgtgcactctcagcgacccattaggccaagagtaccaagccatgcacagcctgccaggagccgacttggtgcaaggagggagaggtggctgtttgcgtgtgagctgttagggttgggcgctgccagaaacttagaaggtcatgaagtttcatgttggagaaaccagagatcagaccttgttctactgtgtgactatggctcagctggtcaacctctctaagcctcagtttcctcatcttttacagatggggctaacaagagttgtcccataacaaatgattggcattaaggaatacagtcagtgtaaaacacgcagctttctcgtagcatcactaaatactattcatcgtgttttggtcatggagagccaccatggagctataagattttatacagagatgtggagtgtgtatgagggtacatggcaggcacatcaccctggagtgagatgtctgtgggattttgtcttgacagatgcctccatgggcattccgaagtcagaagagtaagcttcttcccagaaatggaagctgtcatttccacccaggtttcagtagcatgtgcgtcactggctgcgcctcctcatcccattttccaaggtttgaatcctactgggtggcccagcaggggccccctacagggctcagggctataaggctcttgaaattaagacgtggaggaaagggggtgttaacgaagagcgtatttcatcccagcatgtatggctggttctgaaagttcctctgaccccacccttcaaccagtggctgcgttgcgggtaccactaagctgatagtaagtatgacaggaagatacaccatcttttgtttcatattttattttctcaatactgctataaaaagataattgtcacaaaaaaaatccttcattcctttttccaggggccctctttatttgttgattttcaaattattcctttgttaagggccttttctgtatcctccttgttaattttctcttccattgttactttaatgcaccggatccttggttatcagcgggtgtgcataggatgcaaacagttctctctcatcactttcattaacttcatgaaattcttctctaagatctgtaattttactttaagcagtttgcattttgtagtcagaggtttacagcagccaacaaggagcaggaagtggagtggagaaaaacgttagtatgacaaagttggagacagacagaccagcagtaacacaggagggatgtttcagaggagactagttttataaggcccagaatatcactctattctagcttctcaaaagattaattatcagataataatgacctgtccccctacaccagatgagacttgctcctaacagaacatttaaagtttcaggtaaattatctttccaagtgctgtctttgtattagttcctggagttgatgaaggtggtcagaccagagacatttatgaagtacttacataattcttggcatgctttcaatgtttaagacttgtcatagtccccatgtattgatctaaactcaggaatgcaaaagctattctcaagggagcctggtaagagattgtgtctgctgcacaggtccagccccagcccctaaattaatcccgctcaattcaaagcctcctttcttccaagttagaagtgacaggccaggtcctctctcatacaagcagctctcaggagggctccagctgagaaacttgctgtctcatttgtttctcgaacacacgccccatggaatgcatgtgtcatttctgtagcataaggaatgtgcccgcacttcatgcctcctgtctgttcgttagttcgtaattaagtatgcacagctacagatgtgtcgcggaaagacatcatccgagtcttgacaaagaaccaaaattattcatataatttatcatcccagccatcttgaatgctaacgagaaccgtccttgattggaattgtcaagaaacatttgcacccatgtcctatcagggagcatttcctccgccagatgctgcctttcataccaacgacaaagactctctcgtgctttctccctggcctttacagaaaccaaatgcaataaaacaagcagttctcccttcccccttttctctgatgcacagttttccaaagggcttgcagttttcaggttttctggtgaggggcattgcaattgttagcttgttctttaaagcctgttgtgagagcagtaacacagatctgtctaacacatgttcctagcatcagagtccagggataggtacttagatgcaagattcttttctgctcttagatgcaagattctcttctgcccagaaggaaattcaggagtgtggaaaccactggctgtttgacccaggtccacccaaaagtgacccagttttggagaactggcttgctttggggttttgctcagatatgaggacacactcccaaatgtcatttttagaggtggtggcacatttaggagactgaagagtcagtgttctgttaccgggatgaaaaggaagaagcaatgcatttggaacatattggaaggaagagatatagctccctgggaagagccttcaatttccaagccctctttgcatccttagggacagtatcagtgcttctttgggaaaaaggagagatctgtctacttattgttttgtgcactccccaagcctgctgtatgtccatctgcaacactaacttttaattcatcaagataagtaggttttgaatgtagcattttgtcctcatattcagtgttcataagttaatctgcaaattgttgttttgattggaaaatgcattaagcacaaacccatctgattatccctgggctagaggcttggtcagacccccaggaagagggctggggtcagagaggtctgacaatgaaatctgttgcagagagctctggtgggctccagttctcagcaccagagttgtgcaaggcttggggtggtctggaaaagcttcagaaaggttaccttgtgaagtgttctaggaactctgaaagagactggatagaactgaatgttcacacaggaagtggttatctccctgtaagtgtgtattattataattggccaactttttcacttcgttacccagcaggagaaacagcatacaccaacttcactagacttttgctttcaaagactccctactcacataacccgtcaatccacctggctgtttcagaggtaacttcattgtagagatggagagcctgagactggaaggtaagaccaagatgcacaattctctctcaatttcttctttatctttcccactttcctactttcctacatcagcaggcagtggcatcacagccttatcctccctcagaacctaaatcagacttatcagatgattctgagggttcagttaaccctgaaatttccagacagaccactgctcccccatagagtatctggggtcatgggtagctctgcttttaagcattctatccctcattcactgaggtccagatattaaatcagcactcaagatagtagagagaacaggatcccaccatacccacagcaattttaagggtggcatggaaatctgcctcatggaggtctgaagtgcaaagtacatgtatgtgggagaggcagatggagacaggaatgatatgttttattaagataggaaaatgtggataaataagtgagctcactcataatcctttcccaaaggaaagtcataaggctagacaaattcatgcatgtttggtataaagcaaaaattagaaactttcttatcaaaagacaccataaaacacaaaggtaggaatatgaagccaccaactgggaaaaaatgtttgcatatatataattggcagaggattagtatataatacaaataaagaacccttaaacaggtggggcgtggtggctcacgcctgtaatcccagcactttgggaggccaaggtgagtggataatgaggtccagagatgagaccatcctggccaatgtggtgaaaccctgtctctactaaaaatacaaaaattagctgggcatggtggtgcgtgcctgcaatcccagctactggggaggcagaagaagtgcttcaaccaggtagtccaaggttgcagtgagccaagatcgcaccactgcactccagcctggtgacagagcaagactctgtctcggggaaaaaaaaaaaaaagtacccttaaacaaatgagaaaatgtcgtgggaaaatggcatgagcagtcaatttcatagaagataaaacatgaatggcccagaaacatgtaaaaagtgcttaaccaggtgggaagttaagaaaatacaataaaagacaattttactcctaccagacagggaaaactgtgaagtctgacaacttcaagtgtaggtaaggaagaagagcaacagaaattctcatgcactgatgatgggatagcatattgatacaacctccttgaaaaatcatttgttattacctagtaagttaaatatgcacctactgtctaaccaagcaattccactctttaagtatatactgtaggagtcgttcttaatgcaggcattaccacaccctagagggagtcttggaagcctgcaaatgtcacaatgagtaaagagtgctactggcatttagtaagtagagcaaggaatgctaaacatcatatggtttctggggcatttccgcctaaagatgaattagcctgcattgcacatgactacatgtgggaccacataatttatgcaagtgaatgtctgttgatacttacctgatcctgcaatctaactctaactttattttacatataaacagttaaaaaaaaaactcaaatgcattgttttcctgtctttaacatattgaatttttcaggaaggcaaccacttttctgaaaaatattccttttattgaagggatattgtgctttctgttgttattgttgtttagaactttaccaagaattgattaacattatagaaaatcatttctctgctgggaatctcgtacgtggtatttgggctatcaacccaaaacacctatgactgtttgcatttgtagctggaacaatcatggtaattctacccacaggtgcaaacatctgacattgttattctagcttctgatgtaattgttcctcaaattttacatactggtccaaccaccttttattataaattgctttgtcttatttcttttttatatcacattcagagcattacattgatttcttaaaattctgtgggtaagtgggttatagtacatgatctatagtatagatagatagcattctatctatactatagataaaatctataccatagatagcacttacccatagaatttcaagaattttatttcaagatagtaaaaagaacatcacaaaatacttgtcagaagggtggtgctggtgttgagaataataattcttttggggtatatgtaccccaaagccatgtacaaaagggttaacagcagcatgactaataaaagcaaaaaaaggcaaaaaaaaaaaaagaaaaaaaagaaaacccaaaactctgaaaacaaccaaagtaaccattaacagcaaactggataaatgcatgttatgaaatactatatagcagtgaaataaattaacagttatattcattatgatgggtaaatttctgaaagcataatatggagcaaaaacagcatattgcaaaacacatatatagagtggaaacatttaaatttcagtttcagaaatgggcatgactaaatatcctatttaggaacacacgcagtttgtgaaagctatgcagaaaattgaagaacagtgaacacaaactccagggtaatggttacctggaaggggagggatgagtctgggaggggcacatgggatgatgttttctttcttaaactggatagtaggttcacgactgctcattttattattttaaactataaaaatattacataccttttaagacagaacatatttcacaatttaaaaacttttaaaaatcagaacctcccaatctatccaagcctttagttgactggactttttaaaaatcccatcttagcttgttccaaggattggcagaaagacaaatgaaactgccaggtctcttctgggtttagtacgtactctttgtagcactatgtcctggcacctgtctggggacgtctggccaggggacactgttgatgccggaatgaatcatcatgttgatgttggaatgggtctcagcatccctgcagcctcccaaaggggctatccagcctctggacaccatgggggctagcatctgggagaattcttgcagcagaatcagaggaagggttgccgttgccatgagaatgcagtcgcatctcaggggagttctgactgagttccttggccctgagtgatccattctctacctctaatgggtcacctgtcctcctccattgcttctaatgtcaactgcacaggtgcccaggcttacagaggctccaccaacccctaaggctgcggggtggagaccaggtttggcaaggcagatatcattttatttgagggattttgactaaacgggaagagggagaagctgcatattcagaatgaaaatgagagctgataacagtgccttcagcgggctagccacttgctgggttctagaacaccgcagggatgacaattctcaacctgaagaactcaggctcccccgggatcaaatccccatgcactgcaagcttctcgccagcaggggctgtgtctccatgccctggtccctggcgctgagcttggccaattctaggtggttgcagtcttgaaggaggcacattgaagaagtagctgaaagaggaaggcagagcagatctaataaatgacaaatcggtggttcagacactgcgagcaaaacaaagacctcacgttgggttagagaggcctgaaagggtctcctgtagaagcagaactagaaagaaaggtgggtatgagacgggtgcagaaggaggggctggggtcggggacatcggggtgtggaaatagagaagaaagactaggaggtgggcagacacggggagctgccaggcatgaggggcaggcagctcttgcagtcgatgggtgacatgttggctactgccacatcttgggggccttagatgctgcactgagggtccccggtgtagttttgcaggcaacaaggagttgtaaacgatgtttttgtgtcccgtccctggcccagctcagacttcagctgcaactctcctgccagggtcagctcccacctcaagcaccttctgaatttctgtacttttcctccctgggcccttccccatctctgtggagctccctctgctgcttccagcaaaacccagaagtgcagcagagtttttggcctgggtgggaacacatgcccaggccccatgctgcagagtgggcatgtcctaggcacggaggagcaggttttcagaggcagctcacagaactgagccccagtggccgcaggggtgctggctccagaaggcacgctggtgggacattctcccctttccagtaggctgcctgctccctcactctgccccacctctcaggtcctggcctctggcctaggtttcagggaaacccgcaagggaggaggggccttggacatccaggggagggaggctcctggagatgtagccaacagagatgaaactgtgaggagagaaggacagtcagaggccgccaagggctgtgatgcgggcagggcaggaggcagttgaggttagagacagacacagccagacagagacagggagacagagagagacagagacaagatagagaaacagagagagactgccagagacagggccagacagtgagaagacagagacagacagagagagggacagatggacagagagaggcagagacagggaaagatagatccaaagtgacagaaacagaggaagacagagactgggacagacaaatagaagacagagagacagagagtaacagacggccagagagagacagagacagagagagtgacagagggccagagagaggcagacacaaggaaagatagaccaaaagagattgaaacagagaaacagagactgggacagacaatgagaagacgagagacagagacacagagagaaagaaagagatggagagacagagacagagagtgacagacagacagagagtgacagagagacagccagaagagagacagagaaacagacagaaagaggcagagacgagaaagagaaacatggagagacagagaaacagagagcaacagagacaaagagacagacagagacagggacagacagtgaggagacagggagagacaagcacacagagagaggtgccaagcaggctggagctctggagcttccagaggcctgggcaggttcagctctggagagacactgcagcttccctggcgaggcagggctgtgggcactgggctgtccattgtagggtggcagtgctggttctgcctgtggggtggctccagcctggctcctgggatggtggcagccccaggggactgcctcattctgccacctgcccattccctggctctccttcacctttgtccctcaccggcagcagaagcacagatggctgttccgtcatccagcacgtgctgcggtgcatgtcacagggcaaggtgctgagcagctgtctggtccccaacacctggtgacaccttcacaagcacataaatcacactcatcttgaccaacacaaacacattcacatgggacagatactaatgttaatgtttaacctggaaagagccatacccagcgcaatcggtggtgctcaggtcctggaatgaggcagccacggggaaccctggtgcacagggacctaaatggaatcactagtgagtggtgaccacggtccaccccgtctctcactcccctgatttcacaccctaggcaaggcactgagcctgggtttcctcttctgtggactgggaacagcccagaaaattgctgtgggcctctagaggggtcatgcatgggacacagtgagcctgggcctgccgcacagacatgccccgtggaaggtggcttttctggcggctcaggctcaaccatacccctgctgccttggcaggctttctcagttctgcgtagctgtccaacactccgaccactgtatgcggctcagtctccacttctgtgagatgctctgtgacctggtaggaccggccacccctccgagccccacacgctgccctgtaccgaagctttgttgcatacaattgcaaatctgtaaatgtcactgtgtccagtgggccttcattgactggccctgtgtgatattttattttgccctggttcattttcttcagaacctttattacgacttgcaatgagctactttttttttttctccatctctggtactagatgctgactccagggtggtggccgggaggttctttgttttagttccagatctccagaaacagacctgagacaaaaatctgggtgcacccaagacagaaatcttgggtgggaggtgatcccaggaggcctgtgagggagcaggaaaccaggtgggaggagagagaccagggtcccaccgtgggtaccaggactcatctgctcaggagagaggctgtgtgagacacacctccaaggtgtcctactccagaggtgaggaagccagtatttatttaccaggccccggattatctcagcatctggacatctgtgccaggtgggcacctgcccctcccctgaggggatgccttcccacccctcctcactccggcctccacggatcttctcacttctcttggggtgacgatactattgtgtctgccttccagtctcttttggtctctgggcacacagctcaggagtggctcctgaggacaggccccgcacccggggaggggaggcagatgccgcactcaaagacctgtccccaagaagtgctccatgaacaggatttggggaaaaaaataaactccagggtgacaagagctagaagaaggattgaggactattccatggggtcacctagatctgggggtgggagaagcaaggaaggcgtctccaaggaggggcaagggcctgggtgtgaaatcacacaggatctgtccccacatgaaggagaaggagacagggagatgcggctggaggaacaacatggatggagtctgtggggccagggggaacaaggcatatccaaggacagctagagggtgcagtggggggcctggagggagggaggcagcaggagctcggtggggccttggccacagtctaggtacttgggatcaggcctgtggttgcctgtgagctgctgaggaaccttacctggtaggtgatgtgataggaaatgcttgatttaagacgttgatctgtttggcagcctttggaaggagggcgggagggcgcgtgaagggacacagatgccccagccacggggtggcaggtagatttaggtgagaggtgggaggtccttgtctgaagccatcttggggatggagaggagagaggcaaatgtggacactcagccctgggcccaagaagatgttccactctacatggagagacagggtaaggagaggtaattcccggctgagggggcaccgagcaagggcatggaggtgggagagcccaggaatggcgggagccttctgctgtgctgccgagtgtggtcacgatgaagactgacatccggagtgtttagaaaccaccgcagccatttgacagagtcatggagtatgactgttcaatccaataacatgaaattgggggcttgtattttgtatggcttttcttttaatttcatttttctcataattcaagttttattgaattctgcaaaaatattggcccgtgactgatgggaaacaaaacacctggtctttctctgcagctggtgggggttggggtgggaggcgcgggttgaagtgccctccccatcagctcccataactctgcctcatcccagagttttattttttcttcatgccagaaaagtccctccccacactgatgccagcaagccaagcaggatgtccccacccccaacgctctgtccccagattctcctagccccaaagacatatcttagctcagatgaggtagagaccccctcaccccagctcaggctgaaagcgaatattgttcagtctcttatccctggggccaagcccgtgtaggaggattgtgtggtgaccgcagctggcggctcccaacctccagtccctgctgtcggcggccaaggccttggaggtcattaatgtggatcggcactaatggattctctgtgctggctttgtcccccagcgctatttttaactcattttggactttgaattgtccaaatgcattttgatgtgtttgtgagaaaggacataaataaacccttgagtgttgtttctgtgcagctcctcagaaaccaacttctcatggctctatttgctttgctgagagctgagcatttcctgcaacttaccaagatgggctgaggcctgcccagcttccagagtggcacctccacatgtactcatttcagtgccactaaccaaagcagtgcccattctcctggtagagtttcagggggaccccctctcacccctgatcaaagagcatggcagcccagtagctgagtacctcctgtgtacaggcacctgggagcttacgatggggcaggcactgtgggaaaagcaaaatcagaggccgacagtcccgtctccaagatccttcagtgaactgcggtgactgtgaacacacaggaaaccaagaggtacacgcccacaggccaacccctggtttggggacagccaggcatttatgaacacattcttcaggcagtgtttggcctgaatacatgtgctgagtccctgcctgttatctgaagcctgctcaaaggcagctaagatggaagatgtggcaggtggctgtgcaggcagcatatgccacaagccacagctgtctctttgacagtggccagggcttccttatatgagcagttccctaagtcactcaggtctggaggccagggattctggccatgcttctcatcttggccgggcccccagtgcagcgtgggcctaaaccatgttctggattcctttaaacacctcctgagcgcttggtgtgctcaggacttgagccagccttggggtcactgagggagtagagtccagcttgtgtctgggaaggtctcctgttggcagaggagaaggtcctgagctgtggacaccagtacagggccgtggtccagcctttggtgctgcaaagaaccccacctaagtcactcagacatgacactgtcttgaagacggagaatgaggaatggagccagcctcaaatgtaggagaggcgctaactcaatatctccaatcagaagaaatcagaaggttccttatttcaaaaatctctacacatcaaatgccgtgattggcccaatggctcaccagtcttcagatcaagtgtagcctgagtgttcttttaaagtgtggctttctagtatagagaatctccatgtcccatcacattggtttggatgtgtttatcaggctcattcatctctcatgagaacgtgtagagtttaaaaatctctaaagaaatccctggacgtaagctggtgtcttgggcttgggtagtaccagataaaacgaaaacacagacagatttaacatgcttaggggcaagcatttccaggacttggggatttattgggttgggagtgagagggaggaagacactgactatgattcctggcttccatcctgggccccctgcaaatggtgattatgaagatggtgggttggataggaggttctgagttccactttcagcatgctcactctaagtggctgagacgatggccagtgaagagtgttgggtctagaagcctgaagctacaggtccggctatggagctggatttggatgtggttggcacagagaggacacgaggccatgggagtaaagaaaatctgcagagtgcgaccagtataaacagagccgcatgcattttgccctggaaattctccttctaaaaatgtattccaaggaaatcatcagaaatgtgcaggaggggaggcttaaggataatcatggcagagttatttgtgcttataaaaactggaagtacccaaaatttccaacaagaagggcaaagttggattttgttccaaagcatggaatacaacctagccacaattacatcggtccatcgtggtgtggaatgctcaagtgctgggaggagcaagccagttccaggaatgcacaggaggcaatgggtttgtgtaggcatgtgtgcatactcacacagaaaacatcctggaaggttacacactgaaatgttagttccgatgatctgtgagtggtaaatttcaagatgaattgggattttctcattttcttctttcctatatatttttttctttacattgattctgagcctcttttaatgaggaaaaaaaatgttttgggtaaagcctcccttttggttcactagagacagcaccacagcagagctgggaacagttgtttaaacatccccctccctgactttaccttgggtaaatgggcctctgaagaaattccactgagaggccccctgccctcacattacattgtcaatttcatcctgagcactctgcgtaaataccattccagagcattaggtcgcagccattagcatggcagttatgtgccagcttttcctctcagtttacagcccttatcatctgcaactctgctttaagaacttaaaattatggtccgaccgtagcctacataaacattcaagaaagtcttaccatttggagagctgtaaaatgaatctgacagtgtgacactcacgtgcagcttcataaagtgcatgctaacgaatcagctgtcctgtcttcccagaagcccccagagcttccaggagccaatgtctccttggagcaatgctcaggagccattgaggccaggcacaagcacagcctgcacagccactcatgctgcttttcttgggatggaaaaccagggccttttctggactctaacagcatcgagttatagctcaaaagttgctcaaagtatcctctgccttaatgatcccagtatctaaactgaagcttcctaaacttcccaaattaaagacccttcccattgccacctgccaccagcagcactgatgaaatgccctctggcactgaaaccatcggtgtttggcataaacacaatgaaattcttgtttgcctccaaagtgtcttataaaagcttatccctcttagaccatggtcccattctcctgacaatgtagatggtacaaaaagcagccatccatcccgaggggctggcccagatcacacatcatggatggcctgtggttctgatccagcctgcagtggcaccattgcatatttacattttggatttttactaatttatttatttatctgttttttcgagacaggatcacccttggttgcccaggttggagtgcagtggcattattatcacagctcattgcagcctccaactcttgagctcaaatgatcctcccacctcaggctcctaagtagctgggacttacaagcacgtgccaccatgcctggctaattaaaaaaaaattttttttgtagagacagggtctcactatgttgtccaggctggtcttgaactcctgagcaaaagcaaaagcaaaagcaaatgcctgggcctcctaaagctctgaaattacaggcgtgagccaccacacctgacccttcaccaacatttttaaaacttagagatttcacagaaaaaccacaacattcattctcttgagaaaattgagaagatgtgaaacactgggcactttcgcagctgctgcaccttttagacaaagcatatgcttcccttcgactgctgtgcaatggaccaaatgcttgtgccacacccacccccccacccaaagttcacatgctgaaatcctaactcccaaggtgatgacattggagctgcggccttcagtagataagcaggtcatgggggtgtgaaacctcataaatgggattagcgcccttacaaaagagacccccgcccccacctaaagagctccctccctgtcttcctgccatgtgaagatgcaacaagaaatcagctgcctgcaacccgaaagagggccctcaccaaaacctgagcacgctggcaccctgaccttggacttgtagcctccagagctgcgagaaataatggttgcttgttagagccactcagggtatggcactttgctgtagcagcccgaactgaccaggataccctgcctacctggcccatttcagccctgaactgaccaggatgccccgcctacgcgcccgtttcagcccggaactgaccaggatgccccgcctacgcggcccgtttcagcccggaactgaccaggatgccccgcctacgtggcccgtttcagccctgaactgaccaggatgacccgcctacgcggccgtttcagccctgaactgacgaggatgccccgcctacgcggcccatttcagccctgaactgaccaggatgacccacctacgcgggcggcccgtttcagccctgaactgacgaggatgccccgcctgccccgcatatttcaaccctgaactgaccaggatgccccgcctactcggcccgtttcagccctgaactgaccaggaggccccgcctgcctgaactgtttcagtcctgaactgcctggactgtttcagccctgaactgaccaggacgcaccgcctgcctggactgtttcagtcctgattgatgcctgtgcagctttgggaggcatgaccgcacctcctcctccctacacaccccagtgggggaagaggagagaaaatacgcctcttccctggctcttcgctggagtcttagtgatttggtggagatttccaaggacaggcctccgggagctcagcgccgccctcctgttactgggcagttaggtgtgggaaggaacatactgacaacccatttttcttcaggaaaatcccattcaccacccttgaccttatattgctcagcccaggggtgtacatgggggaagtggtagtcacagggacagtaaggcaagcccagtctgtgtctaatgactatttcttcttcagatagttgagaatttaaatgtgaatgcaaatgttacgcaaatgaaattactcctaagacaatttacacagaccaactattagatcagaacctcctgtttaacacagcctgcccaaaataactgagactattccgatcttttgggcaaggatgtcgacacactgccagtgcctctggagttaaagtggagcgctgtctttgggattgggagccagctctggatatgaacacggctatctggcaggctttggcctgccggagagaaatgtgtcttgtcccatgagaaagacatccccaggctcacctgaggagccagaattgctggtgagggcccaggtgtctctaaattgattgctgcctctgatagactattctaagccacggccatctcgtggagaaattaaacattctgtgtgaaggacatgcatgtccttaacagaacagtgaagttgctgatgcatttttattctcagccaccctcacggcaccccagtacctaccccatgtcccagcctcatggggccttgctctcatctgcccattagctaatctgggctaagaagatgtactgcacaaaaagaaagaaggaattcaggcttttaaatgaaatgcccaatttgtaactgttggctaccaatgcaattagttagaaggtagttctcagacaggtgggacagttcttctcctaacaagcatgtgtcaaagcatgcttgtttcttctaacgttttgtttttctaaaaaagtgtgctttcttcttctaagaaaatctggcaaataaaatgttattctcctcatgttaactggaagagtcccttgcctccaaatcaattctatccccaaatgttgaaagacttgaaattccacgagtagatcaagggcatccccctgaggcctttactatgggaacagacctcacccccgctgctgtggtaactgtagggacccgcttcactcatgctgtcccttggcttctgtagacacttgagtctgcagcctcagaacagggctgatctcaaactgggcctcagtttgaggggtttcacccacgagtgactggaggccagcactgaaggctactgtgcaggactgcactctgtcacaggatagacctgctacatccagaggcatcccacccctgttcatctcatcctgggcactgtttctgctcagttctcaatggcaggcttttggccctctgaagtcagagaaccaaacccactgagaatttatttcttctcattagagatttctggattccataaataattaattcagaaggaagacacacactcttctcaaatgggaggttaaaatcagggaggactccttcccaagcttctaggtccatctgttgccatcagtggagatgatttggaaactgctttcaccctgattctggggacttgagccatgcagtcatccctctagaaaagactgcagggcaagttagagaccccatatagagtgtgtgatggtcaattttgtatgtcaatttgactaggataagggatgcccaaagagctggtggaaacttatttctgggtcctttctttctttcttttttctttctttctttctttctttctttctttctttctttctttctttccttccttccttccttccttccttccttccttccttccttccttccttccttctttctttctttctttctttctttctttctttctttctttctttctttctttctttctctccttctctccttctctccttctctccttctctctttctttcgatgcagttttgctcctattgcccaggctggagtgcaatggctcaatctcagctcactgcaacctccacctcccaggttcaagtgattctcctgcctcagcctcccgagtagctgggactacaggtatgcaccaccatgcccggctaatcttgtatttttaatagagatggggtttctccatgttggtcaggctggtcttgaactcctgacctcaggtgatctgcccgtcttggcctcccaaagtgctgggattagaggcgtgagccaccgtgcccggccatttctgggtatctctatgcaggtgtttccagaagagattagccttagaatcaggagactgagtaaagatctgccctcaccaaggtgggctgacatcatccaatcattgagggcccagatagagcaaaaaagcaaaggaagagtgaattctctctcttcttgagcttaggcctccatcttttcttgcccttagacattggagcttcaggttcttgggcctttggattccaggacttacgacagtgccccttggttctcaggcctttggtctcaaagtgggagttgcaccattggctcccccagttctcagggctttggactcagactgaactttaccaccagccctcctggttctgctgtttgcagatggcttatggtgggacttcctggccttcataatcatgtcagcaaattcccaacataaatctctccttatatatataactctagctatcc

SEQ ID NO: 507 - DNA, 75226 bp, Homo sapiens
ggagcctttttcttctctgggcctactgtaagcgccccagtggctggaatggaacggtttccagtctggaatggttgacactaatggccaaagagtagggggtcccacgtgcttggttaaaaggtgaaagtaaatgcgggagtctggaaggacttcctataggcacaaaatctgccccctcccccccaactttgggaaatatggattaccaacaggtttgtgtcaactcagtgtttcaagcaccttgcaagtttcagtttgcgaagaaaagactttggtgagaccaaagccactgcttttaaaattgtttaaaattttacaattagtacacaaaagggatttatactatgaataaagacttcttgggcatttatggatcataagttaagaacttctgcactagagatatatagagtacagtacagaatacagtacacagatctttctgggacagaagctgtattttagtttggtcagtatcttatggctaaactgttatgtgaatgagaagcaccagcatattgtatagtgttccagtaatcttctagggggttggtttggcatgccagctttctctgaaagagcacaagatatacaatgatctatagaaacttggtgttagtcattccacaggaatcattggattcaggcacagcttgacgatagagtgatcaaagggaccctgagtaagagctaaaggaagagaaacctttgtcttcaaattggacttttagaccatgtaactcatctagaatgagagcaattaatcagtgaggcaaggaatactaacatgattaagaacttagatccaagaacttgtgacatgaacacagaaatacttacagtataggtcatagaagtattttggaaattcagagaaaaaaagagatgacttctgactagatgaaaattcagattaattatccagcaaatgacaaagtgccacaattctgatggtacttctctttcctttaatgaaaggtttgctttatgggtaatacaggctgagtatttcttattctaaatgcttgggaccagaagtgtttggacaagaaatgaatcctgccaggccaaggcaggcggatcacttgaggtcaggagttcgagaccagtttggataatatggtgaaacctcatctctacttaaaaataaaaatagctgtgcatggtggcacatgcctgtaatctcaggtacttgggaggatgaggcaggagaatgacttgaacccaggaggtggaggttgcagtgagctgagatggtgcaccattgcactccagcctgggcaacagggtgagacactatctcgaaaaggaaaaaaaagaaatgtatcctccccttctagcccatttctccaatgagcgtttccctgagtgtcatggtggtgctcaaaaaattttggatttgggagcatttcagatttttgggttagggatatacaacctgtaagagaaatatgttgtgaaagcagcagtagcagtgaattgacagagatgcatcaaatccggatcttaatactggtttaagtgagcattcaggtgactggtgggatcaggattcagtttcagatcaattaattgcagaatttgaatttgagtctctcggagtttacagccttaatgtagaacaacaagaattctcagatgaaggtgatgaggtgtgtccagttactgattattagacatggggagagtggtacagattcatttgatgaaggtcctaaaattgccttagctgccttggacatgtactttattaaatgaaattaatcctcctcttctaggccatttcaacagatgttgggccctttgtgagaactgacttcctgaagacaaagtgatagagggaaaataagctcaacctgagtagaaggggctttgatgctcctgattataaaaccaaacaaaaaacctatagtgaattactccaaagagtaatatgttcatgtgtggaggaaaatgatgagagaactcacatcagcctcccattcccaagagaccgagcactgttgtcagccagcaacttctaatagcatcatttagagctgccaagaaaatgtcaaagaccttgagtggaaagaaacaaacaagaaagaagaaagtgtgaatctagttttctccttaatgccattgaactttgtgtgctttaaagcatacaacctaaaaatggttgcatcagccatggcaataaaggacatctaatggaatgttttacatgtgcaaaaaagctaaaaaagagatgagtcagtgtaaagacagccagttcaaatgattctgcttacatcccctagttggcctgttcataaaagtagaatttctatctatataactctaaatattagacaacataaaaagtattattaatttttttacatgtatcaaagcaaaaaagtatcttagcccatgtgcatttattttcttttgttcagtttacctacttttctgggtggggggcagagggtggtaataaatattttcttccttttaggaaaaattttatttgtttatattttatatttggggttcaatgtaattggaattggatatatagctcatcctttacacctaagcccctatattttaaatcatgtctactttcttttaaatgagaagtatctgatttttgaaatatgtatgtgtttggggggatcatttaaatgtaacttatttaatacttttcatgtaagaaggaaaagtttctgtgaaaaatttaatatttaaattttagatcttaaatcttctcatctttagtttctctgctctttcagaggctcttaaaatactcttttgagataaaaaataaattggtagttatatttggtgctatgtaagtaaaaatgtacttattttccagtctcttcagtttggaaaggatacgtggtaatgatggtgtcaatcaaggtatctttgagaatatccatcatttacccataagatcaaactttttaaggccctctaacagaatatggagttgtcctggggggtccaacctggtatccaggccctttgtcacacctgatctcaggatttagtgaaatctattgtttctcctaagtggaaaacagttctaagacatttgaaatttactgggctaggttccataattcctggtagttgcctaggtttctgacccttacttaaggcaagtttagaaaccagtgaattcagaaagataaactcagaaatttgataaacagaaaatttgttcattttaaaattagccagaaaggttacaacttctaagtgaattacaaagtactcatcactttcctttaagaatcgtaggttcagaacacagaattctaaaatatctctcaaactgtgtagattaacttatttacatatttatatgtgaatcttcagcaaagtagtgcaaataaccagtgtgatttagggtcccattatttttcctccatatatgatcattgtacatatttgggggtggacaataacaaactgagctataagtttagaattgaactgaaggataatttctcacaccaaatttgtgtgccagttactaacaatacattgttcttacaaactttaaaaatgaaagccacacaaataaataccttacatatgtatacatatttatgtagaagatgaatggttgaacagaactttagccaaagagtggtcctcaactacaggaaagctttattaatttgaaatttataatatttctagtagaagtaagtaaatttatcctgaggagagtgggtagtataaatgagattataaaccatgtataccctgactatatgtagcagtgattatgccatttacaaaacatttaaatatgggtgcaaatgtagtgtcattacacatgcctatggattactaaagtactcttgtctaaatttttaggtttaatatacatatactatttattgatttacacataagcagtttgatatggtttggctgtgtccccatccaaatctcatcttgaattgtaattcccataatccccacatgttgtgagagaggcctggtgggaggtaattgaatcatggaggcagtttccccatgaggttctcgtgatagtgagagttctcacgagatctgattttataagcgtctggcattttccctactgccactcattctctctcctgacgccctgagaagaggtgccttctaccatgattgtaagtctcccaaggactccccagccatgtggaactgtgagtcaactaaacctcttttcttcataaattacccagtctcaggaagttatttacagcagtgtaagaacagacttatacatagttttataaagtgattaagaaataaatgaaagggaaactattaatgattatgtaaggataacaagcattaatgggccaccctacttttgactctaactttttgacatacttattcacagtggtacacccccagttcttataatctggaaaagctctacttataaaatataaacactccagtcttttactacagctttctacactcccagttctgttttatctcaacctgcctttcttctgaccaagacctcccccttctgttcattatatgttttctttatctaaatcataatctactctcaccccacatccttcttaatcttgaatacatttcaatttagccactctcttacatgttttttcacttgttctattatcattctcaagaatccatctcacagaacgttaattctggatcaagttcattgtcatccttccctaatcaagtgaggtgcattgtttagagaaaaaatagagcctcaaaaagtactgttttttcatatgtatattctctagcatcaaattggcactcaagaccgacaatcctgtttcctcagtactccatttctcactgtgagtacagtggctattttgagtcttggccatcttcctcaagccttctactcatcaactctgtagccgatttggaactgatcatccagcttcttatttctgaaaaaatatatgctattaaaatatgatatttgtcagcactaaacacccaaaggtaaatgtgcctgttctgtctcttacattcaccacagtgtaagacagtcctacttccttcaaaagattaattcattttccagagttctagagtttatagccttccatctcccaagggaccttgctacattaatttttttcctttttctgcaatgtcttcaaagaaaaaaccactagctaacattggttaagggtatattgacacacattcacagatgaagaaactgagatttgtcttagaaatgtccccaactgagaaatgcccgaagtcctgctctgcttgaaaatgcaagagctagaataaagattaaaatgagttatccatagatagagaaaagatttgctatcacatattgattgaatcacataatcatttaaacagcttcaggtatttctcctcctaaataaaataccacaaaatgatctgggaataattgtctctgtctttcacatgtcccaacaatctagctttaccctgctctgtttccctgacaccttgattgtgttctgcttctctgtgagctccttgttgtcaataacacttcttcttgatgtttttaatcactcattgttataaaaatgctctttcactgagttccgtggccccacgtactttgtctttccttctacctctttggctgctccttcttggtttccttcatgatgttctcctatttccttaaatggttcttaattattgattctcaataggatttggtccttgatcacttcatctattgtgatgaccttgatatgacctatttgctgatacttcccagaaatgctgaggaagatttgttcaagctttcattcaccaccctcacctctcactctcacctgcacacatagctattcttttcttaacagcccataggtacggtgtgctgcaaacttttgagttagtaagtggccctgtaactgaggaagaatgttggttgccacagtcctaactgtaaaatgtgtaagcccgttggatcctcaatgtgctggtctttcccatccccacttgtgatgcagactgataaacagattttcacgctggtccattttaccttttcatcatctccctcattgttactggtctaaagttgaaactattgttttctgcagatgttttctgcatttgatgttgtagatgtccagatactagcttgagcgatctgaaaatttctgccaatttgtgagttaaatggaagaatggacagttctcaattttatagaatctatgaaacaagagttgtaaatagcaatcttagaaatttcctgattgaaggctgaggtctgtggatcctccaactggcagagctgggaactctaatctcttgcttgcattcctggcttttctccaatttgaatttgtaaaaatcaagggctctgcaacaaaggtactctctgtggtaagtcagcaatgaatagtgttaaatcacagagttaccttagtttacctagtgagcacacctggtttcaaaaccagcatgcatgtccctctccttttagtggctagcagaaaaccagtatgtactgtagtgaacaagtgttggatatatcataagcacaatttgctgccatgttcttggattggtcttgaggtaaggcaatttattcattgaaggaagaaaaggtctaggttagagtgcacgtctgtttaatttgatgttgattttcattttctgcccacccattgtcctttcatttccctattgtactattttagttactatagacttaagatagaataaggaagaaatggcgtatttagtgaaagtggaagaggaaagtacagataaaaactaaaataaatgtaatgtcccagagattttcacgtagacctctgtatagtatctatattactgcacagatcagtagttactttgcagtgaggacctactttttgtcattggcttttgtttggtgttctttggtttggttttgtttttctgagtcagggtcttgctttgttgtgcagctgaagtgcagtggcatgaccatagctcactgcagtctcaaattcctgggcttaagcaattttcccttctcagtcgccaaagtcatgcatgttacaggcatgttgggaggccgaggcgggtagatcacgaggtcaggagatcgagaccatcctggctaacatggtgaaaccctgtctctactaaaaaaaaaaaaaatacaaaaaattagccaggcatggtggcaggcacctgtagtcccagctactcgggaggctgaggcaggagaatggcgtgaacccgggagatggagcttgcagtgagccaagattgcaccactgcactccaacctgggcccagagcaagactctgtctcaaaaaaaaaaaaaaagattacaggcatgaacccctgtgccctgggacacactgtgcatacacatatatgtgtgtgtatatatatatattatatatgtatgtgtgtgtatatatatattatacacacacacacacacacacacacacacacacagaggacactgatggggatgcaataaactactttggaaataaattttaatatggcaacattcatcaaaatttcccccaaatatatacacatttttatccaagaattctttgtcttaagaatatttatctataaggatgtttatattttactgtttataatacaaaaaatccaataaataccaacttaataactacgtactatttaattatcatatacccatattgtttaatacaattcagtcctgcctgaaaatcagaataaaaaagaatactaaatcattcaataatgtaattttatgtgcaaaaagaagcatatagaactgttatgcacataatcaaaatgatgatatcttaggtattttggttttattttatcctagctttttaaaatttttcttcagtaaaagcatttcgtttttataaccagaaaaattaagttgtttttaaaggaagactcattagtagttaaaatcagaaacacctaatagaatagaataggactggatgtaaatgtctatgtttaggtgtaagtacgtgaggagatgaaaaaatttaataactatgcatgatcttagtaagtcaaggtcatatttatcttaaccttaatgtcaacttgatcttaataagtcaaattttagacaacagtaggcaatgtctcctgacaagataaatgcagtctgtgaattattttaatatttctattaagaaaacagaaagtactagtcctctgtactctgacttggtctggccatatttggaggatagtgtttcattctgagaccacgtgttaaagaagatcaacgatttataagtgaatgtgaccaaaattacatatgactgccatgtggaaaacagaattacaaagttctctagggcaggggagctggtgcaggtatttgtattgtttaaatacaaagtcatatttctcaagattagaactatacaaaaacggaaccagttttctatcattatctttttccagaacgctaacagaacagcatctgcacgtccccctcgacatgagtcctgatccacaaataaagcatattaactccacccaccatccctccaaatctgcagactcctgaggtctgtatggcaaaatcatctgggtgttttcaagatttagacactttctttattataaggattcttttcccattaataaaacctggaaaaatatcaaagaaaaagggatgagtatgaatcagagaacataattacttttgtaatgtggcatgttataagactattcaagcagatgtacatggaaacagtttgccaaattattatacaataatattataaaatatttttctcaatgaaaaaagttatggctattaacctaagaaaatccttttggagtgtatgtgttcaaacctgtcttcagaagctacttaacatgtggataattacttatgggtctatttaatgtctggctttgaattgctttttctgtaattcacaaaaaagtacaagtatgccagatggcaatgcataagataagaataatttaatgctttcgtctaacaaagtactgtaacttggctttgagaaaaaaattattttttaagaataagtcagtcttcacatctaaatgtatatacgtatgtatgtgtgtgtgtgtgtatatatatatatataaatgtatgtacaaatctatatagaaatttttacatctgcattttgtttagttactcagtatattttgcatattcatcgatgcaacttaatgggcaaatactttacagtgaattttgtttataacatgtgtgtttattttctagatacacattaccaaatagtggtgagaagatgagtctgataaaaaaaatctgtcttagacccatatttgacaaatgcaacatggcaattaatcaaaacaaagatattactatgcattagggaaaacatattcaaactttttcatagaaactttgtggactgcagaggcttgaagcatatttactaataaaatgaacctgagattacacaacatagacatgttaagtaattatgtctgcaccacaaaacatataattttgcttattcttggtcagtaataaacttaatatatttttaatataataaaagaatatcatcattgggcaaaaatacgaattctgatgatctgttctttgttatatatggctgcagagtttagccaacattttatatttagctgtagtataaagatatctatttaacttttagctacaagcagggaaaagtcctcaaagtatttatacttccaatgcattgctatattctaccttctagtttctaatttcacaataatcaaaataatctcataaagctatcttctctttagtgtttctcaacaaaacctcaatcttttctgtgcaaaatcagtgatctcagctaaaattacaaaaaaacaaatttctcttccttacatttcatgtcaagcaaattaacctatcctctcctattctcctctcctttcatttatcatagctccttgctgccaattggtgagtatctgccatttcaatgcatttcatatcatttttgctttcctctgggtcttccttatattcagattcaagtatatatattgaatatatatttgaatatgtattatacatattttaaattactaaaaacgtattgaaggtttgtatactgtagctaaattcaaagacatcagttattttcagagattctctgtcttccataggacagactttgctactttgcctgaagctgggctgcctttctctaaagttccctactttaaggtcttttccattgaatttcaaacaactctactttatctttctttttaattctagctcacagagctaaccttccttggatcttcagtcagcatccagtggctgatagacaagtaaattgcccaatatttgagtcaaagttgggtaaagaatcaaaataatctttaagaattgtttcagtgtactgaattagtcactgttaacaactgggtattaaactgggtttaatctattcaagtgaaccaaagacaataaagacgacatcccacatacttagaaggctcagagatcgtgtctctcttgcaaaatgtaggcatagcaaaatgtaggcctacctagttacttttgtattcctaggattctagaatcacagtagaaaaaataggtgtagtgatgcctacttggcatttgaagtcacaatgccaatctgtcaccattcagtaagcaatatataaatcctgcctgcagctgcaaaagggctcctgtcttcagtacccacttcatttatttgaaaacaaagcaaagaacctcgctcaacagcttttacaggtatggtgactgctgtttttgcaattgattaggctccatttgtttatataatattaaggagtattgcaggcaccaatctttcaagttgccaactccaaaacacattgttttcagtttctttaatgtaattaatctgtagacttctgtgctaggttaactgaatcgatttttttcctgccccctccctcttttgtcacttgacagcttgaaactgggtctggaaaagctcatttgcattcctgcagcaaggcccggagaataaaccgagcaaacgtgtctatttgtgtacttcaatatatgactgtgcttgcttcaatcaagacttattttcagtatcatggccaacaaaagcattaaacgagttttctctaacatgaatgataagctgtagaatgcatttctttaaagtaatttttttctgtgacgcttatggaatgcagtgaaaaatagaagcaagagtgcaaatctcactagaaattcacaatgctgccttgccatttgaactctttctccttgtttcctgacatgttaagtgccttcattatagtttaggttgtacctgattataagtttaaaaggttacagttatatctcaaaagtaattatttttaaaaatcagtatttcacattgaacttcaaagattgcattctcaacccaagattgtcattttatatactgatatattttgggaattgatgctggtcttgacttcttagaatgaaaaatacctaaagcatatttttttcaggcattagtattgtttcaacataatcccttctgaatactttttctaattcttcccctatgaaaatacttggtacattttcatttaaatttttttttaactgtctcccatcctggggtcaaacatttaactgaatccaattttttttttttactataacttatgtggcttcaactataaagtcaacatctgtgtgtgtccatgtttctctctctctctctctctctctctctgtgtgtgtgtgtgtgagagagagagagagagggagagagagagaaagagagagagagtctttgcgtttctggaaaagtatgagtgaaagaagaaaattcactttctctgtgtttcatgtaacaccatcttataatgttaatgacagagatgatgttctcagttatttcagccaacacattcttcttttcataacctaatctccttcatttgaaagagaaatgtatttttagccaactctttgggaccaagtcattgatttatgaatataaggtgaaggacttcatgaattttttcctgacctccatctgtcatttccttagtcatatctattttaagaaatataaaacaaattgtcttaatggggcacattatcaccttgatatatcatacaggaaggactccctctgcttcttatcacatccttacagaaaataagctttacactgccctaagctgattttctgtatattctttattattttatattgatgatgacatacattactcaaatgctgattcactctcagtattcttgcaaaagattggagtaattctgttcaagtcttctgcagataagaacagacaacaagaagcatctgagaatttctgagaaattaatcctccaaagctgtccaatgtctaattccactcactgctgtttctttagtatgtttgagttcatattctcctaaaactatcagttatgtctttgagagacatcacaactgttaggcctcaagcctcatccaaaataagcataaaaataatcattttgctttttaaggacctacaaccagataggaaacaaaatataaaacttttcatgtgtattttgaagaagttccatgtagtctcattttataggtgtttgtaactacatatagaaattatatttgtctctataggctaacacattatctctcttcacaaacacacacacacacacacacacacacacacacacactgtatgaactacaaagaaattctggttggagaaaagtatgaggacattagcaatgacaatctactatcttggttagatacagagtgaagataagccaatacaatattctaaaagaacaaattagaagttgacacaagattagggtccatttcaagacaagatataatgtgatttatgcaaacagatgttaaggtgatacattttccttgtaaggtattgcaagatttcttgtgtggacttggaaaccccaataatatacttcagaatgggaactatcgccttaatttgcatgtagagacttggagctctccataggggttggtaatgtcaattctgtagaaataaatgacagtttcttgatgggacttgatttaagggaggcttgctaaaaataagatggcaactagggctttgttaataaagtcaagatgtacaaataatgacttttctttgtttttgttatagctgagtatttattgtgtcttatttgcagtcctacattttaagaatattgacaactgaagttttgttagagaagggtaatctggagggtgaaatatttaaatcccaactagaaatgaggaggagctattggtaagataatgacttaatgtgggtacacaggaaagccattgtgacagttgttctacatctgaagcactaccataaagaaaacgaatatcctcatgcagtataactttaaagagcaaaactaggttgaatagcataaagttgcaatatgttaaagtttgtctcattttaagaaaaagtgttgtaacaattaataatatctaaccacacaacatgagccttttgaagaactgtttttcttgtcactgggaaaatgcaagtacaactgtcagctgtggggagcagtgcccaaaggaatcctgcactggtagaagtaggaaagtgagattctagatctatttctagacctgagatgttaaaatcctaataaatcagacaccttagaaatttgcaattatccctttgaaaaacttttatagttagaaatatatgtgaacgggccagactcttattatttttaatattaaagaataaaaaggtgattttaaggacattcaaaagtggtaatgatcttgagtcactccatattacgataaaactaggcataatttttaactaagtttggagagatataaagaaagcttatgtgaaagtcaccatgtcaagggctgaagttacaaaaataaccgggttcttctcaaggagatatttatctaaaatggagactggacaaaaagcatagacagatgaacctggaggtagaaaagtttaagttgctcaagcagatactcaagatattagagacaagaataaactggctgagggaagtataatattagaatggatatattatgtaaagccaaaacactcaccagaaaattgtgtttccaaagagggctagaagacacatcattcacaaggccaaaaggatgcttttgaggagcaccagaattactaaaaagttaaggtgtggctctctgcagacacaaaggtgatggtcagagaagtgattacatagctatgttcattaacatctatgatgattatgaagctctgaagtaatagatggtgtcccttgatcaccagaacccagaaggttgcaattctcatgatgactggcaagatcacatgaacagctatggagatttttcattgggagttagaaatatggttaatacaacattgtgcttccaagggcaaaataaatggacactcaacggggatgctgcttaatatatataatacctaactgaaaaaaaaaaagcaagaaggagaaataagtggttgaggattgttaccccagtgattttcagatttggaacccattggctgaaaggtagctagccccatccctatgatgaaggactccacagttccatgacaagtaattgctgtgttgattccctcagacttaataaatatataaactgcttagttaaaattgcatttcaaaagaacatataatttatttagtatacctatgtccccaaatttgcatgggacatacatatacttaaaagttatttatctaaaatacacatttaaatgtatcccataaataatcttgtatccctactactttgagatgtaaagtgtcatgaatcttcagttaaagtgagagctttacgataacaactgaggttctgcctcaattctatctcacagtgggctcacttgtctaccttcaggcccacccaacaatcattttcccagactccaatgcttaactgagatttagaaacatggtagagtgacttatacattgggtccctggtctgtggattaataactgtcatagaggtaagggtcaaatgaaaagctatgaaaaagctcttctacacctaagatagtgtaacaaaagcagtactgtactcacagttgatgtcatactcaatggtaaaagattaaaatatttccccctaatatgaggaacaagacaagaatgtctactttcatcactgatatccaacactgtaccccattctagtaaaaaaaaattagacaagaaatttaaacagatgcctctaaattggggaggaagaagtaaaatttttatgtgtattcagagatgacatcattctatatagaaaaaaagagtccaaagaatccatagaattactattagagctagtcaataaattcagcaatgttgcaagatataaggtcaacacacacacacacacacaaaatctcatttgtgttctacacaatagtaatagacactctataaaggaaatttagaaagtaatgtcatttactatatcatccaaaagaataaaatgcccacgaatatgcaaggacgtgaaagacttgtacactaaaaacacttttgaaagaagttaaagaataactaaataaatcataagacatctcattttcatagattggatgacttaatattgttaagataacattactcaaagtattctacaggatcaataaaatccctatcaaaattccagcagtcactttgcagaaataaaaaagccaaacatcaaactcatgtgtaattgtgagagcccctgaacagccaaataatcttaaaaaaataaaaacaaagacagaggattcacagtaaattcaccaaaacactatgatactagcataaggatagtcatatagaccaatataataagaaagaatgtccagaaataagcctatatgttatgagttttgttgtgtccttccataataaagaaaaatatgttaaagtactagtccccaattcctcagaaggtcatttttttggaaatagggtatattaatccattcactgctataaaaacatacctgagatggggtaatttataaagaaaagaggtttaatttattcacagttaggtggagattaggagtcctcaggaaacttacaatcatgacggaaggggaagaggcacatcttacatggtggcaggcaagagaaagaagattgtggagtgaagagggaagtgcctcttataaaaccatcagatcttgtgagaacttactatcgtaagaacagtatggggaaaccacccccataatccaatcacctcccaccagatctctccctagacacctggggatcatgaggattatagttcaagatgagatttccatggagaaacagctaaatcatatcatagtgttactgcagatatagttaagatgaggtcatactggagtagtgtaggaccctaatccaatacaactattattcctataagacaaccatatgaaaacacagacacacagagaaccatgtgtgtctgtaaaccatgtctgaacaccaagtagtgatgaagacagagattggagttatgcagctgcaaccaaggaatgccaatgatggccagcaaaccaccagaagctggagaaagtcaatgtaggattcctatatagctttagaggaactatggccctgccaacaccttgatttaagatgtctagctccagaactatgagacagtaaatttctcatgttataaagccaccaagttcatggtattttgttactgcagtccttgaaaactaacacaccacatatctatggctaactgatttttgactaggtatcagaattcaattaggaaaaaatagttcttcaacaaatggtgctagaaaaactagatatcctatcttattatatgcaaaaattaacttaaaatggatcagcagcttacttattaaagctaaaactataaaattattcgaagcaaatgtaaaggtcattcttcatgactttggattaggtaatgaactcatgataccaaaaacaaacagacaaaaaaaaaaaaaaacagacaagttggacctcattgaaattaaaaacattgtgcatcaaaaaatatcaagagtgagaagacgatttatagaatgcaagaaaaaaatagcaaatcttatatctaataagcactagtatctaaaatatatgaagaactctttcaactcaacaacaaacaaacaatccaatttagaaatgagctacaggcttgactggacatatctccaaagaagatattcaaaggtccaataagcacataaaaagatgttcaacattattagtcattaaagaaatgcaaatcaaagctacaaagagataccacttcacatccactagggtgtcataaataaaatgaaaaatatgtattggcaagggtgtagaggaattggaactcttgtacattgacagtgggaatgcaaaatgattaatctgctgtggaaaagggttaggtggttcctcaaaaattaaaaatggtattgccatatgactctgaaattctacccctaggtatatacccccaaattgaaaatagacactcatacaaatacatatatattcatgtttataggaacactattcgcaataatcaaagggtaaaaccaacccacatgtccaaccatagacacgtggataaatcagttgtgtcatatacaaacaatggaatattattcagccataatagaggaatgaagtacatactgcaacaggagtaaacctccgacacttaaggtcacatattctatgattctatttatatgaaatatacattatagataaatccacagagacagaacacacattgttgcttaccaggagttgagggagaaggtaaaatgagaagaaactgcttaatatattttaacttggagtcttaggaatgtattaaactagatgtgttgcttgcacattattgtgaatatactgaatgctatttaattatttgtttttaaatgattaacttatgttttgtgaattttgcatttataaaatttttaaataatgttgtattaatatattctggaggagatggcagagattagttcaacctttaaagacccaaaatatacagctgtgctgattccatttatgtcttcatttaattcaataatctggcctctgtagaaactggatgaatcatggagaatgactgtgttctatgatagacttaattaagcagtagccccagttgcagctgcagcactggatgtggtatcattgctgaaacagattaataagacctcaggtatgtggtatatagccattgatttggcaaatgtgttcttttccatttaaattagttaagaggataagaaacagtttgcattcctgtggtacagaacaatatttatttacaattatgcctcaggactatgttaagtctcttgccttctgtcacaacatagtcctaagagatctagaccacctggacatatcaaagagtatcatcctgctgcattacaccaatgacatcatgctgagttggcaagataagaaagaaatggctaaaactgtggaggcctttgtaggatatgtgcatttcaaagaagaaaaccaaatcctacaaagattcagggacttgacactttagtaacatttagacagatttgttgctcaggagattaccatgatattcctttcaaagtaagagacaaattgctgcatcttgcatcttccaccaaaaacaaggaaacaaagtatctggtagaccactttgggtccacaggtagtatacccacatgtaagaataattactagagaagatgaaaacctctcagatttcctggagtagagaagaacactgcagtaaacccaggttgcagtgacatcagtgctgcctcttgggccatgtgattccactgacattatggtgttcagaagtaatgtgatatggagctcatagcaagcccaagtgggagaatcacaatgccatctcctgggatacagggctgtggtatccaccagagagaattaaagcactttaagaaataaatgtagtttgacatgtccctgggccctattcgagatcgaacacttgaacatgggacacaaagtggcaatgcctttgaaatttcccattatgagttggagtctatcagatccaccaagtcataaagtcacataggcctggcaatagcttcccatcataaatgaaaatggcacatcaaggaatgaatctgagcaagatcaaagggcccaagttctgctcatgagtacatactttcagagcctatgtcatctgctggagttgcaccagtgtctctccatcttcttgcacttaaagccatatgggggtttctatgcatccagctgtaggaagaggaagcagctgtacttggtttatggatagttcagctttagtgggagagcacaaactgaaaatggtcagtgactatatatcctcattcagtggcgacccttaaaaatggccaagagtgataattttccaaatgggctgagctatgaacagttaacccagtcatctatttttgtagaatgagcaatggtgtcatgtcatggttataggaggaaaagaactagaagtttggagacatcttccagacagaagcatgtgtatggtcatatggaggtgggaacaaaatgatattttcattacacattaaccccatcatgaaagtatagatcatggaaaagacactgaaccattaaatagacattgtgacttggcctttgtcatcagccaccccacaataggcatgatgaatacatgaatggggtgatcatgttgacaaagtcacaggctataaatgggcccaaaaagatgaactcccactaaccaaggcagatctactgacacctctgaatttctcctttttagtaacagagaccaatgctaacacccattatggcactattcctcaaggaaattgactacttggtgagaaattacattgggtagcttctaccccaaaaacagtgctactcatcctcaaagctatgataaatacttgttttgggtatgggcttacttctacccacaaagccatagccagcatcactatcggaaggcttagagagtgcagtggatcaacactctgtaagcctcctatacacatgtcagcagatcaggggactgacatgagatgaaggtggtgaaggaaatgctggagtggtccatgactgggtgccacgcttcagaatactgtgtacttattaaaacaaagatctctctatatggtgccctgtcccctataggaaggatacatgtgttcagaaaccaaaagatggaagcatgcatagctccacttaccaagactccttacgattcatgggaggaatttatgatttatgtccctataactctaggctctgcagggttgaaggtcgtggtctccaaacaggtacactcttgttgttgcggctctgggactgacattgtggtgacagcatcgtgcccctgggataacagctatctagtagtatatttcattggaccacatcctgattccccactgaactcattgtgccagggacagcagctaagtatcttacctaggagacacagctaagtatcttactgaattaaaagttacatttgctacctgggcaccttggacttcttccacccagggaacagcaggcaataaaaggtgtcaccagattggcaggggtaattaaccagaagcagcaggagataatgctccttatacacaagatgggagcaaggagaaatacctgtggaaccgaggtgatacactgggcaccttcctggcacttccttgctccattataactgtgcatggatatgtccagcaatgtagacctggaagtagaatggctatcaaagcttcagagccctcagagataaaagtgtgagttgcaccaccagacgagccacctagacctgctgaagtgatagctgagggtgagggaaatatagagtggagaagggagggaatgagtgtcagtgatgacctgtgatcatctgcagcaatgaagcctctagttaatcagattcactttgtttttctgagttttactcagataagagggccacaaaagacacatggaggagctcctccctacacccatgtaaaaatgtagatctgaacagtgcaagaggaggagtgtggcagccataagaatgtgcactgtcctctgaccacagagacgaaaactgactcaggacctctgctgctgaatgctgaaatccattgctaagatgtactgagatcacacctctcttgggctgattccagccaatgacagacagtggtgcaagagtactgataacttctacatatcaatattttaaaaaatcaatagaacaatagattagggagataatcaggcacttataaaaaatggaaaataaataacatgtaaaactgctcaatcattaataatcaggttctcaaatagatacaacactgtgtcatttaacaataattgaattgacagataatagttataataactataatgaggacgaagaggaggagaagtagtagtagtactatcacaatttcaaatgttggttaggatgtgaggaaatataaactcatatacgtggtggtataaggtggtccaattatttggaagagcaatatgacaaaacctagtgcaaaggtatctatttcctaaaacatagtgcttcagccatggttcatttgaatactgcgaaaacacatctagacatctgaaagcgaaagcaattcaaaacatgaatgtagaggcatataacattttcagagagtatgaaggaagagaccctaggcagggcttttaagaatcactcctaggcaatgtctgttatctggcttaccagggatgctgctgtccctgccacaatgagttcagtggggaatcaggatgtggtccaatgaaatatactactagatagctgttatcccaggggcacgatgctgtcaccacaatgtcacccccagggccgcaacacatcagctagttcataggcaaaataatgtgctctgcaccctgcccttgggtgggacagtggaaagtcggacattgtctgatgctagaataaaacaaggaaaacgtctctgtgcctacttgttagcagagcagcccagccttcacctcgttttttttcctttcaaatctccacgtgaccatccaactgggaaatctaaaacacatctgcaactacagacagaagtgagtatacaacttcccaggtattgtgagatggtcaagtaaacaagcgaagtttaaaatggaaggtaagcaccaaactaactaaatccacctcattcaacaatttcacttctagcacacaacctagagagctgtttatgcacaagaaaagttgtgttgttttggatggctaattctttcatgttttagatatttattgcaggatgttaaggatgccttgcctcctagtaacaatttccagcagcatccctcagccatcatgatgaacaaactgaacatatatattttcaaacgcccctgaggaagacagttgcatactccaggtgtgaactttttctattaaggatttccatcatatttacccatggagattcatagcagcatcgtcaattacagtgaaaaattagagagactaattgtccatcaataatggaataaaatagatacattcagctgtataactttaagcaattaaaatgaataagccatcagtatgtatccataacaataatccttgaacagataatattttgtgggaaaaaaacagggttgtaaaacagttcctattagattggcacaaaagcaattgtgttttttgccattaaaagtaatgcttgtttttgggtatggacttacttttactcacaaagccatagccagcaactctatctggaggctgagagagtgcttgtggatcaacactgaagtaaatacagcttcaagatactttgacaaaattagccttttaagccagtatgggtcctgtctgaagaatagaaaggcctgtcactatatttttttgtaaccgaaaaaatacgaactgtttatattttttatacataatgttttggaatattgtggaatggctaaattgagctaattaatgtatgcattacctcacgtacttatttttggtagtaagaacatttataatcttctctcaacaattaaaaaaatagtttattgttattaaccacagttatcatgttgtacaataaatcttttgaacttattcctcctatctaactgaaattttttatcatttgatcaacatttcctcaatgacccaccaccaccctgggaaaccaatattctattctctgcttttatgagttcacctcttctagattccacatataagtaggatcatgtggtattaatcctcgtgcatggtttatttcatacaacataacgccctccaggttcatccatgttgatacaaatgacaatattttcttctttttaaaggctgaatagtgttccactgcatatatgtcatattttctttatccattcatttgttgtgggacagaggttgattctgtatctcagctacgcatatcatgtggcaacgacatggaaatacagctatctcttcatgatacttatttccttttggacatatacccaaaagtgagatactggactatatggtagttctatgtttagttttctgaggaatctccatactgttttccataatggctgttttcaataacttacattctcaccaacagtgtacaaaggtttcgttttctgcacatcatcctcaacacttttcatcctgtttatatcagccatcccaacaggtgtgaggttaacatctcattataattttaatttgcattttcctgatgattagtggtgttgaccattttaaaaaatatatctgttggctgcttgttggtcttcttttgagaaatgtctattcaggtcctttgcctatttttaaaatcaggttatttgtttttttggtaatgagtggtgtgaatttcttatatactctaggtattaaccccttatcaagtgtgtggtttgggccaggtgtggtagctcattcctgtaatcccagcactttgggaggtcaagatgggagcctaagagttcaaggctgcagtgagccatgattgtatcactgtactctagactggatgacagagcagatcgtgtctcaaatttttttaaaaaggaagaaaaatggttttcaaacattttcatccattctataggttgttgcttcattctattggttgtgtaatttaccatgaagaagctttttagtgtgattcaatcccatttgtcaatttttgctcttgttgcttatgctttagggatattaaaagaaaattattgcccagacgaaaatcatggagctttctccctacgttttcttctaattgttttacaaagtcaagtcttacatgtaagtcttcaattcattttgagtagatttttgtatatggtgtggaataagtatttcatattcttctgcatgtgaatatccattttcccaacacaacttattgaagagattgtcctttcccattgtgtattctttgcatctttgtgaaaaatctgttgataaatgcacaaacttgtttctgtgctatcagttatgttgttggtgtatgtttctgtttttatggcagtgccatgctgtattgattgctatagatttgtatgatattttgaaatcagagactgcgatgcctccaactttgttcttttcgctcaagattgtttttgttatttggggtcatttgtggtttgatattaattttatgattgctttttctatttctgataaaatgattttggaattctgataggtttgcattaaatttgtagattactttggtcaatttaataacgctcaaatgggcattttaataatattaacccttccaatccatggacataggatactttttttttcacttattttctgtgttctttaatgtctttcatcagtgttttatagttttttgtgtataagtcttttatttccttgggtaaatgtattcctaagtattttattttattttattttgcagccactgtaaatggcattgctttcttgatttttttcagacagtcattgttagtgtatagaaatgatcctgacttttctttgttgattttattttttgtaactttactcaggacatttcttacttgtaacaggtttgtttttttttttttcagtagtctttaaggttttcaatatataagatcatgctgtctgcatcagaactcttttcttcccgattttgatgtctttatttcttcctcttggccaattgctctagctaggactttcagtactgtgttgaatagaaatgatgagattaagtatccttatcttctcttgctcttagagggaaagctttcaacttttcaccatttagtataatgttatctgtgagtattatgttaagtgaagtaagtcaggcacagaaagataaatagcatatgttctcactcatatgtaggagctaaaaaaaaaaaaaacttgatctcatataggtaatgagaagcatggagtagagataagaatggtggtcaccagcagctgagaagtatagggggcagaggggacaaagttggttaacgagtacaaaatacagttaaattgaaggaataagttctaccatttgataacacagtagggtgactatagttaactaaatttatggtatagttcaaaatagatagaaaagaagatttagaatactcccatcacaaaaaaaaataaatatttgaggtgatggtaccccaatttccctattacacattgcatgtatcaaaaatgcatgtacctaatatgtacaaatactatctatcaattaaaaagaaagatttcaaatagacaagataatgttacacttcaacaaactagaaaaagaagaacaaactaaacccagaggaagcagagaaacaacagggatcagagcagaaataaatgatatagagactagaaaaagcagaaaagacccaggaaactaattatttggctttttgcaaagataaataaaattgaaaagctttatgtagactaacagagaaaaggaaaaaaaagactcaaataaaataataaatgaaagagggaacaagtcataccacagaaatgcaaacatgagacaagtatccacaattatacgcaaaatgtgaaatatcctgtaaaaaatatgttaatccctagacacatacaaactatgaagacttttagaaaatctaaacagactaatgacgagtaaggaggttgaatcagtaactgaaagtctcccatcaaaaaaaaaaaaaaaaagcccaggaccagatggctccactgttgaattctaccaaatatgtttaaaagggctaatacttaaactccttcaaaaaaactgaagacgatggaatacttccaaactcattttacatggccagagttgtaccctgattccagagccagacaagaacactatacaaaaagaaaaccacaggcactgatgaacatagatacaaaaatcctcaacaagatactagcaaactgaattcaggagtgcattaaaaggatcattcaccatgatcaattaagatttattctatggatgtaaagatggctcaacataaacaaatctataaatgggaaacactgtattaacagaataaaggacaaaaatcatatgatcatctcaatagatgcagaaaaagcaattgacaaaattcatcgtcctttatgataaaaatgcatacaaattaggtatagaagaaatgttctcatcactgttttctttgttattttttggcgggtctattgacttcaaaatgactagtctagaatttacaaggtatcacagagcttaacagtattggtacataccaaatatgataatatttgcacagtacactgtggtaatttgatgaggctgtttgaggttagaggtgactagcccatgggctttggctgcctctaggcctgttctagcctccacaggggatgaaagaatcaataccgcaagcaatgttaacccattggatgcacaatctttggcaagatctatattaagaaagatcaataatgaacaaagatcacagtggtctcacagcttattctgccaaatcagactatttcttaaaggagttgtgttttagagactaatgtgaccaatatttccaaatcaaataaaataaatacatatagaagaaatattctacaaaggtcatccccggccaggcatggtggctcctaacactttgggaggctgaggtgggtggatcacctgcggtcaggggttctagaacagcctggccaacatggtgaaaccccatctctactaaaaaaatacaaaaaaaattagccaggtgtggtggcacatgcctgtaatcccaggtacttgggaggctgaggcaggagaatcgcttgaaccttggaggtggcgagcaacactccatctcaaacacacacacacacacacacaaaggtcatcccatgtaaaatccacttttggataggcagctactacctgcaagctaagcaaagtgcttagtacacctaaatttctgttgacgttaatggagttctgttttcattgttataggtcccctactgactgccttttaaatccataggttcaagtcagagtcttcattatgaaatttctgactacagagtattcacattaaagagttttgcccttaaaaagagggctacgccctctggtgagcaaatacaaaccatcaggctgttcctgaatccagagcattctccccaaaaccatgaagacagtcctagtctcatcaatcactgtaaaaccaaatcatcttgttagagagtaacatacaaattaaattttacctgcaggatgtgtttaaaaaactgttacaaattctgccaagcctgttataaagcaaaaaataaaaataaaaaaaagaagggagaagaagaggagcaggagagggggaaaagggagaacgggaggaacacaaacaacaacttatttttctgctctgcaaggaaattagaaaacccttgtggatataatgcctttttgccctttgagctaatcacaggttcctggaaatttcttctttttgggggatgcaagtatccttccttttctgcttggaaggagtaatgcccctcccatcttcaggttgtttggagttagtgtgcttatattgcaccctctgcctcacctgatctctctgctatttgctgaaccctaagccctgggaaagagatggccactgaagcagtgcaaatgttggaactcagaggcaatattgctcccatcattgcttgatcccctctttcttcccaaagctctattttagcgcctcctgctcatgagtcaaatgttttctgcctctgaaccacatcatgcacctgcctgaagcactgcttagattttctctctggggtacagtttgtgtgaagcccattgagttgaaagtccttcagcatttgctctttccgacacctaggaggcagagccgcagcagaccgttttgtattctagccgctaaatgttagaaagtcagatggagacagaaagttcaaggcctggccacattaagctttggtatcacagtgctgcacacttcgcctatcatttgtgaggcaggaacactggctttagaaacattttacatttaggacataagaacagccaaatcttctaagtcttcaattttattcattcaccagaccaaaatcataaactctgtcacaaaaaaaaaaaaaaaaaaaaaaatcacttgttctgaagcactgtccaagtgaaagggcagttttgttatgtttacaaggagactgaacatggattcattctgctactagaatacaaatgtgagcaaaagggtgtgggatagtatgtccagttcattgttttgtgaaaaggctacagggatgataacacaagtgggaattcagctctgatatggtaaaacatttatcctgaaatccaaaatgtagaaactcaaataacaagatttttctccaagcctcataaaatgttaattcagggagaaatacccggaccttctggaaagagtctaggctttagattaccacggagtggagaactggaggtcaatacaggctcagctactttctagctgtagaaacttgaggacttatttcactctctctgagcttaagtttccttagcagcaacatgtggctaattccacctgaccttcaggactattgagaaatccattaagtgtatactatgtgtgcctaactatgaccttaagcaccaaaaatttcttaataatatgtcttatgaaaatcaaacacagtgttttctcctgatgatgtagtgcttggtgtcctgaatgcattaacaaaatctaaagccttcctgaaagccagatctttgcaaatcttgatatactaaatgtgttcttgcttaattcatttatttacttaatagaaacttgattgctccccaggttttcagcatctagctgagaacagtttagcggatgatcaatccgctcaatctatacattacttcaagtatttcaaaaatgtatggcaagatttttgagaagttataaaaatcaacataaaggttctcttttagtaaaaattacaatcatgaatatagcttatagagttttgagtctgatcatttttaagccaaattcacatattttgagatcattttaatactttaaagagaatatattaagaattaaaatttgctcaaatattctatgtgcataaaggaaatttagacaggttttctataatgattggaggaaaaaaacggctctaccctccagtgggtggagccctgaggaacagctcagctccaggcaattaagcacttacggactgaaaaggaaactttggaaactcattaatttttattagtaaaaccaaagggatatttcacaataaaatggtaggctgttgtagactcacagccaggaagttttaaggctttgctctaaactccttgacatcacagggactttgccagtcttactttcaaggtaaacatttcagaaccctcagctctagttacaatcccccattagtaaaaggccatcttctctgagagtcttttaaactatgcatttttaactactcattctgctctgacattatgtctttgcaattcatatttcccattcagtcaatctgtccgaggtgcccctactcccagatcagccaaagtttctaaaattatccatctctctcaggaaagtttgggtacagaaccatttatctgccagtgcatgtttgtgtggaacctgtattaattgcccaagggagctccattgaaccccttagagttgtaaattttatgcttacaagaatttccttctcctccctaattgtacatgctagctcatctcttctttcttactgccaacactgatgtcttagctttgactctatttagagctggaagagaatggcatggaaataaattcaattcttgtctcagttttcctaacacattaagtctgtcacccccttttagtgtgtgttcaatcagaatgtcttaggtctccatttctaattgttcgggcaatgtatcctctagtgccttctacccttaggttattgaaggaatggaaagtttctctcccctgagatctggggcaacattgtaatgatggacaatgaaatttgtgaggatagcccagagttgaacaatttatgtgagataaaaatagagaactttgtagtgtttctttatctgacagagaggagcaatcactattaataaagtttacttgtatgaattattcaaggctttaatgaaacattagaaacttagagagacataatactgtggattatacagctggccttggagccaattgagtaagctttatagtaaatgtaagcccatgggctagctgaataacctctatataaaccttttttttttcttcatttataatatggggataataattcctattaaaccttgtttcagtgttgctgtgggaatcaaatgaaaatgcattaaaatgtgaattgaaatgtgaaaagcataaccaaatggcaattcaataataccattagatcctgaaatttgtcatgttaaaagaggaatatgtatcaccagaaagagcagctttcctttagaaaaattaattactcttcaatcagatagagacttacatcattgtggatgagcaagaaagatgcattgaattgaaatccatgtcagtggtaaataaattcaaaactcatttaatagttatatgaataggagagagtggtgtggcttctcaaagtctcagagtttttatttttcataaaattaagattacttgagtatgtactttataaaattgtgagaactaagtgaattttatagaatgaatgtttgtgccccacccccccaaattcatatactgaaagctaatccccatggtgatattagaaggtggggtctttggaaggtgattaggtcatgatagcagagtcttcatcagttagattagtgcccttataaaagagtcccaaggagcttgttcaccccttctgccatgtgagggcacatagaagttgccatctgtgagcaatggaccctcatcaaacactaaatctgttagtgccttgatctcagacttcctaacatccagaactagcttccagaacaatacattcctattgtttataaattatccactctgaggtactttgttgtagcagcctgaacagatcaaggcagtgaactaacacatgcttgacacagtgcctgacacatagtactcaaataataatttgatataatgccaatttggccacaggaaggagaccatataatttaaaatacttcactgaaaagaaaacatattaaaccttcaaacatgattaaattgcttattggtttgaagcatggttaaaacaattagctccatgattattggattcagtgtactttttttccttcctctagccaataaagtcattaaatggataattattttcccaatgcacttacttttttgtgtgtttgtgtcagacattgaaagtataaaatttaataaaatttgcctcctaatgtgggataattaaaggtttcagtgtaattatagtatctgaactaagcatcttatttttttgttcttaatatcagtttttaaaattgagatataattcatataagatagtgggttgaatagtgtatctccaaaattcatgtccacttgaatctcagaatgtgaccttatttggaaataatcatttgcgtatttaaataaatatgtgaagataaaattatcctgtatttagagtgggtcctaagtccagtgactgatacctttttaacagaaaggagaaggatgtttgtttgatgcacacagtgatgataccatatgaaaatggaagcagagactggtgtcatgctgccaaaagatatggaaaaccaggagtcaccataggatgaaagaggcaaagaaggattctcctatactttcagagcaagtaaggccctgacaacattatgattttgaccttctggacttcagaactgtaggaaaatgaatttctgttatcttaagccactaagttgtggtaaaaagttatggcaaccctaaaaaaatctaatacatattttagtactgggaaatgggttgctgctataacaaatacccacaaatatgtaagtggctttgggattgggaaatagatagaaagtggaagcatttttggatgcatgatgaaaagagcctagattgcattgaagagaatgttgacaaaactatagataatataggcagtactggtgaaggctcagatgggaatgaggagtatggtagggaaagctgttgtcttagagaaaacacatatcattgtaaacaaaatcatagaaatataaaggttaaaggtatttctggtgaggtcagacagaaatgagaaacatgttattggacactggaggaaaggagattcttgttataaagtgagagaaaacttggcttaattacattgtacagttgggtggaaagcagaacttgtaagtgatacaattgtatatatagctgaggagatttccaagcaaggtgtggtctgatttctcctttctgtttagagtaaaatgtgaaaaggaagagataaattgaggaaggaactgttaagcaaaaaggaaccatcaatttgagacttgtgagttccttggtctatccagatttcaaaggatgctaaattaggaaatgtactgttgagaaagcatactctggggagaatgccaagaatgtggctggacagctgtcttagtctgttttctgctgctataacagaataccacagactgggtaagttataaacaacagaactttatttggcttataactctgaaggctgggaagctcaggagcacggtaccagcatctggtgagggtcatcctatggcagaaggaaaaaggcagaagcttgcatgctaaacagaaaaagcaaaatgggacctgaaatattctttttgtagagagtctactcctgcaataattaacccccttctgagacaaaggcatcaatcctttcctgagagtggaaccctcatggcctaatcacctcttaaaggaaccatctctcttaatactactataaagaccattatcttttcaacacatgaacttttggaagacacacccaaaccatagcaacagctttttgttgaaagattagttgtatcactcatggatccaatcaaccattttagcagaaagcagaaatacagatgggattattcagaaaggatcactggaaaaccattttgttgaattgtgtttgtcttcttaacatatacatgaggatcggttattgagaacattatcctgggggaagcgggaacacaaggtgcacctggactgacagagacagagctaaaataacaaatgaaggtaattagactttcaaaattctataggtagaaagcaggctgatagaactactcagctgccacatatatttggaatcaggtctcctttttcttgaaaaggagacctgattacaaagataaagccttgggctcagagaatgaggctgccaccaccacagattcagaggaaagagcattaagccacagaggattattttcaggctctgaaacataataaaatttgctctgttaggtttcagtcttgcttggaaccagtgacccttactacttccaatatctcccttttggagtggaaatgtctatcatataaccatccaaccattgtattttggaagcagaaaagttgttttctaattttaagaactggagatagagagggattttgtcccaagatggatcatacacaaagtggaaccaatacctgattcagatgaattagacaatgagatttggaaattagttagcagatgatgttatatcagatttaggagttagagttgatgctggaattagttaagactattcaggatattgagacagggtgaatgtggcttgcacatagaaaagtaaagaatttaggaagacagagggcaacttagagtgagttgaataacatctcctcaaaattcatgttcatccagaatctcaggatgtaactttatttggaaataggatatttacagatttaggtaagaatctcatgataaactattctagattatggtgcactctaacttttggttttgaatttctggatttaagaactgtgagaaaataaatttctgttgttttaagccaccaagttgtattaagtcatgatatggtttggctgtgtcctcacccaaaaatcatcttgaattctaactcccacaattcccacatgtcaagggagaaaccaaatgggaggtgattgaattatgggggcaggtctttcctatgctgttcttgtgataatgagtctcacaagatctgatggttttaaaaatgggagtttccctacacaagctctctttttgcctgttgccattcatataagatgtgacttgctcctccttgccttccaccatgattgtgaggcttccccagccacgtgaaactgtaagtccatgaaacgtttttctcttgcaaattaccagtctcggatatgtctttatcagcagtgtgaaaatgcactaatacaataaattggtactgagagttgggtgctgttggaaagatacccaaaaatgtggaagcaattttggaactggataacaggaaaaggttggaacggtttggagggctcagaagacaggaaaatgtaggaaagtttggaacttcctagagacttgttgaatggctttgacaaaaatgatgagagtgatatgaactataaagcccagactgaggaggtcctagatggagatctggaacttgttgagaactggaacaaaggtgactcttacgttttagcaaagagactggtggcatttgcccctgccttagagatttgtggaactttgaacttgtgagaggtaatttaggggatctggtgaagaaatgtataaatagcaaagcattcaagaagtgacttgggcgttgttaaagacattcagttttaaaagggaagcagagcataaaaatttgaaaaatttgtagcctgaaaacgtgataaaaaagaaaatctcattttctaaggagaaattcaagccagctgcagaaatttgcattactaatgaggagccaaatgttaatccccaagacaatggggaaaatgtccccagggcatgtcagatgtctcatagcagcccctcccatcacaggcccagggacacaggaggaaaaaatagttttgtaggccaggcccagagtccccatgctgtgtgcagcctagggacttggtgccctatgtcccagctgctccagttgtggctgaaaggggccaacatagagctcaggccatggcttcagagggtgtaagccccaagccttggcagcttccacacgttgtgttgagcctgtgagtccacagaagaattggggtttgggaacctctgcctagatttcagaagatgtatggaaacacctacatgcccaggaagaagtttgcttcaagggtggggccctcatggagaacctctgctaggagggaaatgtggggttggagcccccacacagagtccctactggggcaccacctagtggaactgtgagaagagggccactgtcctccagaccccagaattgtagatccactgacagcttgcaccatttatctggaaaagctgcagatactcaacaccagcccatgaaagcaactgggtgggaggctgcaccctgcaaagccacaggggcagaactatccaagatcatgggaactcacctcttgcataagcatgacctggatgtgagacatagagtcaaaggagatcattttggagctttaagatttgactgcctgctggattttggacatttgtggggcctatagcccctttgttttggccaatttctcccatttggaattgctgtatttactcaatgcccatacccccagtgtatctaggaggtaactaacttgcttttgattttacaggctcataggagaaagggacttgccttgtctcagatgagacattgcactgtggactgttgagttaatgctgaaatgagctaagacttttggggactattgggaaggcatgatttgttttgaaatgcaagaacatgagatttgggaggcgctgaggcagaatgatatggtttggctgtgtcccccctgcccaaatctcaccttgaattgtaactcccacaattcccacatgtcatgggaggaccctggtgattgaattatgggggcgggtctttcctgtgttgttcttgtgatagtgaatgagtctcatgagatctgatggttttaaaaatgggagtttccctgcacaagctctattttggcctcctgccatccatgtaagatgtgacttactccttcttgccttctgccatgattgcgaggcttccctagccacatagaactgtaagtgtaccctttctcttataaattgcccactctaaggtgtgtctttatcatcagtgtgaaaacagactaatacaattggttatggcacctctaggaaacaaatacatattccaaaatatttacccttttgaagtgtacaattcagatggttttggtatattcatgcacaaacatgtgcactaattccaaaatgtcttcatcacacctcccatcaacacatacacacacaagtattctacctttgctcttctttcttaaatttattttcacaattctgtgttccttgaatttccatgcgaatattaggaacagtttgtcagtttttgcaaaaagaaggtatttgatattttgatgcagtttaaattgagtctgcagattaatttggggagcattattatttgaacaatattaaatcttttaattcatgaagatgggtttcctttttttttcatttagttcttaatttcctttaatgacattttgtgccttttggtttaacagttttggatttcatttaaaaattaacttctaattattgtatttatttattttgaaactgagtttcactcttgtcatccaggctggagtgctgtggcacagttttgtctcactgcaacctctgcctcctgggttcaagtgattctccccactcagcctccctagtggctgggattacagtcatacgccaccatgcccaactaatttttgtatctttagtagagatggggattcaccatgttggccaggctggtctcaaactcctgacctcaaatgatctccccactttggtcttcctaagtgctgggattacaggtgtgggccaccatgccccacctattgtatttattttactattataaaagctgctgtttcaaatggtattgttttcttaatttcatttttggcatgtttttctgctagtgcatagaaataaaatatatttttgtatcttacaacctctctaaactttttaacctctaatagacttttgttgttttctttagattttctttaaataggttcacagtctgcaaacagagagttttggttcttctttccaaatatgggtgccatcatcttattctttatttcaaggcaaagctttcaatctttcaccattagctacaaggttagatatgagatttgtgtggatgcccttgcttagctttaaacattttccttttatttctagttttttgagtgcttttatcataaaagggtaagttttatcaattttttttctgcatctattggtcattttttcctttataagtacagtacatttcattgatagttttttatgttaaaccttgcattcctgggataaattctacttggccaaagtgcaaaatcacttttgtatattcctaaattcagcttattactttcttgagaattttgtgtatatatcataagagatattggcctatagtttttttcttccattcttgtgatgtctttgtctattttcagtagtagcataataatggctacataagatgtgttggaaaatgccccataattttccattttttgaaaaactttgttaaggattgagattagttgctttttaaatgttggatagaattcacagatgatatcatctgattcttggtttccccttgtggaaaatgtttgactattaattcaatctatttttatataggtctattcagattgtttacttcttgggttggttgagcagcttgtatctttctagaaatttgtccatttcacatgggttgtatattttgttgacccttttatctgaatatttgtctttgtttctatcaacaatttttgtcttatatagtaactatattttacttacagttgtatagtgtatgtttttctatccttttacattcagtcttttgtgtctttgagtctaaagtgtgttttgtgtagactacataattaaattatacttttaaaaatatcaattctgcctactttgctttttggagcatttaatccatttcgatctaatataattactgataaggtatgatttacagatgctattttgctatttttctacgtttatcttataccttgttatcctgttttttctgttatcaccttctttcaagggttttcttttttccagtgtagtattttaatttcgttattgcttaccttagtgtgttattttcttagaaataacctagggattaaaataacatcttttattataacaacctaatttaaatttatgccaaattaattccaatagtatacaaaaactttgctcttatgtaacatcattacttaattccattttccttttatcatcacacaacttaaatctttgtgttttaatcttagaaacaaattttttaagttattgcttttttcagtcaccttttaaataagatagaaacacacacacagtgttgcaaacaaaaaagcacttatactttctttaaatttacagatgtagttacctgtatggtgctattcattcctgtgcatgcaagttattgtctcgtgtctctttctttcagcctgaacattccctttatcatttcttttggggaaggtatgctaacgaatagttctttgaattttgattttctgggaatgtcttaatttttccttcattgttgaatagatttgctgaacattaaattcttggctgacaatattctttattttagtaccttgaatatgccatcccagtgcctgtctccagggtttctgttgagaaataatctagtaatcttaccgaaaatgacccatatataatagattgcctaactcttgccaatttgaagatttgaatttgtcatcgtcttttttttttttgagggggagacagagtctcgctggagtgcagtggcgcgatcttggctcactgcaagctccgcctcctggattcactccattctcctgcctcagcctcccgagaagctgggactacaggcacctgccaccacacccagctaattttttgtatttttagtagagacggggtttcactgtgttagccaggatggtctcgatctcctgacctcgtgatccgcctgcctcagcctcccaaagtgctgggattacaggcgtgagccaccgcgcccggcctgtccttgtcttttgacgttatagtatgatgtgtctgcatgctgattacattttgtgttctgcttagggctttttgtgctacttggatctgtagattaatgtttttaaattaattctatggagttttcaaccatttcttcaaatatccttttggatttttattctcctctacttctggatctgccattctaagtatgttggtatacttgacggtgactcacaggattctgaggctgtgtttatttttattcacttttttctttctcaaatgagatatgtcaattaacatacattcaagatcattcattttttattctgccgtctcaaatctgctattgagccactctagtgaaatttttgtttaaggttattagataattctgctccagaatttttatgtggttttaaaaaaatcaattttatggcttgattgttattctgtatttggtgagacatttttctcatactttaacatatgctccatttgcttatttggaagtttaaaaaaataattgatttaaaatttctattaactctataacatgggttttgtcagggacagtttctattcacgatttttcttcctgtgcatgggccatactttcttatttcttttaatttttgttattttatgttgaaaattgggcattttagcctcccgagtagctgggactacaggcaggagaacggcgtgaacccgggaggcagagcttgcagtgagcggagactacgccactgcactccagcgtgggcgacacagcgagactccatctcaaaaaaaaaaaaaaaaaaaaaaaaagataattgggcattttaagtaataaacttttgcaactttgcaaattggatccctctcctcaccaaggcttgttattgttgccgtttattgttgttactattgttagttttgtttaaccataaaaaaggaaatcttaccatttcaacaacacagatgaagtgggaggtcattgtcagtgaaataaagacaaatagtgtctcacttatttatatgaaatcttaaaaagttgaacaaaaacagaatagacatagtgaaaccctgtctgtactgaaaatacaaaaattagctgggcatggtggcgtgtgcctgtaatcccagctccccattaggctgaggcaggagaatcgctggaaaccagggggcagaggctgcagtgagccaagattgtgccactgcactccagcctgtccaagactccatctttaaaaaaattttaaaaaagatttttttcgtttgtagtttttggtttgtttattgagttttcaaaactaattctgtaaaatcactaatcttcattatgtgtgaccaattaagtttctgctcagtttactagtcaagaagagactggacaaagattttcataaataccttgaacttataagtcctctagcttttgctgatggggttctatttgtgtactggagtgtgtttttatgcattcagagtgtttacagctctgtcttagcatttatttctggttggtacagaatctcaagatcagccacagctgagaaattagggtcttttaagtctttttctgggtacacacacattcctgaagatgcaggtggtcttctagattcccaggagcagatcaaagatttacaaagcttcctatggacatttcatattccaaaattttcattaatttgttttttgcttagtttttaattgtcccatttgtttcaactgcttcaggaagctgggatgttaaacaattgttgaccaactgcccaaaatgagcaagttttgagtcaggacaataacagaaaatccctgtcggtggaggtttccaggaaaccacaggatgggttggttaagtaccactgtttggggatggcactctttgttatctccaaacttgttctcccccttcagtggctgcttgtctactgatttttattttttaatttttttttcttgagacagagtcctgctcaggcacccaggctggagtgcagtggcgcaatcttggctcattgcaacctctgcctccctggttcaagccattctcttgccttagcctctcaagtagttgggattacaggcacctgccatcgtgcccagctcatttttgtatttttagtagagacggggtttcaccatgttggccaggctggtcttgaactcctgacttcaggcaatccacccacccctgcctcccaaagtgctgggattacaggcatgagccactgtgcccggctgtctactgatcttcaaggctgcagtgactgtgtggttattgactttcaaggcttctacggaatgaaaagcgggtgtgagcatgttaaaatgttggaagctcactgttctcactgttcttacagagattgggtccctttttaaaataaacctcccttgaattcttgcgtgggctgttaattctgagtaatgaaaaagttgatcttgactttttgccattgttcttactgttttcatggagtttttagaggtccttttctcattccattgctgtcaatgttacatggttagttacttttgtatttgaggctgttgtgtatctgttaaagttttgtggttgcaattaacagaaattcaacctggcttaagtagtaacacgatgtttaagagggatttggaggattttacagagtaaaaaggatagctgaagcaccatgtcttgcaaggacacaaatactgatggttacacaatgtaaccagaagaaattctcacaaacactagtaaggaggggactggcctagggaaatttttctgaaagctgcatttcaattgcactttcaaaatattgaaagaaaaaatatacatcctctaaataaacgaaaacgaaaggctgatggagatttgaaaggatccagataccccaaaccatcctctggaagccaacaagtatccacgtaacaggaactaattgaaatttttcccagcattctgtgtctgggtgtactgactccaacaatttataatcttttttatcctcaaaataagacttaaagttctaacataaaacattcaattgacctactatggaaataagaagtaagaccactggggactaataatttaaggttgagacaccaaaagaaaaaataatgggttccgggtgagaaagaacagtatatatatccactgtatgacataaatgtagatttacaaagattcccatctaagtaaaaacaacatcacaatttaaacttttcacaatgatcaaattatactttctcttattttattcatcgttcacacagaagctaaattgatctttaacagaaacttccatcactctaatcacacatttaaaataattccataacttcccattttattaggacaaagtcctacatcatctagcctctatcttcttcaccatccttgtccttttcttacctctctttcttcctaatagcattgctgtttggttgaacccatcttgttcccacatcaagctttcacatctgctattttctctttctggaatgttcacctacaccctcttttcaggagtcattttctccttctcttactaattttattaagcttaaatatcaatccattaaaggataatatttgattacctatatttatttattttccttctggaccccatgtttttctttcatatattacatctgtaatttatttgttatgtgtttatttcatatcttatccaccagggaaacagatccattctgttttattcaccattacatatgcatgtttgtggcatgccaagcacatatggaccaaatatttcttaatgagataaattaatctgcttgtatacccaaacttacacagacatgaaacatgcctttcatagaatgtttagaatcaataagactgtatacctaaatatactgacagaattttgttgaaaatgaaacagatgaaaatagtattaactaaaagtaaatttttgtactttttctgttttatgtgttgtgactactcagaaatttaaaaaataacattgacagagttgcattctgcattcgaatgagattttctttccttgaaagaagcatcatttctgtatattgtgcttccagtgatggtataattgtctaattggtaattcctatttttgttaataccaaagcaaatttgcaagacaaaaagaatagtcatattatctcatttcatactggatttcagtccaaaattagaaattcttccagctcagattgaggataggatcccaccatgattatatcttctctttgtaatcccttctatgtttctttattcacagatattcacaaataagtagaaatcattaagcatttgagaagagaaaaaaagacttgaaagagaatgccaacaatgaaggaattaaacaaatgacccctgagggaaacagacaaatgagtaaacaaaagcaaatgtttaagaacgtattcatgaggtattacttgagcctaggagttctagactagctggggcatcatagtgagactccatcgctacaaaagaaaaattagccaggcatggtggagcacatctgtagtcctagctcatcagaagcctgaggtgtgaggaccacttgagcccagtaggtcaaggctgcaatgagccatgacagagccactgcactccagcctgggcaatagggcaagaccttgtctcaaaaaaaaaaaaaaaaaaaaaatacaaaaacccacaaaaaacaaaacaaaaacaatgtactcgtgaacagaacaagaatgttttaaatgaagcaatctgagaataaaaaatgctatatatgtgtacatataaatgcatataacataattatacaatgtgttatatgttaactctaaaatacatacttgacaaattgcttacacttttaagtagttaatctgaattacaaaaaggacatgaacaaaaataaaaatatttgcaaaaatggaattgaaataaatctccataatatagaaaaacgaaaggacaaaacaacagaaaaagatagaaaagcaagcttactgagaaggtattatacatacaggttcttagcctaatcctagttaagagttccaggatgaaaaagcagaaacagaaaggaggacagaatcaaagaaacaatggatatgagggaaaatattgtcagatttgaagtatctatgttatttgaaacaactccctcaaacctaggcattcatttatgatttttcacaaccacaaggaaaaatagaatattataactgtatcttttaaatggaaaacactatattttatccagactatcagacttcttatcaggaatgctggatctacagaataattacattatcaaacacattttcatagatttctatatccagtcaaacttcctataggcatatcatctgggaacaaatgtaaaatgagtctggtcacatgagtagaagaaagcttggcaactaaacctggtccagaaacaagacaatctatcagttactggcactcagtagttttctttcagcagtaacttttaacaatattaggttacattttcttcattctatttagttctgtaatgaatggacattgaagttttaaattgatattagttttagaatatgtggttttagaatcaaactatagacacaatcaaaaacccaattatagatatagaggaaaatgtaatgtcataactcttgatgcaaaataaaatggctaagaaaatgggaaaaaattaataagaatattagtaaaagaacattaggtgccccaatttcacatctttcatacaggaagtgcaacagattctgtctaaagttgacagaagttcttatgtgtgcagaaataatgatttaaactaattttaatgatgtcaactaaacaacaaatgaaatacttattgacacaagtactaacaattgggcagtaaaattgggaagaataggtgtttaatggtacaatacaatgcctcctaattttcattgttatttttaaacttctgtctactggtaatatatcatgaaacagatctaagttcactttttaaagacaaacaatatccacataaaatcaaaacaaaaagctgttaacactgtctatagggagttacactggtgttaggttgggggaagaggcttttagttttcatttctatttttgttgggcaggttatatttttacccaggtgcgtatattagttctctaatataattccaggttaaaaagatgatcttttataattatgtatcctgggctaatctcttaatatatttatcattattgaacctgaatgaattggcagtggttctaataaacaaatttgctctcatagaataaaaattcagcattatagaatattaaaatattgtgaatatcaggcttaggatcttagcctttcaagatcctaagggtaaggtagaatgagactacaaaatcttaggctatgcgctcatagtgttagtggcacctaaagggagcacacattttcaaccaactctaatgagaccttcgtggagaatgctggttttcatattgcagcgtcttcttccatttccattcttcttccaaatatgccttcaactaatcccaagaaaactaaagcaaccatggattcataagtgaggttttgataattaccttcaccaaatcctccatcgcttccttttatatgtcacaaagttgccacattctgtatttccctttgctacatcatcttatgcagcaaatagaaggctatgctaaataaacagagcaaaaacacaatctgtataaaaattgaaagccatttagccttatagaagaaataatccaactctggtacctgtattgagaaaatagaagtaagaacaatgtaaatcaagatacttctatttttcatggttccaaaattttctacttaaaacagtagacttccgtataattaatgttaagtcactgtagcatttatatatgcaatgctcatccttttatactaacaaaaagtcattcaaatatttcttgcggatatagtttttatatctcaacacctttaaatagtgtatgctgggttgatttgaacaagtttcagacaccaaaggaagttctcagactgaatctgctgcaaggccccagactttcaaaaggaccactttgtaggagatactgtcattagatggataagtgtggaaccgttaactatcagatacactgatagttacacatggggattccagtgtcatttgacctgtttcattgatgctgattgaacaacaaaaataaaagtgcatcttattgtcaccaaattagtgtgcattgtttcttaaaatcatctccagcctggcaccggagaaaaggagattataaccactgagtactccttgcttaattgcaaatttggaatacagttaaatgtattacactttagattttaaaatgtaacttgtgtaaaaataaaggttttatagacttcaagaaatgggtaccttgagtgagtgttcaatactataaccgagtttattcaactttgcccacttatgcagtataagtggtttaaaacacaatgcagaaatactactgagtctagtaaatgaaattatcaatgtgattttgctccttctcagtcaagactaactcaaatcccttctcatctttcatttattaatcattcctgctccatcagatgcccaggacccgaaataatctagagtccatcctattagtgaatcaaaccatctagctaatatatccaaaagcatattaactttattcattatatacttataaatactaaaaagatcagatgccaaatctttgttttagaaattgagaagatgagacacagaaattaaagaggtgtggaaaggacaacatggaacagaaacaattggcccagaggtctgaataggtttcaaaatcagcctggtctaaaagggaggtcttgggctgagggacaatatatctctagtccagtggtccagagcatacagcaggatgcccttttgtccatcactcttagttggaatgacagccacctccaaatctagtttggagtctagtgacattgggatatggaatatgacattagtatccagaatattctgatctcaaagccatgtttcataatgctcataaacaactaaggccactagagcctggaattatgattattactttccaactctttgtcctcatattacttgatccctcttgtagtgatttttcaaatgctatgttgtaatcaagatcctttcgtaattttatttgagaataccgccctgggaaagaataagagcagtggacacagtctgctttggcaacaataccaagcattgcaagcctaaggacacagtgaatacctctcagtctagggagaagcctcaactcattacccaacaccaacagtaccctactttttaaactgtcaatcctgacaatgtataccatgtctggggtatcttctatgagataaatatgaactccactctttaatgcttcacaaataattgagctaatccccaaatcaagttaaaccatgttgtcttagtatatgcttctgaactggtcagaactcgacctgtagacattcttgaaactccatacgaaagtaaatcacaacaaagcaaaatgatcatgcatgcttaagaccctgagtttccatctgttttctctaaaatgacccacactgagaaaattgcttaacatgcacaaggtaagccccattttataagccagtaatggagaaaccgcagtaactaattagctcctaccagtacaagtcaaactgttattaacaaaatctgaaagttaaatagaggttcattacttccctagtcattggcgccccctccctggggagtgtttaactcatagcaatggttttggctttgcttgactaaatctcactatgagaaaggaataggcacttgtgcccaagtctgaaggaacccagaggtgtgccaagccaaccattaagctgtgcagaaaagtagatggttagaaattggcatgcagagacttctcttccaaatcagtctgaagtatggtgagaaacattgttccaaggcttttgttttcccccccgatgggttcctttgagacaacactgaaaaatggcccatctccatctttctattcaagaaaaacattgttaaataggtttgtgttacttcccactcttctaaggacctttcaagggaatatagggtttacaatgttggacagttggcagtatgtaaagaagaaagcaacagagtgtgtatagtcagttttccaaagagaacaaaggccaaggcaggtatgtagcttaataattatggatttgccttgtaagcaggaacaaccctgcagaagttaacccatcgcttgccattatctcccctcctgcttatggactctgtcatattcagcagtgaaatgtaaggtattaaaggatagaacttccatgtagctccatttctatcccctctccaccttgaaccagaaggagcgtcagtgcccttataaaacatgagatacctatgaagtttgatctctgccaattgactgaaaataggattgttaaactgtggttcataacattttatttgctcttttttgatttcaatattcaactttgtaaattaaaattaatatatacttttctggaaaaacatcttacaacttttagagttggtgtcaagaaaattgcctttttattgtgtttttttattccagtaacttgggtgagtcacatatgactgccgtgaccgtttccatctgtgatcctaactatgaatatccctaactatggcgtaaacaaaggtaagcaggtgtctttgttgtaggacttttcagaattttaaattatatgttaaaataaggttttaaatacaatattcatagagagtattcaaaaagaataaaacatagcacttcctaaggtgtattttttaatcacaagtctgttcttcacagtacatagaaattctatggggtggtttgagaaatgtttgactaacccagagtttcctaaacttggcactattgacatttgaaccagataattctatgttgtgagcaatgttctgtgcactgtagaatgcagagcccctgcccactggatgtcctcagcatccccagtcataataaaaaaatgtctccagacacttccaaatgtccctcaggggcaaaatcatctggaaaaactgattttcaggggtctttctggctggcatgttcagaaaaaatgttctccagaccagtaagaggtagtatggggtagtcatcgacaccacactttgcaaaattaaagctttgtggttcaagtacaaagtttacttgtgttaaatactacggaacttaacacccagaatctttggtttctgcatctgtgaaatggtaataataataataccacctacctagtatagatgttatggggcttgaaggaaataatgtttgaaaagtatactaaatattttatatatatatatatatatatatatatatatatatatatatatgcacacacacacacatatactaaatactctaaatactagacaatgtctagtatacagtagagaacttggcaaataccagctctcattctctctggaattcactatctattaaccttgatttacttagttgctaattatttctaaaagtcacttgctttttcagaagcaggttacaacccaaataatttcctttttcttattacttctctcatttatttccctatcatacttcatacatccatacatcaaataactatttttgaaactttcttgttgcacttctatgctaggcttctaataaggggtttctgattcccttggaggaacagaaaacacctgtctaaagttgttggtcctagagcttacactgtagtcctttcaaagaaattcctagacaacaagagattaaatgcaggaaaacaaactactctaggtttttcaagcacagtggaattaatatagaaatcattgaaaaagctagagagctgacgtcaggggctactagtaaatttgcttttcaaggtgacaccttcatgacacagactcgctggcaggaactatctgcttttatactatcaccgctgtcgttgccacagctgtctcaaacccatgaagctggtgacaagcaaatgaatccgcttcggacactcatgtttgctagagcttgcttgtcagctagcatagacagagagatgggtttgttgttctaatctcatatgagtacatttaattggcagaaactaattaatatccagaatactagctacaaagctgtctagaaaatatatagttggtgcaaaagtaattgcggtttttgttgttgcttttaacagcaaaaaccacaattacttttgcattaatgtaatatttacctttccaaatcttccccccaaaaagaaaagtgaaattgtgcatgtgagtgcatttaattggcagaaactaattaatatccagaatactggctacaaaattgtctagaaaaaatatgtattttttaccattccaaaccttccaaaaaaggaaactgaaatagaggctgatcccaacatccagttatcccacatagacaaccctatagagacacacatccataatattcaacagtgataatagaaagatccacttggtcctctctactgtaatgtaacagtcccctgtataaagataagtctcttgttccctcccttaaagaggagactcatcaaccactctttctcttcctttgtgtagttaattcttcatctattcaaaattccaccctgagatactacaacgtaaaaattaaatcatgaagttcaaaaccaacagtatactttatataaaagaaaagagaaggaatttgtttactataataatatggccataacaaagaaggaaagaaatacgcattttcttgtttttgcaactgatcgtgagaccatggctggtatttataatttccacctttcacaatatattccacgattcctttaccttgaggcagcacatcagattgttaaccattatttgcatcttggacaactgaagcttcattcctgaagagtgtgagcactggtattgaagtttccgatgtcctctaagatacctcatagacactcttgttcagatgtattcgcctgtctcctactgtatagcagcaaacctatttttccttaataatcagcatcattcagtaactgccttcctgtttactaatctagatgaactggttctaatgagacatcacagctaccatctttctcttcactggcataaaattcacccgagtgtagtcattgaaattcttgttatttgaacctgatcataacttgcttctccatggcacagctgtgtgagttcccaacactggattattgagggctcagagggattaggataaagtgggtttgcagcagtaggatgttccaagccccacaaaatcatttcctgtaccctactgtcctcactcctggtcaagagccaggacttttcagcaatatagatgccagttgactcctgagttatcactgacaaaattatatcctaaagtcataattttaactgctaacatcttcaaacaacattttccatttggaattgttcagacacatttacgtttttctctactttcctgtttaccttttttctgcagttattcactcatatatacatagtaaatgatactatttttatcagcattattataactattttaattgccattttaaaatactttactatacattacctcgtttaatcatttcaataattctgaagataattggtgtatcttacatgtaaggaaactgatataaaggtctaagtatcttctacaacctcaagcaggaataataatggaacccacaactcaaactttttaacgccttagagagacgcaagagcaggaatggagcctcttaagtttttctcaaatctttcatagcttttgatacaaattctctatttctatgcaacaatatgttttcttaccttcatatggatcactgaaaaatggaatttattcttatatttctcctttttttcattgtaaggaggtgataccctaatagttctgtaagtacccaaaatcaggatagttaaaattctatttccttgaaaatatggaaagaaattcttgatttttatctcaatttattagtaactaacagaactaattttaaattccattttttcctctctcagaaattctacaagtactttaaatggagctgtcactgtgtatccaagcaatgaagcaatgattgatttctgattcacctctgataaggctacttttgatcaattattgaacatcccaggagtgcacaggactcttgtattgtatgtcctgacagcactgtgtgatttggccaatccattactcttaatgcctttgatgtgttccttgcctgattaacagctcaatatttctagagcttatattcctaacaaatctcactctgtggcatattgcttggctttctgtgtttcatgaccaatttgcatacagttaaagaaatgttcccctaaatatcactgatcagctggaaaagagatatatcaaacaactatagctatcctagaggaaaaacatgggtaaatcagttaaaatgttagtctggaagccaattatttatcacctaaatgatgatttctttgtatttttactttgcactgaaacacataaaacaatttcacatgacacaatgacaaaattgcacgctcccacactggatccttaacctctctgagactgtgagttagatatattttgcatttgagattaacactgagaaaactccaaatttaggactaaggcattcataaaactataattcttttcaagtgagaaaatctgtattacttaacagagactgtactatttaacaaaatcagagatgactaactctcttcattaattctgacagttcatcatagggttgcttctgttgataagatctcctcttcataattttcatctgccatgaacctattttaggtttttatgaaaaagcacactgtaaatgtgttttggtttgaaaaccactgtcaagttaaataattgtttatatagtgttcattttttcattcatcccttcatttgatcattcaataaattgattaaattctcactctgattaatacagatgtatgttgctagacatttgaatgttgactttgaatcatattctaatgcaagattaatcctgatgtcagcagagtgattctgcctccttccaatccatttgtcacatagtagccagagtgatttattttgtttttaaaaacacataagtggatcaagtcaacttcatcttgtgatacttttccttgtcaattttttccctttaagctggccctgccattcctaaaacacaagatctctctgatctgccttagagcctttgggcttgctattttcttgttgcttatcttcattcccttggttttttgtaggcctcttcttttattctcaggtaggcctaccctaagaaaagtaccctctgatattatctattgaaactccataagtaaatcttcatagcacttatcacaataagtaactattttctccctccctccctttctctctcctatctacctatataaccatccatccatctactcgtcatttcctgtctatcccaaccatcccctcatgctcttgctcatatgcaaacacatattagattttaatcccatggtacaggaaatttgttcacctcaggaaggacagaagaggctcatatttcaccacttcaaaacatttccacatgacacaatgaacatttctcctatacacattagctttttcgcatggccaagtgactttcctagtgtccccttctctcttttccctcctttccccattggctctcccttttccatcatcctccctagaaagagacaacaaaggaaagaccaaaacaaaaatatttttgatttcttcaacaaaactattcggttcagttctccctagaagctccaacaaacatcattcaagacctgcttttttattggaaaagatttaaactttgaaattacagtttatgacttcacagaatgcagttctcttcccagtttctgcttgtgggtgcgagagattcacacttccagttttactagcaagattgacatatttctattacaggattagccccatatttctaattgtttttgctcattggatatgcagcctgtactgagtctagagaattttaaaaattacttcctagttggcaaagcagcactatgattcttattgcaagtatgagagcattacataaaatcagcttaaaaaaaaacataatgtatccacagaccaactcagaccacgaagtgtttcagggcatcagcttatttaatcatcacaacaattccttacaattcctttaaaaataaaagaaagattgttgttcctattgacagatggactggggagattaaaggctttcccaagtagcaaattcacagccaacatgaaagttcactacacaagaaggatggaggcaatgaggctgagtgagagcagccaccctgtgtccagcacagcacctctcacttgtgcttttccccattcctcttccttgagattactggtaataactatgaatgtccacatctataaaacccaatcatctgggtagaacttgacattcaatattaccaccatatttccatctcagaaggtgatgtacctacaatcccatttagatatactgataactggattcttaatccacttaaaaagatgaaggctttcaaactgttaggtcttcctacaagttagaatgtggggaattttcaagtgctgtgaagatagggagcagagaggcaggacttgccatgtttgaactttcaggcatcattggtagaatcagctttaacccaccctctacctctaacaggaacatgagctctataattacatgtcttcactgagcaaccagcaatcatggccacattcagctggtctcttcctcaccttatttgcccaaagtagcaataatacaacatgcacaaagtctgtatctctgaccctgattacttatctttactctcatggccacagaatttctcacatttctgactaatcagaaatcatcagattaactagaagttaaaatggttcccgaatgagtactcagggagaatctttgttccaaatggtcttaaatgtctccaaccaatggggcatcacagccgtccgatcagtggcctttgttaacaagcatgccttgagcacgtccacgtctccctgtatagaccaacttgcttctaatcagtgagtattggtcttctctacagatttgtttgttaaaccgacatctacaacaaacatcagacatcaaaaatgatatccaccattttgctatatcatcttaattaaatgtcaaattcaaggaatgccattttcggcagtaaataaaaggcgccacaataacgtatcgtggaaattttctccccgttactctctcctgtttcctgaaaattgtttataccattttctctgacctctttattttattgtttagttgcaaaccttgcttaagctaacatagttactagttcatgtaaagcacagagaagcccttgactccattaaaattaaaattcaaaaaaaaaaaaacaccttatattagtgtatgtggaaccatagtatgtacctcaatcacgggaaaacatctgcttaagaataacttaaagttctggagaaatatcataagctctatttatgactttgagctctataatcagtaatcatctaaagagatctctctagactaatataatctgaatcaatagagtggagaaatactttatttcttacatgtttctctgtgaaggctatgaagcaaatgctgctttctcaatcctctgcaatgcagtgcctgtttttttttatgtgttatagtgtaaatatataaaattacagtataagataatttgtatgtggctgttgaacctatagaatcttccaagaaatctctgctcaagagtgaaccagaaaaatagaaattatactttctcctttaaaatgggattgtgatatattatatagatgaaaattttaaagatacaaaaataataactgatgaaatgatcagattccttatattacattgtagggtctctcatactctatcctggctagtgcttaaatgtatgtctctgagtgaaatcactcctcaggatctttgcacaactggccagatgtagaaggtactctcatcactatcttttcctcctatattgtttcattttttttgccagacaaagagtactttgaggattatatctgcatatgtagtactcattcttagtgctttcaaatacaattaggaaaggaataacttcattctttaaatttttcttacatttttttccttatttgaattgaatagtgtactcaattttttgtttaagtgtttttttcaggtaattcagacccaacatcttgaattgttatttttaataaaaatgatttaagtagttaatcattggtaatatttttataatagaataaattataaattgagttttgtgttgctatgactaacaagtgtaactgttgatatttaagcagttggtaagaaatgagtttaccagagtaccaggcaaggaaactttcagaaagccatctagttctcattagaaggcttcaatcattgcagagaccattatggtatattcctttgttctcattcaatgaagaaaacacacacacacaaagaacacaaagcaaggcctttaaaggttgctctttaaagaaagaaagaattaaaacagtttagtccttcttgaatttgtaactgccaaatcgctaatgtaggcaggaaatactgtagcacacaaactgcttcgcctgatgtagcataaactcactattagggggaaatgatgccagaaatttaataaaatagacacatgatcatgactttaatctcaccaagtaagaatgtaagagtaatttactttgaaagtttctacagagaaaccaaagatactgtaattccttcctgttcctcatcacagggcaacccctacttccaacctcaggccatggggcttgatctgggaacatggaatcactggtgaaaggcatccagaggagctgagtcacatgtcagttgtcgccctggtacaactatactcagcatgccctgctcaagcttaaagtctcagatttattaaaatttaattgatataatttaaaaatcaactgttattttaagtaaaagcagttttacctttccagagatttaaattacctttaaataatattttgttttcccattttcctgccttaacctattggctatgatgtaggacccttttaagtaagttggtataatgaaaagactattgagtactattcagccataaaaatgaatgtgatccagtcatttgcaacaacatggatggaactggagatcattatgttaagtgaaataagccacagaaagacaaacattgcatgttctcacttatttatgggtcctaaaaatcaaatcagttaaactcatggatgtagagaatagaaggataatgaccagaggctgggaagggtagtagggggttgggggaggtgggatggttaatgagttaaaaaaaaaagttagaaagaatgaataagacctactgtttgatcacacaataaggtcactatagtcgatgataatataattgtatattttcagataaagaatgtaactggattgtttgtaactcaaaggataaatgcttgaggggatggataccccattatcagtgatgtgcctatttcacattgcatacctgtatccaaacatctcatgtgctccataaatatatacacctactatgtacccacaaacaatttttaaaaataaaaaagtgaacaacaaaaaagcagaaagcagggttttttttgttttttttttttaagagtattgaggtttttttgtttgtttgttttccagcaatgggagccaatatctggaaaactgagagactggatgtaaattgtttagttcagaagctactatagtagcataagtgtgacaccttaataccctagaccatgataataggaaggtaatagaaggggaaagatgtatctatcccatattctagattttaaaatttgtgatggtaggaggcagcagaataaaaacaacaaagcctctagtttcaaaacctgtgaccaagcaattgacaatatttgtaatagaagttcaaatgtattgcagattttaaattaatggagttgaaaggaaagcaattatatacttcagtttaaatgcagttctaagatagtgcctttgaaagaaattggcagatattataatcatctactgtgttctactatttaatccaggtggtacatataaaatgtcctataacatttctatgatttctagcttttccagttaataaagtaactttatacttattgtcttattgatgttatgataggtaataatagaaacatctcttgcatttgggaagtacttttattatttcaaccgataatagatcaatgatttattaatcatacctaactaactatagtctagcccaacacaggccaatgcctaagaagaatacaacagcgcatagcctagtgacacacacaatctgggaatgccagcagacctctggccaccttctgagcaactcaactactttggctgagggtccttgaataaaaaatagagtttaaataagacaagtaccaaacccattcacttggttccactctcctatagcaaatactggccatctcattaataattaaaaacaacagctgctaatgccttggaacaagatggctaatttacatatcctgagcgctggcaagagttctccagcacgttctgccaaacccggggaggattctgttttctctgaggcaggtaaagggcagaaaggaaactacagctcaaacacgaatattaataaagttgtaaaggagcatataattaagccatatcaattatttatctaattatgaggttattagtcatctaaaattactcagcaagcaactccagagtctatggggtactaacatacaaagtgttgtccaaaatcatcaggcctgaaaaactccatctgacaatgctgcttcaacattaattagctgtaagatctgaaggatgagtagaaaaaggaggatatggtgaaatattctattagaaaaagccatgtctttgatggctggaggtaagagaaagcacagtgttttctactaaatgattacttgtcttctgaagttatttcatttggggaaatcatatctttattccatgagtccagttggctccctgggtccggagctgttccctggagaatgttttgagttcaattatttaacactgagataagattctccatttactgcaagcctcaatggatgtcctaatatctgcatgcaggtagtgaagtgtttattcactgtgtagatggaataatgatcccccaaagacattgacatcctaatctctgggacctgtgaatatgttaccctacgtggcaaaaggtacatcgcacacatgatgggttaagaatgttgagatggagaagttagccagtcttatccaagtgagcatattgtaattatgagggtctttatgagccggagggaggaaggtcagccagcggagaagtgataagcagagatcagagagagattcggagacggatttgaagatgctgtggtactgtttgtctttaaaaatcaaaggagagacgacaagccaaggaatacaaggggcctctagaagctggaaaaggcacaatagcagattttcacctaagcccccaaaaggaatgcagtcctgacccattttaggcttctgacttccgggactctaagttaatacatttgtgtcacatttacattttaagccattacatttatggtaattgttacagcagcaagaggaagcaaatccattcatcacatctccccagaataaattcaccaatacctgaccatttcacatttctattctgaggcataaggatcatgagctaattaaatagcacaacagttgtgatatttcttattcacatttaagagaaagtagtttgtttaaacaaattaacaaataaaaagatttttgaaactacccttacgaaaacatgaagtaatctaaatgtgcaagagacaaattgggctatccagctggcctcccagattcacaggaatataaatcaaagcccaaaataaaacaaaactattggtatggaagggttccatctgtagaaatgatgagaaattcctataagacatattacagtttacgacagagagaagtttatcataaacattgtagaacataagacatctgaataaaaaaatctattgggggagagtgaatggagtccctacaggaatctacttacacagcctaaatcaggatggcagaggagggaggcaactatggaatctggggattgtcccttcaagaacagttttgagtcctgggtcctaggccttagtggctgaggacttttccttggcttactcccggccctaacagcattccaggaaaaatagaagcatcatagtagttcctcagtgagggaacttagaacttagagttgagtcatttacacttgtaaaagcaagtataatcttctgtttccaattcctctagcactttccctttaaaggaaatgaaaatgactcctgtctccctatatcgtactgtggaaattccagtagtcttcccagcatttctgaagctacctggaggtggggtacattttgtttccttggtcagcctttattatctcaggtcttctgaaggccactcccacttcaggtactgtccttcctccttcattttctaatatgccattaataaaattctagtgtttgtaatgtactacttctgaagatttgagtataactcaaaaggtctaaagcacagcaaagaatactgaacaatttaaaattaaatgttaggcataatgatactgaattttctaggtcatccagagaaattttctcactggccaaacttctttgattacataaaaaaaccaagagctccttcatcctccaaagcccattccctcccacctgccttaacctcgtcaccaaggattttttttttttttttttttttttttttgcgtgtctgttttgatttttttgtaccctccaaggaacaggtctaattcctgttactctactatacagagctactcaccttcttttgttacagtctctcccaccaagaaagattgaacaacctagaaaaataaccgctatggtgttttccaaagaacagtatgtcccctatgaatcccaacttcttcttaagcctcaggtgtaaactgcaggcagcttctaaaacagcaacaactcagtcaccctggtacacaaggcaacaatctctttggcccagcagtgattctctggtcaggttgcctccagctgtattttatttattcctctcaatgagcacctgaaacccatatttataactaaaggctgtaattggcttcaacatctgccccttctttggggcttaaaagatttgataggaactcacaccactctgacagaaccaatcctaaatctcaatattggacacacagtgccctctgagaaagactgcaaaatacattaaaacaccttatacttcaaaggaaggcaaccaaaatgaaaaaagaattcaaattctgctctctgaaaacaaaaccaaataaaagcagttattctatcaaagttgagaaattatctaattcttacctgcaaagacatttaaggggatatatttatgaagctaggggaattactaatgaaagcatagtgactaataaatcatattttttctcagtatcagtaaatgccaaagaactgaaattgtcataaattgcttctttagtgtgttttcatactgctagaaagtactgcccaagaccgggtaatttataaaggaaagaagtttaattgactcacagttcagcatggctagggaggccacaggaaacttacaatcacgatggaaagcgaaggggacgcaacacctccatcacaagccagcaagcagaaatgctcagtgaagagggaagagccccttataaaaccatcagatctcctgagaactcactcactctcacgagaacagatgggaaaattgcccctcatgattcaattacttccaccttgtctctcccttgacacgtgaggattatggggattacaattcaagataagatttgggtggagacacgaagcctaaccatatcagttgctgagaggaaaatgttcattcccaattattatatatctagccaaattttcatttgtacttgatggcaacccccaaaatatttgaagatgaaaaaaaatttaaagtatatcatatacattttaaaacagtagacattattaaaattcatggaaaaaaaaacaaaataacaaaatgaatcaaaagggtacatacaaaatacttggcaatgagcaaagaaatcagtaaaaccgagtagacaaattcagtgattctttatcttggcttcatgttttgattacctggaagaattaacagcaaaaataaatacaaataaatgtacattcataaaataataaatacaagaagtgtttcatggttcacattcacagagaagtgattgaattcctcttgggtagggcccagacatgggggctttgtagagagtcctctgtgactccaatgtacatacagagttgtgaaccctagtttaagtaatttgggggaacatgggcttattgacatgggaaataaagaaaggagagagctggagggaataatttttaaaatgctatatttctcctctgataacaataagagataatagttaatgtctcatttatttgtttgagctaagaatatcatcgaaaacgtaccctctgccagcctttttgataggtgatgggaatatatagtcatcaagatatgctgagtcctgaaattcaaggaacatatagtccatcaatagaaatcaacaagaaatagatggacacagggcaatatgattctgggaaaccaagcagggagcactagggaagctccagaaaatcagagctgcctgcctggaggagctaataatacctgatctaaactaataccgggtctgctcttgacttacaagcaatctgttcaggctcaacttacaaaatcattttctattattctagtttactgttacttgttttctcattcatcagtaactagagtcaatagattagataaaaaggaagaattatctagaggcaggtctactctttgaaaagaagtgaatataagagctggcaccaaataataaagccaataagaaatcaaaatggatccccaaattaccacaatcttgggacattttaaaaaagaaaaaccatcttgcgtatctcaatatttttccaaggtagtaatgagagttcaacatgcctacaaaagacatttaacaaaaggctaaacattgctgtcacttcctgttaagtatataggaagtataatcttgttggtagtttcactccttgtaaggataaatttcctacaaggttttgagaagagggagttgtctccctttagcctttgagctgtgtccctggtttgttatttctctatcttatgaacactgaattcagcttttggggggttactaatactggcaaacacctagaacttctatttcgcagttctcctcaataagatatcacttcttcctcacagacttttcaaaacaggaaaggagaatatggggtagactgtatttccattaaaggtccattgcttaattttctacaagatgtttacacattttaatggaaatgttgattttactgaggagttttggtaacaaaaggaaatttaaatgcattgaggagtgttcaaaaataaaagctgcacgctgcatatgactaaccttctaggcccaggtgtgatgagtggggcacaaaaatggacacctgttatgtgattttgtcttgtgatataccccaattcccaaattgctccgctctcctgagacccattgccttcctggagagtgccttcttgttcacactttaacaaggcaaatcctatcttcttttagagcgaccccagttgcttatctgagtgagtttatctgactttagaaaacatccatctctcccttcaccaagaaaatcgacgtgcaaatttgcttctgtacatgttgtaaagcataagtaattcagtctagaataatatcgcaacatacataggaagggggagaatggctagagaacaagctaagatatacctgtcacccagtgccagttcagatcctgtgatacctcctcatcagcatcaggtacagatatgctttttcactctgcttgattatccaaaaggcaactactgagtcaaacaaagacaacacttctaaaggaacaccatgcatcttctgagacagtcaagacaaaatccacatagaagaggatgaacacttctttaactgctagctcatctgttcagctgctgagcctcctgcagggtggctctcctttgttttacgctgcttgcacatggcacttctgtgcctttgacacctgagatgtgactcgttacaaagaaatgcatgtttcctgctctgttctcttcctctaataaatagtcagtaaaggctttagaatcaaacattttgttttttcccccaaataacttttaaaactatttaacattttggtcatggctttctgaaaggttctcttgccattgtgttggcatccaaggtgctttggatttaatttaagagggtaaaaatatgtgaactgtcatattcttctggctgaaaagtatgtaaatgttgcccattccaggagatatttgaaattataaagagaaaatgagttttcaagggaagggggaacattcagaatcttgggacaggccaagggtcatgagattcctaagagctgaatatgtgctctccagcggaagtgatgtgcctttgattgattaaaaggtactgctaacctcaacctcaaaatcaagagttactaagtaatggccctgtaaacatcatgaactagtgatgtacagtagagccttctggggaagcaaaagatggtttgagaagagagacagagcgagagagagaaagagagaatgaatattggaagctcaccctcagcacgtctaaccctttttgtccgtgcatcaaaaacttcaattatattaggtcataaaggagcagctaagtcttccctttgctgagttcttctcagagggaatcccggtagtaaggaaaaaaaagaaaacagaatacccaccaatttaacattctattaaattagatttacttaatattatactcttaaagggttaattgcactgtaactttactggaaagctcttggttataatcctaattattattatagaattctgttttcattaaccctttagcactgccttattaagttaatttgacacatattttgtgttttggaaaaagaaaatataaaataataataagagccttacagcagtaaatgcccaaaatacaaggtccagaattgaagaagaatatcatgtgaaatctgtatgaaagggtgatctgggatttggcagaggaaccattcagctacagcctgaagataaagagatacagaggaaaatcaaaagctaactggtaggggagcagtatgcaaatagggctgtgagttggaggcagccttattaattttcaggagaaccttgtatacaatatcatgaacaaagaacactcacattacagattctgtagagattcgctgaggaatacaaaagaaaaagtaaaacaaaaaacaaaaacacaagcaagcccaaatccagtgccattaaaggagtgtgtgtgtgtgtttgtgcgtgtgtgtgtgtgtgtgtgtcgaagaggacgtattcacatttgcactcacacacatattaaagcttgatgctgtctggagcatatacaatacctatcactagaaatctgtttacagttttctttttctaatacaacatctttttgcagagagcaggcctcctgcattattaatattcagacgacttgtataataaggtgcaggtacatttccatcacattgcatgcatttctataaaggtactcagtagcaaaactgatgtggagactaatgaatcttggccaaggagggtggtttggttactaagttaggctgcatgtcatttttacatatcactacattatttttattgcccactgttatttcgtaacattcattttaaagaataagtatccatgcccttatttaagattttccatcttctgaatgattctcaggattattcagcttcaagacacttcacagactttaagaaaaacaattatagacctgaattcatactcttacgattgccctaaggtttgtcctacaaagcatttgtttgataaaatgaaacaaatgtgtatgtggggagagagagcataggataggatggagcatctatatttgattttagacatctttttcttgtcctaaatgtcttagatgttcttcgtcctcctcaaattccgtctgtttattctagaagcttcagagatatatctagcccccaaagtaacaaaaataacctttggagaattaagttagttttacttaaactctttttaaatttgtttgtggatacgtagtagatgcatatatttatgtgatacatgagataatttgacactggcatgctttggcctaaaaatcacatcagggtgaatggagcatattatcctttctttgtgttacaaacaccctaattatactcttttaattattttattttatttttaaattttcattatttttatgtttcttgaaacaggtctcactctgtttcctgggctggagggcagtggcacaaacacaactcactgcagcctcaacctcctgacctcaaatgatcctcccacttcagcctaccaagtagctgggactacaggtatgtgccaccaggtccagctaactattgtattttttgtaaaatgaggtctcactgtgttttccaggcttgtcttgaactcctggacacaagtgatcctcccaccgcagcctcccaaagtgctgggattacaggcatgagtcactgcacctgaccttgtacttattatttatttatgtatttatttattttagtgcttaacttttattttattaacactaagattcctattctttttttattttactttaagttatgggatacatgtgcagaatgtgcaggtttgttacataggtatacatgtgccatgatggtttgctgcacccatcaacctgtcatctaggttttaagccctgaatgcattaggtatttgtcccaatgtgctccttccccttgctccctcctgcccaccccaatttgtagttatttttaaatgtacaacaaataattgttgactgtcatcaccctgttgtgctatcaaatactacatcttatttgtgctaactatgtttttatacccattaactatccacactgtcccttaactcctggcactacatttcccagcctctggtaaccatcattctactttctaggtccatgagttcaactgttttaattattttatctcccacaaataagggagaatatgcaagtttgtctttctgtgcctgacttttttcacttaacataatgacctccagttccatccatgttgttgcaagtgataggatcacattctttttatggctgaatagtactccgtcatatatatgtacattttctttatccattcatctgttgacagacacttacattgcttccaaatcttgggtattgtgaatagcgcttccacaaatatgggtgttgcagatatctctttgatacactgattttctttcttttgggtatatacctagaagcgggattgctggatcatatggtagctctatttttaattttttgaggaacctccaaactgttctccatagtggctgtactaatttacattcccttcagcagtgaatataggttctgacaattaacagtgcaaacaatacccaacaccatacacatgttaattggttcagattacaaaattccagctgaaaaaacaaagttcaagaaactttgcactcaatggatgcctaaatcagctgcagatgacagcacagctttcaatataaattttaaacaaacaggatcaaggtagagacatggctttatcagtatgatctggaatgcaaagtacaatcaaagcagtggttaccaaaaagtggaagtggtccagtcaaagcaaaaaacaagcaagagcaaaggttttggcaaaagattttgggatgctcaaggcatttacttgttgactctgtggaggggtagagaacactaacatctgcttattatgagtttttaaaaagttagccaaagctgtcgcagaagaacacacaagaaagcttttccagtgagtctttctccaccacagcaatgatcctgctcacctctcatcaaacaagggcaactttttggcagttctgctgggaagtcattagatatccaccttatattcctgatttggcccttctgacttttttgtttcctaatcttaaaaaaatctttaaagagcatccatttttctttagttaatagtactgtaaaaaagactacattgacatggttaaattcattctcctaaggatatccttcaaaaggcaaagttttaaattttgatttttaaatttgatgctaaaatttaatttcatttgttctggtaccatccattgaaaagattaccctttctccactgaaatgctttcgtactattgtaaaaccataaattcttcatatatgtgtgcttatttctgtatgaactactatgttttgttgatttgtctgtctttatgtcaatttcacactactttgataaatttcataagaaatcttgaactctcactttgtatattctaagtcttttgtgtttctatatgaactttataatcagcttatcaaatctataaaaaaaaatgctaggattgaatctaaaggtcaaattggggagagttaacattttaggaatactgagtctttctacccttgaacatggtacatctttccattttttaaggatatttcaaaaacactcttagcagtgttttatagttttcaatgtcaaagttgtatacatattttgtgagatttatcactgtattttcatttttatgctatttaagtcatatatttttattttaatttctaatcatttgacgctattttatagaaatatattttgcctattgatcacgtatcttacaaacttgctaaactcacttgttctagtagttttttgcagattttaaattttttttacatggacaatgattttgttcatgcaaaagttttatttttttctttccatctgtatgacttttacttcatcctctctcactatttcaatggctagtgcaataaagagagaatagaagtggtgagagaaaaacctctgttcttgatttttcacggaagacaatctgtctttaccattaagtattacgttagctgtaggttattaaccaattcccttccttggatcgaggaagttttctgttgttcctagtttgctgagagcttttatcaggaatggatgttgaattttatcaaatgcttttctgcatttatttgggatcatctatgttttctttttaattttgtcaatatgttgaattattgatggatctgtgagtgttcaaccaattttgcattttggggtagacctcagaaatgcgcatgatctagccggtcatgatataatctaagttattttccttctcagagaatcagccttttatttaatggatttttctccattttctctcttttttcagtggattaaattctggtctttattatttctttttcacacttcctttgggttcaatttgcttttctttagcagggttattgataaaagctgaggtcattggtttaagaccatttttttttaatgtagatcttctgtgctagaaggttttccactaagttactgctttaggaacattccacaaattttaacatgtgtttttattattcattcaacttaaaatatttttttaatgtagtcctactttagacattttaagttctatacaaataaaaggcattataattaaaatgtgaaataaactcatttatcattatagtttgttcttattttatttttttatttccataaaaaataaaaggaacaggtgatgtttgattattgaggaacaagtggtgtttggttatatgagtaagttctttagtggtgaattgagattttggtgcacccatcacccgagaagtatacactgcaccctgtttgtcattttttatccctcatccccttctgaccctttcccccgagtccccaaagttcattgtgtcattattatgcctttgcatcctcatagcttagctcccacttatgagtgagaacatataatgtttggttttccacccctgagttacttcacttagaataatagtctctaatctcatccaggttgctgtgaatgtcattaattcattccttcttatggctgagtagtattcctttatgtgtgtatatatatatatgtatatatatatatatatatatgatatatatatgtgatatatatgtgtgtgtgatatatatatgtgatatatatatatatgtgagatatatatatatatctcacattttatccactcattgattgatgggcatttgtcttggttccacgtttttgcagttgtgaattgtgctgctataaacgtgtgtgttcatgtatctttttcataatgacttcttctcttcctctgggtagatacctagtagtgggattgctggatcaaatggtagttctacctttagttctttgaggaatctccatactgtctttcgtagtggttgtactagtttacattccctccagcagtgtaaaactgttccctgttcactgcatccatgccaactctactttttaaaaaatttttttgattatggccattcttgcaggagtaacgtggtatttcactgtggttttgatttgcatttcactgatcattagtgatgttggacattttttcatatgtttgtcggacatttgtgtatctttttttgagaattgtctatttatgtccctagcccaattttgagaggatttttttcttgttggtttgtttgagcttgttgtagattctggatattagccctctgtcagatgtatagactgtgaagatatttttcccactctatgggttgtctgtttactctgctactacttttgctgtgcaaaagctctttagttataattaagtcctacctatttatatttgtttttattgcatttgctcttgggttcttggtcataaaatctttgcctaaaccagtgtctagaagggttattccaatgttaattgatagaatttttatattttcaggtcttagatttaagtccttaatccatcttgagttgatttttgtataaggtgaaagataaggatccagtttcattcttctacatgtggctagccaattatcccagcaccatttgttgaatagggtatcctttccctactttatgtttttgtttgcttcatctaagatcagttggctgtaagtgtttgggtttatttctgggttctccattctgttccattggtatttgtgcctattttcataccagtgccatgctgttttggtgttttggagactatggccctatagtatagtttgaaattcagcaatgtgatgcctccagatttgttctttttgcttagtcttgctttggctatgcaggctctttttggttccatatgaattttagaattgtttttgtctaattctgtgagggatgattgtggtattttgatgataattgcattgaagttgtagattgcttttgtcaggatggtcattttcacaatattgattctacccatccatgagcatgggatgtatttccatttgtttgtgttgtctatgatttctttcagcagtgtctcttagttttccttgtaaaggtctttcacctccttgtttagttatattcctaagtattttattttattttttttgcaactattgtaaaaggggttgagttcttgatttgattctcaccttggtcactgttggtgtgtagaagagctactgatttgtgtacattaattttgtatccagaaactttgctggattcttttatcagttctaggagctttttggaggagtatttagggttttctaggtagacgatcatattatcagcaaacagaaacagtctggcttcctctttactaatttggatgccctttatttctttctcttgtttgatttctctggctaggacatccagtactatgttaaagaggagtggtgagagaggacaaccttgtctcgttaaagttctcagagcgaatagtttcaacttttccccattcagtattatgtttatgggtttgtcatagatggaggtatgtcccttttatgccaattttgctgcaagttttaatcataaatggacggcggattttgttgaatgctttttctgcgtctattgagatgatcacgtgatttttgtttttaattctgtttatgtggtgtatcacatttattgacttgcatatgttatccatccctgaatctctggtatgaaacccacttcagcatggtggattatctttttgacatgttgttggattctgttagctagtattttgttaaggattttagcatctatgttcatcagggatatcggtatgtaattttctgttttggttatgtcctttcctgattttggtattagggtgatactagcttcaaagaatgatttagggagggttatctctttctctatgttgtggaatagtgtcaataggattggtaccaagccttctttgaatgtctggtagaattctgctgtgaatccatctagtcctagcctttttttgttggtaattttttaattaccatttcaatctcgttgcttgttattggcccattcaaggtagctaattcttcctgatttaagctaggaagcttgtatctttccaggaatttatccgtctcttctaggttttctggtttatgtgcataaaggtgatcatagtagcctcgaatgatcttttgtatttctgtggtgtcagttgtgatatctcctgtttcatttcttattgcagtcatttggattttctcccttcttttcttggttaatcttgctaatggtctatcacttttatttatcttctcaaagaaccagtttttgtttcatttatcttttgtattggtttgtttgtttcagtttcatttagttctgctctaatcttggttatttcctttctcctgctgggtttgggtttggtttgttcttgtttctctagtttcttgcgttgtgaccttagattatctgtttgtgctctttcagactttttgatgtagccatttagggctatgaactttgcttttagcattgcttttgctgtatcccagaggttttgataggttgtgtcactattgttgttcagtttgaataattttttaatttccatcttgatttgatttttgacccagtgatcatttaggagcaggttatttaatttcaatgttttggcatggttttgaaggttccttttagagttgatttccagttttgttacactgtggtctgacagagtacttgaaaaatttcaattttcttgaatttattgaggctcattttgtggcctatcatatgatctctcttggagaaagttccatgcgccactgaatagaatgtatattctgcagttgctagatggaatgttctgtatatgtctgttaagtccatttgttcgagggtatagttttaatccattgtttctttcttgactttctgtcttgatgaccagtctagtgctgttaatggagtactgaagtcccccactattattgtgttgttgtttatctcatttcttaggtctattagtaattgttttataaatttggaacctccggcgttaggagcatacatgttgaggattgtgatattttcctgttggcctttatcattatataatgtccctctatctttttaatgctgttgctttaaagtttgttttgtctgatataacaatagctactcctgctcacttttggtgtccatttgcatgaaatgtatttttccacccttttaccttaagtttatgtgagtccttatgtgctaggtaagtctcttaaaggcagcagatagttgattggtgaattcttatccattccacaacttggtatattttaagtgtacatttaggccatttacattcaatgttagtattgagatgtgaggtactattctgtttatactgctatttgttgcttctataccttggtttcttgttttttgtttttgtcttttaaattatatttttgttttataggtcctgtgtgatttatgctctatagaggttctcttttgacgtgtttccagactttgtttcaagatttagagctccttttagcagt

SEQ ID NO: 508 - DNA, 20001 bp, Homo sapiens
tggccgtgatgttgagcatcctgagatcagacaattctccctggtctgaagccctcagcttgcctttggctgaggcccaagatggaaaaggacaaaaacaaaacaaaacaaaactgcagaggttaggtggcctaattcttttttttttttttttttgagatggagtctcactttgtcacccaggctggagtgcagtggagaaatcttggctcactgcaaccttcgcctcctgggttcaaatgattctcctgcctcagcctcctgagtagctgggattacagctgtcccgcaccacgcctggataatttttgtatttttagtagagatggggtttcaccataattggccaggctggtctcgaaatcctgacctcatgatccacccacctatgcctcccaaagtgttgggattacaggcgtgacccaccgggcccaacttttttcttttttgttttggtttcttaagtctcatttgcaaacttcttgaccaggcctagcttgaggttgagcctaaagaacatctcaggggaagtgtataaaataaaaggatttgaggccaggtgcagtggctcactcctgtaattccagcaatttaggaggctgaggcaggcagattacttgagctcaggagatcgagaccagcctgggcaacacgacaaaactctgtctctacaaaaaatacaaaaattagctgagcatggtggtgcacacctgtagacccagctagttgaggggctgaggcgggaggatagcctgagcccaagaggtagaagttgcagtgagccaagatcatgccactgcactccagcctgggtgacaaagtgagatattatatcagaaaaaaataaaaaggatttgaaagaggagtgtaaagtgatttacagtctacaaaaaggcatctgcagcacatctcattaaaaatcagggcggggtatacaaaaaattagccgggcgtggtggtgggcgcctgtagtcccagctactcggtaggctaaggcaggagaatggcgtgaacccgggaggcagagcttgcagtgagcagagatcacgccactgcactccagcctgggtgacagagtgagactccatcaaagaaaaaaaatcagggcagggtgggcaattctgtcactgagggcattatcagttctgctgttgttgaagacattaacacaactacgataggaccactttctgataataaaccctcagtggataatgcagtcttattgttttaagtctttagcatggcattcatgggctattgttccagtctttgtctccgggccagcctcatactcatcacaagtttctactactttcctctagagctttgccccaatcagaccttatgggcctccatgccatagttctttctttctttttctttctttttttttttttttcagacagttttgctcttgttgcccaggctggagtgcaatggcgagatctcagctcactgcaacctctgcctcttgggttcaagcaattctcctgccttagcctcctgagtatctgggattacaggtgcccaccaccttgcccaactaatttttgtgtgtgtgtgtggtggattatcataggcggtggagttaagagcaatgttttgcgggtgggggtggatctcacaaagtacattctcaagggtggggagaattacaaacaaccttcttaagggtgggggagattacaaagtacactgatcagttaggttggggcagaaataaatcacaatcatggaatgtcatcagttaaggctattttcacttcttttgtggatcttcagttgcttcaggccatctggatgtatatgtgctagtcacaggggatatgatggcttagcttgggctcagaggcctgatattcctgtcttcttatattgataagaaaaacaaaacaaaatggtggtgaagtgttgaggtggcgaaaattttggggggaggtatggagagataatgggcggtgtttctcagggctgcttcaagcgggattacgggcggcgagggaacctagagtgggagagattaaactgaagaaagattttggggcaaggggtgatattgtggggctgttagaaggagcatttatcgtatagaattattggtgatggtctggatgcgattttgtatgaattgagaaactaaatgaaagacacaaggtccaaataagagaaggagaaaaacaggtgttaaaggacaaagaattgggagtacccaggacatccaattacaaagcgtccaagggggttcagcataattacttgcttggttggcacaagtttaggctctatccttgagtttttttatgttgtcatataccatgccagattgatttaggtaaaaacagcattcttcatttaaaaatatacagtcttctttttttagcagtgactaagtcgaggccttggcaattttggaggaaagagaaatgcaaagccagcaattgtttgttaaagaaggattagaaatggctaggaaagagtgagtttgatattgtggtggagatagctggggagaggtagagggtgtcataagaacgggaatgagaattagagtaagtataaaagtaaagtataggacttcatcagggtgaaagtattggagtgtactttgtcactgaagatattctatccacttaaagagagacttaagggtggcagtttgaggtaaaaccaggcgccactgaataccaagagactgataaactgcttcggtgatttcactaataaaggccggtgtgttatcagattgtatcaaggtgggaaggccaaaccaaggaattatgtctgacagacgggaagaaatgaccgcggtggccttctcagaccctgtggaaaaggcctctacccatccagtgaaagtgtctacccagaccgagaggtattttagttttctgactcggagcatgtgagtaaagtcaatttgccagtcctgggcaggggcaaatccctgagcttgatgtgtaggaaagggaggggtcctgaacaatacctgaggggtagtagaatagcagatggaacactgagaagtgatttccttgaggatagatttccatgatggaaaggaaatgagaggttctaagagatgggctagcagcttgtaacctacatggaagaggttatgaaatgacgacagaatagaatgggcctgtgaggctggaatgagatattttccttggtctaagaaccatttgccttgtgtgggaagagattgataggtggaagtttcagcgggggagtaggtgggagtgacctatgatgaggagaaaaactggccatgagggacagaagtttgaattctagctgcttctttagctaccttatcagcataagcgttgccctgagcgatgggatctgatgccttttggtggcccttgcagtgtatgactccagcttcctttggaagtaaagtggacttgagaagagtttttattaaagaggcattaatgatggaggacccttgtgtagtgaggaaacctctttcagcccctataatagcatggtggtgcaagataaggaaggcatatttagagtcagtataaatattgacacatagtccctttgcaagggtgaggctccgagttaaggcaatgagttcggcttgctgagagatagtggaggggggcagagtggtagcctcaatgatagatgtggaagatactatagcacagcctgcctttgctagtgcgtggcgattaggccgggtggaactgccatcaataagccaaatgtgatcagggtgaggaacaggaaagaaggaaatatggggaaatggggtgagtgtcaggtggatcagagagatacagtcatgggggtcaggtgtggtatccggaataatgtaggaggccggattgaagactgggccaggagcaatggtaatgtgggagactcaacaaagagtgagtatagctgaaggagccagggagcagaaagtatatgcgtcaggtgtgaggaggaaaatagattttggaagttatgagagctgtagagagtgagttgaccatattttgtgatttttagggcctctaaaagtattagggtggcggcggccaccacatgcagacatgagggctaggctaaaacagttaggtcaaattgtttggacagaaaggctacagggcacggtcctggctcttgtgtaagaactctgcacagccctgcaattcggctgtgtgtaatgaaaagtgttgggatgagttagggagatctagtgtgggggcagcttctagggctctttttaaggaacagaaagaggagtggcgaaaggatttaggatctatggggtcagctaggtttggttttgtgagttgatatattggttttgttaggatggcaaaaccaggtatctaaaggcgaaagtatcctaccatgcccaggaaggaaaggagttgttgctttgtagaagcgtttgggagattagccggacacaatcagcagagagagcacatttgttttcatgaagaattatgtcgagataggtaatggatgaggaagaaatttgggcttgactgaaataatgggggctgtctgtgaaaccttgcagtagtatagcccaggtattttgctgagcctgatgggtgtcagggtcagttcgagtgaaagtgaagagaggctgggatgaagggtgcaaaggaatagtaaagaaagcatgtttgagatccagaacagaataatgggttatggaggggttgtggagggatgtattgaggataggagagtatatgggtttgacaccacagggtgggtaggcaaaacaacttggttgataagttgcagatcctgaactaattgtaagacttgtccagtttttgaacaggtaaaatggaattctaaggagagtttataggctttaaaagaccatgctgtaacaggtgagtgataacaggctttaatccttttaaagcgtgctgtgggatgggatattggcattgagtggggtaagggtgattaggttttagtgggatggtaaggggtgcatgatcggttgccaaggagggagtagaggcatcctatacttgtggtttaaggtggggagatacaaggagagaatgtgaaggaggctttgaaccggggcaaaaggcagcaatgaggtgtggctgtaacccaggaatagtcagggaagcagataatttagttaaaatgtcttgacctaataaaggaactgggcaggtggggataactaaaaaggagtgcataaaagaatattgttcaagttggcaccagagttggggagttttaaggggtttagaagcctggccgtcaatactcacaacagttatggaggcaaaggaaacaggcctttgaaaagaaggtaatggggagttagtagcctccgtgttgattaagaaggggtcggacttaccctccactgtaagagttacccaaagtgtctgtgatggtccaggaggcttccgaggtgattgggcagcgtcagtcttcagccgctaagccaagaagatctgggaaggagtcagtcagagagccttgggccagagttccaggggctctgggagtggctgccgggcgagttggagagtctgatttccactggggtcccacacagatgggacacggcttaggaggaattccaggctgcgggcattccttggcccagtggccagatttccggcactggaagcaagatcctgggggaggcggtcctggaggaacacctggccgctgtggttcaggcgttttgaagttcttgtgtgctggagatgtggctggggtttctctcacagtggaggcaagtaattgcaactcagaaatacgttgcctctactctattattgtacaccttgaaggctaggttaattaagtcctgttgtggggtttgagggccggaatctaatttttagagctttttctaatgctgggaggggattgggtaataaaatgcatattaagagtaaggcagccttcaggaacttctgggtctagggtggtaaagcgtctaagggttgctgctaatgggccatgaactgggttgagttcttatatttgataaaaaagagcctaaacgctaactgatttgggagaggtcggataaagaaaaaggagcattaaccttgactacgcctttagctccagccacctctttaaggggaaatttttggacaggttggggagggctagtcgcggaacaaaactttaagccagaccagatgtgaggagggaaggtgatagaaggattttagggtggggggagcagaggctgaggaagaattgggacctggcttggcctggccaggagcagcctggggagaaggggagaggtcagatgagtccatagaaaagaaggattcaaaggactcagagcttggggtggagactgaaggaacagacaggagagaaagaagaaagatttgggatgagtctcactgggagcagagactcgggcgggaccaatgtgtaaaagaatgcctggatgtcaggcacctcagaccatttccccatttttttgacaaaaattatctagatcttgtaggatagacaaatcgaaagtgccattctctggccacttggaactactgtcaagtttgtattggggccaagcggtattgcagaagaaaataagacgctcagattttaggtcaggtgagagttgaagaggttttaagttcttgagaacacaggctaagggagaagaaggaggaatggagggtggaaggttgcccatagtgaaggaggcaagtttaaagagaagggtagagacacggagaaggggggtggggagcagctctgggctgcaacgtgggtgagcagccaaagcaggcgtccccgcagttgacttgccaccaagggaatgtgggtgaatgaccaaggcaggcatccccgtggaaatcagacaccaatggaacgtgggtgaatatcagagaggcatctctgcaatgattaaacaccaagggaaggctgccttcccaagtccgtgaccggtactggagttttgggtccacggataaaatgtgtgtcctttgtctctaccagaaaatgaaaagaattgaaattaagagaagggagaggccgggtgcagtggctcacacctgtaatcccagcactttgggaggtcgaggtgggtggatcacaaggtcaggagtttgagaccagcctggccaatatggtgaaacgctgtctgtactaaaaatacaaaaaaattagccgggcgtggtggcacatgcctgtaatcccagctactctggaggctgaggcaggagaattgcttgaatccgggaggcagaggttgcagtgagcccagatcgcgccactgcactccagcctgggtgacagagcgagactccgtctcaaaaaaaaaaaagagaagggagagattgaagggtggtgccaagattgaaaggagaaagaagttgagggatagtgagagaggttggagaagagagtaaaatgaggctgcttacccgaattaaaatcggtgagatgttccttgggctggttggtctgaggacctgaggtcgtaggtggatctcttcatggagtgagggtgaggacaggggactggtctcctgaaggagtcccactgacctgggtcttcagcgccaaatgtctcacgtgtccatgtgaagagacaacaaaacagactttgtgtgagcaacatggctgtttatttcacctgggcgcaggcgggctgagtccgaaaagagagtcagtcattttttataattttagtaaagatggggtttcaccatgttggccagactggtcttgaactcctgacctcaggtgatccacccacctcggcctcccaaaatgctgggattacaggcatgagccaccttgcctgaccatagttcttgctctttggcccctttgactggcatggtctaaatacaccacatctttgtctcttcataagggttttactcatcttttaagccttttgttttcatttacttctactaatccttccactaaatcaggacttttaaggcaccaatcaataatgcatagctttgtatattggtactctgtgcatttgaattactctagcactagattgttaactctttgagagcagtaattgtgacttatgttgtatgtctgttgggaaagttctgtgtatcaagctacacatgcataccagttgtccaattagaccttcaacatagactgtgaaagctgagaacttcttagaagtgaaggaaaaaaagacaggacctgagtggattgccaccagtcaccctcttctttctgcctctcttgaatttctttgcgcaaaaagaatgcagtgttggtgtcctcatttaatcattactatggtttttgaggctcttaaaattaactttaccctaatgcttttctaaaatgccacttgacaacagtgtacaggtattttacataactactgtatactggaggtgtcttccatagaatgtagtgatcaaaatccagatcatacttatatcccgtcagtgtttccattctaagctcctctccggaaggatttgttacttattttttaatttgtatcaggctccagcctgacattggagttctcggtcctgctataatgtaagaatccttttctgcctcaaaatgtatattttaatcactacagcaattcaacgtggaatgctgtgtttctctgctggggaagccaattcaatcacccacaccttctgggggcaactttgatggtcaaggctgtgggactgctcaggatcccctgtgaggcatcctatgggttggatgtcatccttgaacccaagtgactcaagggctctcagcaacataagccacgtgtatttcctcaccctgagtcctcattggtttattttttgttttgttttgtttttgtttatttttgggtttgttttgtattcttttttgaaacagggtctcactctgtcacccaggccagagtgcagtggtactatcacagcttattgcagcctttacctcctgggctcaagcctcctccgatctcagcctcctgagtggctggaactacaggtacatgccaccatgccgggttaattttttaatttttttttgttttgtagagttgggggtctcacaaagttgtccgggctggtctcaaactcctaggcttaagcaatcctcccacctcagtctcccaagtaggtaggactacaggtgcatgccactttgcttggctagtttttttttttttttaatttttattttgtagacataagggtctcactatgttgcccaggctggtcttgaactcctgggccgaagcaatccttccacctcggccttccaaagtgctgggattacaggtgtaagccaccacgcccagctgaattcgcgtgttaaagtgctaaagacaagagacctccagacatttcctggacaggaggcctgagctcttctcttttgatacatgctgacctgggctagcagtggactctcaggaaaactggacactctctgatcctcactctaggagtcagtcttgtcttttctttcctctaggtttttttttggggtggcctttgaagacccaagtttattatcccttcactcctcctaattctgagaactttgtccccagcagggtcagggagtaagaagggaagtgcttgcttctcataggtctactttagggtcaagggcatttcctatacctcatcttctcttttcccccaatccctattcccttctggtattcaatttgtttttaggcatctctagtggattttcaccttctttatctttacattgattttcctgtggtacctctgtggtatcagagggtagagagaggcagggattgaaagaatagaaggaccaggtgcgatggctccgacctgtaatcccagcactgtgggaggccaaggcagcagattgcttgagctcaggagcacaaggccagcctgggcaacatggtgaaaccttctctctacaaaaaatacaaaaattagccaggtgtgatggtgtgcacctgtacacccagctattagggaggctgaggtgggaggattgcttgagcctaggaggctgaggctgcagtgagccatgatcacctctcagcactccagcctgggtgacagaagaaagaaggaaggaaggaaggaaagaaagaaagaaagaaaagaaagaaaaaaagaagaaagaaagaaagacaaagaaaaaagaaagaaagaaagagagagagagagacagagggagggagggagggagggaggaaggaaggaaggaagaaagaaaggaaggaaggaaaggaagaaaggaaagggaaagaatagagggaaggtaacattggctctatggaccaggtgtggtggctcatgtctgtaatcccagcactttggaaggccaaggcaggtggatcacttgaggtcaagagtttaagatcaggctggccaacgtggtgaaaccccgtctctactaaaaatatagaaactagctgggcgtggtggcaggtgcctgtagtcccaactacccaggagcctgagtcaggagaatcacttgaactgggaggcggaggctgcagtgagctgagattgtgccactattctccagcctgggtgacagagggaaacttggtctcaaaaaaaaaaaaaaaaaaaaaaaaccagttggctctattgattgttacaacacaagcctgctgtgggaatttctatatttagaggcttcttgctttgggaattttatccaaagactcactgtgtagctaacgccaattacttacttgctttgtttcctcaaatgtcatgggaggcgattcataatttagtgcactcaacaaacatttattgagtaaacaagatacagaccctttccttatgccactcacaagctagccatggtaataaacaattgaacaaacactgacgatacaaaaaggaagtataggcccagaggaaaatgtaacaggggctctgactggaaaaggcttaaaggtgttttcccagaagaaatatcattttagctaaggcctgaggatgagtggaggttacttgacaagaaatggggggaaaaatcgaggctgaggtcctgaggctgagcaagtctgttctgtggagtgtatttaatgagttgggtattcagagcagattctttttaaatgcccccttctctattccacaaaattatttggtaagaatcataagataaaagaaagaaaataatggctagaaaaatgaaaatagtgaaaaatttcttttatataatatcatatatatataatgatgcctgtaaattttatttatttatttatttatagagacggggtttggccacgttgcccaggctggtctcaaactcctggattcaagtgatccactcgccctggcctcccgaagtgctggtattacaagcgtgagccactgcacctggcctgtaaaatgtaaagaaataaaattaaatagatactatgacagaaaaaggaaaagagtaataaaatgatgtttaaaattcataatgtatttttcaaaggggaaaaactaatacctatgtattgttctgtagctgaataataatattataatttctgtttttgagatttaacttctgcagatttatcaatgactacatcaaaactggttttatttgcatgttcccatccaacaatcagtatagctagatttttcaacccaccttcacctacagttgatcaaggaacatttttattcattttattgaaaagtttctttcacatgaagcaacaaaaatcaaatagggtaaagattcataaaaattccacttcataataaattccacaaggtgcaatacttttcatgtcttttgccctctgactctagacacttctgaatgtttccatttggagcttttgtgttaaaaattgtgtttcttagacttgacagtcactgtactgttattgttatttcaagtctactgacaagagaggttggtactttgtacatgtggacaatttctcctttcactagaatatgtagtaagatacatattcacagaaatatgtagtatgctgggagctgaagacttgagagcaagaatgattccaaatgattgtaaacttactcttgagacaaatacatagagctgagctcatatgcatgggacttgactgtatacttgagtgttccaaagtaccttttacaaagactgcaatgattattaagagataagtaataaaattgggctaatttgaaagttatatatattaattatatacatataattaaaattaacagtaattgcagcaattgtttagtacttaagacttacgaaagatttgttgtttgtattttatgaattcccttcagccaaaaatgacaagggacacaaattagctgggcgtgatggtgcacacctgaagttccagctacttgagaggctgagactacgggcacacatcatcagctaatctgtaattgaacaagttgggtttattatttgtttgcatagagggaggacacacaccatgagaacccatgggatgtctcagaaataggatattagaaaaaacctatttggtttggatctgggctttagttgggtaatttgcaggagggtctaaggaagcaggggtttactctggattgggtgccattagaaagtggacgcaattctatgatttgacattttaataagtcttatagtgggagagaccaaagaccaaaactgtaattgataaagaagctggagagtgggatatatggtgctctgtgttgcacagtgaccatgtctgaagtggatgttctgtgaaacaatgcatcccattcctgccctcacccaggcagattgctctcaccattccactcttggttcaccactgctgatctgtttgaaaaatgaatagtttcttttgtcggatcaagaggtcaaggagatggggaagtagatgacagaaattggtcatgaagggcctagtctgtcaaattaagtcaattaaactacatctaaaaataatatggaaccatgagaaggtttatgtaaagattattagattactattttagaaaaatccctctgtaaggaaaatggactggggaggaggttaagactagaggaatcttttctgcaataatccaggcaaccaggtgtggtggctcacgcctgtaatctcagcactttgggaggctgaggtgggtagatcacctgaggtcaggagtttgagaccagcctggcgaacatggtgaaaccccgtctctactaaaaatacaaaaaaattagttgcgtgtcatggtgcatgcctgtaatcccagctactcaggaggttgagacaggagaactgcttgaacccgggaggtggaggttacagtgagccaagatcacgccattgcactccagcctgggcaacagagtgagacttcatctcaaataataataataatccaggcaagagataatgatgagttgaactaagatgctggagaaatgaggacagatttgagagctggatgacgggtagaatgaaaaagccttagtggctggcagtatatagatttgggggagtcaaggatgactccaacctgagcagcagggtggttggtgagtctattttccaagccatggaacactggaagaagacacggtttgggctgagatgggagaaatgatgagctcaatcttggacgtaagtttaaagttcccatgaggcatttcaatggaagtgggtagtgggtaacagagtcaggatatcagaagccatttcccaactggagaaacattaattaatatgacaactatttttttttttgcatttgctatactatacaccatacctgccacagtcctgataaagacacagcagttaacaaaacaaaattcctatctttattgacaaataagcgaatagtacgtcagatggtgatagaaaaacaaagcagagagaggggatagggagaattagtaggatataggtctgagatataagtttagaattagttccttggcttcaagaatttgtgataaatacaaattctgatgaccttcaagaaatgtcaggatccagtctccagtggcaaggtcctttctatttaaatccataacagggtccactctgctattcgccagacttcccagatcataagaatcacccaggaggcagaggttgcagtgagctgagattgcctcactgcactccagcctgggcaacacagccagattctgtctcaaaaaataaacaaacaacaataacaaaaaaacctaaagtggcttggaaattgccacttagtgattgggaagattccaggaaatattaatttttaagaacatggtttattctcttagtttctttgtcacaaccccaagtaatttggcaaaaaattcttcctccaggctagatcctataggttgcaagagatgatatgctaactgccctcacagaacttacagtttagttgggagaaatgacttctgcacatgaaaccaagagcagagcttagatttaaaatgaaaataatcacacttggacattgctgggttgtctcagttcccagggggattacaatgaagtgcacccactccagaactaaaatgtataggactgaattgatgagactagccatctagagagagaccctttagtctgaagatgggtggccaaacactgtcagataccctcagcctgaaacagaatccccagaaaaacattgggatggatggagccaatcagaaaacaacaacaaaaagaaaagcagtgattttcctggaatctggaaaatggcatgaggagaatggaggatatacaagataaataaattcttaccaagtgtctaccaaaggccaggtttgggactactaggcaactgatgtttcaacccacgacaagcttgtgaggctgattgtgcctttctgctttatagatgaggaagccacctcagaaaaatttagtagctaacccaaaataaagaaattgcttaaagtctatttgacttcaaatgccaaggataactaggtaagattaactcaaagacaaatttttaaagctacaagctttttgtctatgatagtttctctctttctctcctcccaccctcagactcttttaaatatttttattatttatttatttatttattgatttatttatttatttagagacagagtcttgctctttcgcccaggctagagtgcagtggcgatctcggctcactgcaaatctaccccccaggttcaagcgattctcctgcctcagcctcccaaatagctgggattacaggcgcccgccaccacacccggctgatttttgtatttttagtagagacggggtttcaccgtgttagccaggatggtcttgatctcctgacctcgtagtctgcctgcctcagcctcccaaagtgctaggattacaggcatgagccactgcacccggcatatttatttatttatttatttttgagacagagtcttgttctgtcgcccagactggagtgcagtggcacattcttggttcactgcaacctccacctcccggcttcaaaggattctcacgccccagactcctgagtagttgggactacaggtgtgcaccaccacgcccggctaatttttgtatttttagtagagacaggatttcttcctgttggccagactggtctcaaactcctgacctcaagcgatcagcctgccttggcctcccaaagtgctgggattataggcgtgaatcaccatgcccagtctcctttaaatattcttgatactcctatagtgtctgttgacacgcatgcactggctgtgggagcaattcggagctaggacatgcagcagtttctccgccagctgagttgacagcctggtggacacacttttcccacttgtttttgtgggaccagtagctgtcagagacctccacctcaaaagcgtgacttctcctgtcatagggtaaggctgccaggagtcagattttgagatgaagtttagcagtgagttgattgattaaggagtgctctcatgatcagtatttacagaaagaaggagaagaaactgggattgggtagaagtcgagttgtaatgccatcccaacaaaggcctcagttgatgccacggggaactctttaagcactaggatgacctctcagagttgtcccaacttaggctgatcttaataccccacactgataaaaaaaaatcctggcaggaagtgtgacctcaggagaggcaattttgttcacgcaagtgcaatcttcctaggggactaacagccgacggccaagttccagtagcactgccagtggctaggggaaaaagaccttcactcctagaggggaatctggaccatgcatcacagcgttcactacaacttgcaaaaattgtagaggatcggccagagttaagactttagcccaaatgactgttgccgctttccatccatttcccatttcccatgatttatcagttcatatttgtccatctcattttatttcagaatacggcaaatcaaagctgattttcattcctatgctaagaggagaggtgttgtccagaagaataaaccatctcaccgaagagaagggtaaaaataagggaaaattatacaagactgaccccattgttacagttgattggtttacagtggcaagacatcagaaccacatgatgggtccacttaatggatgggtttttgagaatggctggtaagcgggtgccatgttagttctgggtcagattgaaaggtcatgcctagttccttttccagccactgtgcgactctcttcaaaatatagagaaatcattggggggaaaagcaaagaacacaccctcacaccgtgaccattctcccacttggttgtcagagtcccacttttctaaccacagggtctccagtgcaagctcagagatgagagagaggaataaaatatctttttacaatgatcataataatccccaatctctgctctccctggaggcttattttgaaaatcacagcgatttaacttgttagcagtttaattcacttttaaaagattaaccagactaattattcatcagatttcaccatcattgtcagcctcaataaggatcttttgttacaatgattaatgtgttttaattgtatcttctctcagagcaataattcgatcgcacagtatttgccgaatctatggaaatcttggaaatgctttgacagctgagctattcttgggaaatgaaagtaaaggaatatatgtaactaacaaaaagtgttttatagtgtatcattaatatggattttcttcctctctgacagagaccttgctctaccagcttcagtccatgaagctgcctgctgttcagtcagtttgccattcagggacatcatagatcaactaatacagctgactaaactgtctccagttggtgtcttcaaatatatgctagtcatagtaatactcagagcaaatatatctaggtcacagggaaagttagtcaactagccagtgtccataaataatcatccaactaagagactggatcctgtgttgaccattttgttttctacctaatgcttcatcctcattcatttaactggtggctgctgtccaagttaagggtttttagaacagcaaaaaggtttggagaacctgatagagagatgaattatatgtggccaatactaatttcaaacttaaaatgtgttttaatattcttattttttaaagcacagtggttctaagagctttgggatcagatctgaattttattcttggcactactacttattaattatgagagcttgctggaaattagcaggacctagcctccctgagccttggtttcctcatctctaaactaggtataataatatccacctcatagtgagaattaaaatgaagtgttacatgtaagacttagtatacttcctggactacagtaagcattcaataaattgtttttgaaaaagcgataggccttcatagtgcaagacaatcatatgtacatgagcatttcagatgataacaattaccctgagatcagtaagaaaggtgtgctgttattgtttttgtttgttgttttcagacaggaaaactgggcacaaagagatgtggtaatctttgtaaattggtcatgtatgttcatcaataaactacttgatcaagcacgaagtgtgctctacaacccacagaggctgacttccattcctgctttttcaactgcatccttggaggcaccaagggctctgaatgagcagagtggttgagaacagaagtaattcattatttgttgacagactttagccctgctgttgtgattacatgaatgtagtaattttttaaagcacagtggttctaagagctttgggatcagaccaacaaaaccaggcataacttcacttaactcatgtcaagccaaggaggtaagtatcactcttccccaaatttgacagctgaggatactgaggcttagagatatttagtaatgtgctttgacggattcaaacccagatctgtctgattccagagtctgttttaaccatacactattttgcctcctgccagtcccacttagaaaaatgcagttttaaacagggtctaactgagacctatgaggtctatatagtaaccaatgaccattttttgaattattgtgctagtgcttcatacaccctgactccaaattttattttctttttttttgttgaaacagagtcttgctctgttgcctagcctgaaccgtagtggcacaatcacagctcactgtagcctccttctcccaggttcaaaagatcccctcaccccagtctcccaagtagctgggattacaggtgtgcaccaccatgcctggctaatttttaaattttttgtagagatgaggtctccctgtgttgcccaggctggtcttgaactcctggactcaaataatcctcctgccttggcctcccaaagtactgggattagaggagtgagccaccatgccaggcctaacattttccttaatttcagggccacagtttgggaaacccattgttccctcacttgggcatcagcactgtctgtgaaaaaggattacatggtcaaacattagagggtcaattcttccttagatatttgtaacacaaatttgcatagtaaaggctctgagaaacactattattaaaacaaattgtgtcagccgggtgcggtggctcatgcctataatcccagcactttgggaggccaaggctggcagaccatgaggtcaagagatcaagaccatcctggccaacatggtgaaaccctgtctctactaaaacacaaaaattagccagacatggtggcgggggcctgtagtcccagctacttaggaggctgaggcaggagaatcgcttgaacccaggaggcggaagttgcagtgagccaagatcctgccactgcactccagcctggcaacagagcaagactctgtctcaaaaaaattaaaaaaaaagtgttaaacctgattcctcaacttatttgaccacaaaacccttctttttagttataataattaagaacctatgggaactcatttagattcatttaaataaaaatcattgtgaaattttttagcacccagtataccccagactgctctcagaacttcatatgtattaactcacgttataatattcttaatgaggcaggtattttaaaaataatcttttcaggtaggtatttttattaagcagctttcccaagatcaccaactagtaagtggcagagccaggacctgaactgaggttgcctctctctaaagcctatgcttcctcagcttccatggaagagctaagaaatagtcagtcatacgcaaaggtatgctgtgttttttcctactttaaatctaggataaatatgcaacaccaaattaccatctgatcacatggacccaactaaaggggaaaaacaacaggcaaagccacttctctgaatcggacactcaaaaccatccgatttgtctgtttgatcttaataacaacattctcccctatagtgttgtttaattcttaaatacttttcatttgttccagctatagaggtctacttatatttttgtagatgtattttgaagcagaggtaacaccctcttatcaccgtatcttttcctgggtaataatcacttcaattttcctccaggccaaatggaccaagatca

SEQ ID NO: 509 - DNA, 20001 bp, Homo sapiens
cccagctgatggcctccttgggcgagaagtacaggccaccttaggtggcagggggtgtctgccagcctgggggagaggcttagaaactcatcctgccgggaggggaatggagggaatgtggaaggagggaaggctctgccttcctcttctgacgggaacagggtttcccaagctgaccttaagttggtcgaatgttggagagtcacgcagcggtggagacctgctcagggccccaggcactgccttaccccatttgcccatctgcaggccctgtgctcacaaagaaaccctcactggagagtgaggcacctggctcctgtgtctaaacacaccatgctgggaccagggttagagtctggggacagacctcagactgcctctcaccccctcagacttccacccacgtgccactttccaggacacagctcccacttgtgcacttacatatgaatagtgtttcctgcaggcacaaatatgaatggcatttcagccgccaccacccagactcctttctggtaccaaagtgctcattgttgcactcctatcccccacccagcactcagatgtcgtcactgtgcaaatatttcttgggcttgggaagcctctgactaaccaaacctccccatccgcctagactttgatgatgacccacgggcagggagcctcatgcctaagtggcctgtgaaactgacccatgaggtactgatccaaaggatcctgagaggtcagggagttcctgactcgaaaggatccccccaccacccgtcccctgccagaaacttcttagaattttcatcaagctctttcagttgcaaagaacagagacaccctgaaggtaactcaaaagataagagggagctcactggagccctagggcaggaaatggagtgcccaggcctggggccaaagcagccacacaccgtgaaggagacagcagggtgacactgcagtcaccagtctgagcttgaaggtgcagctctaccactacgagctgtgtggccttgagcaagtttcttaatctctcttcagccgtttcttcatctgtacaataagaatggtggtatagtgcctgctctgtggattatgattaagtgatcctagaacagtgcctggcccatagtaattgctcaatacacatcagcaattatcactcaatacacgtgagcaattatcttctctgcctttgctggctccaccctcctcttcccgctactgacttcacggagaggtgctgctcccctagaaccatattcaacactgccctggccctccagccccactcctgactgacctaccacctacagcactttggccactcccctcctaatggctaaatcttgaacgagaggatctgattggtcccactcatatttccatgggtcactaggcagcccgcagactgattttccttggataggtgccttctcttgatccaatcagctatgaccaggagccatgggcctcaggacacatacggctgcttttgcagctggagtgctaagtgggcaatgccctgggcccttctggtcccctgcctgtgtcagcccatcacgccatgccatgtcctttctgggcaatgggtacaatgcaggtccctctagagagggcagacaacagaacacagccccttaaacaccctcctttctccttcgcatcatcatcaccttagggtccatccatggaggggctcctgtcctgcttctggtcttggaatgaagatgacaatgggaatagtaacatgcctcctgcactgtactgctaatacgatgcttcacttaccagtgaactctcttctaatcactcctttgattgggaacctctccaatcgacaaccttgggaggtgggttttgtccccaagaaaggtgaagagatcacggggcctccactctcagtgacttggtacagggcagggcctgggagcacagggccttgcccttggaagacactgtgtagtgccgcctcacccattctgggcagaggcaggagcctccccaaatcgccggagcagaaggacccctctgggatccatggaaattcgcatcaccaggagtcctctacgggagtgcccaggagaggaagatacatgggtccaggggcctcttgggtgcccggaacccccacttgccagccccgccccaccaccagcttcgccccactggctgcagaggaatgacagtgctctgcgatgcctactaccccagctcctctgcagtgggagtagaggacccttaagcagcggtcacacaagaggctggacattgccccaaatagggtgttcagaagatgcccgaaagcatgggcagccatgggaactgcgttgggtcgtggggccccacgatcctaaccactcgctgatggcatcgtggctgggttccagaaccagtatgtcccccatgggctggcccacagcctcagagatgctgacacccccacataggggcccccaacacaggtgggggctgtcattgttctcttgttcttgttcccgctcaccctcagtctctcactctcttaactgtctctggaatttggcaagaagtccttgtggacttctttaaaaacacgtatcattgtttcttgaaccatttgagaacaggttgcataaatggtgccctgttccccttaatacttcagtgtgtgtttaccaagaacaaaggtcatccctgtatctaaccacagcagagttaacaaataggacattcaacactgccactgtgctcttatctaatccaccacccctatttcaggttaggcactagttttccttagagtgttcttctccagctcagggtcacaccctccattttacagccagctccttctgctcctctaatctggaagagctcctcctcctctccctttgccttttgtgatgctgacattgccgaaggctgcagtggcctggcctctgcagtgtgacagtgaggtaggcagagggaagcgggggcgggggggcagcagggggggccagggggagcagaggctagaaagcagctgaagccaaggggctgagagaatggagaatcattgattggtaggagctagaagataaaagcaaaactgaagggcaggtgaatctctgtgcaggcagagctctggaaacaaaagaaatggccacctacttgcaaggtgcatagagatgatggaaacactggagctccattccgtcctgaatgagctttccaactcctgcggcctaactgcgggcaagagtcccatctgcctcctctccttatacggtggcccccatgaagactggagggaccctgagtgtgagtgtgtctgttcctggcagccctgcacatccccagagagaggctcactctgcttccctgcaccatcagacaagcggaagcgggacatgttgcagaacttcaccgattgcttttgtctgtggcacccacacccactcagagagcacatgtgccaagctgggaatggggcaggcatgggagacttcctgaagagcagcagctctgacccctgaggtggggcccatccccacgtgaaggtcaggagcacagacggtctccccaagggtgcacacagctgagcagtctcctgccaccctgactgtgatctctcatttcagcctgggcccagaaggaagaggccattgcaagcttcctctctcttgtctgtgccaggcctgagccatctcaggagcacacagctcactccccagcccccacgcaagggccagggctcagtggctgtagtggtggcatcctgcccagcacacacactccccccctaagaacacccacgccaagggtacagggcctggtgcaagctgggctgagcccacagaggcccctcctgtcctgggggagctaggagaagggctgggtgctctctcccatgcagagaactttctgagctgggagccccacccttctaggtgcttgtcttctttcctttctcttctttcttccttccttccttccttccttcacttgtttctctccctttcctttccttccctttcctttcttctctctccctctctttctttctttcttcttttttttttttttggagacagagtctcgccctgtctcccaggctggagtgcaatggcgtgatctcagctcattgcaacctctacctcctgggttcaagtgattctcctgcctctgcctcccgagtagctgggagccaccctccaccatgcctggctaattttttgtatttttagtagagacaggatttcactattttggccaggctagtctcgaactcccgacctcaagtgatccgccggcctcagcctcccaaagtgttgggattacaggcatgagccactgcacccagcctttcctcttttcttttccagtccatcaggcctcctgtggcctcaaagagccatgcctcccatgcccaccccacaccctgcaagacgcctttccagaatgcccactccttgcttgtgccttgtcctttaagatccttcccacgccttctagaagtcctctgccaactgcctcccaccttacggggcccttatgctttggcagaacacccagaggccagcacagccctgtgggttctgcttcttgggttggacccccacattccacatacccgggctcagccacacgtgtgggtgcccccatgaatggaacgccaagctgggtcccaggaggcgcccctgtggctgggaggcttgaggtacaaatgtggagtgaggccgccatgtccccacccacaggctgaccttggccttctctctctgcccagatggacttgcccaagccatgcaccatcccagctctgtaccctggtggtgtctgggaggggactttacacagaagcacagccctcctgagcctattgtggctgttcaagggcctgtaattggtcccaaagtcattatattttcttaataaagttctacatatgtttaatcctattctataaattactttataaatatgcatctttacattaggatcttctgggacacacgggccattgaacacaattttcagaactttcatattcatgtctatgaagatatttcagataaagcactttaaaaagtcttgaataatgtggccaccagagattttatctggagccataagtaccatttataaaacaggagagttcttcccatcgctgaccccattctccataatgcaacttttaactagattgctttttaagtgatctacaaagagcgtgttgtaacatctaacatgagcaaccataaaatcaaacctctggggatgatttataaatcagttctaaatttctttactacttttttttttttaattatttcatcagatgatttccatcagcatccaacaccagcaatgactgaggttattcaggccaagagatcttccctaaatagtattttgtgactcaaaataatccaaagagcctccccacacttcaaggtgactttctacaaggcttctatttcctgatagatcattgtgagggatccagagaaaggttagaaagagaaaggttagaaaggtagtgtggtaggctgaaatgtccccccaaaagtgtccatgttctaacccccagaacctgtgaatatgttaccttacagggtaaaagggatttgaaaatgtgattgaattacgaatcttgagatgaggccaggcgaggtggctcacgcctgtaatcccagcactttggaaggccaaggcgggtggatcacttgaggtcaggagtttgagaccagcctggccaacatggtgaaaacccatctctagtaaaaatacaaaaaatcagccaggcgtggtggtgcccacctgtaatcccagctacttgggaggctgaggcaggagaatcacttgaacctgggaggtagaggtctcagtgagctgaaatcgcgccactgcactccagcctgggtgacaagagtgagactccatctcaaaaataaataaataaataaataaataaataagaatcttgagatgaggaggttatcctggattatccagtgggcccaatataactacaacagtccttatataaggcaggcaggagggtcagagtcaacagggggagatgtgatgacggaaatgagagtggagcgatcggaggaagggctgcaaggaaagaaatgcaagtggtctcgagaagcagaagacaaggaagccaactctcagagcttccagaaggaaccagccctgtcaaaatcctcactttggccaaataagaatgattttggatttctgacctctagacctgtaaggtaataaaattgtgttgttttgagcaacaaagtctgtggtcatttgttacagcagccacaagaaattcacacagagggttgagtgaatgagctaccccagcacagatgggcacaagggctcagggaggcctttgtcaacctgcgctttggggtattctgcaagtccagctcccatgcccagcccaggaggggctgaggattagaagcctgaataggcgtgatcctgcctggtatatttccaagtgtccactctgacgctgttcaatcgggaaagctccagcaacttccctcctccttgatggcgctcagtgaccatgcagggccttggagccctggaacttcagagcagggaagaggggggcagcggccagccttcatcaagccctgcactccacctgtgaccagcacagctcccagcacattgccttgctgtcccccacggcctcctcccaggctgctaggctgcaacggggtgaggtgaatagaatgcttgtcagtacctgcctctgcccccactcagcccactctggtgaccaaagacgcagtgtcatagcctgagttaacttcctgcagtcaccctgtctgcctacagttttcaggaactaaagcacactcccaccaaagcagtcacggtgctagcttgctcccatgctagttagaccccttggagcccctacaactgtctagaaggatggcacctttttctgggctcaaatatgggcaaggctgttgttaacaagacaattgaggggtatgtactgggaggccttcccctacaagtccatccccaggagccccttctcttgccactccgtcctccctcctcccatcacccatctcctgctccttccttcctcatgcccccaccacctcccagcctcccatggttccagccttggcccctcctgctctccagagttgccttttctctgaggaggctgcaaataagcccagccagggtctggggcttgggcactggcccccaaagcccacccagccctgctaagaggagggtgggacgggcaggccatgaggccctgaatccagagcccaaccccttccctttgagcctggcaggttctatgcgcctgcagccctgcccttggccaaaaccaaggggtctgtagggaccccagccaagaatcagaccagcaaaagcacatgggttcaggcccttgcttgtccttctacccagaacaactgtcacctggtcatggtcaggcactagctttccccagaaaatcatgtaggagtgcagttggccggcaccccagggatcaggaagctgagatcagcgagaaggaggagggtcaggggcaaggaaccctatctgggcaaaagcccagagcaggaagaagcatctgctgggggaaacggaagcagcccagatggccctgcagaatcttctccatgggttccacctccaggggaagtctctgcaggcccccaccctcttcctgcaagctggtataaacgctttccccttatgattccgacagggtcctcattctctcctgggatgccagggagctgccctccaccccagttacacgcacctcacacgggcccccgcagccgtgcctgcagcaaaggtctgggcccttctgaccacagctcgtggcccaggcgcagacccctgacccaagctggccaactggattctctctcctaggaattggagacttgaaccaaggaggtgccggctctattcttttagaatgttgactcagaaagtgatatgaggagaagctgaggtcgccgcatttgatcctctacatataaagaggcagtgaaagtcagcctccagagggagaaaaaagcaggcctgagagaggcggaggggagaccctgaggcctgagagagaggaggaaggtagaccaagaggcctgagagaggcggagggcagaccatgaggcctgagagaggcggagggcagaccatgaggcctgagagaggcagaggggagaccatgaggcctgagagaggcggagggcagaccatgaggcctgagagaggcagaggggagaccatgaggcctgagagggtgagagagtgagagcaagaacacatacacacacacacacacacacacacacacacagagagagagagacagagagagagagagacctgagagaggcagaggggagaccatgaggcctgagagacaggagggagaccatgaggcctgagagaggcagaggggagaccatgaggcctgagagaggcagaggggagaccatgaggcctgagagagaggagggagaccatgaggcctgagagagtgagagcaagacacacacacacacacacacagacacagagtgagagagagagagagagagagagagagagagagagatggttcttgccagcccctggtttacacttttgtcgatgagatgcctctaaatccttacaatctgacccccttcttccccttgctagtttgaggggtttctctaacctttctatcaatgagccttggctaagatacacgtggccatctcccgcctctatctcattctagaacagcatctcagtgccaggtgctgcctgagatgttgcttcctagagaaaacaccctccatcagaatgtccagccattactttcgatcatgcaggggactttagcccacttggagaataaaattggaaactatcttccctgcagccatcttctcatcaaagggggacaggagacactatcctgagacatcagtctgatcttccaagtgtctgttttctgctccaaaggaatgtaattgtagggcgtttattccacaaatgtgaatacattccaggagatgatggccttccctttcgcccctcaacaaccattttacaagggcctgtaagtctagggctttgttgcagccaaaaagagacattccctttgtttggagcccaattcacagggcagttgtgggaggagggtaatgtgtgtgtgggaggaagagcgggattctcgggggaaccaaagcggggacctagagaagccagcatcatagcagttaatggggaggggctgggctatttactaaaatataacaaaatgtaagcattttattagctcttcattttattagctttttaaaaagaccctttgcaatgatttattaaccactctggaatctccctagcctttgctgagacaccactgtcatgcataggatctgcctagctagagccccttgggcagaaagcatgtggtcccagccttctgaggaccctcatcccctcccacaccctcacttgcaccctccactgtcattggtccagactgcctctgttcccctccagcaaatgtttattcctgccctgggcctttgcccagataggcttccccacccctgactctttcctctgctgatcacagcctcctgatacctggggtgccggccaatctaccctcctccgtgcgggccaccccttacctcccaggctcaggccacactgccttctccttcctctgaatgcctgcggccttccttgtcacaatggctcctctgtgcacctggtgcaatgatttggcagcttcctgaaactacagctcgtcttcctgttggaactgccatccacgtgagggcagccccttagcttcaaacacagggcaactggcaggagatccttggcacagcttgtatggccttcccccagccggcactatcccacactccatttccggcacaaccctccccaaactcagtcacgtgcctcattcatctttgtttcaagactccactctccaaccccagctcagcaccttgcacatagcagatactcaaaatgttgttgacttgaaaacacaaatattcatcaggttgaatcaatattgttcttttcaggggattcaaagagagaaagaaccagttttggggatgctgtgacgctcagcttggcctctgattaatgctgaccgcccacggaagtcttcaagagggccatgaggccttataaccctgatgcagttgagttccagctagagagaacaaggccacacagagcagagaccagacatctcagggcctgtctgagagcagcccggggcacagtctgtccgaatctgctctttggtaataagcatagtgaacacataatttattgctcagaccaggacacttttgagagagaactggtaattatgctgggactatcccagataagcaagcaggacagtcacctcaagcaatcaatcatgttttgtggccagacccctccaaggaatagacaaaatacagttttctaaacatgagaacgtactaaacctcaaagtagagcttggtgccaagatcactttattttaaaagccaattgttgttgttgaagaaaaggctatgctcttggcccattttggctatggtcggagactgcttagggaattgtcttaaagttgtatatgctcctgggcctggggttttctgaaaacagagcagaaaacagggactgatgagacagtgaaaccaaaaccctgaggctcctgtgcctagccactggcttggatgtggtggacaaattccccaaggatgaagaccagggccacaccagcctgggctgaagcctggcagaccctcgaattggagcatgtccttggagcagaggctgctcctgttaggggctcatcatgaggctggaggggggctaacaggccaggccaagccaggggccacctagaacctgctgggagaggcggggtcacatgccacctgcatctcaaggcacaccttctcccaaagggcacttggcccaggcaactcctatcccgaggaatgccatcatctttcccccggtgacctcagcctagcaagaagtgagtgaagagaattaattctgaacctgattggtctaactcaaaagcccaaatcgcctctcaaactcgggttgggttttagttattgacccagagttattaaagtaaggtgtttctcaaccagggtccatggaccccagggtcagaagtgttctcaagggatccacgagttctaatttttaaaagtcatgtttttgtttttataaaatgcttgaacaaatattattatttatttatatatttttttgagacagagtctcgccctgttgctaggctggagtgtagtgcgcgctatctcggctcactgcaatctctgcctcccgggttcaagcgattctcctgcctcagcctcccaagtagctgggattacaggtgcccgccaccaccacacccagctaaatttttttgtatttttagtagagatggggtttcaccatgttgcccaggttggtcttgatctcctgatctcgtgatccgcccacctccgcctcctgaagtgttgggattacaggtgtgagccacagcacccagccggggttttttgtttttgtttgtttgtttgtttttggtttttttttgagatacggtctcactctgtcatccagcatggagtgcagtggcaggacctcagctcactgcaacctccacctcctgggcttaagcgattctcatgcctcagccacctgagtagctgggattacaggggtgcaccaccacacctggccctattttaccaattatttaaacaaagcttctcttctgcagtgataaaatacaaataaatgccattttcatagactaagacttcaatttcttaggtcggtgtcttcccatgctggtggcacatgcacatattcttgaagtccgaaggcatttgagacaccagtgtaatggttaagatcaagggttttagagtccaacaagcctgagttccagtcctagtcccacaaccaacagctcagtgggagcctgggcatgggcttcccataccttacccatcaaacggggcagagtacctgcctctagggggctatgaggctcactggtgtctctctaagacaaagaggcttggacaggccagcagttagctaccaccactattattttttactattatcacctacttgtcatttccaccctgccctgcagtttcttatctcttcaggaaacagcaagagtggagcagagcagtcagtccagagcacatgagatcagctgcctgcagaaaccgctttaaatgacaggatgtttcccttgccaaaagcagaggagcagcctggaaatctaatcaagtcctagccaaacgtcaaaggaagctgaagcctttattattgctattaatgagggttcaaagtgcatgtggagtcctgggaggccagggcagagaaaagaaggttcagggggcctgcatctcacaaggccacccctcgggaggctgctggttggggttcagccaccttgagaacatcaagctcagttcccctcccctgatttcactgccaccaacaaccttctggttgtcttcagcttccatgaaaattttctataagggagagactccaccaatcagtgctccagtcaccacgcccgtatggtgaatgcttagaagttaacactacatcttctgttgcctgggagtttggttagcatgactcagcgttcctgagaatgcctgaccccgtgggctccgacaaacatgtttctggatcatggtgatgccactaaggtgtgtggatcccccagcctcctgctgtcagtctgtctgcaatttcactggcagggcctccccattatcactctagataaaggctgtgctaccttactctgctgcccagcagctctggggcagagattctgcaggccatggcctgggatataggctaaggagggctacgggaggtgatttgcagcccaggcagtggcagtactagtcctctcctacccaccgctccaacttctccttctagccccttgactcccctgggtgggcccattttcttacaggcagaatttgtatttctgtttccccagccatctcaaatgagtctacataccagcaagtcttggggactttcagaccgtattgcagactgaaagcaacaaagctatgggaattaaaactgtcttttgacattaaaaaaaaaaaatccactgttggtaaacttcacattatgcttttataatctttcctggtcttctctaggtttggaggagtcctgtatgctcccaggatccactttctttgtatctctccatggacttgagcctcttccctgtctgtcctgagtttttgggggtggggtgatcgctaatgccttaatggtcccatttgggtcaataaaaatgtttctgcttcaaattttgcttccttgggctcccagaagccacacacacagagaacagccattctggctggcaggaggcagccactgcaggtacccccaacaaagcatctagttggtaacattgatggctgattaatgtgctgcttccaactggccccataattcagccacagattttgggcctggagtcactctgaacctgaagttggttgagaacatccaggtatttgaggatttcactcctgattgccttgacaggcaactgtatctaccagaactgtacacacatgatcattcccccatctcaccaccaccccgcacctcctacacacatagaaacagaaaacctaccaccataaccatacccctaggggtggggggcgatctgtctttccgaatacttactgaacagctgggcaagaatcgagggactctggattgaaaacaagaagtgacagagcttgttggaggcattttcacattataatgacctggaccagggccttcatgctattgaacatttaaaaaattgcttcattattattgtacatttgatatattttaaggctttatttgccttctacaaataaacatatgaatcactgtgatatagtagaaaaatcccatatttggtctcgagagatctctttaaggtgtgagctgggacaagtcattgtgaaacgggagtaactcctgcctcaccttccttgtgcacgatggtgaggagtgaaggaacgttaggtgagcagtacctgcctcccttctccctgccagggtccctgatgcccccaggctcccagcccacactcaggtcccccgttccctcacagcagcatgcatgcctcatgccgtacttctccctctgactgttaaaggtgacttgctgctccaagctgttagctttataaaaatgcttattctttcatataaatgtcatatatgttatctcagtccaaaaaagtattcatagcaattcactgatataagcacaatgctatgagataaacataaataggtgaacacaattttaaaaagacaatcactccagtaggaaaattagcaacaggccattcatgaagaggatatacaaacgttcaatgagcaaactttgaggaaggagggctttaacctcatttataaccaaatacattctaatttaaaaaacaaacttcctttttttcccacggggtgaggggaagggggttctaaaaattaaaacaggttaagaaagaacagagagaggaaggaagaaagggagggagaaaaggaaggaaagaaggaagggaagggagggagggagggagggaggggaaggaaggagagagggaaagaaggaagccaaagctttaacaacaagcacaagcactccttatgatgctggcagaagcataaattcgctcagcctttccagagtgcaatctggcaagatatgaaacagcttaaaacatatatgcctatccagagagggagaaagaagaaaggagagtggttattggttgttgcaggaaaccaggagacaaatgatgagtcttcagcctagaatgtggcagggaaaatgggaatagcccaaacaccacactggataatgctaacatgatgttcatcttttttttcccctagtaattcgcttttttcccccctccattttcaaatagctagggttccttgcctcaggagtgggacagggcaaaaaacagaaataagtgtttttctagcatgatgtcttagatctgtttctaaataatgcaggagttaggggaagtgggtgggagtattaacccaaaacactggcctaaaattgaacattgttgaattgttgactaggtatatgaggtttcaatacagtattctaagttgtatatgtttttcaagttttcacaaaacggagtttaagatgacatatatttattattttgacccagcaattccagttttaggcattcaccctaagaaaacaattgagaatgtgtgcaaatatttagccacaaagactgtaacattgtttccaaaagtgaaaactgggaaataaactaaataatggatgatatgtgcctggttcaataaattacaacgcttccatccagcagtccagtgttgatgagtttttatagacgtaacaactactcccaaatgtcattaagtcaaaaatgcaagctgaacaaatgtgcattaaaaaaacttggaatgaaattatctcagaatgttcataaacagtagttttcttggggtagtggtgtgttgaataaaaagcaaacaaaaaattttttttgcttatatgcattttctaatttttctacaatgaacacaagtactcctaaaacaagaaaaaaagatacttaatgtatagataaatgactatggaaattaggtaaagaagaaaagaggccaggcatggtggctcacgcctgtaatcccagcattttgggaggccaaggctggtggatcacttgaggtcaggagttcaagaccagcctgggcaacatggtgagaccttgtctctaaaaaatataaaaattagccagttgtgggggtgtgttcctgtggtcccagctacttgggaggctgaggtgagaggatcacctgagccacagaggtcaaggctgcagtgagccatgatcatgtcaccgcactccagcctgggaaacagaatgagacccaagaaaagaaaaggggaggggagggagaaagggaggggagggagaaggggaggggagggagaaggggaggggagggagaaggggaggggagaggaggagaaagggagcagaggggagaggaggagaaagggaggggagggtagaggagagagagccagcagtaaggtcataatagggacatgtatctgtaagatccttataataggtaaggctggccacaaatgagcaccacagttttcgcagaagaagcactgcactgcagaccctccacggttctgtttttttttttttgagacagtctcactctgtcacccaggctggagtgcagtcacgccatctcggctcactgcaagctccgcctcctgggttcaagcgattcttctgcatcagcctctcaagtagctaggactacaggtgcgtgccaccaagcctggctaatgtttgtatttttagtagagatggggtttcaccatattggccaggctggtctcgaactcctgacctcatgatctgcccgcctcagcctctcaaagtgctgggattacaggtgtgagacaccgcacccggcccttccacaggatttaaagcaaggctttcccattctctctggcaggtggcacagccatgtaattggggctgccattctcaattactccaccatgaatggagtctgttattatcagccaagcacacatctgataatcaagggatagatgcccctcatcatttttacaactcatggcagagagatgaaaacagtcatgttttcaaactgatgtatacgtgtgacagaggttgctgtcagggtgaggctctctgtgtggtgtgaattctgtactcacattgaagaaatctaagccctaataaacacaaagaagcaaaacgccaagaaaatctgcacaggaacagtttgtgcaggagcctctcagtttggccataaagatgcagtgctctgaagccagatgagtagctggggcaagagatgatgctgagtgtgcgaccattgattccacacctatgatggccatctgcagaatggctaaggagcgacctgccccttttccccaggcctaatgcggctttgctttctaaagcttcctggtctcaagctgcctgggagtccaggcatgaaggctgatgaagcatgatgcatggccatcccatccagcagtttccttgcatggacttggtcatctgaatcacagggactaagatgtgctgcagaaagaagttactgaacgctattccacatgtggcagatgggatctttaagagggagcactgaggaagtggatataagcccaagttcatattccaaagccacaggcatgctgcggcaaagccgtgactattctgagactgctcatggccgggccctgcaatggccgggcaacagctctagcagagtccccactgctgccccatccgaggacggcttgagtggacagatggctcgggatgtgccatttctgaacccagttcaataggagggtgtttaaaacaagagggacatttgaaccatgttctcctcttccttaaagctgagcactctgctctctcctttactggggatcctcaagtgtgatctagaccttgggtctcacattgtgtatgatacgtgtgcagagggaggcctcggattcaccaagcagcactaagcatctcttccacaaatcaaatgggccatttcttaaaccttgcttttgtcagggtcatgctttggcaactgtgggtttaccaaagctaagcctttcaaagaccactgacaaaaattctgtctccaggggagaacagaatagtcaccttcctggagtcctagaacttgatgtcaaaagaaacaacagggaacctttacagtatctattcctcagctctggtacatgattacatctcaaccctcctgatgagaatatcattctcttccctttgaagaagccctatttaattgtgcttttatttgagggcaactttaaccaacgggagctgtaaggattattacacagatgaataaaatactctctttggcctctggggagtttggagtccagtgagggatataggcagaaccaaacagaaacaccacaaaagaataaacggagataggaggggctggggtggtgctgagcaagagctgagctatctgcctggctttcagatgccaaaccaggctctggtgtaacagggctgtcttgttaagtgtgatcccagtgggttacgggatgtcgccaaggccaggagctttcatcttgctgcaaaagactcagactttcctggagagctcctaggtctctgtcataccgcgaagaagcctggcttattggttccaacttctgatgggtcataatgctgtataacattacaggcctttggtaagcctgacatttcctgcctgcacacactcctccccagggctgggaggctgggactggttaatctgtatcatcaatacactcctctggagtgaagacgtgtatcactctggggcagcccagggcagccaaatgccagatgcctcctagagaacgtgagagtagatgaaactgtcccaagttgttaggcatcaaattctataccccccaatcataagtcctgtgaatttccattgtgttgacatggcttccatgctgaatactgtctctccccagtttttaaggtcttatgaatttggagttcccggtacctcagtatgggacctgatttggaaatagggttgttgcagatgtaattatttaagctgcagtcattagggtggggcctcgtccaacatggctggtgtcctttattaaaaggggaaatttggatacagagacatgctcacagggaaaacaccatgtgaaaacaaaggcatggaactctaaaccgaggaagaccaaggaatgccagcaagccaccacgagctgcgaatgaggcatgaacagattgtccctcacagcactcagaaggaacccacactgccaacaccttgggctgggacttccagtctccagaactgtgagacaacacatttttcttgtactgggcacaacaaatacccagtctgtggtactttgttatggcagccctagcacatgaatacatcagtgttcagctcatgtctttattcagccaatatacattgttccaggccatgggctggaagctgggaatacagtgatatatgactgtctcctaacagctgctctctcttcatttcttagtgttagaacaatttttaactgggctcatgtctacccagaataaggattcactttcccagcctccctggcagctaggtgtggctgcaggactaatcctgcgccaacaggatggaggtggcaaaggtgcatgcaaattccaaggggaagccttcaggagagggcatattgtgtttcttccccacgctccttcctgcccactgggcccctgttccctactctctgggaccatgaggatggaagccatgctcagcagaacagcccataggaggagtctgatgcagtagagttaccacaaaagccctaaactgccgactgcagagactgtatacaagagagaaatcaattcctatcttgcttataacattgttatttaaggtctgtgttactggcagcagaacttagtcctcatcgaccaagtaggcgtggatttcctatgctcatcagcctcacatcctagcaaggaaggcataccttaccaaaaataaataaatcaatcaatcacagtgtggggagtatcacacaaagggatgtataggatgctatggagagcacctcagagagtaaacccatctggtccaaggggtccgagacgcctctcaaggaagtacatttgaggctggtggaagggtttgtgggaagctgtgttgggaaagctaggccaaaatgggcagggcctcgaggacaagcctagagagaaggatgttattcactttaaccttgctgggacaaattcactgcattgcaaaaacaaaataaaaagtgttaac

SEQ ID NO: 510 - DNA, 40001 bp, Homo sapiens
gtaggagactgagttgtagggcagtcttccaaatttattaagtcaccaaaatttatctttggatatctaggtgctccttgctgggcccattatcctttttcacaatgtttccttgccattctttactttaagcacctaggaccctcctactctccccatttctaccaactttgtgacccaaggcaagtcacataaactctctcagcctcatctccccagatgtaaaataagcatgatgtcaatatgtcctgggttggtgtgaggattaaacatatgaatcctacataagtagttgtgtaacgtgtctagaaagcactaagcatgtagtccacattcagtgattgttgtttatttcctctcaattttttcccctaaaaaagttgcattcacaaaaaggtttaaagactaataaagatgcttaatgagttaccattctttggagtatttgcattttagtttagttaattagctcattcatttctttattccatattaatgggtttttttgtgggcctctgtgtatttcagagactgtgttagctttaacaattaaaaattaaatagcgaaatatttggtgtcagatgttacttaaattttacctagtagtttgaatccaagcacacagacctagaaggatatttgagttgttttagtagtacgttatacctcacagtattagggtatctttcctttttgaaaatttcactattgatggaattcctaacttgagaactttattatctctgaaggcaaggatagaaggagaagaaagtaatgcaagagagacaatgactaagacgtggcactgggttggaaataagtggcagcacactaaacaccatagtctttccaaatgttgctgttttgtcttaacagggctctgtttttgtaatgaaactatttgacggaggtacatttggcatacttctctaaggatcctggacctcatgataaaatgattctgaatatcctgtgctgagaggcactgtgagcagccagtgatttccttggtactgctttagccataacagagataggcctatatgcagagctaggggaattcaggagacaagacatcgaaggactggggttgcaggagggtgttggtgattagagcagggacgcagcccttttggattccttagcactttttatacatccaaagggctaaaacattctcccaatgtctgtataaaaaattatggcataatttctactcacattacaggtggggaactgagaagcatagagagattcaaggcatgttttatctgactccaccgtacctgttcctttttatcttcagtcccttagtatcaccgactgtagccatcacaccaccttttttgttattccctaattgtaccatgtttctctcccagctttcctgtagaagagggaggtatactgatcccaatttacagatgagaagactgcagctcagagagcttaagcaacttggactagctcacctggtttgtcatggcaagtctgggacagaatttcggcctactgactgctaatccatttcacttaacctccctcctttcagaccttaggaaagcagaggtcctaggaggacccctcagtgcatattgaatctctgcaccaacgacagcagacacagcagatggaagaaggaaggatgcactacctataaggctctacttattccttgcccaaggattctcctcttggcaacttaaccactttctagagtcagcatttagtgatggttgtaaaaacacaagcaatttagcacacaacactctgaactgtaaacttggtaaataggatcgggggaagatttaagtggaaaggacaagtgctataaagacttaacaggaattcgttaggcttcacagataaagcagataaaagatccataaccacaggcaggaagtgaaacgaaaatcctaaatcgttaagatgcaatgaggtcccgccacaattcattaatcagatcatcctcaggggcactggctcaagaattcaaaggaacccagagcaggaaggcttcgatggccgccattttagatgagagcaaggtcttcctggcaggcgtggatgtgtcgtcatctcaatactaccatttctcctttgaccaattctttctgtttctatatggcagtattatttgctgtcttgctgtcatttatactttgctccttttctttctcctctctgcttctccactttcctctcttaaaaaaaatcctgttctttttcttctccaccttactctgcgtttaccatctctctctcaccttctctccacatatttcaatttcccaccctcgtcagactctccttggacctgctttcctctcttcttcaccctcatttcctactgcctcgcatattctccctgtaggatgcagcactttctccggcctgctgtgtgcaagctgtgtgtgggggcgaattcactcaacactcttctttgtctttctcacatttcttttagcatttttgtatgactgagagaagcagaggggtagagcataaaataaccagttaatttggtcctaaattgttttcttttatcattaaattagatgtcctcagatttctttgtaaaatccaaacataagtaggctgaaaactgtatcactgttcctttggaaatttaaagggatgcagttgaagagaatattaactattatgaaatgtatttttctcctcacagattttctggaaaaaaaatactggtatgacttttcactctcctattctctgtccttctcctagaagggatgtaaaatattttcaagaattgagcaatactttattgcaatttttgtacagttttcaaagtaattgcctgtaagtggaaaggaagaactaaagaacttaggagcaatgcagtgccacttttaataaatcaaaagggagggagagtgggtattgttaagtgacagaagggaaactgctcagagaacaaactgtctatctctctctctctctctctctgtgtgtgtgtgtggttattgttgtttctgcagcatcttgaagatccattctagtctcatgagttttctacaattgctggcaagattgtagtaggacgaatatctgtgctccctttcatagtaaagttctggatgaacccagcacacgtttggctgcagtaaaaaagcaatttttcatacaccagggggctgcaatttgagtattgtaatgattagtgatttccttcagttgcagttgaccccctgctcatttttatatagtaaatgtaaaaaggaaagggaaaaacttgacagtgctggttgattgaaattccaagaggaactttcatgcagataaaacattgagaaaagccagggtgctgggaacttcagaatgaaaaaagtgagaaatagagaaagaaaaaaatatcgttgaaagttccctgaagtctttctgattgcaaataaagtgtatgtacgctttaggctgtttgatgtgctatctccatatttaatggcttttcatcttctctctagtatcatgttctctcttttcttacttcctttcccttttattttccccacctgcctatctttctccttctcctttcttttcttttcctctttcctttttctccagaaaaaaggctataaaatgtctctcgaagaggcagactctataatggtgcctggttgtcatggaaacacacagattgcaagaccttgagtcctgccaccatgatctaggatgagaccctcattgggtcagaggctaaggctgtccctagaatttctggataagggaaaccaggaaatataatgtcatttgaaatataagtcggtgcccacagataaaagctaggaaaagtggcatctaaatagttgtttctttgtttcgcactcttcataattacatttgctgttaagaatatagatgaatgtggctgtcagtgtgactgaaaaataagcataattgcagtattttcttattctttatttgtaaaatgatatggtttatgtctttgaggaagggtcgcagtttgaagatattttgccaactctctcatatcaaacctggtgcaaagaattgctttttcaatagaataagaatgtttggtgattttatatatgccatcatcatctttcttctcctaaatcagtaacatcacactttgcaaagtatatcagattttatcgagattgtttcatataagcccagtatttcaagctaggtaatatggtgtcacctctgtctcagaccaggtctctagaacactcagttttcctttctcttcacagctccatatggcaccaaaggtcatatcactcttaaagattaggtactgttatggatagaggcgaaggcaatgggctaattaggtgaggactgagcaagattcactaagacctgtgacctctttttagtttggaaaaaatctcatttctcttttgatttatctcagagacactcctcttttcttgtttcacctcctcagcccccatactgattctgctgttattcatttgcaatggactctgatgaccccagaagccaaaagctcaaaaccgttcaaaagccatccttttcctatgatggccagagagtttgctccttaaatcatcctagaaaataagggaagtagttatagtccactctttagaaaaacaataacaatgaatgcagttaagtttcctcttaaaacagatgaccaatattttgaccatacaatctataaaaaatactctttcctccaactagttcagcaagcagattgagtgataaacgcataaatggtaagagattggtgaatgctcctgtcaggtgacatattttactccataggattttgtgaggcatgtctgattttgcagagctctcaggagtggaaggcagtcattgctccagtctgtgacagctcaccaggggcttactcaaacaatctttagcacaagccagtgcaggcaagcctcaattgcccagatactcctttagcagatgcttctctctaccagttatccccctatcagctgtgtcaaacctcagctttatactggttcttttcacttagcgcataaaaaactcaagacgtctctattcttaaaaaaagaagaaaagaaaaaaagaaagagggaaaagcaaacaaagtccagtccttaacatcatgcctctcttattaaccacttactacctttctttcccttagtagccaaagttttttgtttgtttgttttttcctgcagcacttgtttattttttattgaggtaaaatatacataaaataaatttaccatttaatcatttttaagtggatagttcagcgttgttgtgtatatttacattgttgtgcaatcatcaccactattttcagaactctttcatgaaattccggctgggtgccatggctcacacctgtaatcccagcactttgggaggctgagacgggtggatcatgaggtcaggagttcgagaccagcctggccagtatggtaaaaccccgtctctactacaaaaaaaaaaaaaaaaaaaaaaagaaagaaagaaaaaattaggcgggcgtggtgcgcgtctgtaatcccagctactcaggaggctgaggcaggagaatcgcttgaacccgggaggcagaggttgcagtgagcctagatcgtgccactgcgctatagcctggtccacagaataagactctgtttcaaaaaataaaaaataaaataaaaaaataataactcaccgttctcccttccccaccagtccctggcaaccaccattctaccttctatctctatgcttctgactaactctcactactctaggttcctgatgcaagtggtgtaatatgatagttatttttttgtgtgtctggcttatttcacttagcataacatcttcagggttcatccatgttagagcatgtgtcagaatttccttcttttttaaggtttagtaatattccattatatgtgtatatcacattttgttcatctgttcatctgttgatggacatttaggttgtttcctcctttggctggtatgtataatactgctatgaacagtgctatatctgtttgagtctctgcttttagttctttggggtatatattcagaaatggaattgctagtacagccaaacattttacttttgttttgcttttcaaagtaatcaaatttcatagtttgaaagtcaaaaagttatagacagcttataacaaagaacagcagtcacctgtcctgcctctcttcacccagaccgcttcttcaaagtcacccactttaaactcttcagctgtttgttctgtttaccatatttacaaatttcatatggatttgctgattttcctacattggccattatactcacttcccattatagaagataaaggcttacttcttacatatcattatggtggagtctttgaaaaagtggctacaacaaattctcccatccctgtgtgcataccgctttccaaagtgcctttgtagctcctcctgtcaagaggtaggatctgtttttctacccatacaatctagactggccatatgatttcctttgaccaagagaatgttctggcaatgaccctgtgggacctctaaacctagacttgaagaaccatttcacctctgctcttggaacactcctctgaggctgtcatgtaaacaaacccgatctgactgaagggtgataagatacttgaaacacagacaaggcatcctagctgaggctcttaggcctaccagtagacagccagcaccagtcccaaaacatgagtgtgaggtcatctggagtcccccagataacagccatgggagcgaagaactgtctgagcccagtccaaattgctaagctacagattcataagcagacttcagttgttttaactaagttttgggatgatttattacccagaaatagatttctgatgttattcattgctcatgcatatttcatcaccttgtatcttcctaatataattttataatgcatttgatcacatctatattcattattttcataattaataattgtcaacataacattgctcaatgctgagcccagagctatgttatgaatgactcaacttttggttctttttgttttgttattaaatttacttacctttcttccagtctgttgctaagtcttcctatatccttcagtaactataaaattattctcaatccaatcttccacactataagcctatcagaaaatctatcacttttattttcttctggaaacctgtctctcagagcctttttcttttctgctttaatctggactggctgctctataaaatggctgcccagctgtagtcatgggatttgctttcttattatagtgggaattctattgacctcctttatcctgtgcccactgttgtgtggctcccatatgttcctctttctttttggcagtaattattttgttttgtaggaacttatcctctagaagtttcctgagaaagaatgcataagaagtatattttttgagaccttgcatgtaaggaaataactctattttcactcttgattcactgtttggctgggtatagaattgtaagttaggcatttttttctcagattactttgaagacatacctcactgtcttctaattttcagtgttgctgttgagaagtctgatgccattcttatttctagttctttgtatgttatttgttttttcttcttagaatctttactttatactcaggattcttaaaattcatagtcatgtcatgctgtgaatttctttttcatcattatgttgggcctttggacttcttaatctggaaatttgtttccttcaaaaatactcttatatctttttctttgacaattccctcaaccatcctgtattttctctacttattaagaattcctcgttttggatgtttgactgcttagatctcctagtttttattgatatgtctttttgatatacctcctatgagatatcctcaactttgtcttttaattctttctttttcttttatttgaatgctagacccacgtattcaactgtttgcacacctgcacgaggttgtttttccagactttcctaattcaacctgtccaggactaaattcatatttggcgaaagtccttgttgtctgttatctggctgaatggaactaccatctttcaaggaaacccagctatcattgacaccattcatactcatagcctaattgaagtcctgtttattctgcttctttaatggttctttaatattaattgctctttaacacccctagctctgccctagctcaggccattgctgtatcattcctgcattatgacaatgccctctccacttatatctctgattcctgggtgactccaatctaataaatttttatattgcaaccaaaccttgagattaaattcaagcatcattttccccactcttcactatgcaggctcctgttctacattttttcttacctctattacacttttcttttgtttttttaatcttgagcattgtcgttgtctattcccttgcttagcttctaccctagaccctgaatgactttagggcaggataatggttgttagcaagttcacaataaatatttattgcaaaaatctgtaccccctgaggtagagcatttgatttttggattactctttctgttagaatattttccctcataatgagctggaatttattgtcttagaatttcttctaattcattataattgtattctgtgactataagccccagattttctagaacataatatctgatttcaaatacttactattttataagctatcacagggtcatgctggaacttccagctctccgtattcaaaccatatatcctaggttaagtcttacactcagaagtggcacaaaaactatttgtgtcttgatttttggtttggaaagttggggaactgcacagtagagaaccaatctaatcccgcctgtttagcacagatactgaagtcaacaattatgttcctttttccctagattgattttttttttccaggtgaaagctcatagattgctcttgacttacctctggatctctgtgctcctatttaaagtgtgtggtgagcccaggtgatgctacctgtgcagaacagatcagacaatctcctccctgcctctggacactgacctgcttttaacacagcccaagtttgcttttgctctctaggtacaaccgtattatatttatgacttttaggtttttcttttttaatctatgatatcaggacatattttctacattgtacacttgagcattgagtttattcctgttaaaatgcatctggttgggcttgaaccatcatgtaatgtcacattttacactggatcccaattctactacccagtgtattatcctgccttctcagacttgtgacaataaaataatgttagtttgagttattggcctgtgcccagtgtggctggaacttcgaaggacatttgttaaaatagaattctccctctaagttgttttcctctgatgctgtttggcttgtgaatacctgtttatgtgcttgaatttcacccagtattatatttcacagtaggaacttggggtgagaaaagtatcttttgagctaacacataattaaggaatatagttctctaagaaataattttcctccataatagaatggatgctgtagtcctattcaaatacctattccaatatttgttcatagttcttctgtcatgtaagcatttgcaggtccattttagtaataagacaactagttataaatcctctatctctaatctgaatatttctaaaaaactatagacttcaaagttctcaggggcaggggcacggatgctttttacttctctatcaggttatcccttacctgccctacccccgccccccgaaaaaaaaacttccctagataagtaaacatttttctctctcctacgtctataccttctcatatgctagcttttctttctggaatgtctctcccttccccatttgctgtgggctaaagttcctattctttctcaaggcctaacttaactttcacatcctttgagaaggctttcttcatatttagtcaagcctcaatttttcttcaccttgaattcttaagatattcattatgttaactattttttcttgaaactgacttgaatggctgggcactgtggctccacctctaatcgcagcattttgggaggctgaggcaagaggattgcctggttccaagagtttgagatactgacttaaatgtcacattgttttcctatttaaaggatctgaatatgctagtattatttcctgagatggattataaactgaaggtggggaccacttctcctttttctatgactccctactattctttgaagagttttaggtacactatattaatataattggattgaaattttggaaaacttgaggaaaggaaatgcatctaggaaagcaaggctgaaggctcattacttttctttaaaaacaagcacatggaaagaatacgctctttgaaatctttagaggaatatgtctcagagctgctgcaatttttcacaaaagcattctaagtctaatttgaacatctgctatcacaagaattttacatcccttctgtgggctcatgggaaagggccatgaaggagaggctatgatggatggtccggggagcctcaccctagccttggcacagggcaaggctatgaaactgcacttttcaagaaccagcagggaacatttggaatttctcctgttaacacaagggacacataatttgattttttatgttttgtacttttttttttgccagaaaaaaggagagtccttggatatttttggagagttttatcacctccaaccatttggtttcaaggtaacaatacatgcttgtttcttctaccaccctcattcattttaactcatctgggaggtcaatgtggaaggattaggtttgactctgtttaaaaagcccagtttatagttagcctaagcaggtcatttttacctcatagagccctacttaagcaatggaatcaatcactttcttcattagatgtttgacatttattaaaataatatattgtggtatgtattataatagagcctactatccactatgagtgatttacaccttttaaatatgttttatatatatattagggcttttttatgtagtgaagaattaaatttacacaatgagaggcctgacctttgtccctgcccctggaagataatctctaacccttggactttccagaatgataggagtgtctttgctattcatagcggattcctcagactgcacctgacctgatagtgtatgccagtgagatgactcggggggaggctgtccatgctagaaatgccaagcatgtgattagagggtttgggctttcagccacgtgatatcagccttaccttttgggaggagagggaggctggagattgagttcattcgggagggcgctgatttaatcaatcgtgcttgtataatgaaacaaacaaacaaacaaaaaaaaaacccaaatactctggacactgaagcttgggtgcacttccctgcttgggaatactctgggtgagttgtcacacatcaatgctaggagggtaacaagtccctgaggatagtggaaactttgtgtttggaaatctcccagatcttactctgtgcttcactctttctttggctggctctaatttgtatccttttgctataataaaactgtgatccaaagtgtgatattttcctgaattctgtgagccattctaggaaatttttgaacctaagggtgattgtgggaatccccaattttttaaccagctagtctgaagtgtgggtggccctggggacctctgaacttgcaaccgatgtctgaagtgggagcagtcttgtggggactgtatccaaagactgccttttctctaactcactgtagtagtctatcaagaaacaggaaatagaaagaagaagaagacaaaaaatatttatgttaaaccatgaaacccagataactaaaggtaattttttaaccctatttctcctacaacaaagctgggaaaagactggaggtttttgtttgtttgtttgtttttgttttttctttttttgtctgtgtttcctctgttgaacttaacgcataaaacttttgagaaagcccccttatttttctaggcaggggacatagcccacaacctctaggtatttaggatcaaaaatgttggaatcctgaatggctgaaggtggtggtgatggtgaaataattccaaatctcttctcaaggtggagctatttgggcatctctattttttgcaaatggagatgcaatgggaatcacaggatccacctcgttaataaggtaactgtaaatagccaagaagacagggaaagctactatttaaaagctaagtgcagtggtgagggatggggtgggccaaaatgcttccctagggttctctgttttgtcttctaacctctcagcccttggaggacctctttccttatttttcttcttctcatctttgccttctccaacattggccttttgctatttgctctctcttcccttcctatcacctatgcattctgatcatttgttgatgctctataatgatccacccattgacagggatatttgcattttctttttcgtttcttttttttttttgagacggagtcccactctgttgcccagcctggagtgcagtggcgtgatctctgctcactgcaacctccgactcctggtttcaaatgattctcttgcctcagcctcttgagtagctggggttacagagacccaccaccacggctggtttttgttttttttttttttttgtatttttagtagagacaagttttcgccatgttggccaggccagtcttgaactcctgatctcaggtgatctgcccgcctcggcctcccaaagtgctgggattacaggtgtgagccactacacccagccgatatttgcattttcacaaggacaaaagtcttaaacctaaagatcaagcatagaaggtgaaatttccaatctcatttgctgtgaaactgtagattcagtggtctgagaacagctctgtggaagtctcctgcccaggctgacttccacacctcactcatcctaatgctgtgtttcagtgaggacctcaggctacagaggggctgttattcttccttgagctggcctggaaaagaaaaattaatgttggtaatactttagagagaagaatataggaaatttgtaagtgattcatgaatcatgttggctctcagcagcagcattttgaggtgattctggagagcgtggccttgagtaagcccttcagagaaggtggcttgaggccacagctaaataaatcgaaattgagtgaaatcaagctaaaaacagtggaagccagccttagaggcagcagtcctcctgtgtaaatacacagaaaggcctgtgtcttttccacaaacaactgtggaatcttggacaaatcactgttcctttctagacctggttttctttggcaagtcagatgttctttaaagaccctgtaagctctaacagtgtcatgatttttagtccagggatgagcttaggaacaagagagagaaccatcatagaataaaaaatttacatgaggtaggctactttggaagcccaaatatagtgtttgtgccctgaacattttatgtacatactctttgctttgggacaaaaggagaagagctatccatggatctgaaatccagtgctttttgatggtggggccagtggagaaagtagaaagtgggagtgaatgcaattggtgaggagaaatggacaatatgagccattcttcagctttcctcctcattctattgctgctgcatagagaacctcacctgtaaagagaagaatatctggaatatttgtcctttattattttatgaatgtttattatgacagcacgttctaaccaataagtttatgtccagggatggtcctctgaactgtgaacaaggtagtctttatccatctttaaaattctcttatctcttcttgtgatctctttcatcatgcattctcagtgccaccttggaaggaaatgataccttcctagttaatggcagcaaactctagctcttctgaagttggccctatatggaggagaatctcctgtggggtagggcttcggggattggactgctcatagatttatcttgtttttgcggtttgtttcttggatgagaccaacacaagtggcctcacgagtacactgatccaagtgagatacaagtttcctttcccttgattctcagtagtccagctgaactaagactagactttctcatgagtaggacaggtagacctaagcccacaagcaggatagtagtgtggtgttcttccatctgatatgtctttgcaagtgatgtatttggggagcagagagaaatactcatgatagtagcacttagcctttccttgatgatccctgagtaatttaaccactaacccacatcttcatacccaattcagaaaatcaaaagtccagtgattaaccagttttaccatttttggaagacctgaccctcagggtctctctcaatctttccctcccaaattattttcaatcagtacgctttttcttttagaggagcttcagtaaatacaatttactccttgctgaatttctggcagtgttgtagccccttcaagagggacatttcaggcagttgctcaactgatttggtctctcacaagctgagggtcaagtaactaccatacaaagaacactatgaaattttctttataaatagatcttttttgagtgcagacagttcctaccgtattcttcaggtatctttgggaagagacccagcctggtctctctttatggggaggacattatctttgtacataccacctatggatatccacccagacatctagactctgatgtctagatctttcatttctggtttcttctcgtacattagcgtatacctttattactgaacactaacaatgacccttcatgaggccgtatctagttacaggggaggccttcatagaaaaatcagtcttcatggagtaaccataacagaatataatgtattataaccccaatagtcgtgacacatttacagtaataaggagcatttttctactcatcccactcccaatgactgcctcgagcagtcaagatgccttcactgctgctgttcaaaacctctttattcctcttcctccatttatagcagaacccactctttttttcaataagctgactcttagaaaagaactgataagctaaattccaagaaggtgctcctggctaaaagtagcataatagataatttaactttggagtaacaatgctttaaacccaaatgagccaggctctaaaaatgaagtttagtgattgttacaggccactaggaagatattttgtgtctgagagacttccctggttcaacttaaatcacacacaattagtagaagcttattccaattatgcctgcatgatgcctgccttgtggctggttgcttgggctattctttaatagagtgagggagatttggaagaagtaggttcctactaggaagtctctcattccaccattattgagctgcttacagtgctgtgtgtgtggtggtgtgtgttgggaggtggtaggtggtggttcactgcagagtgctggaaggtattacaaaccttagggtaaacatggcaaccctttttggagcataaatctcttcttgaatatgtggggaaaataagtgcagtgagattatttattgaaaccttaatttgtattttggttgagggcgtggaagcatcagaaagaatgagaacaattttttttaaaaattttcctgaattctgagaaggccattgtgttcttgttgcagtagcagcttgaagataattatctttcaggctttctcaaaactctaaactctttgaaattgtgtaagggcatgtgtatgtatatgcagggatggagagatgtgaagaaaagagttggaactgacagagaaaggagattctgagaagcctgggaagggatgcagggctatgaggggcccggatgcccctatccctgattggcaactgagaactgcagagggtaggctggccttgagtgctgggctctagcctcagcaaaagtcccagtggtagagcagaggcttggcagggaatgtgtggagcttcttcacccgctaactccaagggccatgcacagctgggcaatgagcctagtagtggtaaccagtacaaaccaaggactgaaggcccttcctcaaataccctgtcccaaataccctgagactttgatagtactctgggagatatagatgtgcatatagagttacaggattgaataagataatttcttgccaatctggcatagagaggagggggcctacattagatttagttttgcagaaaaaaaatctaatgtttgtggaaaacttggtgtattggttatttattgctgtgtaccccaaaatttggtgtcttaaaataccaaaccctgtaatcccaggactttgggaggctgaggtgggtggattgctcgagctcaggagttcaagaccagcctgggctacatggtgaaacctcgtctccaccagaaaaaaaaaaaaaaaaaaaaaatcagccaggggtggtgacatgtgcctgtagtcccagctgctagggaggctgaggtgggaggatcacttgagcctggaaggcggagattgcagtgagctgatattgccccactgcattgcaacctggccgacagagtaaaatcctgtcacaaaacaaaacaaaactgaatgtttagttagatgtcgctggctcatggtttctcataagattgcaatcaatgtgtcagctgggactgaagtcatctcaaagtttgactgggggaagatctgtttccaagctcagtcatgtatcaggcctcaagtcttctctggatattgactggagacctcatttccttgctctgtggacctctccacagagctattactcacaacatagcaacttgattaccttagagaaaaggctgagagagggagagagacagagacagacagacagacagacagacagagacagagggagaagagagggggatagactggggaaaagaaaaggcaaggtgtggggagagagaaagagagactaatacaggggcatagtctttttgtaacctaatctcgaaaatggcattccatggctctgccacagtctattaattagaagtaagttggtaggtacaggtcatatacaaagacaggaaattgtacaagggcatgaataccagtctgtaaggtgaataccaccatacagactgcccactacacctgagtttgagagggcaattttgtttcctctattcataagcaaacataattatgttatggcatagaatatgagattctggggttgttaattcatggactcctagtacgaagcattttggaagctttgtattcatatggttcctatgcttaaggaattggcccaagtagggcttccactcaaaggacactggttgctatttgggggctgtgaaaagacggtaggtaagtgagaaggaaaagaaaacatgttttgcaaaatactttgttttgctgaatacaatgcaagagaaaaaggaggaataaggcacggccttgctctcagatgtgacatgggtaagttggaatctagaagacagaatagaaaatagtgctggattgaatttaagccaatgatcacaataaatgttcataccaaatagtgatagatgggtgaggcagggagaatgtcagagggccccacttagtattaagaaaagattttgaagaaaaggtgaaatgtgacctgcattggaaatttggggatggaggtgggggcaaacaatgtgggcagaggtttagaaagaggaagaatgatgtctttggaaactgacttagttggagggcaggtttatatggagtctgggtcctggatttttcatcattgtttgttcctcatcttcagtgtgtgtttttggggcatctcctgcctgcatagctctgtccttggtggtggtggagagcctgagagcccaggatgactctggagaacatggcccttctttagggagcttcctggtgggctcaagatttcttaatgccatatctgatgtcacattgctcaccgctgtgattccaggatggaaaactgaataagaagcattttttctttctctggaagggatagcctttgggggcagaggggaaattagctagaaaaaaaccaaataggcttctctgaaaaaacaaggtttaatcaaggatcttgagaaaataaccagctgttttatgagcaatttgactattcttttgaaaagagttaatgtaccacaaggaacacaattatttttagagccctaaggaagcagggatttgtttgaagctccagattaaaggtggatccaaggttctatgaggtgacgggcaaagagaccaaagaaaaagttttctgaactttgaatttgtgtaacttgtaaggaagaggggctgttttatttttttccattttatttcctagatcgcttgtcagagcttagatgtcgcactttggggatttaatgagttgacattttcacaggctaacctggtaattaatttctgctcatcatggggccagtgtcagctcattcttcctttctgatccagagccaggagtgtgaggtctgagtcctgtttgtctgactttctcaggagctggcactgggcagcaatgggtgcccataggctggaccccttttggggtcaaggcagtggttggttgagagatgagtcttgcagaacaagatgggccccagaaaatttagggagttgaaatcttatgtctctgttcacacaaacaaacacagttactttgtcttttcctctccttacagtaaagagttggttaagtcatggaatcattttaaaaagaatccagtaaatatacattaatatttatctacatactatttgcttaatcactcacttacttacttaaaatatttagtttaattttaatctgagtttttaggggaactcctgtcagttgatgttgagccaagactgctctctaaggatgtattgctaatcgtaattttgtgttgtctttcttgtataaacatctcccctaaatgcatcatctctgatttctaattttagggttttaaaacatggagtgaaagttatacacacttgcaaggtaaaatcttaatattttataattatagttgtctcattcacatctgactcactgataacttttattagcatggtgtgatggatatttttcaatgtattctgcttaatttttaaaatagaaacattcttccttttcacactcattttattaatatacacaatattttattgaattagatatttacatcaacacatgaaactgacaaaacacatttgggaacaatttactcttggaaagaatataactaaattggtgggatgcaaggatatattattatttattacttgttagctttgagctcagagtgctgtatgttttaaagggaatgaaggatatcagctcatctagaataggggttagcaaactttttccataaaggaccacgtagtacatgttttaggctttgcaagactctacagtttctatggccaactactcaactcttccatcatagcacaaaagcagccctagacaatgtgtaaatgaatgagtgtagttatatcccaataaaactttgtttccaaaaacaggcagcagatgggatttggcctgagggccatagtttgccaactcctgatctagagtactagttaagctgaagtagattaagagagttgctattcctcttgattcactctaccaaatgtttgttaaatgtaaattgcatgcttacctgttcatatctgtgatagacagggtaataatgtggcttattcttcctagctataatgtgatgcatgcctttgtgttcattcttctgtggcttgatgtcctttccatgcccttttcatctcctggcacatttctgcctatctttcaaaacagctcaaaaattacctcctcagggaagcctcccctgtctgctgggccaacttcaatggcccttctctgggttgttgcaattgtcatcccctgcaatcctccaacctagtgcttgtcatgccgtattgtaaaaaatgggctttgtgtctctctccttcaaacctgtgacctttttgaaggcatgaactgagactcagtcatgtccatatacctttgtacatagcaagcattcaataaatgtttgttgaataaatgacagaatcaatgtggcaaagcatgacataaacagactatatgaatagccattgctattatttgtgtgtatgtattttgactttgtaacttttttcttttatttattcactaagaagatggagggagtgtggcagcagatcttgacaagttttcccataaaaacaaatttacttatttgttatttatatacattttaaaatttatagacattaaaacataaaagtaatatgtgtatatagctttaaggtcaaattgtgctacaagatttgtgaggcaggcacttgtttggctatttgcagccattctcaacccctgtctctgttgcttgctttctactgcagaggatgaaagtccagattctcccatcaccagcctctctcataggcagaggtggccatgtgacccagtttcggctaacgagatgtaaggtggactctactcagggtcttccaggaaagatattttcctttctaattgtggtgaagactgccaggtatctgttattttgttcttccctttttttttttttttttagaacttttaagttttagctgtgcatatggctactaggaataaatactgcattttccagtgtcttttctagctagttgtggctttgtgactaaatcctggccagtaggatataagcaaaagtgttttgtggcagctttcaggaaatttcgtcaaaagaaagctctcatgtgtcctttttattcctcattcctccatcctgctggctgtaatgttgacatgatggctggagctgctgtaaccttctggaactatgaagtcaccttgagaaaggaagctgtgactagtagaatgacaagagagatggaggcttgttttctgaagggatcacagagtaagtaaacctcataccaatcctggacaacctacctcctctagagtggcgagaacaagattttgccttgctctagacattctaattttgggtccctatcactcattatcaaaactaatcctaactgattcactaatgagagggaagagttacatgaagacaactttcttgctcagtcacgggcaatctgtctcccatgatctgcctgtgaacacaatgtttgcatctgtggcagccaccttgcagccctgagtgaacaaggttgaaaagcaacacactgaggatggtggagcagaaagctggaaagcaatgagtcctcagtgatgtcactgagcttccaagcccatctatttctgtacattttttgaaaaagtaaacaacaagtatcctcacatagtaagccaccgttagtccagttccctgctactggtatcttaattaacttggtttacacaaatcagtagttccttgtctcatgcctgctcatcctgattctgtctctggtagggaaccactttcaactcttagctgcttttctttgctgtttagctaactaggtaaaataaaaggatgatgattttgctctcttaaataactccttttatacacttccttaatgtcttaatgtctctccttctgtctctcaatatagcgaagccactatttttgttcatcttgactttgtcaatattatttacagctgagacatagtgttctacaacttcatttttttcttttgcaacttttccttggaatcattaattgacttcctgtatcatttgcttagttttctatgtatctatcaataattcattcccatatatttcactaaagctgtaaaactcgttttactccatttaaacacatgaagtaatcaaatagttcctttattcctgtaggagacatctccctgggagcctctagtcaactactccaaatgtggacgagctgctatctcagtttgctgcccagttatcatcttaagattcttttgacctctttcctgtgttggagtccctattcttgatcctcatgtctccttctttcctggttttctcagttgtttggttggaacacatttggctgaagctttctaaaaaagaatacatgggcaattttctatttttttaaaaaaagattgagcatgtctagaaatatctttatctgaccttcttacttgattcatgatttggctggcatagaattcttggctggagagtattttccctcagaattttgtaggcatcttcttttagcttctgctgcttttaagaaataggatgctattcttacctgctttttttgtttgtctggaagctttaagcatcttctctaatctccattgttctggaatttcatggggatggtttgtgccttttttttgtttattttacaggatatttactaggccatttcaatctggagactcatgtattttagttccagaaagttctttgtattacttctttgattgttttctttcctctgaccttctgtactgatttctagaacttatgtaaatctgatattggatttgatcttctggattgactctattttctcttttatcttctacctatgcctttttgttctaattttagaaatatttcttcaaccttatcttctaatgtagtaaattgtattagtccattttcatgctgttgatgaagacatacccaagactgggtaatttataaagaaaaagaggtttaatggacccacagtaccccatggctggggaggccttacaatcatggcagaaggtgaaaggacatcttatatggcagcagacaagaaagaatgagaaccaagtgaaaggagaatcaccttattgaaccatcagatcttgtgagacttatttgttaccatgagaacagtatgggggaaatcgcccccatgattcgattatcttccacatggtcccttccacaacatgtgggagttatgggagctacaattcaagatgagatttgggtggagacacagccaaaccatatcattctgcccctggcccctcccaaacctcttgttctcacatttcaaaaccaatcacacttttccaacagtaccccaaagtcttaactcatttcagcattaactcaaaagtccacagtccaaagtatcatctgagacaagacagctcccttttgcctatcagcctgtaaaatcaaaagcaagttagttacttcctagatacaatgggggtacagccattgggtaaatatagcaattctgaatgggagaaattgaccaaaacaaatgggctacaggccccatgcaagtccaaaatccagcagggcaatcaaatcttaaagctcccaaatgatctcctttgactccatgtctcacatcaaggtcacactgatgcaagaggtaggttcccatggtcttggggagctcctggccctgtgggtttgtagggtacagccctcctcctggctgcttacatgggctggcgttgagtgcctgaggcttttccgggcacacggtgcaagctgttggtggatctaccattctgagatctggaagatggtggctctcttctcacagctccactaggcagtgccccagtagggactcagtatgggggcttcaaccccacatttcccttccacactgccgtagcagaggttctccatgagagcccacccctgtagcaaacttctgcctggacatacaggcatttccatacatcctctgaaatcaggcagaggtttccaaatctcaattcttgacttctgcgcacctgcaggcgctataccatgtgaaaaccgccaaggcttggggcttgcaacctctgaagctagagcccaagctataccttggccctttttagccatggctagagcagctgggatgcagggcaccaagtccctaggctgcacgcagcagggagccctgggccaggcccatgaaaaaatattttcctcctaggcctcagggactatgatgggaggggctgctgcaaaggtctctgacatgccctagagacatttttcccattgttttggtgattaacatttggctccttgttaacttatgcaaatttctgcagccagtttgaatttctcctcagaaaagggttttttcttttttatcacattgttgggctgcaaacttttcaaacttttatgctctgtttgccttttaaaacagaatgcttttaatagcagccaagtcacctcttgattgctttgctgcttagaaatttcttctgccagataccctaaatcatctccctcaagttcaaagttccacaaatctctagggcagggcaagatgccaccagtgtctttgctaaaacatagcaagtcacctttactccagttcctaacaagttcctcatctccatccgagaccacctcagcctggatttcattgtccatatcgttatccgcattttgggcaaagccattccacaagtctttgggaagttccaaactttcccacactttcctgtcttcttctgagccctccaaactgttccagtctctgcctgttactgagttccaaagtcgtttccacacttctgggtatctttacagcagcaccccactctactggtaccaatttactgtattagtccattatcatgctgctgataaagacatacccaagattgagtaatttataaagaaaaagaggtttaacggactcacagttccatgtggctggggagatcttacaatgatggtggaaggtgaaaggtatgtttcacatggcagcagcaagagacaatgaaagccaagcaagtgttataaaacatcagatcttatgagacgtattcactaccacgagaacagtatggaggaaaatgcccctgtgattcaattatcttccactgggtccctcccgcaacacgtgagaattatgagagctacaattcaagatgagatttgggtggggacacagccaaaccataacataaatttaaaaagtatgcctttatatttttaatttcaacacatctttcttgttctccaattatattcctttatatgacattttactattcatccatagattccttatttatatctttgagataacattttttgagtgtatttgaaattctcttctgcttcttgtgttgtctcttttcttttgagtttcttttctttttgtttgtttgtatctttctcttttatgttggaggtttccctcaaatacctttccattttaagaggaaagtgctaaaaatatgattggaagatgcgcatgaaggaaagggggttgtgccaaaatatggatgatggcatgcagacttagctgtttcattggaggacccctaaatatcaccatcgctattttttttttcttgagctggtcagtttctgcagaggatcctcacatcttctgcctggaagtataagcttagttcctagagttccagaaactggggatggggtgatgtctcaccacttaggatgctaacttccaattaattcctttgtagttttttttttatgtgtgtggggttttttgttgctttttaacggatttattgaggtataatggatatatttccttgcattgtttttttcccatcctgtgttgcataaccctctcctttgttcttccctagagggggattcttcagaagtccatggtgatttcaattcttaagtttttctggggactgcagcacaagccaccttgactcctagtttaggtttcagttttctctggtctgacaagtaatttaccacagcccatctactctccagttttcacaatttgaatattatcataattttaatggtatttgagaggaagtggagaaaaatgcacatgttcaatctgtgaagtttaaccagaagccctatcagttgtattttaccagcattaataccatcaattcttactactcatatgtgggtctcttgagctgtttggaagctagggattaggagtaaaggatgtacatacatgtgtgcatgcttctatctctttgtgtatatgtgaggttatagtatgagattgtatgtgtgtgtgtgtagtggttaaaatgaaaacaagtgtgtttgctggggaactattaataggactagaatgatgagcttcaggagttagaaggtgagaagaagagcagaaaagagaaaggaagcaaacctgcaagttttggagtgatgggtttcaggacatgttaccccaaaatatggcaccttggcagttgaggaaacagcagaagaaagaagatctctttgactttctcctgctcttctctcctgaagcaggccctaaaagaattctctgatcttcctctaaagcagttcttaagaccctcatgtgagaagtgcctaccccatactcagaggaaaggaatatgcttaactttggaaccacaggaacacagagaagaatctgaacaaactggcttgtctaatcaaatatctctacaactatccacttcttcatcaaacttggcataaaaatacacagatttccctgattctttgcgtcttcattcctgaaggttactatatcatgtaaaacttgtattaaataaatttgtatgcttttatcttgtcttttgttacaggggcttcagccatgaacctagggatgcaagagaaaagcaatcttttctccaccttcaggggtaatgttctacctcaatgaatatttccttttcttaacctggccctttagctcatttctttaaagcagaaacactgggagtaggattgaacataggaaagagaaaactttgttccctctccagagccttttaaactctctctactacctcacctggtgactttggacttttttagagttctctaggtgcccaaacttccacttccttcttaccttttatgtagggatctctgtttctgcccacttcttggatagattctgaagatacaaaatgccttcttctttttcttcttctctctctctctgttttttttttttgttgttgttgtttttgtttttattttttgtttttattttttgagacagtatctcactctatcacccaggctggagtacagtggtgctatctcagctcactgcaacctcagcctcccaggttcaagtgattcttatgcctcagcctctcgaatagctggaattaacaggcacatgctaccaagtccagctaatttttgtgtatatatatatatatttttagtagagatagggtttcgctatgttggcaaggctggtcttgaactcctgacctcaagtgatctgccttccttggcctccggaagtgctggggttatgagtgtgagccaccgcacctagcgtgacttctttataagcattcagcatctcatttattttctctaataccttgtacataggtctagtttttttttcccatgggatagatggagaaaccaatgtttagagagatgtagtctttttctcagacacacagatatcaagtagcagagctatgattagtcagctgctctgggtttaaagtccatactttagctaatatactatgctgcttcattgtgctaaattgcatgagtattcatttataaatatataaaatgagaacacgtcaaaatcaatttgatgaacacactggtatttgatgtacacataattggcatttgatgtacaaggtaaaatatagattcttgctgaggtaggagtacagctctttttttaaaaaatttcaaacttttattttaagttcaggcgtacattgtaggatgtgcagttttgttacataggtaaatgtgtaccatggtggtttgctgcatagatcatcccatcacccaggtattaagcccagcatctattagctattcttcctgatcctctccctcctcccactttcaccctctgacagaccccaatgtgtgttgttccccaccatgtgtccatgtattattcacctcccacttataagtgggaacatatggtatttggttttctgttctggcatcagtttgctaaggataatggcctcgagttccatccatgtccatgcaaaggacatgatcttcctcctttttatgttaggagtgcagttcttaagggagaaaggcatagcccctgccttcaaagaacttactttctgcctctcaatgtcaacatctagaattgggaaagacaaaactttaggatttcagatatggtgtaaaatctaggctcaaataatagttgtgttactatgagccaaatctcttccggggttcataggtgtgaagatcaagaaagagaatgagaaagaagggtttaccaccaccctatataatatgtaattacaccctatgtaggtaatgcagtatcattatctgtatgttaaatgcaaggaaaatgaggactgtgaagctgagttccttgaccagcattacatgactggaacccagtcttctgaagatcagcacaggatttttgtcttttcactgacatatttttccagccctatatagtttttaaagcagcgataaggtagataatgaaggtaatatcattttcattttatagatggacaaactgatgaagagctattttcaaagatgcttttagtaaatgctattttaggatggatctgaatggcacccccaatttctaagcagcttgggtccatgggatagaaggaggggtctcaagatggagggaggaacaaccaacatttattgaacttctactgtatgctagccagccagacactgtaccagaggtcacacatgatcttgtttaatccttacaacagtactgagaggttatgatttgtatcttcattatgtaaatgaagctcagagaggctatgaaactttcccattgtcacacagaccttcaggctattattaagtgggttcattttattaacatttgacaaagttaatattcaactccaggactatataattttagagctcacaggagtatgtgttgataacattttccccagtgtctgtgacttgtcattgaaatttctatggctttcttagaactgaaaccaaaggtaagcttctcagcaaccactttgcaaagatgcctctcatttaaagagcacactcatatctttttctctctgttctgggagaaggataaatcgtgtatttgagcagatgtttcttcagtgggtacttaaataatggtttttctttttttttcttacttctgggtccatagacaatatttttaattgctctgcttttttccccttgcattataaaagccatgctatgaaagttataaaagttagcaaattttattcatctgctaaactctctgcctcagagatatattttgttggtttggatttactcaaaagtattataaataaaagatttaaacataaaatgtatttgatatggaaattcaatagttaagaagcccacaaaacttgccatatgtttggtgaaaagctagcagttcaggtgggtaagtatttattgcttcctgtagggccatatgagttacttgggagccatgaaataaaaaagagacccttgcctgcattggggaaagagagtgtagtggcattgacttcgtaattagggaaaaaaacctaaatatgaggatgtactaacacatatttctcctgtctcaaaaataccttcttcttctaaagataatgactttgtattttcttttgcttatgatgctattttttttccagggagttcaaattttatgcttggagggtgacctgaggagaagtttactagacatgagttttagagtatgtaatttctagggccatttctggaagcacatattggctgttgtcatggatgaggtgaatgagctgctgcccacgtccgagggcaacctgcacgcagcaacacaaagccctctcaggactagtcactgagatccaagtgggaattagttctgttcccttcctgtactttacaaagcaattcaagtacattcctcagcttatcatatcagaagtactttccaatgggcttgtttttggttctgcttaaattaaaaaagcctcacattttcattattttagttttctatctaattgtgctgaaatgacggctagttctggattttccccgatttttctttgtttctttttttttttttttatctttggaacacatgaggcacatgttcacatatgggttttaattgatactctgcctgggaattgctgtggcatcatgggaaatacaaaggaagtgaagtgatcacctgtatgagagtgatgagattaatatactcaaataatcagaggaaaaaataaggagtaagtacaactggactctcatgcctgcaaatattaggtgctcaaaagcatttgttggtagagtgactgagagaagttaacaatctagaatcctcaaataaacagaaagaggttcaagcaaaaggcaggatttgaactggattttgaaagatccgctgtagttagatagataagagggaagtcctacccagcagtggagaatattgaacaaaactgaagagttgagcagtggcttgattcatgaaggggcaagttagatgatctatctggatcaattggagtgtcatcttggggagagatgaacaacatatctgtaaaatctacacatttctgcacaagtcatcctggttcttcttagttactattatttccagtctgttggcactcctaggctttggggagctccctgctgggtttcatctatccctgtaagcatcagggtcagagatacacttgtttagaaaagcagcatataatgatagaggaagtgtcttcaggtcctatagggtgtttgtgtgctaatgaagagaggcattcccgagtccctaacccctggcacccaacactagatagcttgtgtcagcatttccttgtcatgaatttcctccttgcagaatcttgcattgcatttcaaaattatgcaaagaggtttttagaagcataaaaggaatgcttagttatccctttattggtgagtaaattagatggttataaagttaaataaaacccagaaagttccaactgcgttttcttaaaatcctttgtcaaaacaaatagccttgaaatgcacataaaaacttaaatgacattgactgtaatgaaacatggaacctaatgaagttgaagtgctatgagagtactgggaaagcagggctgcttttatcttgctggaatgtttatgtccttgcacgtctcctaatcacactgtggtaacgtcatttggagaaaatgcttcaggaaagattgctaataaaaaccaaaaataatacagcctcaagttaacagtccagagtaccccaagaagtcagaccaaatctgttgtctggtatagagggcactgggctggaagaatactattagagatgtctctgattgtatatttgggtatgtgaatgtttggcaacattgataaaggggctgtcaactattcctgggataacatctcaaaatttacctgttggaaataaaagcctttaccattctctgagaaaccagctttctatccactgtttctatttctacaagtgagtctccctccagacactcagacttgaggctttgagtcatccttagttctttcctctctcctcctatactccaaagttactaaatttttatcagttcttctctcaatgctttagaatccttctcattcattccatggctatagccatggctcagcaacttctacctcatcctgcgcaaagtggtcagattaatcatcctaaactctatgagtgttcacctgaacacagcccacaggataatcctgatagtcaaggatttgactttagcaccagttccaatctgctttccaagcttatctcctgaaatttctgtatgaacatgagtccagttctacaaccagactgatactgcatgttttccacttaaacatggcttgttcattttctcaccattctcttgtttacttgttcctctaattaggatgctgcctttatttgtcactacttatgcaatttcttgcaaagcaatggcttgtaaagttttcagttatccattcgagaatctgatgaaggccattaactttatcccacaaaaatgtatctctagagggttcattgagacctgaaactccattcatgcactccttaggagaacattgaccttaaattaagaatccttgctcaaggtcaagttgaaattctcaagcctccatgaaactttcctaaatcactctggctaatgttgataacttctctaccccttcctttctcttctgaacttcactgaaattgttcaattcatttggtacttactgaagaccattgtgtgttgtttgttttctttctatgcacatggcctgtttactcaaacaaactaaaatctccttgaaggtaaagccccgctatgtatctcttggaattgtatataactcagtgtttgttgctttgattggtcaaataatacaatcaggcatatataagaatccagttattttcttcttctactctagttgctgtagaacatgttctagagagccctcttatgctcaccatgttcactgggtcaattagaacctgaaaattctggaagacctcttgatctgtaagtttaccggaatgattatcagagtgaccactggttctaaaattcctgatctagaaggaataaaggaaactggtaatgtcgatatttaagggccttttgggatgcaataaagagaccgtcacttagtataggatattggcaaaattgtgaagatgatgaatatgttcttggggtgtccactttccttttctctattttcaaggctcgctcttccctgacattatgtacctgaagtatcccctctcctaaactgaatcctaggcttaatggcagcttctttattctttataattactgataaatataattatataattattatatcaatatataataattatataatatattatataatcattatataatcataattaattataattacaagattacttgtaattaaaatcttatttctaattatggcatgaaaaagttttctggtgaagatagtccaggcatctgatagtgtgtaaaagatagtccaggcatctgatagtgtgtaagtatggctcatgcttaaaatcaccccatggaatttaacatctatacccttgtttttcatccctaaaacacacacatatacacacacacagagatggaactgccttctgtgtagtggatctacagtcttaataacactagtcattcattgaggaaaccctttcctaagtttctcaaataacctgagccatgaagcctttaccataatcccatcatgttctctggtaggtaaggaatatgtaataggaggaaagcggtgataaggaactggaagagcaacacattataggtttaacattaagaagaattggtgtagatgtaacagttgcaggagtgcttgagtcacaaagcctaacagcagcaaaggctatctatatattgccggcagccaagatcagcggccctcaaagtagtttgggtgatatcacctgaacaagccggtgttctttgcttacaccatactctttgtggagcaccataaaatggtgatatacttcactccagcaggcaaacaaggaacaatgttgctagcagaaaccacccctgtattatatgtatgcaatagaatctcactatcaggaacacacttgcaccatacataatgaagcatgacacctcagtctggagtaggggaaggatgacttctccagactgctgacagagagagaaggtctgcagatattgggtgtggctgcagccctcctagagcagtggcttgagcagaaggaaagtcagtggccagggccatctggaggacaaagagccatttctcccccctccccctgccaaccccttttctcttgaaatttttaatttgtgtttttttagaactatataagcctctgggttctgattcaaccaaggaaaggtggagagggtgtcctaaataattgcacatagattttctgctcaacaggtgggactgtttaatttgatttaaaacaataaagaaatgtgatatttcttgcacccaagtaccatggaacaattcttatcattacagttttggttccgatttcacagttgggactggtcatcctcaacattgcctatatgaagtcctgatttgaagaattcctcccatcattctgttggaatttggcttaggtgcatcctattgttacatttctggtgatcacataatctgctctctgtctgagtgtgctaatagaacacagggacaggctgtagggtttagaacataatgacgaaacaattatgtctttttttcctgtgaattgaggaaagaccatcatcagtcaaagtcatgtgagaaacacctgggttcagtttccactggatgacacagaagtagagacctataaaaataaagcagtgcttctcagactttagtgtccatgtgaattaccccagcatcttgttaaaatgcagattctgactcagtaggtttggggtggggcctgcaagtttgccttcctaaccagcccccagctgaggtcgtccacagaccacacttcgggtagtaagggtatagaatatttgatgaaatttctgttccatctcttcctctaacttgctctttgacctttaagttatttaaactttcttgatctcagcttccttaactgtaaaagaagagaattggctttagcattcccaggaaggacatttgttatgttttgctactcagtatgcattgccttttcctaatagcactttgatttcctttaggggaatttactgccttcctttgtgtgcagttgtgatgggtagataagtctcagggccttctgtcccatcatggcagctgaaggaaactctagaagctcgtttcctaagatctgtctttcacagcctaggtatagcaagaggcaggataggactaaaacttagtgtgttggtttctttctctatcagaactttggtcttgagtacagtatacctaaggtagaggaacagtctaagttcagctcttccagctgtggggcctgggctcaattgacagtaagaacttgtggagtctcctaatttctgtctttccaagcttggttccctagtcttgccttcagtattgtgagcagcaccatagctttccagaatattctctttttacttacgttaccatttaattccagaaagtccatttctgttgcttgcaaccagaaattaatatactcctcttagcttctggctagagatttgtaggatttaagtcctgagcagcttattgatgagttcgattactgttttcaaaaagaaaaggaaaaggcatcagaatattttccctaaagaagatcaatggttttgaaatcttggctgtgtagttgggagtaggttaccggtgctggtgagggatgtagattattttccagcaaatcggtaattgtagtaaggtaatgaggttattctcctggagaaacaggtgaagacagagatggaacttgtgcttcagaagcaagcagtgaggctcctaatgaggcatcttggacctatttatacttggaaatgccagggagcatttatattctgcttactttgaccctagtgcaaaaagttttctgagaggctccagagctttctttccaaaactgagaatagtagctaaaagctggcagagaagattctggagagcaagaccatggctaagcagtaacagagctaatgactcagtcaccttgagttgcagcttgaggaatgaagacacttgacaccttaccctcattgtcaggactgtaacaagaataggaaattccatatgcatatgttactacctcctaactgtgctggagtggccagcagctcgttagctaattttggctgctctttctggtatagagcttcagctgctaaatccttttcctgttgtctgtcagagcctacgaggaatgaagttgcagtccatcagtacattcctcatctttcttgtccgtatcctacattagggttttcaggggccggtaaataacactcctctattctcactccacaattctgaggagtcagaaagatgaagaacacatgctagctttactgacaaaactatactgaaggatgcagcttggaccactggctgataggctttccagaacttcatttctggtcccagtctggctgtaggcccctgccaacaaggggcagcacctgctgcacactatgtgtgtgtaagcctgaaaagataagagagatgcagtcagtgtgattctgagctgaattatgttagggttttctgttctgtagttttccatgacaagccaaataacttcttttcctcctttcaatcctgcccccctttcagtattaaattgaactgtttgcttcctgaacaatttcttcatacttccattgacctgaatcttctttgctttaccgccatatttagggtccaaggacatgaaacaagaatctaccttgaatataatgttcctagaattcctaacttcagtgaaacatggtcagcctgaatgctgaggccttatcaagccactttgtgcaatagggccaactgtgaaccatttgctgaggaaggattttgactctgcccagcaggtgcttccttggcagaagtggggagaccctctttttcaggtgctgtgctactcaggcactttgattttcataagagaatgtctcttatggaagagatgtatgaagagaatgttcctcctcagtagattgttaaaggatacagacctgccctgggatgtctgcactccaggtttctgctagagaccatgaccttgaactctgttgttcatttcttatcaagagctcaattatgagaaataaaactttcagtggattgttggaaggctatcagtttttccaggcagcccaaaatccatccctaggtccaactagaccatcaaagaacagcatacttggatgacattgtttttggtttcttctaaactggactttactgagctggactttggggttaagcaagtcatatgaaagttgcttattgtactttttgaaggagtattggtgagggtattgtcaactatatctcaccatgccttgtaatgaggaccataggagaaactttttttcagacataaatactaggaaaatctaccattctcctgaacaaatggagttggaaaattttatgttctttgtatttcctgtcaatacattttttaaagctgtgactgccttgacacttagaagtaaatttgggacacttaacatttgtatatgacaatctgatatcattttttaaatatattcagtttgcttatacatgtgctccttgacttatgatggggttgtatccagatgaacccatcataatttggaaacgttgcaagtaaaaagtgcatgtaatacacctaacctaccaaacatcatagcttagcctagcctaccttaaaagtgcccaaaacacttacattagcctacagttgggcaaaatcatctaacacaaagcctattttataataaagtattaaatatctcatgtaatttattgactagtatatagaaagtaaaaaacagaatggttgtatgggtactcaaagtatggtttctaccgaatgtgtatttctttcacacttaaaagttgaaaaagggataagttgaattattgtcagtcagggaccatctgtaatttcaaatactattctactgttgttttcttctttgctctgatctctttatcaattgtctttaccaatttgtcttacatgttgtaaactgctttaaaccctctttataaggatgagagagagtataagtaaattaattaatttgaaaagtaagtatgagggtggtcaagatgggtgactagaaactgctagtgtgagccactttaatggagaggaatggaaggggcaagtaaatagagcaccttcaactgaaacatccaggtacatgcactgggactaatcaaggaaacaagtcgacccacagagaacagagaaaagccgggcaggatgatgacccaccaggagcaacatggagctaggggacccttccgcacccaggaaagtggtgaataaacgtgcaaccctgggaacccatgcttctcccacagatccttgcaacccctcaggtcaggagattcccctggtgaacccactccaccagggccttcagctgacatacagagctacttagagtcttggaagagcagctgctcaggcacatgcagagacccgggagccttagatacctgggttttctgggcttcctgacaaaagcagctgcaaatctggcaaagcaggaggttagactctcccatatatatccctaggaaaagggctgaatgcaaggggctgagcagcgacagtctgcaggcgcaacttgcatgacacctcacaggataagacccactggcttggaactccagccagccaccggtagcagtgttatacctccctgaggcggagctcccaggggaaggggtgggctgccatctttgccgtttggccaacttagctgtgtcagcctttgggctttgggcatttcggaacaattaggggctgaagcagacccccagcacagcacagctcaaaatgtgtggccagactgctttttaaagcaggtccccaatcccattcctccttgctgggcagaacctcctaattggggtctccagctacccctgctggtgatctctagctgacagaggtttagagtctccctggagtggggttcccagagggaggggttggctgctatctttactgtttggctgatttagccattctggcctttggactttggagagttcagggtgtctgggagctggagtagacctccagcacagcacagctgctctacgaaaacgtggccagactgccttttaaaacgggttcctgttccagttcctcagtgggcaggacctcccaactggggtctccagccacccctgccagagttctgccactgaaagaggtttcaaacctccctgggatggagctcctagcgggaggggcctgctgccatctttgctatttaggtgacctaacctttccagcctttgggttttggagagtccaaggtgactgggggaagcagacccccagttgctctatgaaaatgtggccagactgcttttttaagcaggttgctgatcctgttcctcctcactgggtgggacctcccaaccaggatttccagccacctcctacaggtgaattcaggctggcaacaggtcagtacctccctgggatagaactcccagagggagggacaggccactatatttgtgttttgcagccttcactgccgatacctccaggaactagaaaatttgaggtgactagggtctggaggggatccccagcatactgcatcaacctacagaaaagtggccaaaatgttatgtgggtgcctattcccatatctcctcacctgcaggttctccaggtctgagtacgcagccagccaccactggggctattgagccagtagcaactctgtaactcactagacagagtccccaggggcaaccaaaagcctctctaccactgcctctgcagtggaactgcccttgctgccctcggactaatgaaggaggaaagatactaagtgccttatccacacctccaacaaggtgcatttgacccaaagaaaggaggccagttcatctcccacaggtcccgcccactccctctgctcatcagtagacagggaatcctgacttgggcccacagcacagaccttccatcctgaggtgattgcactgagcaattgctgatcttatctctttggtatggagcccccaggagacaagaaaaataccattggccaccaggtcccttcctctgctgctgtaagtttggggaggaacataaaccctgagatcatcccagagctgcaatgggcagcatagaagtgccaagccatgatctacggccggcactcaagaggcagaagagcccacactttcagagtcttgagagggaacatggctgcaatgtgaggaaacataggggagccacacaactgagaacaagtctaccaactgaccagtacacttaagca

SEQ ID NO: 511 - DNA, 20001 bp, Homo sapiens
accctcccttgagactaggttggggccatgtgactaggttctggcctatgcaaagcaatgtaccctccatctgggtctggacataactcctccctgttctcttcatccacagtactttgcaggcccacgtttaagatggcagtttcacacaagggaaggagagaatatatccttagctcagaagagtatctccaaggagagccattcaacctgcactagattgtgacatgagcaaaaattaaccttggtgcattaattttcctgactaaaataatgaactccatcaatacagggttcacaattccagctctctgtagatacgagttaacagtttagaatatctagaagaagagatagattataaatatttcacacagccctccctcaacattgttttgataatgatgctgatgctgatgtaataataataataacaacaacgataataatagccaacacttggatctcactatgtgccaggctctactgcaagctctttcaatatgttaacacattgaatcctcgaaatatattaattcctttaatcctctccagtatctttaattttcacatgaggaaaccatagaagagagtagctaagtgctttgtccaaggtcatggagtaaaacgtggcaccaaaattagattccgggagtataattccagagtttgtgtttctaacttctatattacactttattttataaaataataagattggtattgtgcttgctgaagagctattaaatacttccagttgtctaaaggtacagagaattcacaatacctagcagctgaagtatggctggcatcacttgaaatagctgaggagcctaatgagtcactaatcttaagagctgcccatgccttctcaaacgaatttatcctggctgggcatggaggctcacgcctctaatcccagcactttgggaggccaagatgggcagatcacaatgtcaggagttcgagaccagcctagtcaacacagtgaaaccctatctctactaaaaacacaaaaaattagctgggtgtggtggtgagcacctgtaatcccagctactcgggaagatgaggaaggagaatcgcttgaacctgggaggcagaagttgcagtgagccgagatcgtgccactgcactccagcccaggtgacagtctgagactccagctcaaaaaaaaaaaaaaaaaaaagaaaaaaaagaatttatcctcctggatgcagtagctcacacatgtaatcccaacactttgggaggctgaggtgggtgaatcgcttgaggccaggagttcaagacaagcctgggcaacatggtgggatcctgcctctccaccccatctctacaaaaaatagaaaaattacctttgcatggtggtgcatgcctgtagacccagctacccattaggctaaggtgataagatcccctgagaccaggaggtggagcctgcactgagctatgattgcaccactgcactccagcccaggtgacagaattcagaccctatctcaaaaaaaaaaaaaaaaaaaagagagaattatcctagatagaaccaagattatcttttgaaatgagttttcaatattatcctgctgtatgatataccttattgggttgatgtaacaatctctacaatttacttttaaataactttacatagtgtaatattaagtatatgctagtcagcttaaggtttaactctaggggcatatggttgccctaatttaacaataaaatgtgacaaaatcctactttctcagtgcagacaaaatataaatttgttatttcttggtcatactaattccatcatatactttttttttgcgatttggtcattgaccatatgtggcatcccagaagacaatcaaacacactagggctccatggttagttctccttgctataattaatcatgtggaaaacaaatttaacctttctgttaactcaaatatcacttctattagcttcttgcagtttgtgctaaagtgcgtaataattaattttgtaatttcatgtaaaattctacataccttcctcaaatatatacgtatcacaaaaactgtagatcaagaaggcaatgtttaatgtcatctaatccaactcctctttccagagaggaaaacatgaaggcccagacagggtaaatgatttgtgccaggtccagcatttggctgcccctgcaagcccttccacagcttcatacggtcccgtaagtagtcccatgacataactttttaagtacttagcatagtaaaaaaaaaaaaaaacagaagcattctcagttgaggtggggaatgtctgctactgaaataaatgcaacaatttaattctgagaggaaaatgctgctcaaagtcttcttccaacatggcctttcctatcaaacagcacaatcaaatttttggatgccatccttgtcatctggagggctgggtttactcatcactgagaacccagacaatatggatttgctagaaacttggaaaatatctgagttaggagccaccctgtctgtcactaggtaacctgaggcactgctctcccaaatgaccagtctttctgggagccctttaccagctccctggttgcccccaaacgtttcaataattcagctctgtagaaggctgtttttggcaccaaaagcagagtgaaaaacagctttgcaaagaaataacaggcaaccagtatccaataaaacttttagaaaatttcaccgaaggaaaaaaaatccccgagttcacggcaaaaattttaagaaaacaacaaaattatcacaaaaataggaggcagactcagaagccttaggggttaaaaagaaacatgcatggccgggcacggtggctcacgcctgtaatccagaggccgaggcgggtggatcatgaggtcaggagatcgagaccatcctggccaacatggtgaaatctcatctctactaaaatacaaaaaattagccaggcatgtggtgcgtgcctgtagtcccagctactcaggaggctgaggcagttaaattgcttgaacccaggaggcagaggttgcagtgagctgagatagcaccactgcactccagcctggcaagagagcaagactccatttcaaaaaaaaaaggaaaaaaacactaattcattactgtcatacacacgagtttgtattttatgatgccttttttaaagtcagagaaaagaggtttggtgattttaaaagacaaatagagttacatggatttgacaaataaagaatattttttaaagtataaaaccacctgaactcttttgagtaaatacagatcaccaaggttctgatttaactggacagtataaacacaggaaggaacaggaggttaacccaagagaaataagtcatccatagagtgttttagacagagaggttgtgtcctcccaaaattattatgttgaactccaaacctccaatatgttggtctttggaagtggggcctttgggatataattaggttgagatgaggtcatgaaggtagggtcctcatgaagagattagtgcccttaagaaagggacatcttggccgggtgcggtggctcacacctgtaatcccagcactttgggaggctgaggcaggcagatcacctgaggtcaagaatttgaaaccaccatggccaatacggcaaaaccccatctctactaaaagtacaaaaattagccgggcatggtggcaggcgcctgtaatcccagctactcgggaggcagaggcaggagaattgcttgaacccaggaggcagaggttgcagtgagctgatattatgcactgcactccagcctggcaacagagtgagactccgtctcaaaaaaaaaaaaaagggacatctccctctccctctctgctgtgtgatgacacagcaagaaggcagccatctgctagccaggaagtggaccctcaccagaagctgaccttgttgatgccctcaccttggacttcccagcctcaagagccatgagaaataaatgcctgctgtttaagtcccccagtctgtggtgttttgttacagcagcgtgagctgactgaaacaggtttttctgtatcagtgatcgggtcaatataaaagggtacaggacagacagagggagggacacgaggacttccctttccagaggaaaactacagtacctgcttcttgaggcttctgttgattttattgacatctttggcataaatagccaatgcaattcctcttgatggtaaacaagtttacattcaaatgactgttccctagccacagacctgaaaccctggtatagactgaaaaaaaatatctagaaatccttcctagacacaaaagttgcacaaatttttaagatttgcttgtttttactcttctgacatattgaataactttttaaaatatattatcaatctttaaaaggtttcatttgcatatacaccgtacttgcctctctcagtgttttcatgtctgtgggagaaatacctcaactttttcttcttctcctacaaacttgcctgactctgaatctttccaattattttcctcttttctcagaagtgccctctcttctacccatggctgactttctacctgttcccagatccatacccccatttcagtcatctgtctcctttctctttaccctaccgattctgttcaactagcctctaaacacgatcacatcttttccattaaaaattaaaactacacaaaactctccctccccctccacacacacactcaagcctcaagtcatccctggccgcacgtcttctgtatctctcccttctttcaagactaagcttctagaaagtagtttacagtcaccatcttcagtctgtttagtttctccttaactcactgaaaattggcttccactcttgtcatgttcactaatattacctcagccttcaaaaacattcgggcgctttatcctccttaatgtgtccacagcacttacaaccttttaccacataatccttcactcaccgagtttctttaaaagtgtttctgcccttggcttctggtatactcttctcctccaggttacctcccacttctaggtcacacctccctagttgttatcatggctctctctctccaaatgcagggattaagctttcttactctgtacaatcaggtcacttgaatttgaatattaactttaccacttcccagctccttgaccttaggcaagtcacttctctgaggttcagtcttctactctacaagacaagtataatgtcttataggatgtagttgaagttaaattaaaaaatgcatgtacgtctcttggcactgtgcctggtagtacatgatagtgtatccagaattggtgggttcttggactcgctgacttcaagaatgaagccacggaccctcgcagtgagtgttacagttcttaaagatggtgtgtctggagtttgttccttctgatgttcagacgtgtccggagttgttcattcctcccaatgggttcgtggtctcgctgatttcaggagtgaagctgcagaccttcgcagtgagtgttacaacttttaaaggcagtacgtctggagttgttccttccttccagtgggttcgtggtctcgctggactttggagtgaagctgcagaccttcgcagtgagtgttacagttcataaaggtggcacgtccagagttgttccttcctcccagtgggttcgtggtctcgctggcttcaggagtgaagctgcaaaccttcacgatgagtgttatagctcacaaaggtggcgcagacccaaagagtgagcagcagcaagatttattgtgaacagcgaaacaacacagcttccacagcatggaagcgaaccggagcagattgctgctgctggctctggtggcctgcttttattcccttatctggacccacccacatcctacagattggtccattttaccaagagttgattggtccattttacagagagctgattgttccgttttacagagagctgattggtccgttttgacagagagctgattggtgcatttacaatcctttagctagacacaaaagttctccaagtccccactagatcagctagacacagagcactgactagtgcgtttacaaaccttgagctagacacagagtgctgattgttgcatttacaaaccttgagctaaacacaaagtgctgactggtgcatttaaaatcctttaggtagacaaaaaagttctccaagtccccacccattcagaagcccagccggcttcacctctcactggcactccctgcgggactttgcggcacctagcccaggcactctggcagcccagagggagctggtcccctgatgaagcccagcaggtgccggcctcagagactgcagggcccgctgagaacgcacccaccgggaacccgcgctggcccgcgagcgctgcacgcagcctgggctcctgcccgcgcctcgccctccacacctccccatgagcagagggagccggagacggctccggcctcggccagccccagacaggggccgccacagtgcagcggcgggctgaagggctcctcgagcacggccagagcgtgtgccaaggccaaggaggcgccaagagcgagcgagggctgttagcacgttgtcacctctcagtaggtactcaataaaagtcaggtgttagatggattaaacatttatgttccccatggcttcactccgattcctctactttaattcctctctctagataacgtcaagaaaatcctgactccatctatttcttagtcattagataataaggactccaatacttatgtttccaggttttataaagccagtcgttcattgaccttgattcttatatgacacacaggcaaatagcaaacctcacatggacaacacagaagatactatctttccctcaaaatcttccccttcctatattctaacctcagttttttattaccttaattagattagattagaatcaccacctctcatccacctcacctacaccagagatctcagattcaatcagtccccaaatcctggtgattcttttcctaaatatttcataaatacctctcaaacattttctcttctccccattaccattgccaccttatttcccctatattacctcagtaaactttcacccagtaatatctgccccctctaaatcaccctctgtcattatagtggtatttctaaaaaggcaaatttctctccacattgaatattatttgatgattcatgatttgatttagaaaaggtctaagtccttgacagaagagatctgtctctcgccgccaccctcccaatgttatccaccattactatcccatgagcactaattgatttgctattttattactgcctccatcgttcttgctatggcttctgcctagacataattctcaggccttcaaagttcaacacacgttacctcctctagcaattattctttgacagcttcccttacaatgctgagagatctaatcttttgtaagccaaaagcccactatgcttaatgatcacacagtattttcagttttcttattctacgaaaaaaattcgggtttgatttcctaaagcctaggacaagctgagcacatgaatgatgttcaataaatgaatgctataatggatttgtaatttatgctaatggatttcatgctacaaatccatgattttcaaaattatcttatagaatacactggacaagtataattaatcccattttatagaaaaataaatagacaagaggttaaagtcaatatacatgccttggaagcccaagaactccctggctaaggaaaaaaataataatgtgtatttcttgttctgactatccgtgtaatggaggttagcaaaaaactctgttcacattagtattttattcctgaggtattttgtccaactgaaatgatttacttggtttcatacctttagttagacattaaaagagatacttttatctggaagacttaacaataaatgtaatagccatatttgagtttaatcagcctttcttgaccaaaagccttctcaatttttttaatctttctttgacattggaagttgcctcttccaaccatacaattctttgaatctaggaactctctctattccttttatttgtgcttacaaagtgtccaattcatcttttttgaagtatcttatcaaagtaaatagcaaccaatacacattactaacattttattttctacctctttctctagagatacaaattaaataggtacattaactccaaattatcatgggagaagtttgtcatttgtctagcctctaatatgctttctactgaccagcatccaaccaataacccaatgccatatgttacaggctttagtgtagcaacccccatttcaatatacaatttgtttctctcagtgtgggctacgttatgctgcagtaacaaataagctgaaatttgctgttttaacttttatttttcatttacactatatattcaacgtgggtctagtcatcatactcattcagggaccccagctgtccaaattccatcttaacacaagtttccaaggttactgtggccagtataaggccgtagcaaatggaactttagttcttaagtttccactcatgttttattagcaaaagcaagtcatgagtctttagtactgcacactgcaatgctatcatatgcccgaaacaagaagaaccaacgtatttgtgaacagtcttaatttaatgaccatcatagtcacatagttctttagtgactgaggtaatattaaaattcctttctctaactctttgttttcttatcacgttaattatctgtattaaagactataatgaaacaaatccaaaaatgtaatacaaaaagtagcagaaatcctaaaataatttctgtttagcattatatgaatgttttgctgtagttacttccctaataggggcttaaagagagatgctgcaaaattcatcattttcaaccctgaataaagtatgcaaatgaaatcgtcaaaacctttcagtctgaaagtgactttcttctgttttctgctacttcctttatcaaaacagatggctacattgtgttactgttggtgtccacacaccacaacatctatatcttcttataatgccttcccggatagggtcaccagatatagcaaagaaaaacataagatacctagttaactttaaatctagataaacaacaaataattttttgtgtatgtttgtattagtccatttacatgctgctgatagacatacctgagactgggaagaaaaagaggtttaactggacttacagttccaaatggctggggaggcctcagaatcatggcaggaggcaaaaggcacttcttacatggcggcagcaagagaaaaataaaaaagatgcaaaagcggaaacccctgataaaaccatcagatctcacgaaacttactcactaccatgagaacagtatgggggaactgcccccatgattcaaattatctcccactaggggcctcccacaacacatgggaattatggaagtacaattcaagatgagatctgggtggggacacagagccaaaccatatcattccacccctccaaatctcatgtcctcacatttcaaaacaaatcatgcctgcccaacagtctcccaaagtcttaactcatttcaccattaacccaaatatccacagtccaaagtcttatctgagacaaggcaagtcccttcggcctatgagcctgtaaagtcaaaagcaagctagttacttcctagatacaatggggtacaggcattgggtaaatacagccattccaaatgggagaaactggccaaaacaaagggattacagagcccatgcaagtccaaaatccagcagggcagtcaaattctaaagctccaaaatgatctcccttgactccatgtctcacatccaggtcatcctgatgcaagaggtaggttcccatagtcttggacagctccacccttgtggctttgcagggtaaagcccccgtcctggctgctttcccaggctggcattgagtgtctgcagattttccaggtgaatggcgcaagctgtcggtggatctaccactctggggtctggaggatagtgaccctcttctcacagctccactaggcagtgccccagtagggactcagtgtctgggggctgtgaccccacatttcccttccatgctatcctagcagaggttctccatgagggcactgcccctgtagcaaactttcacctgagcatccaggcatttccgtacatcttctgaaatctacgtggaggttcccaaacctcaattcttgacttctgtgtacctgcaggctcaacaccatgtggaagctgccaaagtgaggctttcaccctctgaaactatgggccaagctgtaccatggccctttttagcaaaggctggagtggctgggactcacgacacaaagttcctaggctgcacacagcatggggaccctgggcctagcccatgaaaccatttttttatcctaaacttccaggtctgtgatgggaggggctgccatgaagacctatgacatgccctggagacatttacctcattgttttggggattaatattcggttccttgttacttacacagatttctgtagccagcttgaatttctcctcaaaaaatgggattttcttttctatcacatcgtcaggctgcaaattttccgagcttttatgcttttaacagcacccaagtcacctcttgaatgctttgctggttagaaatttcttccgccagataccctaacttaactccctcaagttcaaagttccacaaatctctagggcaggggcaaaatgctccagtcactttgctaaaacatagcaagagtcacttttgatccatttcccaagttcctcatctctatctgagaccacctcagtatggaccttattgttcatatcactatcagcatttttgtcaaagccattcaacaaatctctaggagttttcaaactttcccacatttttcctatcttcttctgagccctccaaactgttccagcctctgcctgttacccagttccaaagtcgcttctacattttcgggtatcttctcagcaacgccccactctaccagtaccaatttactgtattagtccattttcacactgctgataaagacctacccaagactgggaagaaaaagagatttaattggacttacagttccacatggctggggaggcctcagaatcacgacaggaggcaaaaggcacttgttatatggcggggacaagagaaaaatgaggaagatgcaaaagcagaaaccctaataaaaccatcagatctcatgagacttattcactatcacaagactagcatgggggaaaccgcctctgtgattcatattatctcccactgggtccctcccacaacatgtgggaattgtgatagtatgattcaagatgagattcaggtggggacacacaacaaaaccatatcaatgttccaaatactgtatggaataaatatgtcctaaatattgcatggcacatagtttcactaaaagttattttttctatactcagatttaactaggtatcctgtaattcatctggccaccccatccccagagccaagtcatcaatggcactaacgtaaattaatttcatataaatatttataccaagtgcaccaaatttaaacaaaaatatttggtcaatgtaacttgtcaagagccatagaaaaacatctatttgaaatatcttttgacaggatggatggactgagtatttcaaaatgtaatttagggattgaattattctcaccatatcaatgcactgacaaaacttatccgccgggtaagtacttttggaactgacctgggagtgagggcaggcatgttaatcatgatgtccttgatagggaattctagtcacagtaaagttcaaaagggtttgctacctcttaatggaaatgacaagcaaattgttaaaaaaaaaaaaaaaagaagatctgggtagctacactagttgaagacctatcagcaagagaatcagcttaaaaagtagttgaagaacaaaaacaaagttgccagatacaagatcagcaaggaaaaatccatggttttccaaaaaccatgaattagaaaatgtaataggaaaaaaatgtcatttataatagcaactactataaaataggaataaaactacacaaatatgagcaagatactcatgtacaaaaaactctcagaaatatgttttttaaatgttaaaacaaagacctgaatagagagatataccatgctcattaaaataaagatgtcaacagtctccagatatgttaatttcagtgcttctagtgcttccagtggaagcactgatattaacatattatttagagactgtcaagtccaaggggaaaatggagcctgcccaaggcttgtaacttcaacaaaaagggtcttgcatattcttgtgcatttagttttctccatgaagtttcgaatcagttcatcaagttttgtgaaaaatcatgttaacatgctccattgtccccttggacttgacttacaaaaaaaaaaaaagtttaagttaaaatgattagtaattttgagactgagaacacagagcattaaaccaaaggcagggccctcccaagtaagcggtcctgtgaggacatactgctaaatacctaccagccttgctgcacaaagagcagcttgtcatctgtctcctcaggggatgtccacaaagaaaacacattcacatcctggcattgaaagttctcagcaattgtcctaaagtggcggcctccaagggacaagcttctgcctatatacacagagctccccaaacagccttttatactctcattctgaaaggataaaaggatacctaaagattactggtatctgaagaaaatttccaaagaaaagacaaagattaaaaaaaagaaaagaaaacaaatatgatgccagagggaaagaataatttaagggaatgaaacaatttttttaaatctctgattattatcctcagaaatctcaagatgttattttatctgtaaaatagtaaaacattacttaaaaaagaaaagtcagtagaaagctagaaattcttaaatgttgaaaatatattgtcaagttagaaaaaaatgagtggacagtttgaaaataaagtcaagatatatcccaagaaggagaattaaaggcagagaaatggaaaaaaaaaaaaaaaaggaacacttaattcatatatctcaaacatcagacattccaatctaacagcaattttaggaaaaaaaaaaagataacagagacaaatgaaagaaaaattatctaggaaataatacaagaaaatctccatgagactccaaatttgaaaggcccatattaaatgaaaaagacctgtactcaggaaaatctctgtaaagttttacaatacaaagaataaagatgctaaaagctttcatgtagggtttttttcttttaaaaaaaaaggtcactgacattgaaataagctgattgtctttagattgcttggaacagaatacaacatgccttcattactgcaagggaaaataattttcaaacttgaatttttatgcaaacacattaacaattaaatttgaggataaatatatttttgtgcgtgtccagaaaatttacccttcacataccatttcttagtaagttacttgaacatatcttggagcaaaactatatgggaataagaaataagaggaagatactacagaagcagtaaaatgtcccaggataaaagctgggtgacaggcctggagaacaatagttcttactggaacaacagaatggatggccctgagcagaaaatttctgggaaagaagaatccaaaaatattttattgaaaggggtttttttaaaaaatatagagagagaatataaaggcaaataatgtaagaaaacaagaacaataagaaacaaaaactgaaagttttattttaaaagtatatataatatactttgtatacagaatgtctgtgtagtcataataatgtaaatgccatgtgttgatttttccatgtttagattcagcttgtaaatgaagcacatattccaactcaacattttacagggtatggattataataaaataaattggaagagtggaaaggccactggtgttctccagctgacagatatttgaattctccccgggacagagttcccagggggaggtgtggaccaccaactttgctgtttgggcaactcagatgcttcagcctacaggctttggagagtccaaaccaaccaggggtgaaagcgatgccccagcacagcacaactgctctaccaaaacatagccagactgcttctttaagtgggtccccaatccattcctcctcactgggcaggacctcccaactggggcctccagccacccctgccggtattctctgaccaacagagatttgaaaacttcctaagacagagctcccagatggaggggcaggccaccatatttgccattagggtggcgtagtcgttccagcctttgggctttggagagcccaagccaaccgggggtaaaagcagtaccccagcacagcacagctgctctacaaaagcgttgccagactgcgtttttaaagggtccccaatcccactcctcctgactgggtgagacatcccaagcagggtctccaggcacttcacacagttgccttcaggatgacaacagatcattacctcctgggatggagctctcagaggaaggggcaggctgtttcacagacctcactgtgatacctccaggtactggaaaatctgaggcaactagactgcaatgggcccccagcaaaccacagtagccctacacaaaagtggccagcattttaaaaggaaacaagaaagaaattcaaaggtcagcagcctcaaagattgaaggtagataagcccacaaagatgcgaaagtgagaaagaatctgcacaagaatgctgaaaactcaaaaagccagagtgccctctttcttccaaacactgcatcacctctctatcaagtgttcagcactaggctgaggccgaaatggctgaaatgacagaaatagaattcagaatatggacaagaacaaacttcactgagctaaaggagtacatcgtaacccaatgcaaggaagataaaaattatgatagaacattacaggagctgagagacaaaatagccactatagggaagaatgtaagtgacctgatagagctgaaaaacacactacaagaacttcacaatgcaatcacaagtattagcagcagaacaaaccaagcagagaaaagaatctcagagcttaaaggctgtctttctgaaataagacaggcagaccagaagagagaaaaaggaatgcaaaggaaagaacaaaatcactgagaaatatgggattatgtaaagaaactgaatctatgactcatcggtgtacctgaaagagatggggagagtggaaacaatttggaaaacatgtttcaggatgttattcatcagaacttccctaacctagctaaacaggacaacattcaggaaatgcagggaaccccagtacgatactctatgagaagatcatcatccctacacaagaagatcatccccaagacacataaccataagattcgccaaggtcaaaatggaagaaacaatgtcaagggcagctagagagaaaggccaggtcacctacaaaggaaagcctatcagactaacagtggaccttgcagcagaaaccctgcaagctagaagagattggagatcaatattcaacattcttaaagaaaaaaaattccgacctagaatttcatatctggccaaactaagcctcataattgaaggaaaaatatgatccttttcaaagaagtaaatgctgagggaattcattaccaccagatgcgccttacaagagctcctgatagaagcactaaatatggaaagaaaagatgattgctgccactacaaaaacacactgaagtatacagaccagtgacactgtgaagcaaccacataaacaagtctgcaaaataaccagctaatatcatgatgacaggatcaaatccacacatatcaatactaaccttaaatgtacatgggataaatgtccccaattaaaagatacagagtggcaagttggatacagaaccaagacccattggtaggctggcttcaaaagacccacctcacatgcaatgacacacataaactcaaaataaagcagtgaagaaaaatctaccaagcaaatggaaaacggaaaaaggcaggggttgcaacacatctgacaaaacagatttcaaaccaacaaagatgaaaaaagacagagaagggcactgcataataataaagggttcagttcaacaagaagatctaatgatcctaaatatatatgcacccaacacaggagcacccggattcataaagcaagttcttagagaccctcaaacagacttagactcccacacaataagactgggagactttcacaccccactgacaatattggacagatcatcaagacagaaaattagcaaagatattcaggacgtgaactcagcactggatcaattaacctgatacatatctacagaactctcgacccaaaaccaacagaatatacattcttctcattgccacatggcacttactctaaaattgatcacaaaatcagaagtaaaacactcctcagcaaatgcaaaagaactggaattataaaaaacagtctctcagaccacagcccaatcaaattagaaatcatgactaagaaatccactcaaaaccatacaattacatggaaatcaaataaccttctcctgaatgacttttgggtaaatgatgaaattaaggcagaactcaagaagttctttgaaactagtaagaacaaagatacaatgtaccatcatctctgaaacacagggaaggcagtattaagagggaaatttatagtactaaatgcccacatcaaaaagttagaaagatctcaagtaaacaacctaacattgctactagaagaactagagaaccaagagcaactaaatcccaaagcttggcagaagaaaagaaataaccaagatcagatctgaactggaggagataagagaaatgaaaatcattcaaaagatcgataatgacagaagctcatttgctgaaaacattaataaaatagaccactagctaaagtaacaaagaaatgagagaagattcaaataaacaccatcagaaatgataagggggacattaccacttaccccacagaaatacaaacaaccatcagaatattatgaacacctctatacacataaactagaaaatctagaagaaatagatcaattcctgggcacatatatcctcccaagactgaactagaaagaaattgagcagaccaataacgagttctgaaattaaggcaataaatagcctaccaacgagaaaatgcccaggaccagatgaattcacaactgaattctacgagatgtacaaagaagagctggtaccaattcctgctaagactattccaaaaaattgaaaagaaggaatgctccctaactcattctatgaggccagcatcatcctgataccaaaacctggcagagatacaacataaaaagaaaacttcatgccaatatccttgatgaacatcaatgcaaaaatcctcaacaaatattggcaaactgaatccagcagcacatcacaaagcttatcccccacaatcaagtaggcttcatcccaaggatgcaaggttggtttaacacacacaaatcaataaatgtgattcatcatgtaaacagaaataaagacaaacatcgcatgattatctcaatagaagcagaaaaaggcttttgataaaattcaacatccatccatgctaaaaactctgaataaactaggtatggaaggaacatacctcaacataataagagccatctatgacaaacccacagtccacatcataatgaatgagcaaaagctggaagcattccccttgaaaattggcacaagacaagaatgccctctctctccactcctattcaacatattattggaagttctggcctgggcaatcaggcaagagaaagaaataatgcgtattcaaataggtagagaggaagtcaggctatccctgtttgcagatgacatgatcctatgtctagaaaaccctatcgacccagcccaaaagcttcttaagctgataacttcagcaaaggctcaagatacaaaatcagtgtgcaaaaattactaacattcctacataccaacagtcaagccaagagccaaatcatgaacaaaacttccatttacaacaaccaagaaaagaataaaatatctaggaatatagttaactagggaggtgaaacatttgtacaaggagaacacaaaacactgctcaaagaaattagagatgacacaaatagaaaactatttcatgctcatggataggaagaatcaatattgtgaaaatggccatacctcccaaagcaatttatagattcatggtattcccattatactaccattaacgttcttcacaggtctagaaaaaaaaaaactgttttaaaattcatatggaaccaaaaaaagagcacaaatagccagggcaatcctaagcaaaaaggacaaaaccgtaggcatcacgctacctgacttcaaactatactacagggcaacagtagccaaaacagtgtggtataagaacagacacacagaacaatagaacagaacagagaacctagaaataagactgcacacctacaactatctggtcttcaacaaacctgagaaaaacaagcaatggggaaagtactccctattcaataaatggtactgaaagaactagctaaccatatgcagaaaattgaaaccggacaccttccttacaccatatgcaaaaattaactcaagatggattaaagacttaaatgtaaaacccaaaactataaaaactctggaagaaaacctaggcaataccattctggacataggcataggcaaagatttcatgatgaagacaccaatagcagttgcaacaaaagcaaaaattgacaaatggcatctaattaaagagcttctgcacaacaaaagaaactatcaacagagtaaacagacaacgtacagcatgggagaaacttttgcaaaccatgcagctgacaaaggtctcagatccagcatctataaggaacttaaatttacaaagaaaaaaacaaatgaccccataaaaaagtgggcaaaggacattaacgcttttcaaaagaagacatacatgtggccaacaatcacatggaaaaaagctgaacatcactgataattaaagaaatgcaaatcaaaaccacaatgaggtacgatctaacaccagtcagaatggctattattaaaaagtcaaaaaataacagatgctggcatggttgtgaagaaaaggaatgtttatacactgttggtgtgagtgtaaatcagttcaaccattgtgaaagacagtgtggtgattcttcaaagacctaaagacataaattccattactgggtatgtatctaaaggaatacaaatcattctattataaacacacatgcatgcatgtttattgcatcactattcacaataggaaagaatcaacctaaatgtgcatgctaatggcttaaatgtgcatactaatagaatcaacctaaatgtctatcaataatagactagattaagaaaatgtggtacatatataccacagaatactatgcagccataaaaaaagaacaagatcatctcttttgcagagatatggatggagtgaagccaataaccttagcaaactaatgcaggaatagaaaaccaaataccagatgttctcacttataagtgggagttaaatgattagaacacatggacacatcgaggggaacaacacacactagggccttttggagagtgttatgtcagaggagggagagaggatcaggaaaaacaactaatgggtaccaggcttaatacctgggtgataaaataatctgtacaacaaacctccatgctgtaagtttaccaatgtaacaaacctgcacatggacccctgaacttaaaataaaagttaaaaagaagagtgga

SEQ ID NO: 512 - DNA, 40001 bp, Homo sapiens
tcaggactgggttttcttccatgcctggaaaatattatatccaccagtcacctgcaagtatgaacactgaacttcaaagcaaacgactgagtccgaaaatagattctttctccaaagggcactaatagaagatttgccccaaagttttgaaatccagaatgcctggaacatccttgtggagtcataactaagcaggcatactgcaaaaggcctcacagctccaacgtctatgcatattatgggacagaactcccattgacctaagaatagtcatgttggctgacaaccaacgtcctcctacttgtcttctgggtatgacgggtgttaaaatgcaaaatgctccaaaataactatacgtcaaagttctcagtcatttgcagcttactgttaataagtatcagatctttttgtgaagaagtgttaccttttcaagggggaaaaccctacactaaatcaaaaagcagtggacactaaccactttacaattttcctttggtcaggcctcaaattgttgctactgattcaattaattccaaaggaccgcttcatattatggaaccacttcacttaggagagagccttccctttttatctttaagagaagtagcactgcagttttgaatttgaccatctgaacagtaagaaatggaatgcatcagtttacttgaaaattatacttggtcagaaaaatatcttaagaaaaattgtaatgtttcatcacagtaaaagataaattgtaatcccacagaatactgagtagataaaagaaaattagaagaacctagaaatgtccatttatttccttacttgaattgaggcagatgaattattttctacaaccaaaaacgtacaagtccacaaagaggttcttgccgggcgcgatggctcacgcctataatcccagcactttagcaggcctagatgggtggattgcctaagctcaggagttcaagaccagcctgggtaacatgccgaaaccccatctctattaaaaatacaaaaaattagctgaccgtggtggcacccacctgtagtcccagctactgggacgctgacacatgagaatcgcttgaacctgggaggcgtgagctgagattgtgccactgcatttcagcctgggcgacaagagagagactctgtgtacaggtccacaaagaggttctctgagtagggaaaacaaaaaaagcagccctttaaagatctggattttatcaaaagtgagggaaactagaaagtatctgtgtccaggtatcacattcaaaactgcaatgtcattcctcgtagagataaaacggaaggttgtctcctaagtgaaatggttcctcagcttgattttcgaatgaggcttgatttgggagtagcagcgaacttcattgagcaaagctagcccagacctggccatagcattggaaaatgccccagaagggccccagagatgagggctgtagttttgcctgaataacaggggaaatgagggccttgagaactcatatcttgcgaggctacttcttgagaaaacaaatatgacaaaaggctgttagcagctttaagatgtagaaagggttcccaagtctgtagcaagctcagtaaggaacctcagtggctatttgccaaaatcagaagaatcatctgaaattatgcatgggaaagaggacaattaaggtgtcttgactgggcactcccattcctagcaggaagtacagcaagtcttccttcctcactgtggcagactgaagcttcagaatgtgtattagagctctgcaatacaaggaagagagcaagttgagctccattgcaggacattgcagctatcaactggtggtcattaaaataaaataaagcttctcagtttgcaaaatcacattttatgtgaatttttcatattcaagtttgtaatttggttccctgaatggcattctatgtttggcacctggtgtcttgggtggaagttcccaagtctaaccagaatcacaggaggaagggaatgtgaggttgtggaggctggggaaaaaggtgcaagaaccactgaatcatcatccctagggtgggacttggaaaggagtacatacgtccccaaaagatttataccactgtgcttatatagctccattcctcacagccccaaactgaaaacaaatcaacttttcaaacaacaggagaataggtaaacaaatttggaatcgaataaaataactcatggcaataaaataaacaaatcactgagacttgcaaaaatacggatgaattttgaaagcatcatatggagcataagtgcaaactgaatgatcccattcttacaaagttcaagtaaaggcaaaattaatctatggtgatagaaatcaaagagaggtaacttttgaatacaaagcggttttgactataaagagacatgagagagctttctggagtgataattatataaatatttatgtacgcaaaaattcattgaactatgtttcagattagagcactttcctgtgtataaattaccttgttttaaatttacttttcaaaagaaatattatttaataagaaagaacaatctgtactttaaaggtttggtaactcctttccactacactaaatattttgccttaaaaaaaagtttgacaacccacacacacatgcacactcattccccatcctcctacttgacataatgttgaatactgaattagtcttgaataacttacactttcataaaagaagctcttcattctggaatctatgcagttcactaaactgtactgttcacattgctttcatcatgttaaaattctcaacagctatttcattatttcttactaggtcttgtaataaaaacaggtgtcagtatgcatccaaatgcaaaccagctccacccaggaaaatcataaccttgcttttaactatattgtaaatttttgtatagatgtcatgttttcaattacttttaagttttaagagttaacttacacaaatgttttcatctatggcttttctcactgtaattcgttgagtccccttgaattactgctcaagtgtttttagctttcattgtttaaaaaaattggataacttcacattgcaagttggttgtgcaaccaatcaccacaatggtttcattttacacacagtatgacaccgctggtgtttctggggcttcatggcttctgcccatcccattgactgctgctctgtgttccaattagcctcacctcctgtgttttcgcttctctcctcccaccctagccatcaagcacaacaaggaagttcatctgacctcccaagagctttcacgtgtttctcaaggagctgctttgtggatcaaatctttccattcccctcctctttctctgctattctttcccaccaatgctgattgattagaattttgcagctttaaaaagaataaggtggcaattacatcgtctccaataaatatttttctcccacatcttgttacctgaggagcaggtcagctgaaaatatgcattttccattggtaaggggtcagttctgcatatgctgtaatttagtttatatctggtttgcaacacacacctgcagttccaaatgaaaccccaaaagagactgacaagtacttttatgaaataaacaggaaagaacataacctagcaaaccttccagagcccaatagtctccaaatatatgactatttcagtgacaaatgtagccaaatattaaataaggaattgaaacatttttaagtgttaaagagaaagcactcttatttattacagctcatctccacagatctgaactcatatgtatcttcaggtcttctcttaggattctgagactcccagactcacaaacctataacttaaacacagctggagcttgctcgctattctggttttatattcctagatctccttaattctcatgactctaagaggaccgcttactcaccacatctgttcaaggagaaaccaaatgctttgtgcctttcctaccagccaaagcaccttcagtagagttttcagacacggctttcagaagcaaaatgcatagtgtactggagacacatctaacacttccataattttagatacagcagtagtgtcaatgaagagtgaagaaaaaaaatgtttgtgaaattgccagcctatcaactctcaacaaatttgccactcacctaaaccctactttggtctaatggccagctacttgaacagatggctcctttgcttatcaaaataacatctgtcaatcctggcaagtgaagaattgtatctgtgtgtcctcttccaatgctacaactaatttattagggtcttaaattctttttgatggattaagagtcctggtgagcacaaacaagccattagattgacagcaaaatttttccacactataatgattcactaatgtgttgactgctatcacacaataatcaattagaaaacttaaagaatagaaaatctgaactatttttaatgtgttttttcctcttttcacattgagatcacttacatacaataaaatgcataggctttgagcgatgaactttgacaaatgcgtatatccatgtaaccataatgctggtcaagacaaaaagcatttccatcagcactaaatgtccccgtgtgtcccttccagtcaactcaccaccaccacccagaggcaatcactgttctaatcctagtaccatagagtaggtttgccggttctaaagcttcatgtaaatggaatcatacagtttgcactcttttatatctgactgctttcgcttgacatgttttcaagattcatccatgctgtgtttatccatatgttatttgtttattatacggatataccacagtttgtgttttcttttcttattttaaaaattaaaagaatgctttatgagtttgcgtgtcatgcttgcgcagcggccacgctagtcttctctgtatcgctccaatgttagcatctgtgccgctgaagccagcactaccacagtttgttttccaccctcctgggaatggacttttgggttttttccagtttgaggctatgagaactacaagtcttcaggtgaacatatgcttcatttctcataggtaaatacctaggattggagttgctgagtcatagggtagtcctaaggcttaactttgtaagaaattgcctggccaggcatgatggctcgcgtttgtaatcccaacactttgggaggctgaggtgggctgatcatttgagcccaggagttttgagaccagcctaggaaacatggcaaaatcctgtctctacaaaaaaatacaaaaattagctgggtgtggtgtcacaggcctgtagtcccagatactcaggaggctgaggtgggatgatcacttgagcccaggaggcagaggctgcagtgaactaagattgtaccactaaactccagcctgggtgacagagctagacgttgtcttaaaaaaaagaaactgctgaactttttttttttacatgaacacttccatgtccactgatgcccacatgccagcctcagccacaggccaactctttttttttttttttttttgagatgcagtctcactctgttgcccaggctggaatgcatgatctcggctcactgcaacctctgcctcccgggttcaagtgattcttctgcctcagcctcttgagtagctgggattacaggcgagtgccaccacgcccagctaatttttgtatttttagtagagtaggggtttcaccatgttggccaggctggtctcgaatgcctgaccttgtgatccacccgcctcagcctcccaaagtgctgggattacaggcttgagccactgcgcctggccgccacaggcccactcttaaaaagataatgcataatataagattttgtttttcttttcttttgtttctttctgctctgacaggtaactttgattgtcattgacagttttaagaattcagtaccaaccactgaaagggtatgaatatccttgcttaaagaaagttaaaaagaccagctgtagtggctcacgcctgtaatctcagtactttgggaggctgaggcaggtggatcacttgaggtcaggagtttgagaccagccaggccaacatgatgaaaccccatctgtactaaaaatacgaaaaattagccgggcgtggtggtgggtgcctgtaattccagctacttgggaggctgaggtaggagaatctcttgaacatgggaggcggaggttgcagtgagctgagaccacgccactgtactgcagcctgggcaacaagagcaaaactccatctgaaaaaaaaaaaaaaaagttaaaaaaacaaaagtgctccaaagaagacttaactcttcagaccaggccttcagaggctctgccaataaagagatgctatgttcattgttgcaaacacatccattcccgggttaccctctgaacttaggcagcgggaaacttttttttttaatattaccacttggttttagcagtgaaatcactgctaaaagggggggtattgtgcaaattaacattataattaaatgcttggtactaaagtaatcttggacaagtctttccctttgtttctgctttggagacttggggttccccaaatcctcttgggtggcattcaatggccagccctggcattagagggaggacagttgttcatgttaagacagctccggttttgcatgatcagcagccatgctctacatgggattaagatttatccctttgataatatgaaaaacaagtaaacaaaaggcactgcttgaaaataatgatttaccacagaacatattttgctttagtcaaacctttttttcttcctaaggaaaaagtgtgtgggcttatctcttgaaaatgccagcatggttgtgaacactggggaaattaaaagactgaatacaatagatttcttatgtatgcctatgcagggagttgcatagcttatttattaagttgtgtgctaggggaggattatctgctttgaacttatctattactttgtgacagtgatttttaaatatggggtagttttgtattgtacaaagccaagttcaaatggaatcttaaacttaataactttgggagctttggctatgacttagaatttggaaaatcagagatataaacattgtctccaccaccaccccttgcccagaaaaggaaagaatttgatgatattctatagccttttgacatagcatcaattattctttcataaaaatagaagtcagtagaacattagtacaggtgtctagagtaatgaatgctgcctagcaaggttgatggtcagtacatccccatttactgcaatagccaaaaaagaactaagacagagatgtctctgtcatgtgagaaagagatgcacactctggagtcacatattacaacagggaaacaatggacacaattgtgactatcagtgcagctttcagctcagttcaaaggcaagagtggtctcatttattaaatgggatagttatgacctggtgccttgaagttttatgccaccagctaatactctgcaccaaagacacttcttgtttttaacatgaaaagtatgcaatagctattagccggtcttcagaatattgctcagaatctaagttaatgctattactcttattttatttgaggagaataaagagaatacatatacagagaataaagatatctattgaccttcaagaatgcttgccgcttgtcctgatcaaacttatacttttgaccaaaaatatgaatctctacaaagactttgtgaaatactttgtgatagctcttttaaatgacattatcaaatatctgttcattttggaccaaaacatagaatgtgcaacattaaaaataggatggattttgtcctgccctgatcccagcagttatgcctgcaactcctgcaaaggtaaccctgttattgcctcttgacaataacccagttggacaagatattttattagaaaattcttttggaatgcatgggcctcttgctattagaaaatactttctaactaaagaaaaatttattatttccatcgaagggaatgagtgacctattatttcaaagcagcatcctttcttccacagataagtcagtcaatatttattttcattcaagaatcagagttccaagctggcatagtcttacacgtatggtcatggttttgataggtactaggaaacacaagtgtaatgaaactcatccccagaacctgctcagccctgggcaaactggtatggttagtcacagtattttaatagccagcaaggaaccaacagtccaaaatccctttctgacacccctttcagaatctaaaagtatcttattaaaatgaatctccttttagttccagagttcatatcatacttctaaatgatgcagagtagcaggtatatttgcttctagggatgccataaccagatgacttaaaacaacagaaaggtattcattcacaattctgaaggctagaagttcaaaatcaaggtcttggctggatcgtcctccaaaggctctggaaaataatccttccttgcctctcatatcttctggtggttgctggcaatcatcggcatttcttgatttgtggcagcatcactccaatctctccttttgtctttacatggccttcttccctgtgggtctatgtctctctgtgtctctcgtcttcttataagcataccagttacactggatttagtgttcaccctaattcaataggacctcattttaacttaacttattacatctatggtaacattcacagtacaatagagtgaatgcatcccccacccaatccatatgttaaccccaaggtgatgatattaggaggtggagccttcaggaagaaattagatcatgaggctggggcccttataaatgggattagtacccttattaaagagttatcttgtccctctcggcgccatgtgaggattcaaagggaagttgcagtctacaacctggaagagcgttctcaccagcacctgaccatgctggcaccctgatctcagacctccagtctacaaaactgtgagaaatgaatttatgctgtttataagccactcagtctatggcactttgttatagcagccccaacagactaagacacacaggtacctgcaattaggacttcgatatagctttcaggggacacaattcaacccataagagcaaattacccccatcttcacgattccagtggttctcacctctgaacacacattagaattacttgaggtagtgttaaaaaccaaaaacaatgccccctcccttctccccactgccataaattaaatcttaatatctagagcaggggtggccaatcttttggcttccctgggccacactggaggaagaattatcttgggccatacataaaatacactaacactaacgatagctgatgagcaaaagcaaaaaaaaaaattgcaaaaaactctcataatgtcttaagaaagtttatgaatttgtattgggctgcatgcagcctgtgggctgtgggttggacaggttggacaggcttgatctagaggaagcctggatgccattatactttaaagctcctcaggtaatcctcatacacagccagtgtcaataacccctcacaaccttgaggaatgatatctgtagctaaacacaagaaggactactaaaaacggcttttactatgacttcctctgtccaaaatgtcccctccaagtcagcctggttttaagatgtaactcaaactcttgcaacttttttagtaaatgctgaactgacagtaaaaacatatattttaacactaagaaagctcccaacaatctacttcacccaaaagaaaaagtatatggtgatttaatctcaaaagtcaatttttttaaatgtaaagttaatctaaatacctatttaactgttttgactgacctgaaacttgtcttagagcaagacaagtttcttgaacatgaatgttcatgttgttctttccagggatactaataaatattttcaattagaagaaactgtgacctttctaagacgaatgtcaaccaagaatgcaaacttatttacaataaatgatttaggggaaagaattcctggtttcagataagtgaggtttttctcctatactttctcattgcttagtgttttcctctctgcttaagctggagctaggaaggtcttttttgctatttgtttcctcactctcattactagttttttttttttttttttaattaacgtttccaagaaatcacattttctgaaggatactcatgctgagatgaccggcagcgagccagtgagatcctattatatgctggatgggccaagaggaccaagtaaaaatgaaacaggatgttcatttaagcaaatcaaagatactctctcacgcacccatcctatttcttttctctgggctctgaatatccacacacccgcagtgctttcatcaaggcacttttctttcctgccagatctggaaggggaaagattcacttctctttcccaaagtgtcaacttttgttgttattgatgccgccaagcctgcaattacttgatgaagctaatgggcaaaagcacttaaagggccacgcttagtggttccattgtcataatccatgtaaaatgaaccagagccaacacagcctgacaagctttcagcctattattattgggggcttatttaaattgcaggtttgattaaatttataatttagccattctacttagcacattttccttttcttttaaaactaaccccaagagagacatttacaaaattcctttctccagctgtcagatgtgaaaaatgtcagtggcgtgggtggtcagagagaggggttgaagtgtacttagaatagtaaacttaaatacaaatggaatttcacagctaactattctttactgctttgtcaacggatacagcatatgtatttattcttgttttaactcccctattaatcctgccatagcactgggaaaagagtgctgtgaaaagcaagttcccgtataatcctcttctctctttcttatcctgattagataagcctttaacaaagcataaagtatttaaagctactgcattaaacactaatattttagctgaagagtaaggatatcacttcagatggccttctctggaagagaacagtatttccctgagaagtcagcaacatataaatatgtttaagacagttatctcttaggccattcaaaatgtgcaccatcaaaagtgataactaatgacaccctcacgcaaatattttattgcggcaaatgtgaaggtatcgtgcaacaaaataaaatctaatatgtatgatacatagcaaatttcattattcatttcttcaaacaataattacagggcatggacccagggccaaacaccatgctaagtgctgggaaaacacagacgcagcctcagtgatgaactgggaaaataggcatggaatggataattataagagattctgattaagttctgtaagaagactgtgtaccttgctgaaaatgaccagagaaatggaactctatgtctctgcctcattgtgggggtcgcaggcaggttgtgaaaggcttgaaacaagagatgacttgggcatagatctttaagaataaactatttcaaaattagtcagccagggaagggcactgcaaggaacagcagatacaaaaagtatggggtcatgaaagggggaggtagatgcaggcgaaagtttgaaatttagcctgagtagctgtggagtgtcagaagagaagtaggagatacagaaggcagtacagatggaatcatgaagaagtttatgtgtcaagctaagtagtttgagcttatcttctgagccgaaggttgtgtaatcaggtggctcttagacatagttaatggttccacattgtgttgttttgtttccgtttatttttaaatattgagctaatatttaaaactcaggagtttcccccaaaagaatctgatgtctggcttttttatttttaacatagaacttctgccaacactatgcctatatttccacaaggatttatttatttatttatttattgttttttatttattttattttattttattttatttattttgagacagagtctcgctctgtcgcccaggctggagtgcagtggcgcaatctcgactcactgcaagctccgcctcctgggttcaagccattctcctgcctcagcctcccaagtagctgggactacaagcacccaccaccacgcccggctactttttttgtatttttagtagagacggggtttcaccatgttaatcacctggatctcagtagcagctggcttccccacacaggacacacagtttgccacagtccctaccattccctatagtctttccagtatgaacaatgagtgttagctgccatttatcattgaacatgaccttcttttccttgtagtagagagaaatgtttctctgtacccatatctctatcacagatggggaaataagagatggtgaggggacacatgattactcacagcctagtcatttatgttacctgcctggcttctaaagtttacaaccctaggtttataatccctgccctagacagaatgaaggtaatgacaagatgaaatatctttttctaataagttttagggctttgattggagcattattaagtactatctgactacagaactcaaaatatttgagtcctgtcttagactttcttcccagtgatcatcttgagggagacaaactcccatgtgatgaaagaaaatggaaagcatgatccatttcatcattatacactgggcttttgcccactatcccattgcagagcttttttattaaaccgggctaaagcacatggtttaggcttaacacagacagggcatcgctaggcctcttccagctgggcagggctcaagtgatagtaacagtcctacagagtgcttcagaggaagagaaacagtaaggtggccacatctggactagtaggttctgactcagcttacccactgggacaggacaggacaaaagagtcatattcatggacatggtcctgcatatttataaggttagcccaaccatgtgtgggaatttgactgcccctgtgcctgagaccttcaaaaaggaaactctggttacagtgtgaagaaggtggcttgggaatggggagactgatcacaggaacataagtgagtaggcaaattcagttgtctatgcaataaatggcacctcataacatcaaggctgggtggaaacaatttgtgtttaacaaatggtacaaatagaacagcagggtagctaaacctggtaccatctccccggtacacctcctatgcactgcacaggttacctcagctccatatatatgccactagattctaaacgaggaaaattaagggggcaagacaaaaatgggtccctgtggagtatcactttgtactgaaattagacttgacagaggtctcagagaagcccattaggagattagatgcccaaccagggcacagtttgagggaaaggggaacattttgttgacaaaaggtctctgctgcctctgtcataactggaagggaggcagatccaccttcgggaaatagactgctcgtcccacatagagacaccagtagcaaaggccagattgcatgtgtctccctaagagagggaggcttgggtcaaacactacaagcagatcaggtcagaatctggcacagtcttcccaaagcacgcagccagaggagggcaagtgcaactctccccacggccatataggaccgactgctacttggctctaactccccagactcccatttgagtaaggagagtgctcggctgccgtagcagaaacacagactttggggtggcttaagcagagatgggcttatttgcctcatgctacagaaagtccagcaagagcagcccagagctgatgcagtggctcagccacgtagccagggatgctacatccctcctccatccttagcttcttggcttgtcactttatggttgtcagcaagaggttgcagcctccctaccccatccccagcttcaggttcacattcaaggcaggatgctatctacagacaggaaagagaataaagcaacttctcgaagacaagcagagataaaaggaggagcccatggcatagcctgtcagcctcctagatctcccaaatatgcagctcaattcctacccatgcatttctgacaacacccagtatccatacaataaatggggaaatgagtattatttatctttataataagaatggtcacacatttacataagaaaatcacaatgttttctttattaaacatttttgagtgccagctatgtgccaggcagggtactaggtgctgggaacaaacaggtgaacaagataaacacagttctgccctcctaaagcttacagtccagttagaggaacagacaaacagtccaacaagacaacaatccccagttgtgataagtactgaaaaaataactaaaaggctgatgtgagaatgactggaaacacctttttgtgttagggtaactcggaaaggcctctctaggtatggcactggtgctgttatgctgagagtatgcattccggataggacacgatgaaatggcacttcgcatcctcccaacctgagaaatcatgagaaaaacatcagaaaagccaaaattgaggagcagtctacaaaacacccgactagtaatcctcaaactaccaaggtcaggaaaaacgaggagcatctgagaagctgcctctgcacagagctgaggaaggaggcatgacagctaaatgtggtgtggaatcccgatggggtcctggagaggaaaaagacgttagtggaaaaactagcgaaaccggagtaaattcagagttcagaccaaacatcccagtgttaactcgtgagcattgacagatgtatagtaggagacatgatgaacattaggataagctgggtgaagggtatgcaatattttctataacacttcagaactttactgtgaatctgaaatttttccaaaattttaaaatttattttttaaaaagtaaagatggaaacacactagccctgcaaagatggtacatgtgtgtgtcctagtatgtacaggatcctgttctgaatgctaaggattgagtagtgaacagtcttctagttactgattcttattttatttaggaaaaaagagccatacttggcacacaatgcttgccaatttttaaccaggcaatgctgtgatatttcttcctctcctccatcttcgaaagtaagctgaattgcttggctcaaataacttaaaatattttgtttcagttattttccacagagtcgattaaaaactcctaaatgaataagcatattataaaagaaggaaggaaacagcactgacttcatttttcatttaaagttacctgcagccaaaagcaacgtttaagttctctgtttcttaatgttttctattaaatgtataaaaaaaataacaataatcaaagcttctttatgaaaatccagcgtttgcattttcactcacctgcaattcagttaaagcataaatgttgaaagaaaatttcctctatgcttttaaacacaggaaaggaccacttgcccagagcctggggacattcaaatccttgacttacttctaatttaactctagggtcagactctttgtcattgagtataacagtgacaactcaccttagatttccatttagatgaatgtgcttctgtcctgagaagaagtgtccagccccagcttcatctaatgtttccaggtaatccttaacagccccaaaactgactccaaagaaagcaacacagtcaaactgtctgtccctctctcaggacaacgtcaataatatacccactttgggtatttggaatataattgcaaacttcagcctgaggccaataaaactttttatctaggagacagacaaataaagcatgtgataaaaaaaaattgaaaataaaataaataaataaatcggatgtgttacatggaatgctgtggttgagttcactatggctatggccaaagtatggaggggaagacacaacatgaaagggtcatgtgtaacttcaatatgtatgtaacttacaatatgaaagggtcatacgtaacttcatatgaagttgcaatatgaaagatttagcagtcctttcttgatcaagagaagatgtttctgggtactgaatgtgtggcccacctccactccactcaagaaaggtaatgcagttaatttaagctttataactgtcagacagcaacaatgtgcaacactctactggtcgctctctagtgcactgttgcaagagtggtcctgggtaacagatgcccctccgagatgacaaactatgtcttggatattccctctctgtcttacccttccctctctccaaccatctccaaccttgacttacaaaacaagaccacaacccaactatccataagtcaaatctgtcgctgctaagggaggacacattctgggacaagggaacattaacataagacaaggctgaaataaaaagtcagtgtgtggacaattatttgccaaaaatgatagaacctgcatttcctctctgctgggtagagccctggtactaacattgaattctttcattgtgcattatctctggatctctaatgtttaggacttggagattagttttgcttttcatttaaaacacaaaaagcatttgctggctgaaatagtcatctgttactgaaatcccacttttccctttattatcagcccaaaaatgtgtgtgtgtgtgtgtgtgtgtgtgtgtgtgtgtgtgtgtgtgtgtagagcagaaaagctcagctgtttgctttgcagctatctaaagattttagaactgagcttagagggggtttggggaatgacgtaaacctgttggtttccacgtaggtgtgaatctgaggaggaggtagtgcccttgaaaacatatggattccacatgaggacatttccccactctcaaagtgggtgctcatggtgcctgctgtgccctgaatcacagtgagaataaagctgagaaaagaggtctttttagggctttcatggaacagcctgttccatgtggctcccaatggcaaggaaaatgaacaaaggggtacacagtgttagctgcctacatagtatctattcctccatcttcctgctaataaaaccttaattttgaccagagtgaaaatatgtcccatcccacagaataaattttgactagtctaaatcaatcatgaccatcccactgccagctttcccacacattcctgtatcaagggatggccacatgatccagttctgttaacgacctgtcaagggaagtcaggcaggggccttaaggaaaagttttaccttcctaacaaaagcaagagacatgcttgccactatctttttctttcccttttcttcctgccttgaacacagatgtgatgttcagctggaacattttgctatccaaaaaaaaaaggccaagagaatcttagacgtgctagctctaatgtcattgagccactgagctaataatatcagcttgttacatgaaacaaataagcctgtagtcagggcttctattattcacattagaaatcattcctgggtttaaatatttgctcatcttctattgcttagatagaagagtatagaacagtggtttctcttgaggaacaccaatccttaaatcgatgtttatttgggatttcctttatactccattatctgttcagctttaaagttcatgtttccatgacggtcacaagaacctgtcctaatgagggaccaacctgtaaagaaatgacagccgtatttttccctcatggctcagaactgtcttaatcaagataagaaaatagttggattcctctgcctaccctctgacccctggattcccctccacccttactagtctgccttagctacacacagagaaatggttttcacagccagttaacaccatggtgcggtgggaggctcagatgcaaaaggaaaaatttattctccataaaaacaaatctaaaagaactgccaatgagaagaaggtggatcttaaaattaatgtcacagcaggaaagtttgtgcaagagtattctcctataaagggaagaaaactttgcctaacagaatgaaaggctaatatctttcagtaattgacaaaacaggaaagatagtcaatcattcaggactcggggtcatacataagcaaacaagctgttcatctggtgacagacagtcttgcatcaactatagatgactacctactgtgaagtggccacacaaatcccatggtctctctgagagaggagctagaagagttaagtgctgtgtgctctgaaaaacactgccagcctgtagtaggtgctcagtaaatatttgtttaatgaatgaacattttctgactttgaagggacagaaagccactagcttctgcaaagtgacactggccatatttcagtttatatagaagaaatatacgagcaagtgaaaatgacagtttacccagaccgtgatgagatgacctggtttctgacgacacccatatttaacctgcaggaagtagcctatgtgcacccaagcattctgtaggaaaacagggataattttcaggtagtgtggtatgggctctggaattagactgtctgagttcaaactgaaccccaccccttacagctgtgtaacatttggaaatattaagtttccaaatttgttaagtctcaatttcctatgcagtacaagatagaacaagaatagtaacgactacagaattcagttatgtgatgatcaaatgaattaatctatgtgtagtgccaacgtatgacagccactcactaaatagtagctatttttgttgttgtcactttcctcattggcagcatctaacttgtcatctcacccatcaagctcagccatcaattgtggagaattcacaatctctcttttgcttttatgcaaaataatttgattcttttttttttttttaatagagtctcactctgtcacccaggctggagtgcagtggcacaatctcggctcactgcaacctccacctcccaggttcaaatgattctcctgcctcagcctcccgagtagctgggactacaggcacgtaacaccatgtctggctaattttttgcatttttagtagagacggggtttcaccttgttagccaggatggtctcgatctcctgaccttgtgatctgcccaccctggcctcccaaagtgctgggattacaggcatgagacactgtacccagccaagaatttgatttttttaatttaatttttttgtgtgtgtgagacagagtctcgctctgtcacccaggctggagtgcagtggcatgatctcatctcactgcaacctccgcctcccaggttcaagtaattctcctgcctcggcctcttgagtagcttggattacaggcgcacgccaccatgcccggctaattttaggtatttttagtagagacggcgtttcaccatgttggctaggctggtctcgatctcctgacctcaggtgattgacctgccttggcctcccaaagtgctgggattccaggtgtgagccagcatgcccaacccaatttaattttaacatgaatgactttgtctattcagatcttatgaggggtctctaatgattactggcagtggtttggtgctctcagaaggaagttccaagacattagtcattcagcccgggggcttgcatttacaaagcaagtgggctccctggccatggcgtgccactgggctgtggtctgagctcaggacagagaagaagcctcgccagaaccttagaaagagtccaatgaaagggctgctcaggtcgccctgcatgtctttgcctctccccgatcagcactccatagcatctaataatgctgtctagggaaacacactcatttaccacatgtgctttccttggcaattttttaaatttatttttatttcattttatttttcaacttttattttagattcaggaggtacatgttctggtttgttacctgggtatactgcatgatgctgaggtttggggtacaaatgatcccatcacccaggtactgagaatagcacgcaacagttagttcttcagctgttgtccccctccttgtctcttccctctggtagtctccagtgtctattgtttctttggcatttttagattcattaggaactcttctccctgcctacgagtgatccattttcaagaagtggctctccatgaccaagttattacataacctagaaagcacttcaatcatagctgaaattatttcatatcccagttcatttgcttgtttatgtctcctctcactggaatgttaaattccatgaggataaggactatttctgtcctgggctgctaacatagtacctagaaaacaagtgtgcctgtatatatatataataattaataattattaatatagtatagctgtatttattcattataattatagctccttggaggctacctgccttttttcttgtctgtatcctccactggaccataattattaattatagtatatatatggaggaatgaatgaacaaaccacagggaacacagaagttgtacactctatctctactaattcagaattgcacagataattgaaaagtttttcttcattatcattatgatcatcataaaacagcctcagattattaagcacccattaagtgccaaccctattgtgcattttacacatctcatttaatcgtcacaagccatatggcacacattattattcccgctttccagattaaaaaaacgaggcttagagaaattattcgccaaaagtttccaattgcccttgagatgggactcaaattttccttttcttcctgtattattatttttcttatttgacaagtaaaaattgtatgcatttctgacatacaacatgatgttttgatacatttatactctgtggaatggctaaatcaaggtgattaatgtatgcattaccttacgtacttatgttttgtggtgagaacacttaaaatctacttttttagcaatatgcaagtacacatattttgttattaattacagtcaccatgatgtacaggacttaaatttcttaacatggtttacaactctaacctcatcttctttcatagctcaaatgccagtctaatgcttcattctcttcagttagaaatgtggtacaaagtggattaaacagtttattttctcacctaggaattctggaagtaggaaatgtggggctgtcacagtgaccccgtgatataagcaaggccccgggctcttttaatttttcctctccactattctggtatattgcattgttacttcatggtcacaaatggcagctgtcctgtacgcattgtgtcagcattcacagtgaggaagaggaggaagggcaaaggtctgtgctagccgagtgttcctccttaatcatgaaacaaaaaaatttgcagaatccctccagcaaactgtgataacatctcattgaccagaactgtatcaaatggctatcattaggtgcaagagagccctctatgacagaaggtagagaagaaaaaaaatgaggttgtttgtggagccaagatggccgaataggaacagctccggtctacagctcccagcgtgagcgatgcagcgtgatttctgcatttccatctgaggtaccgggttcatctcactagggagtgccagacagtgggcgcaggtcagtgggtgcacgcaccgtgcgcgagccgaagcagggcgaggcatcgcctcacttgggaagcgcaaggggtcagggagctccctttccgagtcaaagaaaggggtcacagacggcacctggaaaatcgggtcactcccacccgaatactgcgcttttcccacgggcttaaaaaacggcgcaccacgagattataccccgcacctggctcggagggtcctacgcccatggagtctcgctgattgcgagcacagcagtctgagatcaaacagcaaggcggcagcgaggctgggcgaggggcgcccgccattgcccaggcttgctgaggtaaacaaagcagccaggaagctcgaactgggtggagcccaccacagctcaaggaggcctgcctgcctctgtaggctccacctctgggggcagggcacagacaaacaaaaagacagcagcaacctctgcagacttaaatgtccctgtctgacagctttgaagagagcagtggttctcccagcacgcagctggagatctgagaacgggcagactgcctcctcaagcgggtgcctgacccctgacccccgagcagcctaactgggaggcaccccccaacaggggcacactgacacctcacacggcagggtactccaaaagccctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacacagttcctcaccagcaacggaacaaagctggacggagaatgactttgacaggctgagagaagaaggcttcagacgatgaaattgctctgagctatgggaggacattcaaaccaaaggcaaagaagttgaaaactttgaaaaaaatttagaagaatgtataaatagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcaagaagggaagtttagagaaaaaagaataaaaagaaatgagcaaagcctccaggaaatatgggactatgtgaaaagaccaaatacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattccccaaggttgaaatgaaagaaaaaatattaagggcagctagagagaaaggtcgggttaccctcaaagggaagcccatcagactaacagtggatctctcggcagaaaccctacaagccagaagagagtgggggccaatattcaacattctgaaagaaaagaattttcaacccagaatttcatatccagccaaactaagcttcataagtgaaggagaaataaaatactttacagacaagcaaatgctgagagattttgtcaccaccaggcctgccctaaaagagctcctggaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaagtcctccaattaaaagacacagactggcaaattggataaagagtcaagacccatcagtgtgctgtattcaggaaacccatctcacatgcagagacacacataggctcaaaataaaaggatggaggaaaatctaccaagcaaatggaaaacaaaaaaaggcaggggttgccatcctagtctctgataaaacagactttaaaccaacaaagatcaaaagagacaaagaaggccattacataatggtaaagggatcaattcaacaagaagagctaactatcctaaatatatatgcacccaacacaggagcaccgagattcataaagcaagtcctgagtgacctacaaagagacttagactcccacacattaataatgggagactttaacaccccactgtcaacattagacagatcaacgagacagaaagtcaacaaggatacccaggaattgaactcagctcggcaccaagtggacctaatagacatcaacagaactctccaccccaaatcaacagaatatacatttttttcagcaccacaccacacctattccaaaattgaccacaaacttggaagtaaagctctcctcagcaaatggaaaagaacagaaattataacaaactatctctcagaccacagtgcaatcaaactagaactcaggattaagaatctcactgaaaaccgctcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaacagagacagaaaaaacccttcaaaaaattaatgaatccaggagctggttttttgaaaggatcagaaaatagatagaccactagctagcaagactaataaagaaaaaaagagagaagaatcaaatacatgcaataaaaaatgataaaggggatatcaccaccgatcccacagaaatacaaactaccatcagagaatactacaaacacctctacgcaaataaactagaaaatctagaagaaatggataaattcctcgacacatacattctcccaagactaaaccaggaagaagttgaatctctgaatagaccaataacaggatctgaaattgtggcaataatcaatagcttaccaaccaaaaagagtccaggaccagacggattcacagccgaattctaccagaggtacaaggaggaactggtaccattccttctgaaactattccaatcaatagaaaaagagggaatcctccctaactcattttatgaggccagcatcattctgataccaaagcctggcagacacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatacgaaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagggctatttatgacaaaaccacagccaatgtcatactgaatgggcaaaaactggaagcattccctttgaaaactggcataagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcattgtacaaaaatcacaagcattcttatacaccaataacagccaaacagagagccaaatcatgagtgaactcccattcacaattgcttcaaagagaataaaatacctaggaatccaacttacacgggatgtgaaggacctcttcaaggagaactacaaaccactgctcaaggaaataaaagaggatacaaacaaatggaagaacattccatgctcatgggtaggaagaatcaatatcgtgaaaatggccatactacccaaggtagtttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaagcctacagtaaccaaaacagcatggtactggtaccaaaacagagatatagatcaatggaacagaacagagacctcagaaataatgccgcatatctacaactatctgatctttgacaaacctgagaaaaacaagcaatggggaaaggattccctatttaataaatggtgctgggaaaattggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaaacaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactcgttcaaccattgtggaagtcagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaaatgatgagttcatgtcctttgtagggacatggatgaaattggaaatcatcattttcagtaaattatcgcaagaacaaaaaaccaaacaccgcatattctcactcataggtgggaattgaacaatgagatcacatggacacaggaaggggaacatcacactctggggactgttgtgtggtggggggaggggggagggatagcactgggagatatacctaatgctaggtgacaagttagtgggtgcagcgcatcagcatggcacatgtatacctatgtaactaacctgcacaatgtgcacatgtaccctaaaacttaaagtataataataaaggggaaaaaaaaaggaagaaaaaaaatgatagaaataattttcaatttagtcaaccaacaatctctgcactcaaccatccagagctactgtcagagttacaaaatggcaatgcttgctcttattcctagagccttgcacatgttcttccttcttctttctttagcttgatatgtttcctcttctttgatattttccctggctgaaacatctcccaccaccaagagtgggtaaatgccctcctatcagttttcttagctccttggaaactacctgccatttttcttgtctgtatccgccactggatcaaactctttgaagatggtaccatgtattttcatcaccatatcctagcatctatcacagtgtctggcacaataagcctttattgactgaatgaagtgaaaaatctaggactcaaacttaggcctttccaattccaaaggccacattctgttcgttatgtaacactgactatgaaaaacaaaacaacatattttagaaatcccttgtaaaaactctccagcctctccttgaaagacaccatagagttttactgtttatcatcatcatcatcctcattatcacatttctcttttgccctctaatagaggacccagaaacaaagagagtaaccaaaagctgggcaggaggacaacagagcctgaaaaatagccaaactgagtgactagtttccaagaaaaaataaaagctgaatataatgaagaaaaatatttcaaagttcaaataggatgctctggcatacctaattgtagccccagtactaactggcatttgctttttatttttccatacatatttagtatttatagaccaaagctcacgttctgtgatttttttaatgacttccaaatgcattgcgatcacttaaaggtaattattcattcagacgaaatgtacatctaacaaccagagctttctcaagcagaaaagtcccctcagagatggctgagaaaatgttatgctcaacctgtgcaatgttgttagaaagaaaggaaatttcttgtcatctgctggcaagatgccattcctccacttgcccctctcaactcatgtgagaggcaaagcatcaataccacacttttggctaacacaatgacagaaataattaccttcacctgggacagtctaagttctgggttggatttttgtttgtttctctttttggcattttaatttggtcactatttttttccatatttccaccattcaacactcaaacctcatacatgttaaatgagtcatcctcttttctgtttcagcatatttttaatgagaagaaattgtatcttctgtggtgacttaaatacgtccacaaatgctttgatacgtgaaatatgttcacacctcctttcagaaaaggaaggctaattcctttccctctgaatgtgggctaaactccatgactcatttctgaccaatagaataaaatggaaaggacagtgtataactgggagactaggttgtaaaaggcactgcgatctctcctctctctctctctctctctctctctctctctctctctctctctctctcatattactcgctctgggaggagccagctgccatgtaacaaagacactcaagccttgtggagagaccctcatagagagtaactgaggcctcctgccaacagccacataaatgagctcagaagcagatcctccagcctcagtcaagcctcagatgactacagcctcacactatttactgcaaactcatgagagaccttgagccaagacaatccaactaagctgctcccaattttccaatgcatagaaataaatgtgtatttatttctattataagaaatattaagtgtttattgttggaagccactaagtttggggatgatttattgcataagaataaatcactaattcaattacattaaaaatatatacaattatcaccaaaaacccgtcatcctaatatggtttccatctttgtatattctcttccacatgtaaatgctttatataattgttatcataagctgttacaattcttattctgtcatattgccatatttaaacacatcctttgttgttataatgtctttataattgatatttttaacatttaaataatacttgttcatgtggatatgccataatttttaagtcatttccataatattgaacatttcagcagtcttcagatttttttctattagaacttttactgcagtgaatatctttgaatatacagcgttttgcttctcttatttggttaaggtaaactttctgtatttgaattactggggaaaaaaagtatgaacatctttgtgcctctcattaaataatatcatattttcttttcaaaaagatatataaatttatcagcaatgaataagtgtaccagctacactacaaccataattatattacaatcatttaaagttgtgctaaaaggtacaaaattgcatctcaagtttgctttaatttaaatttctttgattcctaatgagattgtatgggcttttttaatgtataattattgtttctacttttgtgaattatctcctcctatattttgtgattatcctagttttagttgcacttttcttataaatttggatgtaaaattacagattagaaatattaacctttagaaatattagcctttgattaaaatgtttttccagtcagttgtgcatttatacaagtttccttttctcagtatacaaaaattcttaattttttacattcaaatatatcaatacttctatgttatttcttccattgctttctactactgcatagctaagagagttcacattttccctctgatctgaactgttattttcttctagtttctctagaatttatgaagaggtgtttcattttgttttgtttgtaccccaaatccatcaggaattaattttcatacatactgtaaaatgtagatatttttcagaatttttcttatttttaatttaaaatagttcacagtaacttggtttttaaatgcctacaatactcctaggggtaactgtgatcactgaattgtcaccaaaacaatggcaaagaatgacataaccaagacctacggcggacactataactggagacttctctttttttttttttcatgtccatagaagagacaagtgcttctgggagactgggctcctccctagcccaagggggtgaatcatgattggcccaagtcaaatattttatttttccgtgactgatttaggcttgggtttgtcttaccatgttggccaatgataagtgcagaaaaacctgccaggcggtctctgccaatagcctttctcacgaacagaaagagacatacagaaagaaagatacctcttccatcaaaattgctacctgcctgtgcctagaacatgtcaggaaccttgcaaccataaaaagacaagtcagagaacaaatgctgaagatgatagagcagacagatggcaagacgggtattacatgatggtgttgcactacggaattaacccattctagcactgccctacctaaaaatgtgttctttaacagaatatgtattcctattgttattgccactttcagacaccttttcgttattttcagccacaaatatcttaaattttaaaacctctttaatgtttttccccttgctcgttgatttctcacacactgtctagaaacgatgccacagggttaagttccggattcgtaaattccaagaggcaaaaaggcggagcgtatctgggagagtgtattctgtgaacctcgccattagcaggagatggggtcttcactcccccaagagcctttgcaaacactgtgtttctcccatattccaactgtgcctttgtgctcagggccctttgccttctttctcagtaacaaagcacacctattagaaccctaagtacttacaggctccaactttcccaagaggatgagttgcagtgaatgacaaacaccattttccaccgccattaaatgcaaatctctagacacctccttatcagcaacaatacaatgaaaactgaacactctgctaacaagattttgatagtaagagttgtaaactgccatgttctacaaatcctgccacagaggaacaagagtttgcccaattagcaaccttcttaataataacagcaaatacatattcaaacaacctgagactaaatgaaaaattcaaataaatcagaagcttggtctacagcagtggtttttaactgagctcactagaaccctcgagattctctacagaaacacctcaaacgaaaataagtgggactgaggaaatagctcaatcccgggcccctcttcaaatgaaaagctctgcttttatctgtgttttttatatattggtcttatgcaatattcaacttgaagaaagactttcttgttgttgtgaaacactagctgacactcttaatgttttggaggcataataaacaataaaatttttgcaaaatttataccaaaataagcaaccagatcattaagggaaagatgggaaagcagaagatactatctcttttttcttgttatttttattttccttcttgtcatttttagtataataacttaatgaaaggtcaacatatatgtgtatttttcatatgagaactggaacagatgagactttcattattggatcctggtgctatatctggtcttcttgatgtatgttggatgagaggggatggtaagaaggagaaggttggttctcatcgttccattttattttgataacctgcccgcacaaattactggcatagctttcaccacattggcacacacaggctatttctattgatctcgaaacttaaagagtccatgacctcatctgaagtatgctttttaataattcactccatttaaagacccattaaaatgtcataactgtcataaaccttgtaaacagttgttacttctaatgtcttcaaaataataatgcattattgatgaaaacttggttcataatcacattactcccatttgacaaagccaatacagtatatgcttttttccacatcccagaacttgttcattccccttcagctaggcctccccgggttcttccaaagagttctttggaatcttctcatgacccaagccaagactgacttatgggctgacttacttcaaagaggacactagcgcaaagatatgattataaatttgcctggagaagccactgaccagacagtacaaaaggaggaaggagctggggagttagaaatccactgttaggccaggagtggtggctcatgcctgtaatcccagcactttgggaggctgaggcaggaagattgcctgatctcggagttcaagaccagcctgggcaataaagtgagacaccatctttacaaaaaaatacaaaaactagccaggtgtggtggcatgcacctgtagttccagctattcaagaggctgaggcaagaggaccatttgagcccaggagttcgaggttgtagtgagctgtgatcatgccactgcacttgactctgtctctaaagaaaaagaaaggaaagaaagagaaagagagagagacagagagggaggaagggaggaaggaagggaaggaaaagggagggaaggaagggaggaaggaagggaaggaaaagggagggaaggaagggaggaaggaagggaaggaaaagggagggaaggaagggaggaaggaaggaaggaaggaaggaagggagggagggagggagggagggagggaaagaaagaaaaagaaggaaggcaggaaggcagggaaggcaggaagaaagaaagaaagagagagagagaaagaaagaaagaaaaatagagaaagaaagaaagagagaaagaaagaaagaaagaaatccactgctagctgacatgttggcttctttggatgtataaggctttctccttcagaaattcctaggtataaacacacaaacttgatttcaggtgctttttcaatggagcatgaatacaaagaacatattagtttgattatcaatcaaacgagtaaaatgaaaaaaattctccaaaatatgggattctccttaaaagtagagttgccaggtaaaatgcaggatccgcagttaattttgaatttcagataaatgacgaataatttttagtaaaaatatgtcccaaataatgcatgggacacgtactaaagaatgatttgtcatatatctgaaattcaaattctccttggcatcttgtatttttatttgctaaatctggcaatgatacctaaaaagtacgttttaatgcctcacctaacattaaaaatgctgatggtgccagcttagtggtccccaattcaggcaacacattagaattacctgcggttgcctaggcccaccctttacagcagctaaatcagtttggggaatagcacccaggcattattttaagctccccagggggttctaatggacatctaggactcagaaccatgttgctggtagatataatgaccctctcagagaggcatatcaaagatgtctcaggatctagtgacagggaaatatatgtatgtttaaaagcatattcaacattttaatataaatttatatttgaaaaataaaatgtgtttatgttataatctacaaacaaataagagtaaccaagttattcaaatgtggacagctaaaagagataataaagcacatagtccagaacctggggcaagtccccatggggcagagcacctgggaatagagaacaggggtcacaaggcaaggggcaggcaggatttaatgggtgcacaggtgccccgggtcagagggtaacaaagaccagggttcaggaaaacagacaacaagaagtaggacctcgggccaagaagctagacagtcaccagccaggcaccagcagatgcacaaccgatcatgtagttctgccagttgcaggactttggggacatcaatcccagcacctggctggcacagggttcacaagtgacataggtgtgagcatttggctacagtagggaacagagttacagagaagggcaatggtaaattcacttctctgagtgaaatgccaactgacctgcacctatggtgatttgaaatgaatttgacgcttagaagtcacagcttttagtcctgcatattttttttttttctttgagacagggtcccacaccaatgccccggctggagtccagtggtcacagctcactgcagcctcaacctcccaggttcaggtgattctcccacctcagcctaccaagttcctggaactacaggtgcgcaccaccccacctagctagctttttgtggggtttttttttagtagagacggggtttcaccgtgtttctcaggctggtctcgaactcctgggctcaagcaatccgcccacctgagcctttcaaagtgttaggattacaggcatgagccaccatgcctggcctagtcctgtgtactttaagtagggtgatgtgctcaacctgagttcttttctgaaaaacaaggaacataaccttctttgtggggatgtgtaagcagcatacccagagacaagtttgcactgaatgctgcagccctagagcagaagccaggcattctgaagtcacccactgccccgggaacgacaaaaaggaggggtaaatgtactacaactctcattgactacacaataataaaagtcatcttgcatttgctaatcctcctccatctccattttatgtcctacgtttatattttactgagaattctattctcctaataaaataacatcctgcttttatgatcttcttcatgcaaaaaaccttaaaccacagcaacctatccctcccaaaggcataaaagtaaaccaaaagccatatggcactggaattaaagtcagcatattgttgtgttgtataattcaccattattacaaatgatttctcagtgatattatggtattaacccactctagtgtgcaatgattcattatagttctgttttcctttgaagcccagccagctgtatttcaagtggagctcagctgaatttaaccacacaaacattatattgccagcaccattccccagcccagccacctgactcatggaaactgcgtgtttcaggccatccgcagggtttctagctctcagcacacaaagaatgctgcaactccgtatctacaagattccatcctaatttgtggaggtaatcagttccatccatccttacagacatctgaccttgtcactcatattatactagaaaattttgagtcaggtgcccagctccctaatttcttgatgggtaaatctgaagatagttaatgaaagtcacaagagagattgtggaatttctctcaattaatgaggaagatgtaaatttgccttcctttcacagagggaacttggtacttaacaagtatattaaacaacatacattaaacagcatacattaaacaactatgtaggaaacctttatgtatacataaactacatcacatatgtatgcataaaaatatgcgtttgtcatcttgatgaccccagtctcacaactccctgggctcaccctgtctcttaatattcaagtaaaatgattcaaacgaccatactactgaggagacaagcagaccctgattatctgggaacaggcctggtactatgagcaacactttggtgtatttttttgttgaacacaaataactttatggaccatcagcaccaaacaaggccactctgtgcccatgacggatcaggacaaaaataagaccactccatacgtgtgaacacagacaaagcaggaatattgtccaacccacgaaataccagatgtccccctctccgagctaatgtgtgcaactgctgctgctttaccaactaaggtttcagcctcattctagcctgcccacccgatgcataagatagttaggataaccaatcatacaattatctccgcttcctgacagcattcaattagagcaaagcccgcttccttaaaacctcccctaaaatcacccaacacaagaccaaagcctgcaagccttcataaatccattcactgagacgccccacagctccccacaaggtaagttctcccccgctgcagctgcaatgagtagtagacccaacttgttcaactattaacacatatgtgttcctggtgttctttggctacaggacattgagacttggaacatcagaatttatccttatcttttcaaatgtcatttcccctggcatatttgagagaaagggttacctagcttccatacttgggtcaatcctgcttcgtggctgttctctggatcctaaccgacatgctcagctccatgttaggagttctggaccactgtcttttgccctctttctgcagaacatcacaaacacaaggttatgagcaaaataagtatttgtgtgaggatttggaagtaatggagtgcagcatggaatacacaacttgaaactgactatcatacatccgtgccaacatttctcaaggactccctcaccccctccctctactgccaccttcctttccccctaagtttttttttgggtttttttttttttttttttttttttgagacagagtctcggtctgccacccaggctggagtgcagtggcgtgatctcggctcactgcaagctccgccttccgggttcacgccattctcctgcctcagcctcccgagtagctgggactacaggtggccgccaccatgcccagctaactttttgttttctgtatttttagtagagacgggttttcaccgtgttggccaggatggtctcaatctcctgaccttgtgatctgcctgcctctgcctcccaaagtgctgagattacaggtgtgagccaccgcgcccggccgtctttccccctaattttaaagaatttctcactatctgggttctccttgctcccctacctccatgccaccagctttgtttatgtgtttgtcctttcatccttctgtcatctgaacccccaaacttcagcttccagcagcctctcctcaacattcctctcttgtttatttgcagagcctccaaaccctgaactctcttgcccacaggaaaggtggtgaaaactttattatgcaaatcatttttctcgtttgcatgccctaccctaagcaccctagtagcagttggcatggagctgaatcgggtagtaagcagagaaatcaacatttctataaaaccaccccaagaaggtatatgaatttttaaaacaaaagaaaaatgttcctcctggatggaattctgctctaattctactagagtagtggttttcaaactttcttggttgagaacctcaataagaaatacatttacattgcaactcagtatatacacatacaaacatgatggatgagaaagagactgagagacagagagaaagagagagagatctcttacccttactaaaatgctctctggccaggcatggtggctcacgcctataatcctggcactttgggaggccaaggcaggaggatcgcttgagctcagaaattcaagatcagcctggggaacatagggagattccatctctacaaaataataataataataataataaattagctaggcattgtggcttacacctgtggtcccagttactcaggaggctgaggtgggaggatcacttgagcccaggagttcaagatcagcctgggcaacacagtaagatcccatctctacaaaaaataaaaaaattagctgagtgtggtggtgcatgcctgtagttcagctactcaagagactgaggtgggaggatcatttgagcctggaatgtcaaggctgcagtgtgctgtggtcacacgactgcactccagagtgggcaacagagtgagaccctaaaacaaagtagtctctacaaaaaaaaaaaaaatacaaaaattagccaggtgtggtggtgcatacctgtggtcccagctactcaggaagctgaggtaggaggactgtttgagtgtaggaggtcaaggctgcagtgagccacgtttgcatcactgtactccagcctaggtaaccaagtgagaccctatctcaaaaaaaaaaaaaagtaaaacgcaataaaaataaactgcaccctgatatttcctttttaattctactttttttaaatggaaaaattctagttggctgaaacctgttatgctgatttcattacccattaatggatctcacatggtagtttgagcatgctctcctacagcaactaatatttaaaataacaaacttttcttccaactataggtagaaagatagatcttatacacacacacactctcacatgaggtatcacctggcaggttcttgagccggaggaataatacaagacagaaggaaaaaatgtgaatcgcctcttctctgtagcttgaattcacctgactgcggcaacgctcaaagtgtagcatcaattcatatggcgaccagttcatttgaaggagttcctttcaggtgaagagatttgttgaggcccagccaaagatgaagcaaatcaaggcccagatgagaggtaactcaggacgtgacttcagtggcctccaagaacagatgcaaagaacccagcggcccagcaattacacagaactgcaaagtgggagaatgcagataggcaaaataaagagtaataagaccacaaccacacctagggcagttcagggagccgatgtcaacatagagaaggagaagtggttgacgggaattacagggggacgaacagccccaggaacagaaaccagccatggaggaaggggtgtaaaccacacaggtaaagtgatacttaccctggaaccagaaccagaaactatggatcctacaggaaatggatgcagcttcttagagctgtaacatacctttcaaccgattggtagctctcccctgagcagaaaatccacttgtgaatttgaaggtcccagatatttttgcagaatgaagccttgttctacaaaggccaaagacaacgtacggtgcattaagccaggcaaggttgatgagaatgatgaggattaaacgctatttttaccaataatttgagacagtgccccattttggctacttttcacacctttacccttaattcatacatcttctcaaatagaggtttgtaagtgtgcattcattatctttccctggagttataaattcattttcactgatttttaagctctagacagccttgctagtatgtttacattgtggtgtttattttcagaggtagaactgcaataaatgaaaaatattttcccttcagtagaaagggaaatattatacttagatatttataagtggttattttttaaatgctaagacaaaaatattataattattatacattgctgacaattttctgagtgtttctagtttaaagacaaagtaatattcatgacatgaactatacttcaaactgaatatggaataaaaatgtatttaaataacgagagaaaactgcatatctaagtgtacatgcaaatcagcttaactgttttatattagagttactatgatgggaaatcaccataataaaaataataaagctactattttttgagtacctatcttatgccaa

SEQ ID NO: 513 - DNA, 20001 bp, Homo sapiens
tgattcttgcccatatttcctggagagtctgaggtttaaagaaggcaccaaagtgctcttgaaacagtgtaaatctgcactggagaagggcattgtctcactctctgaatcctgagcactgagttgctctaagaagctgtagcacagagcttcttagacatgatcttgttacattctggatctctttaaattctgtttcaataggtttggggtgggcctgagatgttgcatttttaaaaagctcccaagtaatcctgatgatgatgctggtacagggaccatgcttttagaagtagccaccctgagtatcagtggttgttgagttgcatggatgactgtccccatggtacagagcacccttaatcacagagcaattttaatcagtggataaaggatggggattaatagtagtcagccagatgctcccaaagtggtgtctattatgcaggagtatacaaatattgtgacctgtttgtggaggaagtattatgtgatctgtttcctctttgatgctagagatcctctgaacctaggaatgtcccttttcctgagatgtgggaggaagtggaaagcagccacctggaataatagagtaatatggaaaagtactggccttttattatcatttcccttatctgaacacaaacccaggagtgactttttccattcttattttatattatcagagattccaaccaaggtcccttaaaagctgaccaagaaaatttggcagaagcaccttagaagccataatgctttgtggcaaatctttccaaacatctgctgcatgaaaaggagcaaaaatcctgcaatggcgaagggcaagagggcaacttggaagtgggctatcttggcacagctctgtggaggccctttctctgagcacaggcgtacccaggaggccccagcacctgttcttacatattcctgctggcttctgttgtttgcaattgccgtcaaaagcgtcccaggagacggtcgggacaagccttgtcagggaacaagaaaagctgggagtgtggcggttggtctcacaaatgtgaggatgtacaccatcccagtagggactctcatttcccctttcacatcaccacacacctgatggcaaaaggaaatcttttgagtttaggaactgtggcagagaacagtcttttgaaactccggtgacatcaatagcctagtttcattattctaaaactgaaatgccacgagtgggatttggaacacaatcattaggtcctctggagttattgtctagagaggtggatggtacattttaagaaagaaagaatcctaggttagtagtagaagaaaagtagtttatgtgttaggacttagctttgaaagcctagctttcaaggaaatagtcaaagagagaatgtgataaatgtcctttaatttttgctctgaagatatccttgatagagctgctgcatatagttacttcagcttgataggacaagtggttctgtccttaattgtcaccataagcttggattttaggatgcttgaacagtttttaatataacaaagacatggcttttaacatttttttgtattgtcttattataagcagaagagaagaaggattcttttgtctcttgtttattggtcatcaaagcctcagtttaaaatttaaaagtcagaaaatagcttctgaaatacagagaactacttttcagggaatgtttagcctgcagatcttatgtgactaaaacttaatacaataaaaggtgcatttgtaatatgccaaaaagatagcgtttgcaattaaaaatctctgtctttctttagcatgaacactccttcttcctaacagctttagcacaaaatgaaattacagtctgggtttcggaataaacttatttatcaaagacataatcactattctggtcctgagttatcttcactcaaaaaatattaatattattgaccaaattgagttttgattgtgataaaaaatgtctgagccactttttgaagctcttaaaaatttaaattgcagaaaaacaataatccaagctgtctgtctttgaaatggtcttcctcttttgaccaagtataataattaggttttgtctaaaatgatatttattattttagtccatttaaggttctttgtatagtataacgtagaataatctcttccgtagattttttttttttttttagaaaatgataaaatgatgtttttaacattaacttcaggtcatttggctaccaaataaatcattattttcctttgtggtttttaattctgttggattccttattacaattatggtcttttaatgtaaattgcgagtatatgattttacaatggctactaattgttaaactaaaggaacaagagtttaaaaagtgtttttcaaaacattatgcttcacaagtaaagaaatctgattttcaaaatggctagtttaagctgttgtagaatgttggaaaagatctataatgcaaaattcagaaaaaggatatctggtcaccttctctcaaccaagacagctgaaaatgcttaggattaaagctgtcaacctaagggcagatgtattttcattcacttacacatagaggaatgccttctgccagaggaaattctactaagcgttttgtaagccctcttaatgaaggacattgcctgctttggctatttagtgggtagacatctttgcaagcttggttcttactctgatattcttactcagtagtgaatgggggaactctccaagcttaggatggttagaggcattgtcagaggaaaggtaaaattgctgttctcataaaggggacataaattgcaagcttttctttcaacccttcagtgtcctactcacccttttcaaactcagtagtgggatactgactccaaagaggaacactatcacttcagggaaggaactggggctgtgggattgtgaactatccccttttatccagtttgtccatatgtaggagcatcagagagactgctagatagaagcccacctctaggggagaggtgcctttggtgctgaatgttagcaaagaaacatctctacatggatatccagacaactttcaaatgagcttttaaattccattttggaggggctctgaaaagaaagaaatctttctctggagaaaaaaattgcccaaagataaactccagtgcaaactgaacaaaccaaatttagttttttttaggtaaaagtaaaaataactgaccgggcatggtggctcacgcctgtaatcccagcactttgggaggccaaggagggcggatcacgaggtcaggagatggaaaccatcctggctaacacggtgaaaccccgtgtctactaaaaatacaagaaattagccgggcgtggtggcaggcgtctgtagtcccagctactcggaaggctgaggcaggagaatggcatgaacccaggaggcggagcttgcagtgagccgagatcgtgccactgcactccagcctgggtgacagagcgagactctgtctcaaaaacaaaaaaaaaacacaaaaaaacaaaagtaaaaataactgtaacattgcatttcataaacttgtagtttttaacattctgaaagcatacatattcatttgtaagctcatgtagtaattgactttacagaaatcttgaaacgtgttctgtcagagtaaaatgctgtttcattgtatttatttagcttatagaatggacttctcttacactatatcctttctgcatattgtttatttgtatatgctttatggggttaagcacttctggtacatttttcacgtcagacaacctacggaagctagtagaagtatggcacgattaagtttataggtcatgagataaatttacacggagaggcaagtttccagcttcaagcaaatgacttatctgtaatttgatgcaagtaaaatgactgacctttcaaatgtttgttgggcttcaagtgtccagagcaatcgatatgtacattattgtttatattttatgctcctgatcccattaatgtatgcctatggaatgctgggacaccattagtttctgatacttctgaagtattgggtggcatttatcaaacagaaaggcagcacatattgactcgtgacagtttttgcatttcttgagctcaatgtttcatgagctgcttattcagttttggtgagcaaggcttttattgctccaaagccgcctcaattaaataataatgaaccaatttgtttaaaatgaatctttaacttgcagactgattaatttctccattgtgagcatgagaagttgtgttcttaggcaggagagatcagagaagtgcggtggagtggaataattgctgggtgtgtgtaaattgtaagaatgactggcgctgtctgtaactgtgtgactacagacaggtctctaagtattcctgaacctctggttcctggttccccagctgtaaaagggggtcaggtggaccagatagtcatcaagatccctttcagcttggacagtcaatggataatggaatatcgatagacagacacacgagcaacatgcagccctaccagtaagtgcaagactgagaagtggggaaatcctttggccactttaccccccacttcagagaaagatttaagggaaatttgtattctttcctatttgcctagagtatattggacttattctgggtctctgggagaaagatatttgggaagtaggcatgcgcacgcgcgcgcacacacacacacacacacacacacacacacactacacataggccactctctttctctactttactccttcccattccacacacctaatcctcatcccacacaaaggtgcttaaattaaaaagtgccacttgttataggggtggaacaggaactcagttcttcactgaagagacaggaaacagttactcacttctgtattaattaactctccctttctagggttttattattggagagtctaatgacttaaaattaatcatccacggtccaattaaaaatcatgaattgatgaattgctttctaaattctctgttttattgacaaattgctgcatcattgaagctataagacatgtcatccattattaactttgatggcattaaaacagataaattaaatcttttaagcagaaatgagttctcacaaagactgctcttcccaagtgcacacggtctcaattttctctgaatttcagcccacttatttgagtctattcttgtttcacttagattgtattgattgtttagtaaacattaactgatgatagaggcttcttaatatgagcagataatagataatcaatgtgtaatgcaacttaagtgataaaatacttttgccaggaatatacaatctgccataagggctggaaatgcctgcattaaaaaaaattaaaacatacaatgaaaattttagaaaggaaacctgtctcttcaatgtatgaaaagttaaatttactctcaagacaatgacaatagatagcaaatatataaaaaatgctatttccaaggcacattaaagatataaacatatgtatttagaaataagtgttctttaaacacttatggtttgcattaggataagggtaaaaggcaataataaaaatattattaaaatacattcaaaatttgaactcaataattgacttattacagaggcaaaacattcttaccttggcttttgcaaaattccttattcttactattatttacttcttcaactgaaaacaaccttttgtttcataatcagaatcttatttttctaacatcgtaagtatgaatttactgtttacagcttcagtatctgctgtgtaacacatggtatgctgggggtaaaaaggacttacacaagtttttaatagttcaaattagacccgccttttatcccacaatcccttttgtgtgtctcattattgatcagagttgtgctgttctttgaaccctgggaattaccaggatagggttttatttgactgtttgtctctttagcaaaattgttgccaactttgacctttcaaaaatgtttgtgacaaggtgtttgctgttaattgcacacaggaaggagtgaaaagcctcccagttgaatctcatatttaccagaagaggagatttcttttttggtaaaatctgagtcttaagaggagacaggttttggttgttgtttgtactttaacatagcaatgtagcttgagaaggttactattttctaattagcagacccattaacaggataaagaaagaaaggatatggctttatataaagtatgttgtagctccactggcctagatccatttttcacctctagtggaaattcagttcaatagagatacaaaattgcaggattggaaagggccttaaagatcatataatcatatcaacagatgcagaagaagctcttaattaatgccagactctgttctatacacgtatagaaagcacttattaattcatttaacccttagagcaaccttatgaggcatgtacattttattattatttcaatttccctttctttcacagacaagggaattgaggcacaaggaggtgatgcaatcacctacagctaattactgtcagagtaaggaaatgaacccaggtggtctgtccccagtagacagtctcctttttccttcatagtctgcttcctggttactgtgcctatttgattttctttgtagcatttttttgctagttgaaatgatccaactcattttcttcccctcacttattatctgcctatctcccctctgccacattagactctaaggtccaggagagcagggacttttgctcactgccatttccactcaggtctggagtaatggtgcatgcagtggtttcttaataaaaattcagtgaatgaatgaatgaatttgagaaaacgcagtagggacagtgagaatggaagaggctgttgggttggaggatggctccctagtgaatgtggtgggagaatcttcttaccagcctgactgatgagagtgggaataagggaatgggggcatcaagagtgggctcagttttcaagaaggttgacagtaaggaaagcaggggcaggagaaatagcaattaaggttttatgctttcgtcagaaaacctaacaggaaccttcctcttttgcaatggaagaatgcccccttgctcctctttaacgattattattatgtgaagacccatctctggctcattttctcatcgatttgatctgcttaaacaccgaagtaatggtttgaccacagaattatcatctgccgttatgcatttcacccggggtgcactcctgggtagtaatttcccaggatcatccttgggggagcaggccttcccttgtcaatatctgtggagtcagaaagcctataaagtaccagcaaattggctttggatcccaggaaacacgtcctctgtccttttctacacagtctttgaagttgcctatagcattataatttcttttcctggacattacaccaggatagagaacatagaaagaaagagtgagtgtgtcgacatgggtggcgctgaaccaccccattgtggtctgtgtcctgcgaggccaaccagaaacatttccatgacatagttctggttcttgatgtgtgcagtaagcagcccctcacatcccaatagcatttcctaccatccaaaggaaggtaatacagaaatttcacatttaaaagttaaacccctttaaggtggttttggttagctctccctacggtttctctaattaggtgcttgtatgaaatcgcagtggaaggaacatcttgtttttacagagactctctattttgaagccagatactgctactatttcaaggaagaaaataccgccctcttttaaaatatagcaaaacatgttgtctctttctcagcatcaattacaaatcaagattctcttctgaattctttttgtaatctgtgttctcttgttcataatttagaaatgttaataattcaagtaggactctacttgaattgataatactgactagtattatcaaccagacaataaatattaagatttaaagtgcacgttttgtaccatgacattacttggcccagtgtttctcaaaggaggtgctttaagtatttgggggacaggcaaatcttccctgtgaggagctttcccagacattgcaggatgttgagcttccttggttctgggtcacaacttccagtagtacctgccagttattgaatgactcaaagcatcctcatgtgtttgcaatagacctgtaagggaaggtagtatttcccttggccgtgacctggctcagggatcataaacacaaatgcttatgatgccagaggccagccagataacataaatttgttaacctgcctcagtgtaagggaattcagaatagtatgccctatgcttgctggaaaaatgtgcatgacttgtttggaggcattgaagatcaaagttgtaataaacactatgctggtcagcaaaattctcctttctgccaaatttggctccccagccatcaggcttccaccccagactagctcctgtctatcagtccagcccatctatccactctccactttgtacacaaagatttagctacactgactcagcacataggaggcttgacttaaatactagttgaataaatgaataaatgaaaattattctaggcctttaaccaacttatgagaagtttataagaggagcattgatgattaaaatttccccctaggccacacctgctgtgggtttttaggtggcatcctggatttcttctaagtcctctcctggcatatgaatcgaggcttatcttttgtttcctgcatctgttccatttgtccaatagtgcactggttttgatgcataataggtgtaatttaaacctcagattgtaaaaacttacctcacaaactctcctcactgtgctttgcccagtagtgtgctgctttctcagaaatgtcatggagcagtggcctgagattcctttatactagcaatgtgctctacttcttctagttcttggcaggggacaaggaattgctcccaccccaggctgatctggccttattggtactagaaagtgattttagtggaactaagaactcctcccatttcaaagtaaagacttctccgaatatcccctaaattctttctccctttcttccttctctctctcaagtattttaacctattcccctgggttggaactctccatgaaaaatacattttgctgatttttcaccctcttcttgtgatcttatttggccatataacccccaagcagagcaggaaacatggcattcaaaggtaacagagtaaacttctcctccgtactcaggggcttaagcaactcggtttccagaagtttatgtagaaaatctttttactaatgggtcaaagattcccagatgctcacaacataccattttttcccttgatattattatttcatgagactgttttaaacataaagaaatgttgttaattcacacatcattttttctcctttcccttgcacagtctgcgtgtattggtttggttggttttgaagcagaacacacacttgaccagccatttggtttcccacagccaatatgcacatgtccagggtgttcccctgtgattttcaaggcctggttttcttctgataaggtcagaagcacacacagcttatccacatctgctgtgttccttgaggtcaatcagaatatttttccttctgggactaatgggaatctcccagagagaaacaattattgcacgtgaaaaatctattgatttacattgcatggttcacctattatttagggttcagggacactttttgaaactgggagagcaattcaggggattcagaatgagaagatactagtgaatacattcatgccatacatttctgagtatttgctgctactgctattagaagtgcagaatgctgaattcagttgccacaagttgtcaagaatgtaagtcatccagcattactgacttcattggttgaattataaatccacgataatagtgttgggcacaatcacagattaaaaaacggtgaacggaattgtgagtgttcccatttgtgtgatttcccacttctctttttctttgctttaaatgtgaggcccattttctatggctcctgatgctgatttggatggaaacaaggagcagatgactccatgttgcagaaggcaagagcactgggtttccagttatagggatttacttctcatgtggtccatgttgaaattttcaaaagaaatgtgggaccatgacaatatactatgtgttgtcatctggatccaggaatcaaacaaatagttaaaagccttcaataaactatctaccctttggctctttgtttcaatgtatttttgtcacagaatattttttccacagttgcaagccaattaactggactcctagtcgcttaccctcctttaggaattagacgacctgcgtctaaatcccagtctcaacccttatcagctgtctgtctctttgttctgggtttatacccatggaatatgaaagatactaagcatctcatgattatcttgtgaaaaataaattaaactcacaaaatatctagtataattgacactccacattaaacaaacagtcaaatttgtatttttacattctggagagtctaatacgtaatgaagtaacttaaacactgaataagatgctgaattataattttcttaggaaagtatttggatgcaattttttttttttttttttaagacggagtttcgctctgtcgcccaggctggagtgcagtggcacgatcttggctcactgcaagctccacctcccgtgttcatgccattctcctgcctcagcctcccgagtacctgggaccacagacgcccgccgccatgcccagctaatttttttttgtattttttggtagagatggggtttcactgtgttagccagaatggtcttgatctcctgacctcgtgatctgcccgcctcggcctcccaaagtgatgggattacaggtgtgagccaccgtgcccggccagcttttttaaaaatagagagattttctgcaggcttaagagatggaaacttgtaagttgttattccttttgggtataggactaaggcaattctctaaagattttgtactggggtctttatttcagtgcccttatacttttacatccactgaggcagtcaatagaaaatgcattaattggtagccttagtcttatcatccgtgaaactgggttagtaattgtgacgatatcataggatttggtgatgactggatgagataaaatatataaggagctttgcatggtgcctgccacaaactaagcattcaataaatagtcaattaataatattatcattatttataaagatcctatcacagaagttgctacatttccatagggagattgtaaaggatggaacatattatatccaagctcattctagctatactatatacacttctgtaattttgataaatctaagatagtagaacagtattgaagactccatttttgacttggataattctgaatggcatttctcatataggaaaattcacattttaaaatctcaaaatggtaaaaagccccaagacaaacactaagtagcatccagctatttctcctttcaaatgggtataattttatgacaacatctttttcagctgcagagaccttcaaatctgttttagagttattctgttttttccctagaaaaataataaacacaaacggttataaatgaatcagtatgatttttttcctcccgattagagagcatgatggcctcagttgcttgcaaggcaaaagtgctgatgcaggaaggcctaattgattggaacaatatacggtctggcttaatgctttaggtcaaatccttggaaaattatacattctttacgcaaaattaattgtgttgcaagcatctttcccatcaaatgccatttttttttcttttgcccatttggcaccaactttgacttgtagggatgagtcatgggtagcattgtcacatagattcagatgctgtttgtgggcaggaattaagttatgagtattattctccttgttatttttacattttgtcaatgtctccttttgccattagaacagctcaccatttctctttcttctgttttgggagtctgcaggttgtggtttggtcctattgtgggataggttttttcctctctggctgacagacattctcatcatgtgcttgggctccctggtggatgggtattaggcttatgctcagcctggtcttacagtgccatggccctcagagaggctagagataccttcactcgaagtggcatacttcccgttatatgctctcccctgtagtttcttgtccttgcaccttactgccctcggttgggctgtttagatgtggctgagtgaggagcaggccctttgcgcctccctttttcctctgaagcgctcagagtctaggccagttcattgttgatgcgctggcaggtgggggctttctggcctagaattgacaagtaggtggatgtgaggattgagggagatgggggactttgaacatgactcacaggtttatagattgggccagtggttggctagggctggtgataactaagataaagaatgggaagtagttttggttggataaatggtaagtctagttttggaggtgagttggctctgccttcagagcatccttcaggtggagatgcacgtgtgggcttttgtgaatgagcatctgcagctcagcatctgtcaggcttaggagaatggaggctcaaagggaggctctgctccttaaagccacttttaaaattgcagtgctgaatacatctggctccccaaaactgctgatgttgttgaatataccagatgtctcagaattttgaagagcaggaatcagggtaatgcattcctaaactcagcagcacgtctgcgtattacaaccatatgtagaagaaaggtgcctgcaggatggaagtctccgaaatgcaaagcagggtaggtgagcctgagtcatttcacgtatggggctggcatgaggcactcagagtggtttgtgcaattcccttcaacccctttcactcaactcaagcttaaatacaacacaatatattaatattaattaaactatagagttagttatcctaattgccatcaacatacatttatcagaattctcctattttggggtttactcaggtttgtcactattctcggttaccaccgaagtctagttgtgaaggtttaagagtgattttctctgaaaatctcattcccttacatcaaacattgtgtggcaaagtgaatattttgctgttggttagtgtgatagcaaaaaattttgaaaggaacttttaaaaaccaattttccatatgtgtctttatttttagccttcatctttagggcatggaccttgggattttattttctctgtaaaactttctaccatccctctggctaaaagagggaaaagctaaaacccacatatttagaggtgtgtacagactgggttaggggctcttgatcatgagcctgagaattgggaacactgcggtgaactctctgggacattcaagaataagagaaaaatgctgaaggaatctagcaatgctggcattgcatagaaaacattttttgaaaacaaatgtgctaggaggggctttgagaaatcctcttggggcttcctttctttggcagctgaagcagtattgtcctcattgtacagccgaggaactgaatcctggagagcttcagagagagctttggtgacttggctaacatgcagcacggaaaatgaagtggaggctaatggaacacgaatgttggtccaccgttctcaccaccaccttactctgccaccaatagaaggccattgtcagcaaaaggagaacatgagcttccttagctctctctagagtttgaaactcctggaggttgagcacccatgacatttcagaaggacttcatttttcggacttgtggccccatatcaagcccagcagagacacagcagtggacactggttaagaactcagcactgagtcagatagtccagcgttaaatgcctcctctgctacctaccggttttatgaccttgggcaagatacttaatgtctctaacactcagtttatttatctgaaaagtggggacagtatgactatttgattttgttgtcaagattaaatgtgtgatcatccctgtaaaccacacagcccatgacgtctagaagcatcgaccactgtggttgttgtcagctcaccacccaagggtggtgaaagtgagtgcttactcacactcatttgacttgtgtctcacaatattgaacacgctcacgcacatctcaggcctttttgctctgtgttttcctttacacatcccaagccgttgctaacactttacacaatgtgaagaaagcaaagcccctttcctttgtctcttcaccttctatttctttcaccttctctgcccctctttggagacactgagtgaggagatcctcgcattcgcacttgtgtctctggcactgcccactctgcctattcaggctcccactccctggaccctttactttcttttcagccaatcaaaatttaccctttgctgccttgtacccagagcgtatagattcctggtctgcaggttgcatccaacctcagaagtattttctttgactggcacaatgtttaatttttttaaaaaaattattagttacttagttttaaacatcaggaaatttcatacacacacacactgagaaatggtgtgtgtctttgcgccctacctttcctaatggcagccactagctgaatagcagctgtcctctccagacgggcatgtgctgctccagttcaccataatcctcacccatcacgccttgtaccaggctgccatattatttgcattcctgtctggaccctataatcatttacttttgtgacctaacaaatttaaatcccaaaaggtagtaattggtggagtggcttaatgtagcctgtgactttctcacattccccatatattaagcattagcgtacattaactgcctttttcatgctgggttaaggcgacgaacagacatttcaagccaactcacagtagtactgtttgccagtgtagacatgggagtattactatcttttcgtatgtcagtatttgggtaatgtttgaatctgtatctgacttttgctttttctacttcaaatgttataaaaatgaatggaggtgagaaaggtgctaataccagtgttataaagtttgatgtcactcaatgcaatatttgctagtctcgttcagtcattcactgggatttaagctggaaacttaaagagtatgtgtcaaatgcaggaaacaaatcatcaaaggccaggtccataagaggaagtgtattttctaacattttagctttctcagaatggaactgctcttagaatgtatcagcctatcgttccatttttccatcttcaaatctgataaagttttcaggaatattatatgcatataaaatgttctgcctgtatttttgttggcttgtttatttttcagagtactcttagagacacgaagccttacccaaagagaagagatttcactggtagatttcattaggtctgatgcaggccattggggtagattattggggaatatatcctaagcacctagcaggtgtcaggttctcttgagctgtcacagcggtcctgtgaagtaggttttgtccctgttcagtgaggcagcgtggtgtctcagtctgcctaggtctgtttttttggcgtctctgctgacttgctctggggccttgggcaggtaacttaactttttttttttttgagccagggtctcactctgtcgcccaggctggagtgcagtgacatgatcttggctcactacaacctccgcctcccaggttcaggtgaatctcatgcctcagcctcctaagtagctgagattaaaaacgtgcaccaccatgtcttgctgatttttgtatttttagtagagacagggtttccccatgttggccaggctgatctcaaactcctggcctcatgtgatctgcccgcctcggcctcccaaagtgctgggattatgggcgtgagccatcgcaccccgccgtaactaaacttttataagcattagttttgtcatctgtaagatggtttatggtaatacataaaataataagtgttagcaattcctggcacaaaataagtactcagtatatgttggctgttgttatttagagtaaggtcctgaaatccttccatttcagatagctgactactcttcttccaggcttagcctaccaaaggcagaggtggttactctctgttgtgggtggggggtggggggacctcctcacttcatagattaactgtagaaattacttggaactggagatcagctttttgccactctggttctgtccttggtccctccctttctcacctgaccttttgcacagcttggcttcctgtctactgcttcttccttgcttaaatgaagttaatatccccctctgatacccttctccacagtagcctacatgttatttccccataaagctcaaatgatttcattgaactttatgatgcctgtgaaagatgtggatgattatcctcagtctggccagcagttttaattagagggactgtgaagtgtgctgttaattaaacgagttatttttagacatacgtgttcattagtcctctggaacacctcttccttcagatttttaaaaatacaggttaatttatggtgtggataggagtcattaactctttaacttcatcttgtctagcaaaatccctcctttggtttctctgttgctagagaaccagagtgaaggcaaggtggacgtggcagctggagagcaaagctgcctttcttcccgttgtgcatgctctacagtgacacctcccaaagacagtttgaagctgcagagatttgctccaaaatactctaatattaactacttttgagcttcaagatggaattcagccctaagagctattgagtccttttaaacacacagagctatgctgtcatcatgaaatgattcacccttcagtttgcattctggcaaacttacccccggggctgtctctaatgtcttatagattggatcaaattgaacttcaaacatttttataaaatttgaggcaagaatataccaattaaacatatgtatgttattgtatgtatatgagccatatgtattcaaaaaatacatgaatcttcaaaagatacatgctgtatgattccattttacatacttcttgattccatttatagaacattctcaaaatgacaaaattatagaaatggagacaagatcagtggttgtcaggtgttagggacatggcgtgactataaaggggtaaacgggtaattatttgtagtgatgggtcagttctgtatcttgattgtgatagctacatgataggtacatgaatctttacatgtgaccaaatttcacagaactaaacacaaacacacacaaagaaagacagaaaggaaaagcaatcacagcaagatatttatgtattatgacatgtattaggtcaactatgcataaatacagcaaacaaaatagaaagtaaataattgcatgtggctttccctatgatcaagacataaaaatctcaagttaacaaagggttatttttgcattagaatgtaacggggctttaacacatgaatttataaatgctcattcttattgtgaacattagcctctgtgtggtcagtcatcaataacgcagaatttatgggaagtatctatctctttttcctctttccctttatcaccatcatcttacttcgatgtgactattgactgtgattgatttttaggagtgtggctgtaactgagaagaccaccttctctctgttgttgactctcgattttcttggaaacattaactccttacacatgcccagtcttgatagattgtgaggggtttaagcttatcttgtgggatttcaaccttctttgtttaatggtccccaatcagtgatccttcacaccaaattcctcatgcttcatggggaaggggtactatttcccatggtggaaagtgatctaacagataaatgatatgacaacatgttaaatcatcttggggtaattctttttttttgtttgtttttgagatggagtttcgctcttgttgcccaggctggagtgcaatgacgtgatcttggcttaccgcaccctctgtctccccggttcaagcgatcctcctgcctcaccctcctgactatctgggattacaggcatgcgccacaatgcccagataattttatacttttagtaaagacatttcttcatgttgggcagcctggtctaaaattactagaaaaataaaagtaatctattatagtaatttatttaagtgattcttatatttaaaataccagcagttaaatatgcctaggaaaatctaaataatgacccattggtattggaaggaaattggggaaatgtttaacctaaagggatgacttcctaaaattcagtagaatttcagtcactgcgatacctgggaagggaaggtaatttttttgggaggtgcatgcagtcggcttttttcatgctgtttgagttataataatcaaataattgtctaaatcgagcatgaaggttttcttacttctatatgttcaataatgtattgaaatttaaaaatttatgtaaagcagaatttaaggagtctgtttgcaaatcttagtatacctaatagattttaagttctctgacagcaggggctatgcgttttacagctttatttctcagtactgtatagtagaaattttatatacttacttatatttaatatcattattatatttgatagtagatatttaataaatattagtagattggatatgttgatgcgtttttaaaatttagtttgttttgaggcagagtctcactctgttgcccaggccagagtacatggcatgatcatggctcactgcaatccctgcctcctggattcaagcgattctcgtgcctcagcctcccgagtagttgggattaccggcacgtgccaccttggcatggctaatttttgtgtttttagtagagacagggttttgccatgttggccaggctggtctcaaactcctggcctcaagcaatccacccgccttggcctcccaaagtgctgggattatgggcgtgagccacagcgcctggccagatatattttaaaaatttatatataaacatactatcatatgggtgagagcaatcactaattgccatattcatgttctctgatttctggttctccttaactaatatcacattcaggcaccatatagcactaattacattttttgccttactattctttaagaggtcatttgagatattagtgtttaatttatattcatgtatgaaaattctattttacatccatttctttcttttctttccttttcttttttttgacagagtctcgctcttgtcgcccaggctggagtgcagtggcgcgatctcggctcactgcaagctctgcctcccgggttcacgccattctcctgcctcagcctcccgagtagctgggactacaggcgcctgccaccatgcccggctaattttttttgtatttttattagagatggggtttcaccgtgttagccaggatggtctcgatctcctgacctcgtgatccacccacctcagcctcccaaattgctgggattacaggtgtaagccaccgcgcccggcctacgtccatttcttgaatatgcttccttacttaagaaaactgtgctttggagaaatgccagcctcttctataatgaacatccatagttattgtttgaagagaaaatttaatattactttttaataaaaatagcagatggccaatataaaatccatgtcattatcaataatgcttttactacgtttctgagtttatatttccaaatttcattcctaggagtagaaaaacaagtatatattattttgctctaaaaataatattaaactctcaattctatctaagaaaactctgaaaactgtagaagaaaaggattttt

SEQ ID NO: 514 - DNA, 40001 bp, Homo sapiens
aatcttagcaggattttatgttcttcatattattttcagagattatcacccccttactctcctattcatcatggcccaacatgtgatcttatctatttgtgagtgtatgagtcaacaattacttagacttaaatgtatgctgtgctagttttctttctaaatattatttctcatataactcttttctgtatatattgtttcactttgttaattacatacttaagtttgtgttccaaaatagatctgtaggagatatgtaaagtctatgtttttccatcccacttgaatgttgctttgactcaatacccttaaaacctttaagataatgtcccattgttctttataattagtatggcagatgagaagcctgatgacaacctacttctcaatcctttgtatataggttccttcttatctcctccttgcctccccaggagcttttggaatgtttacatctatgctgttggaatgttaaaaatatgtttgtttctaggctctgtctagatgtaaatcttaattaattacctctgttttgtgcttgaatccctttaaaatgaaaatattcttctttcagctcagaaaaatttgattttaaatttttccctgatttctccttttataactgctaggattatatgttaaacttcttgaatttattctctattatttttacttttctttcatattttccatccctttatctttttacttcttgtcctagaagatgtatacaaattccccttccagatcattaattcagttgtctccagtcattcattcaggctttctgttttgtccttttaatttctaagaatgatttcacattcattctctggttgcttattttttattacagcctattttaaattataaatgcaacatcatctcaaataaacctgaaagtattaattagcacatttaacactgtctgctgttccattctctggttctgttgcccaggctggagtgcagtggcacaatctttgctcctgcaacctctatttcccaggctgaagccgtcctcccacctcagcctcccaaggagctgggactacaagcacacatgaccatgcccggctaatttttgtattttttttttttatagagacagggttttgcaatgttgtcctggctggtcttgaactcctgagctcaagtgatccgcctgccttagccttccaaagtattgggattacaggcgtgagctatcactcctggcccaattggagattcttgattttcagggaccacattgactcatataagtaaatggcattgttttcctttatgttgtacaattttataaacttaatagttctctctcttgtgtggaagaactagctgtgggtgcagagtatatgagcacaattgtggaagaagctcaactctcaatttgattcaagtgagtaatttgtctaacaatgttcaggcaaatttaccagcatggtttttcaaagggagatctatggagcacccacatgaaaatcagccttagtggtgataagaatgaacatttgaccccagactttctccatcagaatctctgagcatagggccttggaatctgcattagttaacaagattacagctttccctgatgcacaataaagtctgggaagcacagtattaatagctaagtaacaggtcattatgggtgcttatgtgatcccagacactgactccatgaacaacactaggcaagctattcagatgatccaaaatgtgaatatgcaatacacacacacacacatacacacacacacaaattcttttaccatcacaacaaaatcttaaaatgttgaaagtcattgtagaagacatatacatggacaatgtatttaatccttataactatcatgaggcatttctaactttcattttataaatgagataactgagcattagagaattatactgattagggttacagagccagtaagtgatggatgtgggaaccacatctagtatggcacactgatagtctgaataatggccacctaaaatattgaggttctaatccttggaaccttagaatgttaccttatatggcaaaatgaacattgcagatgtgattaagttaaggttgtgagatggggagattatctgagattatccaagagcatcttacctataatcacatgtgtccttctaaaagggaggcagagagaaaattgactatagagtaaaaaggcagcaatgtgatgactgaagcaagacgctacacagctggctttgaagatggagaaagaaaccacaacacaaggaatggaagaaatgcatctccagacactggaaaaggcaaggaaacagattctcccctgaagcctacagagagcatggccatgcctatgccttgatttcgaaccagagaaagtgattttgaatttctaacctccagaaatataagaaaataaatgtgtgttgttttaagccaccaagtttgtggaaatttgttatcacagtcatcagaaactaatgtaaacactaattaggtctgtccacaaatattctagttctcttcccaagtccaaagcaaggttgtacttctctaccttgatatgaagttagtactgaccatgtgacttgctctggctgataaaaggtaagaagtgacatgtgttagttctgagtggcagttttgagagtcagactacaatttatcacattccctcctccttgctctggtgatcacagaatcatgtgtcaagagcaagtttctatcagccttgggtcctgagtgaactatgatgaacagaaatccctggaaacctatactgaatatatagcaagaacaagatgtcagcctctacatgtcaagtcactggtatttgtgcactgtttgttactgaagcctaatccagcctatcccgacgaatacagattatgaaatctatactcattccacagaagcaagatgttgcctctgtgtgcatttgaccactctccctagactcccaacatattcctagtatttttgagtcatttttacctgaattccctagaattctgaacagtctctgctgcatactacggaaacattgactgaatagttgaggtagttatacaaaaaattaaaactgaatcccaacttccttcttatgccttcgtgcacccctccccacaccattctctctttctgcatgatagtctttgtttgcaaccatcatagaaatccttctctttccctgtgcaatggacatgaatgagatcattgttcctgtactgacatcaaatgggagggaaattgaaagcagtcagacttcagtatcagagtcacactcactaccaaaccatagactggtatgtatgggccaccacttgaccttcacccacacagctcctgaaagtcagaaggtaagcattatcacatgtttgcttcccttatgcagattatatttgcttttctcttggaacatcccaaagatgaggctatcctggcatcttcttcccttccctaaccattgcttccagcccaaagcatgatagattaacatttacagttatttgattctctttagagagattaaggccgtgatattctaaagctgagactgctacagctaacctgtatagataatgcaatccagacctcctgtgaaaggtaccatctctgaaatgtacttccttttacattgggctatagtattcttacatggggctatattgtgtcatgtgatttgaagatttgcctgacctgccgctgtgatctgatatatccttaggaagcaatggaaaatgtcgaaaacaaaaagcaacatgttagcgaaaccctgcttcaaattaaagccctgcctttattggtgaagagatctgctaaaagctgttatttgaaatatctgcagatagtttggatctgtgaataattgctatctgcacatctcaaattccttatagttttccgttagacatatctgtgagaggctataaatagtgaagcaatgtcgctcactgtataatacagtctctctgcttttacaactcatcatgaacttctgtgtaatttattttttattgaagaattccaattaatggcttcctggtgattttaaagcctcaaattatcagtctctgaaaacaaagcagagaacataattatcataaactgagaatttttcattttgaagcttatctgtttgtgctaagtatcttgtctgtaagtaattagtgcctttattttttttcagtaaaaataatgaccactctatgccacacatccaaattttgttaactgctagatgcactctatgtattatatctgaaaatggaccaccttggactagttttaaagtatttcatcaaatgataatagcaacaacaaaatacatctgtttgtcagaataaattatgtggcatgtattttaaaaacctattatatccttttgctttctttctaagaataaaagcctctgaaaaatatgtacttgccatttattaccagggctgcataacaagaaaagacccgttttatcttccatttataattcctaactgctaatcaaattgatcagccaatagcttggttgtagagggtctttcataggaccatttcaaaatgttttaccaaagataaaacaaaattcaatgaaattaaaccaatttgaatgacaatgtgagccaaacattcctttaggtatctagagaactcaagttttcttgattaaaaaaaaatagggtttcactgatgaaataggaattgcctagagagactaagagagacttggttgctctgaagccaaacagaatccaagagcagctctcaccacaacgttaggaagttaacttcattggttgttttttaattaaaaaatatatatattttttaaattataaaactaacacacgtaccttaagaaactttaaaaatacagaaatatatgatgtaaagcacccatttaccatttttaatgtcttgtcatgtcttttcagggaaagagaaatatacacatatatatgagtatgtatatatgtgcctatgtgtttgtataaatatatatataaagagagatttttttggaggatgaaatatatatagttggatctttcttgtttcatctattactatgaattttccctaaaacacaaattattcattcaaagcatgattttaaatagcttcacattttataatagagttgtatagacaaaaatttaactatttccttatgttggtcatttatgacatttctaatttctttttttataaaaagttgtacatcaaacatgtctgtatgtaattctttgaatatattgctgattatttccctagagtaaaatcttaaaaggctactaccaagtcataggtgtaaacattttaaagctttccctccgttcgtgttacagaactgccctgtggaaagattctaacagttcacttccctgtcactggataagcaagcccttttgcacatacccatgaccatggtgagtaacagaacaccatcgcttacgtctatgctaacttgataataaaaggtgggatttcttcatttttacatgttttgataggtcatgaagtgaaataaatttactatacaaatgtagtaaacataacatttatatttatattttgtgtatattttgcaaggcattaggtttttttcctcatccatcgataggagcttgtcatatagtatgtgtgtcttttgtcttgcattattttggcaaaaattttacctcaaattgttatttgtcttcaattctgattctattgttgatatcaatatatgcatttttatgtagtctattgttattacctcttttttgcttctacacattttttatacttataaagtctttacccattagagatatggtacatatatatttacatgtcctttaatggctttatatttttaaattgatctctttaagatattaacaatttattttagtgtaaatgacaaggtaatgttttaagtgtatattttcaaattgtaaagcaattttcctaagaccaatttatcaattaaccattttcttccctggaaatctgtgatattatctgtatcacattctaaattcccatagatatgagtctggcttgctgctatctacttcataccatgtatccatctgctacattgttttgcttgttttagtctggtggtagtttggactgtcaaatagagaattcccatggctttacgcttcctttaaaaaatacattgtatattttgaactatagttgtgtttttttctcaaagaaatcttgcagtcattttgatacatttaataaaataatcatatttttgaaacagcactaaatttataaaaataatttaggaatgtttgtatatatacaataagtagccttcccatccatgaacaagttatatcttcacattaattatctaatgactctcaggaaagttttatgggttaattcatatagtttccccttttaccctgttctattttttatttccaatgtctagcaaattcctagcccatcaactcacacaataatttattgttgactgaagtaactaatttgtagtttcaagcccttactctaccatttattagcgctgtaatcttgaacgagtgccttaacatctcataatctcagtttcctcaactgtaaaataatgcaaatattgcatcgacttaataaaattatgagaactcattgagattacttaatacacttagcacagcaacttacatatattaacgcccaataaacattaatgaataccatccttatctggagggcatgtcaaaggaaaaagcaatagaacatgcaatcagagatggaagcaagagaaaatgaagaaccgatcgtgactccaaagtggtaaggctgatttaaatggaaaatcttaaaataacaactattgattgtcactgaaaagtaatcagtgttttcagattttgtaggcaccagaacttggcttagaagtaagccctccacacctggagaatgaatgtaatgttggcaaagagtctgatgtgaccagagcccatgacggtccccaggccatagaaggctttttcctatgagcattaatagtaacaggcctaagccacatggaagaaacacatagaagtatttctggaagtagagaatacaataaactcacccttacctcaaatatagactgtttactctgtaaataaagtgagaaattagagaaattatccaaaaaattcaaagtctctttcaaaaacagtcgactacttggtctgctatcatttgaatatggtgcttagatattgagcccgggtgcccaagctggataatagtttccattctctacttcaatattcacatagacccagccatagtgtcttaaaaaagctaaggactaactttagccactggccctgctttcaataaagccttattttaatagaaacattgtgtctctcttccaagtcccaccttttttaggcagcctgccagctgaaggcaaaaagaaattctagcacattgtccccaaattccaggcagatcacaaaaataaactgtcccagaatgtattccttttatgaaaaattgcttattcaaggcttgcttttcttgtttgccttccttcttccctttccaaacactttttcttctaacatcatgctgtaaagttgccatctgtctcaaacacatacatacacaaaagggaaatccacttacaatgaatacaggaaagaagaaaaataagttggttacaagtgggttttctaaagtatatgacttttcaaacccagtggtcaaaccctgaattacgtcccagacagctgtctccccatttgccacagagacaaaagtaaaaataaataaataactcttaaaaaaatacctttcaacattattccccaggaaatgcttgatttttataatcctatgatatagggatagccaggaattaaactttaaaaataagaaaactgaaactcagaaagacgattctctattgaagaccacacatgagagtttcaaagtgtgggtctgaggcagaagcacctggggcaattgttagaacacatctcttgagagcataaattggatcatatcattcctctgctaaaaaccactcaacagctgcccattgcaattcgaaggaaatcatgcccaagttttacactcctcactacagagcacaggacatgcccctggctgccctcagaccttgtaggttgccccgcttccctccccaactctccctgccaactctacccttctttgcagcccccattcacacaaagtctttcctccttactcaagtctcagaaaagccatccctgtccatactagcaagtacagctccacacaaccatatatcaatctattatatcttaaatgtacattatttatcaaactctaaatttcacttatttatgatgcatttataggctatttccctgccccctcaaacacacacacacacacacacacacacacacacacacacacacagacttaaagcttcatgaaggcagtaaattgtcttataaaacagagatagttctagcactgagaacatgaagcatgaagtaatactgtgtacctattgtccaagaaaatgccgctgactaagcactacctcagacccgtggagcttctatctagaggagcaagggtctgggatctgcattataaatagttctctagatgacttccatgcacattcatgtttcaaaactccagataatgaatgcttcagccaggggtggaacagatgcccctaactcctgatgccctgctctccatgacaccaaccagcaggtttccaatggtctatttcaaatggctgctccagcaggagagttgtttggagattcatactgggctttaattgtagatgttgtggatgcagattaagtggtacctcaaactgctcttccaaaaatcaatatttctgtctcttatgtgggcctgggctttgatgggaagcctcagatgtattagttcaggcggacagagagaacattctacaaggagctgggcgtatgcatggtggattcattggccatggaatcttgggaaacttgagtaactgttcagggtatcattttcctcatctgcaaagggagggtattgagttagatgatctctacagtccctttcccctagaaacttttgggtgccaagttattccaattattcgaaagagcccttgcagttgtattcaggattgtgaaagggactctgaacagcccagcacttctgacatttgtcccagcccaaccacactcatctaacccctgcctaatgccaagtggcttgccttgtgtcagaaaatcaagaacatatcccattcactttgaaaaacaaaatgcatgtgtgttgagtccatctgattccacttagatgccagtaagggatgttttggttgagcacctgataggatactcaattgttttatttgttataaaattctaacatctgtcaatgacccaaatagaatgttcctctgcctttcatctttacaccacacacacacacacacacacacaaacacacacacacacacacactttggagaacctactaaagggaatccacacttgttcctttaaggaactctcaagctagagtgtcaagcttcatgtcttaacttcaaaataaaggtggaataatatcatcctggttttcataaaggaaagggaagggctatctttatttgccagaactggcactaagcagtccctggtgttcactgccaggcagttatttaaaacaggagccagttggtgtatgatgggggtggcatggtgctagcggtagataggaggcaaagctggtgaataagcaaaggtatgactgggtgatcacattcagaaagcaggcaggattagatcattttagttacatacgccaaaaggaaggggctgaaaaagaagagtaaaatttaccactacgttaaagtttttcttaactaaacttctagaaatttgcttctcaatgttggttgagattcctttttagtccccagtacttacaacacatctatccttggcatataagatcccttcaatttagaaggaaaacatatcagctgatgaattacaaatacactcccctttcagtgtcactctatatttaaatgagtttagatgatttatatgtatgaatgtaaatataagatgcatgaggtgtgcatataagcggactacctgatttcttaagcctcacacacaaatcagtctccttactttaggtctcacttcttatgtgaaagataactgatggtatcacgtttccatgttaaaaaaaatatgaattatcaagcacttcatttgggtgcttctgtttatacattgatgcccaaaaatccatgctgggaaaaagaaaaaacgtgttgtaaatttgatgaggccacaccacctaataaggaccagccagcgttatttgttcaataaataagcaacggggttgggaaacaggcctggaccttcactttccccaacatataaatgtggtctcctttatcaaacattaccctgttgttgacagttagccggtacacagatacagggttccattaagactgtctactttcctatttcaacaggcattgtagatgtgatcaagagtctgtaaatgctacttaaaacactaactgcattatacaatagtgtaaaatgttagtcaaggaaaaatgattactaagtactagaaagggaattataatagtatatttgagggctagcagaatttttgtaacctgtatcagctaagataagagtatctattggtcattaccagaaagtacatttcccctcatcagtcctatatggtaaactactgtttaaaatgcaagagttaaaaattacacaaagatctcatagtttctatttggaatattcttagccaagtccttcagtggaattacccccaccaagctcctttctgtggaagctacattttatcaatcatgtgaagacagacctcattaattcattggatcctcttaaaaaaacacatcttcaggttgaaaggggaccatctaaagagagagagggctctctaacttctgacagttgttctttgtgatttaataatgtcaagggagggattagagaagggagggtaggaacagatctagaattttctaggaagccagtctaagcaaggctctaagaaaagtcactgaaaatgtcagcccagccaacagagaaaggctcggagagcagctaagacatggcatatacattttcatctattcaatctgaccctgggcccactgccataatcttttttaaggttagtggtgggaaggctgccacctgaatgtttgtagaggtctcctaacatcctccgctgaggaaccttaaacctcaggtactatttcagaggaaatggacagtgcaaaacagacagaaaattaactgcagcagaccttggacctaaataagttccaccagcctttctgaaatcactttaatggctggggattgggggagtggaggggtgaatggtgtgtgtatttgtgtgtgtgtgttcgtgtgtgtgtttgtgtgtgtgtgtttccccaacttgggccctggcccaagtattttaataggtacaacacagagaagagaaaaaagaaaaaaatatttaaaaggaacaatttaagcaatttaaaaattctttgcaaaaaataatataaagcaagactttaacaaaattgcagctatagcaagtctatgagggtaacttagtaaaatactctgtggatggctgcaaacctctaatggaaagttgtataagtggctgaggccaaagtaggcattaattacaatgaaaaatcagtttagagtaggccacaactaaattggaagctggtcctctaggtaaaacaaagaaagtgaacagcagcctcagatttgattacatggcaatacaagaaaaatgtgctgtatgttgtctattattaaagctgctttggggccctgtgttgcgtgcctcagggattctaataaaaacttagtaataggtctgctgccctggctcactgtggctttgtggagtatttgtgggttcagggctggtcctgcagtgcaaattaagtcatttcagacaagcagcctcagaaagtgttatgtgatagcaaagttcaaatactacaatttggctctaaaaggacacagccccccactggagtctgattcagagtttcaaagaaataataaaatttcatcagaatgaggaggagggggaaatgaaaagtaagaaaaaggaaaaaagggaagcaactagttgtttctgtgtgtctttgattactgttgccaaatactggttctggtatataaactacagaagtacctaaaatattgccagtgagtgagttaatggcagacaaggcaatggttaacctgggattttttttttttttgccttacaaatgttaactctataactctttttatattgatgtagtgatattaataatattgtctttattactaacaccactgggtccatggcataactgtatatatctgagccatgaaacattaacaaaagttcaccctgattaagaaatcaagctagtgaatctatattctttcaaagaggaaaatgtctggagacaattatgtcctataaaagagttatgtaaaggagatatttcccaactttttctaggtttgcaacagacctgatcgctggcatttgctatcagagacagtccctggtcccatccaaggaaagacaaaaatgtgatacagttcaaatcctgatgaatgctgtgcagataaaaaaaaaactgtgggtgcgtgggtaggaggtacattttcaacctggacctttgcctgaatgctgaataggcttaacaaggagacagaggaagagttggcatgtgacctataaaagaagcgtatgcctgtgtgagcacgtgtgtgtgtggtggcagggtatgctggggtggagggggtggtgtgaggcagaaagaaaattgaactttaatccaaataattcaaaaattctttgtgataggaattttttaaagtttcataaataagggaaatatcaatttatgtccatgaggaattttcctcatccaacatcaaataagacccagttttaaggcttgcctaatctgttgttggcagaggatgtggctgcataacttaattgatttcaagaggttttaggaaatctctattggccccaaacaccttcttctcctatctgattactaatacctgaaattatatgagttagagagctattcctttagtttaaagcattggctgctattaaaatgcaaattatcccggaaaatcatcttaacatgggagtgaataaagaaacagaaagcacaggaagtcatatggaggacaattggatagggagttggtctaagaagactgagaacaaacttcatcaaagccataacttctctaagggtcatctctcagagctgcaaacattctctatgaaatcaaggaagagttgccttctgctaaggacggaagcaggagaatgagaaggtgcacttcacatgggaaatcaccacagtttcagaggacggaggtcatatagacttccaaaataatcatgcctctccattcaggcccaccacgaatatctgcagcgcatttacaagttgtcaaatgctgtttgagctgctgtgaaatcagaagtggaaagatagttctctttgttatcatccccaggttcctaggggccaaagtctcatacaattttgctcttctcaagttgttgaaaagacagagtcaaaacgcacaaggagaacatgtgagaaagaaaagatcagcaacataaaaaagacagtgagagtcacagtttagctcaagtacacaaagacctggtaacactaacattcattcaaagttatcaactggaagacagtaacaggtagctttgtttcttccaggaccttggttggggtgagcataccatatttcttttctgattatattcactaaaaacctgggtggcaatgactaatgtgttgtactccagcaacaacacgagtttcaaaacaaactgtgcactatcaccttctactgataatgcattacatcatcttaaatattttcaaagtagggtacccagtttttcaggagttacataatgatcttgataaggataattcatatgtatctcttgttcaataaatagcagtctaccgagttaagattatatatatatatatatatatatatatatatatatatatatatccaggaatctcagaataaaaacctcagaatggaaaaatcacatattgagatttgaagcaatgatagactacttctgtttatacatatacttctatagactatttttaacaccctttcaaagtggagatttttccataattctttaccaacagataatcttataaaagtaaaactttccaacctgtatattttttctcagtgcttattactcctttcttgacctatgtcatctgcacaaaaacttcatgcagaggcttgactaagcccacaggcactcagtattgaaataataagtatacatattcccatattattcaatgatattttatgtggaagtcaaaatacttactgaaatttaaactgaattcattgaataaatctctagctccagatgagtatggaaagaaacatagaaatttctagtagagctgtctcctgtacagagttctaattgccaagctgtaaaatgtaagtgtttagtatgccatatgtggagggatagatatacagaattcacaagtccccagatcttcagccagtcccataaggcagggcctgtgttgaccttaaatcttagttgcaactgaatcaccattactcatgacagcacctagcacacagcaggcaataaatatttgctgaatggttgacggcgatgtcagaaaagtcttggtaacacttgctaaacacgaaaagatgtccattattagcatttaggaacctcaaagtatacataacagcaaattttttatgtcaagtttcttctttgggacaatagtcccaaagggacaagtctttggaatcaacaagtgtgtgtgtgtgtgtgtgtgtgtgtgtgtgtgtgtgtgtgtttatccttcagcttagcctttaggaataaagcccagtccctctctgcaaaacattcatcatttaacaggtgaggcagacagacagaaacccaataacaatacagtgtggtaagtgtcataatatcatagatagcattagtagaaaaaagttttatgaaagcacagtaaaggcaactttctcctcttgcttcctagggatgaggtattagagctggactgaactgaggcccagctccaagagaagttgccaacagcagtcattgggaacttttacaagctattgtagtaaaaggtttaaggggaggctatgatgcaaggaactgaagagtgaagagaaaaagagttgtgagaaggaagggatttgaagagattgggtgttcactggaggaagatgtatagcacccgaaatggagaaccaagaaagagggaatacctaacggagcaatggtctcacatgcaggatgcagtctccaggaattatccttaaagggagttgctatttcttttttcaaaccaatagagaaggcggtgtaaaaggacaaaatataaataaacttggaattaaatagaaaaggaagttaagagcactgctacctaataaacacaaaatagctacaattgaggatcgactgtgttctaagctctttgaacacatcatgtaattggattttcccaacaatcctatgaagtaaggaaggttttcaaaacaagggaaaaaaacgtttagaaagattaagtcaactagccagggtcacgcagatggtaagtggtagggccaaagttctaatttagcaaactccagcgtctatgagcccatcattcatgaccttacttttctttataaaagtagggtggcaggttgttcactaaaagaaaggagactaagaccaagttggtagtttttagcaagtgataatatattagaaggaataaaaatgggttaacttgccattaaaaaggcattttcagcagctttaaaagttcagctgaggttggaaatcacacatttgaatcaatcactgaagtcacaaaattttcttcagcagtggcaaaaggggagaaaagtatttgggctgacccggacttggaagggaataaagtcaataataagctgaaggttgagatagtatgtagttgaaatgattgactgctgtgtccaggtcaaatgagagaccgtgattataaaagggaagataaggaggggtacaaagatcttgatggaggtgaactgacatgaaggcatgggagggatgaactatagatgatacctaggaagaaaaaattcagagttataggttaaagagattaaatagtaatgtgataatctaagccatacagttgagttgctaaaggactgaaggtgagagataatgaaaaaaaagaacacacaggaaacattgctaagatgttgttacattatcaaactggggtttggatattcctcagaaaatagaaggagaggccaggtgcagtggcttacgcctgtaatcccagcactttgggaggctgaggcaggcaaatcatgaggttaagatcgaaatcatcctggccaacatggtgaaaccccatctctactaaaacaacaacaacaacaacaaaaaaaaaacccacagaaactagctgggcatggtggcacatgctggtagtcccagctatttgggaggctgaggcaggagaatcacttgaacctgggaggtggagtttgcagtgagcagagatctcgccactgcactccagcctggcgacagagcaagactccatctcaaaaagaaaaaaagaaagaaagaaagaaagaaaatagaaggagactggttagacagaaagacctaaatggaacagaatcctaaaggaaattggagacattacttgaaaatgagtaaggacccacgggagagatagatagatgaatggatggatggtgaatggatgcatgaatagatggatgatgaatggtgaatgatgaatggatgagagatggaaaatggtcatgtacttcagagaagactgttaaagataatgtgcactgtcttaaaatagcaaaacgaatagactaattatgccaccatttgtttcacctaaaggtatgccactttcctcaaagagaataacaggttggagacaaccaaaatttaaaagtaagctacataaaaacaatagcaccaaaacatgagtagtggttctctttgcatgatggtattatgtgatttttgtgtgatttttatttttccctttgtattttcttacactttccaaatgttccgtaatcaacacatacaactttcagaatgtgaaaagttaatgttttgagaaaaaataccacactacagacataaaagacactagaaatctaaacatgctgtgggccatggtggaaggcctggaaatttttcatattttaagttgtatacacacttttaggcatacatattttttctgtatatgtatgtgtgtgtatgtgtatatgtgtaggcatgtgtgtgtacttaggctttaaacatgggtatagaggacactaacacatacatgctaccccccaggaagaaagtcaacattaagtaattctatttactataacagcaacaatttcaccctgaaaacctgagctaaatgtcaagatttctccctcagattctgtgggtggtcagcttttattaaagaataaatatatcaatattgcttgatgatggtaataaataaccagacctatagaggtcttctgagtgtaaccattctgtttgcttctcttttgatccaagcactagcattgggacctcgtttttttctatccactgtagggggtcccagactgtggcgcccattccactgactttccgcatactgctgtttggaaaggcgtgctcagggacatgagggcataaaggattcagacacagaatgaagcctctccttatggaaacaattatgtggcagattccacttggttttaagaagcaggctgtagaagggaaaaggaaatccccctttatttgcaggagggtccctgaaaatgtagcctgggaatattgttctacccagctcaagatgctctggcccacagtgggagccttgattggttctactttcagatctttaaagaagagatagtactgtttcttccacaaagattcttctgcatgtgctagtatcaataaacactttgatcaaggcatgctttctaagtcaatagttggcatcatgcatatgatcttaagccaaaggaaatgattctgacagtaatacatttgagagccgaaaacatggacaaggaaccaaacacaaacccaaactttgggaaacttaggatcagcattaaacatgccgcagcacatcacccaaaccaccacgctctaatatgtcagccaacagaaaataagcacttgttttttaatctttccaaggctgttctcataaggttttctaggactatttcttccaaagttacacaaaaggaggaaaaaaactgaaataacaacttcacaggaaagccacgtttagaggcattttctagtcttgcccatctacccttccacacagaaaaaaacctcagagacaaactcaggaaaaaaaaaaatctttccaaaagcactctaattattttttcctgcatcaccatcattcagttgaaccaaagcttctgtgtttattactgtcccaactactactaatgaacaaaaaagggcttacattccatgaatctgagattttttacctttttcaaatgtatcctaaagccctccttagtcaatatttccacaaaccaacagtagtaattaatccaggttttacttaagctaacaaatgattccccttcatgatagccgtgtaagctgattcatgaatttgctaatgttctccaggttgctgacagagcccactgttacacagtaaagggggaaatcatgagtgatattaagactctcctccctacttgttaaagtaaaagcaagaatttcagcagttctgagggcctcgtctgtaccacaaaagttttgcctctgctggccactccagatcttgtgctgatcttctcatcctagaggtctcactgcctctgtgtcctgaagcagacataccctaggccttctgagataaacacacaatctcctgcctgctctacatcaggcagtctgaaggcagagaggacctgcagatacttgaaagaaacagctcatctgctttgggaaccagggaaattcatgccacacttccaggatcactggtctcaggaggatttaactcaagcttggagtaagagttgacatccacaatgtcatcatcatctaattctgtttcctctttccctgccttcctttgtcctagaagcattctgtgatgactaacaaactgatttattctgattaaaaatagtagctatcattattcaaatgctccctctcaatttcttctataatcttaagatactgatagacagagataaagacatagcgagagagagacagagataaattactgacttgagccttggcctgggaattaagacttggcagctaaactgccactgtttgccctgccatattgaaagatctgcccatctaaaaagccatggggtaaaatagacattgctaaggctatcgctgaggtatggtagtcctaggaaaccttatgagaacagctctgggaggaaaaaaatgtttcttttctatgggctgacacattaaagaagggtgtggggtgacgtgctgtgacatgttgaatgcagatcctaaatttcacaaagtttgggtgtgtgtttcattccttgtccatgttttcagttcccaaatgtattactgtgagaatcatttcctttggtctaaggcagacattagaacctgatccattattttctaactttctagctctaatgctcgatgttctgagtgtggagaaaaagcagaatatcctaaagaagttgctttgatggttgtgatttcatgataattgaggtagttgatgttggcagaaggaaaagggacactagcaaaattgaaattaaaaatcagtgccaaaatgctttgggttacatagggaaaaaacaagctaaactaaaccaaaaaccctcttactattctactatgctttttttggccccacccctactctagagaaaggagcctatgtaaatgcaaccaacataagttgaagaaagcaaggcagcataataggtcttgctgtgtagcaatctagtgatctgcattcttattctagatttgtttacgaaggcaggttttgtttttccttctgaataccttccagtattttattttatttatttattttcagacagagttttgctcttgttgcccagtctggagttcaatggcatgatctcggttcactgcaacctctgcctcctgggttcaagtgattctcctacctcagcctcccaagtagctgggattataggcatgtgccaccacgcccagctaattttgtatttttagtagagatggggtttctccatgttggtcaggctggtctcaaactcctgacctcaggtgatctacctgctgcggcctcccaaagtgctgggattacacgcgtgagccaccgcgcctggcctgttttgtttttaatcattactattgacctccattttcctcagctttaaaattcattaaatctagccgggtgtggtggcttatgcctgtaatcccagcactttgggagactgaggcgggtgaatcacctgaggttaggagttccagaccagcctgaccaacatggtgaaaccctgtctgtactaaaaactacaaaaattagctgggcatggtggcatgtacctgtagttccagctactcaggaggctgaggcacaagaatcgcttgaacccaggagtcagaggttgcagtgagccaaaattgcaccactgtactccagcctgggcaacagagcaagattccgtcaaaaaaaaaaaaaaaaaaaaggattaaatcaacagttatgccacaaatatttattgagcaatttctatattccagattctattccaggtacgtatgggcacatcagtgtaaacaaagaaaaaaacaaaaacaacaaagaaacttaccctcttaaagcttacaagacaaataaacagcaaaaataataactaaaataaaatgtaagttacacagtatgcccaataagttttattgaaaaaactaaaaaatacaccgggggaagggggatccatgttgttgaggatgggggcaggctgcagtgttaaataaataaatctcaatgaagaacccaagttctgaaaaatgacctggcagtgagggagttgaatgcactgatatgggagcactcttgttacgtgtttatgaaaaattaggggagcactatggctggaacagaaggatcaagggaagaaaaagtaggagataaagtcagaaagcctcatggcctttgtaacaagctttcaacatgactgacttacagtttagaaggacagatctcgctgctgagttagggataggtcaacagaggacaggagatttgttaaactgctactggaataatggaggcaaaagatgatagtgactcaggccaaggtatcagtggaggttagatatgtgattagattttaaatgcattttgaaggtagaggtagtagtattttctaacagatcagaagtgataagaaaaagagaagagacaagaaactgatctaagcattggaaagttgcggttgtcatccactgagattggaaaaacagtgactggagccaagttttacggggcaaaccaggaggtccattctggatatgctgagtttgagatgcctattagatatgcaagtgtaggggtctgtggacagttggtggtaagcatttaaagttccagagaaagaggtccagtctagagagataaaataagaaataatatggtttcaactgtttttttttttttgctttaccattcgtaacagattggaaaatctatatctataattagtatgttcatatcccaatttctttatgttaagactatttgaaaagaaagagagaacaaaaaaaaaaaaagaaggaaggcagttgggaggaaggcaataagaaagtgaaagggatcaattgattattaggagatttgcaacctaacagtgtattatatccctaggctcaggctgcttccgatagagggcacactcctgaagggctttcagtcaaatcttaaaaactcttaattttgtttccccactgatacacgtcttttaatgttcttaagtcattcctggtagatcttccactagaaatggctcataaccttttaacttgaagtttatctacctccaacctttcaaataattaaatatttaaatgctctgggaagctggcttttgtgaagcaagaaccttttgcaatgcaaattttcactcttaatttctctgctgggtaaaataagagttacagggattgggttttcttctgatgtgtgtaaaatggaatacatttctccatcttctgggttctgggatgtccactcagtgtcagaaggcacctctcacagaacaatcacaagacagacaggaaaagaggacataatgggaaaagacaaaccaatcttaatcgactctggtttatcttccaaggtgccgactggtacttttctttaatatcaactgccctgtgtggaactggaacaagcctggaccgccagcagcctccaaagttgggcaggctggtgcttacaggtgaaccactgggcaccagaatttttcgtgccagtttccatccctgatgagcctctcatcacctgtccagcaagaagcaagaaaagcaggagtgcaattcactaaacccagagccctggccctgccagtgaccccctacctgtgggaaatcagtgtgtttacatctgttagaggaagggttaatctaggttctgtatttgcatccacctttagcttctgttttgtatatttcttacacactactgtcccataatttttcttccataaattattctaaggcaagcaaatgtttccctaataccctcttcatttactaagagaaaatgagagaactttttgccccctgaatttcattttaaggacataaatacgtgcatttgagcaagtgtggacaaagaagaagaaaagagggacagggctgaggcggggaggactgcagtaccaggattcaacagagccttgtctctgctgtcttcatctgcattaaattggtcacgaccttccaggtgtctttaaggttgaagtgtttgctggaccatttcgagcagagcccgctggtccacatggcccttctgacatcaagagacagcttttaaaagaacagaagcaccttgtcagggctcaggggtcactaatagcctgccttgggccctccaataggtcatgttcggcttcctcgtccaacacaaagggaaaggcgagggaggctggggagggtagggggataattatcattctggtgtttttttcctcaggcctggagttatgctccatgtcactgtgttaatgtgcctgcaaccagggagacacataatgctcctctcagccctgtttattagcaagatccatttgcaaaaggcccttcttttgtgccacaatatgaatgtgctttgatggcaaataattacggcagtccttttgacatgaagatccacaggctgccctagttaagccagtaattagcctgtcctcctttttttattattattattgagaaactacaaattatcctcatgtgcgccggccattgctttttctcctattctctcactctcttctgctcactctctcccgctcactcgtgagctcgctcttttctctctccctctccctcgtctccctcagcactttggataagtggaatgcagctgcacaaaagcaagataaagctggaccatcaagatgatgaacaatctggatgaagagccttcgagacgcacacaaaagctggagaagtgcagttgatgtaggcctggacagctgaagaatgctgcggtctaacgatgaatagccctcatttgtgaatatacagattttccacgatgaataaaaactgagtggaggtcacaataaataaactttttccccccttcttcttaaataataattcaggttcccggcaccaaacagctgtaaattgaaggttgtgcttagttttctcaactctcaaaggggataattaagctaagatcacattgtttgatatattagtgtaatgatgagctcctatattctgcttgtttcgagttattttagtttttctttcccattatctgtttttttaattacatttcaaatacattttaaatgtaggaacagcagttctgaaacagagtttgccctatgtttggatctatttgaaatgtattcatataacatttaattaaagcagcaacattcccctttagaaaatgtgtggaggtagaaatatctatattatctgactagttctgacataatcttgccaaaaggctgactctttttccttattggtgcaagataattagaccatcattaacctcctgaagcatcactgtcagtatttcttggcgttataaatcaggatttgggaagattttcataattttgcttaagatcactgagaaggtaaagatcagttcccaaacatgcttggcttagaagatttctgaaaatcagagtctgtgagtatacatgttataaaggaactcagcccaagggaaaagctacagtgtccctttgcacctataacaccccctcccatttgtgaagtcttgacaataaaaaggcctaaatacagtcttgcattttattaacgtaagttagattgtcattttcttccaataatttttgagctaaaaatgcactgaaaagtctgactttctgtatcaaaagagagagaaagtatatttctagaaaaattttccccctaattttttggtaaccataaaatattcttcatttccaaaacaactatttattgtcaagtgtttagtatactgtttgttcatttgattgcttattttttccaggaatttttctattttcacctattagtccaagtctagagtagaccctaccatatccacattcaggaaggttttcagatttaaaccaggtatggaaaacaatttatgagaaggaacactgagaagtatgaaaaagcatgaagaacccaccgttaacttcattgcgatctaagtttcaccaaagaataacttcctaaagtttccaaccctggagaccttgaattcaagaacaacaattactctgatttgattattacacattgtatgcttctatcaaaatatcacatgtaccccataactatttacaatgaataatggtatccataataatttaaaagaaaataaaaaggaacaaccaacccattgcatgatgaggaaccatccttatctatgactccagtctattcagaggaaccctactgaaaagcaagcaactaaatgtcctatctctatgttcaacatgagagagcaagggtaacaaaagacaaaaacaaacaaaaaagtctgaagtagttgaagacaaaggataaggaaatcctaggaggagtctgagtccacttacaaattgcacctaaggaagagtcctcagactcatgaagttcatttcggctttgctgcattaataaaccagccagaggcaaagagaaattaggcaatgggcctcagaaaaggcaatcactgccacctcggtttgctgccacgttggagatggttaacagaccaccacatccatttagaaatattacacaggtttagaccaaagaaagcttggtttaggagttcacatgggtcaaatgtgaaatagcttaacaaacttttaagatctagaagcaggccagatctggtataaagtgcaggcctgtctaaaaactctgacagctctttaatatttcactcacatacctttctccctgagatgtattaattacacccacagtttattgaatgcctcctatatcctaggcactttttcagactgtggaatctagaagagaaacagaacaggtcaaattcctgctttcatggaacttacatttcaggagcaggagatagacagtaaacaaaaaatgaataaaatacagcataccaggtagtgataaatgctacaaaggaacataaggcaggaggatgtggaggaaggaagcagttgtattttacatgggctggtcagggaaggactacgcaataaggtgacatttggctcagagacctgaagtgaaggaggtagccatgcaaaagctatgcaacttttgaggagagaattttccaggtaaaatgagcccgaggtcaaaggccctgaggccaggatatgattggcacatgccccattagtaagaaagaggctgagatcgaggaagactgagcaaggagcgaaggggaaagatgagtaagagaacagatggggagctattcttaccaccaagctgaaagaaaccctggtcatttactcactctggactattaaatactttgccttgtctgtctttcatgcctctaataaagtttagacatatgaggtactgaaaggaatattctaaggtgatgaaggcctgacggactcactgtagtttcataccatgaaagagtgggtgttgacttcaagaaatatggcacaattaaaaatgcctattgcaaacacaacattcctctcccactgaaaaaacaggcagaagatttgaaaaggcaccacaaaagaggatatatgaatgaaaaagaaacacatgaaaaatagtttaacatcattagccattaggaaaatgcaaattcaaaactatgagatactactacatacctatcagagttgttcacattaaaagaaaattgacaatacaaaatgcttacacagatggggagcaactggaactctcatacattcctggtgggaatgcaacatggtgaaattgctttgaagcataacttcacagtttcttataaaaagttaaatgtacacttaacaatatgacccagcagttgcacacccaagggaatcacacacccatgtatccatatgtgaacacccacaaacttgtacacaaatatttaaaacacctccatttataattgccaaaagtcagaaaccacccaaatgtcctttaagtggtggcaaatggatatacaaatcacaatacattcatacaatgccatacacctgggcaaaaaaaagaatgacctgtgttatacaaaacaatacataggagagtcagtatcattttgctgggtgaaaggagccagactcaaaaggacacatactgtcgattccatactgtgtgattccatttatatgacttgttcaaaaaggcaaaattacagggttagtaatcagaccagtggcttccaggggctaggggtgaaggcagggaaactgacaataaagggaaatgagacaacttttggggatgatggaaatattcacatcttaattgtggtgtaggttacacatcacataagtttataaaaattcagagaactgcatagctgaaaagggtgaattttactgtatgtaaattatatcttcaaaaaatgcctactgcaatattgatacattctcaggtaagagaggaaatctaaagactacatatttttaaaaattaattttagcactcatcatcttccctactgaagaaattgttaatttgttaagtagactatcttcaccaataatctcttactgttgtatggaaaaatgtttctgtagggctgagggcagagaagagacccgagattcaggccctggggagtaggaccctacatttcggaactatctctgctctatttgtgtctcccattttgccaaaatagacatctgggtaagtcagaactctccactccctccccaacacagtctctctctcctgataaagtttttatgtttgggacagtatagaagcctagaaaatacacacaatctctttgctctggttttcctctatagttacccaacaggtcaaagactcagaatcaatccagatacttagtaggcacctattatttgaaatatacttaaatacagaagcaaatatagtgcctactcttaaaaactgagaattcaattaggtaaaggaaatacgcatataaaaagataaactacaaatgtaaggcagtatacagaaagtgtcacttaattagtataggcaatttgttgctgttcaaaaaagaagggttccttctaagaagataattattcttattaccatttattgaaagtctattacctgccaagcctttgcatgcatcatcccatataattttcctaacaactctgagactcaagttttttactcatttacagtggagcaaatggaacctcagaagaaatgagtaacttgctcctggtccgtcccttagccactgagccaggatgtcaactcttgattgcaaagccttttggttttccactattctcaactgagttggttgaggaaaagtcatgaaagtgatagcatttcagctagaatttacagggtataggattctacagagccaacaataagaacaggtgtgatggaaaacctaagaatgattaagggggaaatgaaagcaacagaaatacaatgtctattttgcaaatattgttagattgcatccagtatgtcttagctcccaaatattttatgataagtttagtgagtaaacagctccctcctgtttttttatatctagcctctaaatcaggtcaaaacatctcagaaatagagacctctcctgctgaaatgaattttccatgttaggaattttcttccgggaggtgatgatggggaattcattcaagttggcttaggtgtgttattccctactatgaacctctcagcttgctctcagaagacagagaaatgcaataagacccaccacaaactacaaataaaaatacccatatcttttatccctgagttatagctttaagattagacatttaaaatcagaattatctaatgcaacctagggccttttcttggaggttcacacttttgttttgcacaaagagaagggctttctcttatacacccatgccccacacccatctcaatcttctgatgttcacataacattgaggtaggccatgaaaaatttcgaagcaggcatacattgtagcccaagagaaaaataatttttaaaatgtacactttgggccaatcatgaaaaatttcaacttatttaaccaagtagttaaagtttcctaaggctctagatatcagtattcttttaaatttttttaaataaatggccagatagtaaacatcttcaactctgcaaaccataactgagttgtagcacaaaagcaatacttaaatgaatgggtgtggctgtgttccagtaaaactttatttataaaagcaggtatctcctgctctaggctgagtagctattcttggagctcatgggctatgtaggtgaacaagcaggacctcagaaattctaagagttgcaatccacgcaaggatattactgacagttttagctcacagactacccatgctgcctactcattcttatctaccatgtcctccactcccagtttagtctctttacttgacccgcatttaaactgctcatggatttccattagcagttatggcaaaggcagtggatttattaactctttttcttcactcaatatcctcatttataacaaggtgtgtgctggagaacacagagcaagatcaataaccagaatgaaatggggagatgcacaatgttgcttactcaattctctttattctccctccttcatttatgatcatttgtttgtcttatctccctctccccttcgctttcctgatctctttttctctccctctccctctctctcctccacactctgattttcattttgctgggacccaaaacaacatatgatcccttggccccatattaaatacatggttcagttgattactgccaggttaaggcagaattcctttccaagcactagaaataggcaggaaagaaagacttaaatcttcaaagaaggctttcctctccattcagactccaagactcacaaaagacatcgtcaatcagcaactggttttaaaattctcttaaaagtgttttactagttcactttacttggcatttttatcactatttatatctgtaaagtagtgatataattagtaaagctattaatgtttcttatgcttagtattacgaattctacaaatctcaataaatctagcttatagcaaaataaataatgatgataacactgtcaagcatcaatataattgctggatggctttgtgtaaaccaaacaatattagccctcttaaacaacttaatctgggctacttaaccaccctccctgtaaactgttcatgctgcccaaaaggaaaccatgaataaggactccataattccccttattttgcacggcacaggacagcagaggaggaccaagccttctgattggtcctcaacatattgcttcaatagaatgagattcattttattaggtcagaataaacataatgaatttctatatctgtgctattgctaaaactaaggtaattgaagtccctggacactcagttatggatacatctggacactcactgggcttttgaaattttccactccaacaaacgaaggattcattctgaccaacatagaaccctagttttcagcagggtttgcctaaataaaagcctaacaatctggggtcagagcccttttcttaggatgaggaaaactccattagtttcactatctggttcaaactccactacctacctacacacagaagcagggaacgtaatcttatctacaagcttttcctagcattcctgttttcagtaaccagaaaggattaaaatgaacagcctgtgcactggtcctgagtaatgggccttcaaaaaccaaagtattagacaaatatatcagctatgagatataataccaagggctagttccacagtatcagcatttttaactttcattcggaagtggctggatgataagagggtacaattcgtattttgaattcagagtgagaagatctttttaataaaacagttttactatgtagctatatatcgtttcctaccaaaatgcaaaacaaagcctggatcttttatttttttttcctctccaaaacatccataatgatagatttcctttgtatttttttatcccttgaatgaatttttcaagccaaactttcattgctgctgttgttgttgatggcgccaaaaggtttcagggaatctttcttcgcgcagaaagcagcttgcagacccagacagagacggaaaggaagttgttttggtgaataatgagagctgagccagagcctcccatggtggcatgtgtgaggccagatgaataggacagcactttgtgtgttcaaaaggcagtctctttttctattatccttggcctgttgcgctggcctgctaatgagtggacacgcattaccattcattagcatttttatggcactttatatttgcagtgcacattacaaattgtatttgttaacctcacaacattccttgtgagatcatcaccatcgattcacttttacagagcagcctatgttcaaggggccatgagtgtatgcgcaaaattaagaacgggaaaatgacacagagttttggatccaattctaacaaggacatcaagggatacttaggtggaggaggatattcttgatggcaactccagctccccatggtttcgcttatttgtcttttttatctattgcctgcaagttaattcaaacccccttgaacttcaccgttgttgaacttactacatgataaacaagactcatacctgttttatttacttgtaaaatatttttttcttattttcttagaactggttcttttacatttcaacacgcagccagtctttctatcaagcatgatgaagagcatatgtttactttccataatcttatgcattttctagattatatcctctctctggtttggtctttctagaatcaagtctttctaaaacactataatctgtgcattttgcccccttgttagctttagtcacctttcctaagttttcttctacacctactgtattgagaatgtgcatttcaggtttgggcacaacattttttgaagtctatcattattcctccaagttcccagtgatggagagacaaggcccagcaggtgaaaaacaatagtggtcaaggccaaagctaaattaatggtggagctctgggtgaatcttcatcagttggacaatctcattgacctaaaaggaaatgtccaatttctaaaaactgtcagacagtaactatgagacaagagtttgcttgtctcaaacttcttcattaaaggaactgtggagatagatggaggacggagcacagggagagggccaggcagagacagcccaggaacgcccttgcaaatgtgtgacaccctcacagagctgccagacctcccggtagaggtgcacacaggcacagcgttcagagctgccaatctcatctaaatggcctgcgcagattcaggaagattccctaaatcacagcaccatttgtcaaaagcctactacacactttttttttttttttcattttgaaataatttcagatttcaaaatgtaataaaactggcacaaagaattcatatgtacccttcacccagattcataaactattaacattcttcttattgaaacaagattataatagaatctaaagggcctattttcaaattttgccaattttcctgttaaagtcccctttttttctgatctggtttccaatcctgaattggaatttgcatttagactgtttctcagtctttcttttatctcttacgaccttgatattttcgaagagtacaggtcagtggttttaaaaatgtcccccaatttgggtttgtctgatgtttccttatgattaaattcaggttatgcgttttagctagaacattacaatgtgttattgtgtccttctcagtgcatcatatcaggaggtatgtaattgagatttgcccatcattagtgataatttgatcacttaacaaaggtggtatttgtcagttttctctactgtaaaatttctatttttttcatttgtaatttatatgtgccttagggagatactttgagactatataaatatcttattcttcatcattctttcacatactaattttagcaacctttgcagattttttatatgccagcattttgctaagcatttttcctgtgttattttaattttcatatcttccctgtatgttataattactagcgtcattttatcatcgaggaatctaaggttcatcagagtgattaagcaacttgacctggacatatagatactgtgataagagccaggatttgaacctaaatcttattctattactcttacaaatgagagaggaggcatttcagcatctaatatctccattacatatggcccctgggctattctattctgctaccatgggtgtatcactacttagaagtatacaagtgcaatatcagtgacacaattattgacgtgccaaaccaagatagaaagtggggaggatgttgtaaagagaacacagggaagctatgctcatgcttaactggaattgacacacttatcatttctttcttttttttatgtcttccttttttctttctaattttttgttgttattgttttaatttgagcataaccctttaatcagcatggtgcaaagcaagttaataaaaatcgcccaactcctgggagtttaacatttaaattaatcaagtcatggccaggcttggtgactcggtcctgtaatcccagcactttggaaggctgaggcgagcagatcacttgaggtcaggagttcaagcccagcctggccaacatggcaaaaccccatctctagtaaaaatacaaaaattagccaggcgtcgtggcaggcgcctgtaatcccagctactcgggaggctgaagcacaagaattgcttgaacccgggaggcggaggttgcagtgagctgagattgtgccactgcataccagcctgaatgacaaagactccatctcaaaaataaatacatcaatttaaaaaaaaattaggccaggtgcgagggctcatgcctgtaatcccagcactttgggaggccaaggcaggtggatcacctgagtcaggagctcaagaccagcctggccaacatggtgaaaccctgtctctactaaaaatacaaaaaaaaaaaaaaaaaaaaatcgctgggcatggtggcatgtgcctataagtaatcccagctactcgggaggctggggcaggagagtcgcttagaacccacgaggcagaggttgcagtgagccgagattgtgccattgcactgcagcctgggtgacagagactccatctcaaaaaaataaaataaaacaaaaataaaaataattaatcaaggccaatgagttatgacataaagtctgtctgcagctaaactggcagacaaaccccaagaaggagttaatgtcccgaggcccagtggataaacaaagtcttaagagagattttggtcattgtatgtttaaccaaagtgaggtcatgagaaaattatcttcttattaaacaatttcagtttacactattttattgagttcataagttctgtaagagcagagaccttgcctagcttgtccatcagtgtattcctcaaacctagtacaatgcctgactcacaggcttaaatatttgttgaattgaatgttctggtaaaatgtttcaaagtgtgttataaagcagaatatgtggtgacagtgagggttctggggaagctaggagggtttgagtagtgagtcaacttgaatatatttctaagaataggtacattgggcctaggaccaataaacatttcatcttgctttgattctgtacattcccatgtctctggtcttcaagagaaaaatctagccatggtgacaaatcctgttgttgcgattttgttaatttacctatactgcttatgagccaccagcactaacatagaaaccagtacctcacttccctgaaatatttccattgccaccccctagcccccttattaggctcttccacttataagttacagaacttaagtcagcagagaaaaaagaaattattaacccacataattggctttaagacacagctagatacagaagttcaaatgatgtcaccaaatgatgtctctttctcttgccatctcttagctccgcttatctctattcagttcaaactgggtctcctcacaccaggtaggaaagctgttaacactctctccctcacacacttccagcctggcaagcccctgaaaaacaacaagtcttccctatagctctgttgagaaagtcttaggaggactatgattggccagattgggtcaggtgcccatccttggaccaatcaatatggccaaaatggtgaaatattctgactggctacatcctggtcacatgcccagccctgtggtgaagtcaatccaggtgaatcaatcatatggaatggattatccacaggaaaaggaattttgttgccagaagtgaatgagaagtaatcatcaacagtcaaaagtaccagatgtccattagagcctacatatcacattagcagagaatctagtgctcctgctctcatgagagagccctgtcctggcaccacaaatactttcttctccgaccttcagtggtgttaaatccccagtcaggtactgccctactcagctctataataactggacgtggtgtttctaataagaagacgagctcctggaagacagaaatctttcttgtcctagacagccctccttagagcctggcaaggacacacagcaggctccacaatgactgctaaaattatgaaccagaaccttctgtatcaagtcaactcatctcaggcctccttgttgaccgtctatgtgaactttaatccaatttaggcttcttcacatagtggagacctgaactcaaaacagcatggcaggcaagagcttatttttgtttgggattcccaaaaaagagatttgtgtgggtacttcagaccaagattatgcctgacccctaaaagtccttctttcacaagttagtgaagactttacaaatgagaaagtttaggagaaatttcaaatgcgattttagcccctgccactgacagaagaggaactgtcatgtgagaagtgaaaaaaaagagagaaaaagccttcagtcctgtaattctggccccactcctgctttctgctgtagaagttggctttcatgggcccgttgaccttgtgctcggagactggtcacgtggagctcaagttatcagacatcacttgcctgggtacatgcttatgacttttgtctgtgtttctattacacaaatgccaccaattctgtctttgcaagattgaattgaagattgagctgcctgaaaactcgaagagtggagcctcgccttcccctctgctccagcggagacccggtgctggtctccagcacatccctaactgcgtatggttcccacaagcagatctggaggagatttatgtttatccacgttctcatgcccgctgaccttctgaatcaaaggtggagttataaaccaaagaaatttactgcaagactctagtacgcgcttgtgaagctgatgcatttcgctcctttttaataaggttaaaaatagttacaaatggaacattggaataagggcttgaaagagctctgtggtgcatctgtgacttaggcctggccaacattttacagccctgcctattaaaaatctcagaccgcagtcgctcctgctcctcatcctcaccaggcacactaacaatgctgcctgtggaccacttgacattttcatccctggcgtctgtgtcccagaaaaattgatggggccaggcagcctctgcttacaattaggggagaccactcaaactacctgttgacttgctgcacattaaggacagccagctgatataaaaaagctttggcaaaagaggaaagcaaaactttacctagggtccaattttgagatggccagaaaaaaacccactgaaggggcaagtccatatgactgctaccatcctcatttttggccaaatggagggagaaaagcaaattaaacccataaagcctaagatcaggaaggagaaactgagttaggataagaccccattcttcaatgctctgccccagtcagagtcatactccatctacctactgagcaaccctgtgcacttctaagtagaaagcagcagcaaaagctccatgcctcctgctgcaacctaaacggtgatgtgattataaaacctcagatcaaaggatcgaaaggatcctggccaaatgccagggagagtcatggctcctgatagaactaaatcaggtccaatctggatctgagaataataaagcaattaaccacgaagtgacagaagctgaatttcacagtaaaagcagtgctaaccagccatttagcatcatgagaacaagacccctttcttcagccacctgcggtcaccaccccaccccctactctgtaactccctccccgcttgcaactcgttgaaagggaaagattaagcccaggcctgcactaacaggcagacaggggtgggggcaatggacagacccctcattcagaggcctccagaggacactttgacttggctcagaaaaaaagagctcactaactactcagaacttttcaaaacaaggctctgactacttagttaattggcagagatgaaaggcaaggatgcaatgagaaatggtggtgttatcaaaaatgaaggagaaaaaatctgaatagtaatttcagcctccatcactaaagaatctcagaagacattaaaaactgggtttttgaaaaccacatttaaactcaccagtctatgttgatataaccttgaaggttgggccatccttgcttgctttatcctagagtcatacacaggcatgcacacagacacacagagtattgctaaaatattttaggagtgggccctggctttcccacctgctttggccaggcagtagaacacatagtctgtaggaccacttattgataagaactaccttcatgactagctacaatgggcagattgaagatggaattttagaattatagaacttgtttttgagtcctttgatcaattggtttacacacgaaggtttgttttcatcatttctttcccgggagaatcctaaaagaggagatgataaaatataaaagaaaaagaatgaaagaaagagcaattatctaaagatagttctaggcagatatgtagtacacctgcatatgtatatgtaatataataataagaatatttggttctagataattgctatattattgatacctttcaacactcaacatgtttatatcacctgccaaggtcctgtgaagcagaattcactggtttcttgaaggaaaaaaagaaagaaatcccctccactctcctttttagagagaactacatatacaaatctatttgaaaaggttagagaaacaagataaattgggtaacccatgtactaactcttgaggacaggagcagcatgcaaagggaagccaagctttaattcagtagattccctttctgagctgcatttgcagcactgtgatccagtctttggtcactccacatgtaatccaattctctccacagcatggaagagccaaggtctcctgcagtttgggatgatgactcttacttgagccaacatttgctttatcaaggaaaacaaattttaaaaactgggaacaggctattaacccaaaaggttcatcagttagattaaataaaagccccaaatgaagaaattatctctcctttctaatcaatatcactgagcataaatggagtcaagctgatgtacttaaaaatttcccatccatgaaaagaaaaatatgtacatgcatgtacacacgcatgcatacacatttaacctgttgtttttatgactgtattttaaagcactgagaataggggtttataatggaaatattgacagacccccaactagagcagagttagcaggcaccaccacaataatcatttaagctattttctttttctttttttttttttttaaagaaatgatcagcagcccaaccaaagagaacagagtaaacatggctggcatcttaatgacctttgagcattagcagatggcctttttatgatcacagattagcagtacatggttgtttgttaatgtctgataacaggtgccagttgtcccttacacttctttttgtgtttgttcctttaccttttcagagtaggcaacagggttcatttctcagtgaatctgctttctctatgccatcttttgtttttcttttggctgcaacacagccctcatcccccacccccacccaaaagagaatgcaaccccttcagtctctctctctctctttctctcctctctcttccatctccctctccctctcccattgtctctctctagaaacactcgcctctgaatcccactgcctaattcttgtagtttttggaaccatatgactccagtagcaaagtaaaggccactataaaccaggcttactttacaggaggatgtctggtaccatccatgtaaatgacaaaaaatcacagccgtggattcatccaaagtgaattaaatgaatcagccagaactggtgaagccataccaacccttcccttctgccatttacagcatccaatccatgtcacctgaaagaacatgtcttcctctgcaagctcctcaccttcaggaccactttcctctttctgctcacctctcaccttctagttctttcttccccaagaagaaaatcagttgagtggagctagtgtccagtttatgtaagtgatttttccacccattcttgggtaaatattcccttggcctagtttattccattactggagcaattcaggagggcaccaggatacagagtaattaccaaattggtttctctgtgttcatctctgtgggtagggaaagaaaactcttagaattaacctcagatgctgactgcctccaggtccctggggctgcaatctccagtgaagccaatgaagcctacctgaaagttggagcagaagcagatctcacaacactcacagaacatgtgaac

SEQ ID NO: 515 - DNA, 41648 bp, Homo sapiens
tctttcttattttatctatttttttttttaagactagagatggggtcttgctgtgttgcccaggctggtctcaaactcctgggctcaagcaatcctcccacctcagcctcccaaactgctaggatcccaggcatgagccaccatgcctggccgaaataaagcatttctaatacagccaaagaatcttgcagacccatgttgatttcattcccctttcttccttagagaggtaatcaatatcctaaagttggtatttattatattctcatatttttaataaatgtatccccaaacaatacgtaatattgctttgcatgcaactttatatacatggcatcatagtgtgttttcttatgcagcttgatttttatgtcaaatgtgttctgaaaatcattcttgttgatgtatatggcaactatatattaccctatcgtatgaatatgtcctactttattctgctgacacacatttaggttgttaccagtttggggctattacaaaccatatggccatgaacatatttgtacctgtctcattgtgaatttctgcaagggtttctctagagttaattcccaagagtggaacttctggtaccttggataaatagcttctccagagagttcaaaccattctttagagagactgggccaatcaaaattcaactggtgatgcatagaattcttggtgatgctggtattcttagatttttgccaatataatgaatgtgaaataatattttattgtgataaaaacttttattttctggatcactatggagttgagtatcttttcctgtgtttacagatcattcctgtttcttctgtgaattgcctgttcatctctttgcccacttttctgttggattgatggtctttctcttgtcgttttgtagaaattctttgtattgtttggagtactacccctttgtagttatatgtgttgcaaatatcttctcccattgtatggtttgtcttttcatgaacatacattgtcttttgatgaagagtctattgaggcaggaatatcatcttatcccaaggcaggaattgggcagaaattcagttccatgatccacctaggattatgtttcaaggctcaactggtgagaatagttaaggagtgtaactggcactggacctcagtgttggaaagtaatggggcatggtgtgcactgtagcaagctggagagcgttgggaacaggtgcttggtgtcgcaaaaatcaacactgagacaaaggatctctcagcaaggctagtttactttctgcagaaagggtgccgctcactagcagtcttgccatgagcgcacacccgaacaaaggagacagggtcacttataacctgaagtggccaccctactgctgtgtctggtttccactggatggaatgcgacctcacattctgtactagtcccgattggctagtgacttagaactttccaaaagaggcaaaggcagaggagaacaaaggaaggtggaagccacttgtggaatgctgagaaaggtaaaaacacctccaaataaggaagaggaacaggctgtggcctaatgcttgcttggaccagtataagcatgccagggcaaatatctaggctaaaatatgggagctaagaacacaaagtacattgatttctttattacggctagcagatatctaagaatgttagcccaggtctttgaataaattttgcttctaaaagaagttactatttattcgtaattagacggggaggaaagtccctttgaagagaaacctctacttcactttctacaattgaaaatggctgttaaaaaaaaaaaaaaaaagaaaatggctgttatgggatatagtgattccttgattccagctgccttatgtgagcagggaatgcagacgtaatattgtcagatcttctgatttttttcaagagaaaccagaaatccagatttttatggggatggcaactgatttttaagtactggctcaaattcaataattttacaaagttgttcaggccaaataaaacatttttctggggtgccactttgtgacctttgatttagcccagaataaattgtttgtttgcagcctgaactacctttgggataaccagttcctaagagccatatgaaataatatttccttttacttgtactgaaataacctctgttgaataacaagaatctttccttacttgaatgcttaggaatttgtagttcccaatacaatctcacagatttcagttgtatctcatattaattgtctccttctcagacagaagttgagatgaatgaaatagtcacaaagcctgagaccagtgttctggtattgacttgcttcccacagtacttaatgaaaataattgtttttttcttttaggtctaagtaagtgtcttaatggctgtaatttacttgtgtgaacccagaaaatctgagacaggtctcagtttatttagaaagtttattttgccaaagttgtggacagcctgtgacacagcctcagtaagtcctgatgacatgtgcccaaggtgatcgggggacagcttggttttatacattttagggaaacatgaggcattaatcaatatatgtaagaagtacattgattctgtatggaaaggcaggacaacttgaagcaaagtcaggaagtggggaaggagcttctaggtcacagataggtgagacacaaagggttgcattcttttgagtttctgattagcctttccaaaggaggcaatcagatatgcatctatgtcagtgagcagagggataactttgaatagaatgggaggcaagtttgccttaagcagtttccagcttgagttctccttagtgattttgggggcccaagatgtttttcatttcacacttgtaaatactgcagcattgacaatggaatgctgtgtacctgctagtcaaattaagcttcaattccaagggcaagctacaccccaggggtgtcagctagttttatatctgaaaggctattcaaggtgccccttagaaattgcttgagtcatctatattttgattgatagcagatactttgctaatcagcacatgaatatcagaaattggttttattttgtggtgaaatcagtgggttggtaattagcatgagacaatgatagaaaagggctcactgatgaaattaaagagaatcaagatatgtgaatatgctaacatatttgagaggccctgctcatttgcctgaacagggtgtaagagtctattgaggcctttagcatgcccctataaagatggtgcaagaccctggactctgaaccactcctgtatccagatattgctttagaagagtttctggttgcctgatgctgaccacagagataattaaatcctgtctctgaaatgttggttctcttcctgcggaccattcatgtcatgtagtcattaaatcatttaaaaggacataagctgggacttcatgaaacctacagagtgggttgtataaaatgttctgtgcctaatggtccatgaatactggcttaataaatgtctttgagtggggcagaattttgcctggggccttcttttattacaagttgatagcaatgtaggaaatgagcagcttaatcttacccactaccaaacatcttgagctactgccataaactgaaagtaacaggctagttcccaaaaatgaaacaatggaggagccaaaacaaagctggaggcatcacattacctgactttatactacaaagttgtagtaaccaaaacaacgtgggactggtataaaatcagacccacagaccaatggaaaccaaatagagaacccagaaataaacgcacacatttacagtcaagtcatttttttgttgttgttttgtttttgtttttgagacggagtctaactctgatgccaggcttgagtgcagtggtgcgatctcggctcactgcaatgtctgcctcccaggttcaagcaattcttctgcctcagcctcctgagtagctgggactacaggcgtgtgccaccacacccagctaatttttgtattcttagtagagatggggtttcaccatgttggtcaggatggtctcaatctcttgactttgtgagccaccgcgcctgacccagtcaactcatttttgacaaaggcaccaagaacataaattagggaaaggacacctttttaataaatgatgttaggaaaatgataatcatatgcagaggaatgaaactagacccctatttctcaccatatacaagaatcaaataaaaaatggatcaggccaggcgtggtggctcatgcttgtaatcccagcactttgggaggccaagccaggtggatcacctgaggtcaggagttcgagaccagcctggccaaaatggcaaaactccgtctctactaaaaatacaaaaatgagctgggcatggaggcacgcgcctgtaatcccagctactcaggaggctgaggcaggagaaccacctgaacccgggaggtggaggttgcagtgagccaagattgtgctactgcactccagcctgggtgacacagtgagactctgtctcaaaaaaaaaaaaaaaaaaaaaaaaaaaaaggatcaaagacctaaatgtaagacatgaaactactagaagaaaacattggagaaatgcttcagggacaataggctgggctaagatttcttgagtaagacctcaacagcacaggtaaccaaagcaaaaactgacaaatgtcattagatcaagctaaaaagcttctgcacagcagataaaacaatcaacaaggtgaagagacaacttataagatgggagaaaatacttgaaaactactcatctggtgaagaattaataaccaaaatatagaaagaactcaaacaactcaataacaaaaaaaaaatctgatttaaaaatatgtaaaagatctgaatagacatttctcaaaagaagacataaaaatggctaacaggtatatgaaaaaatgctcaacatcactaagcattagggaaatgcaaatcaaaaccagaatgagatatcccagttaaaatgattattgttaaaaaaacagaaaatagcaaaagttgtcaagggtgcagagaaaggggaatgctcatacactgttggtgggaatataaattagtatatccactatggaaaacagtatggagggttgtcaaaaaactaaaaatagaactaccatatgatccagcaatcatccttctgggtatatactcaaaagaaagggctgggcatggtggctcatgtctgtaatcccagcactttgggaggtgaaggcagaagaatcacttgagtccaagagttcaagactagcctgggcaatatggtaagaccctgtctctacaaaattttttaaagaaattagcctggtgtggtggcatgcacctgtagtcctagctacttgggaaactgaggtgggaggatcatttgatcctgggagcttaaggctgtagtgagccatgatcgtgccactgcactcctgcttgggtggcaaagcaagaccctgtctcaaaaaagagaaataaagaaaggaaatcagtatatcaaagagatatctccacccccacatttattgcagcactatttacaatagccaagatatggaatcaacattaagtgtctatcaacagatgaatgaataaagaaaaggttttatacacacaatggaatattattctaccgtaaaacagaatgaaatcctgttatttgcaacaacatggatggaactggaagacattatgttaagtgaaacaggccaggcatggaaagacaaatgtcttatgttctaactcatatgtgggagctaaaataatctacctcatggaggtagagagtagaatggcggttaccagaggctagaagggcaatggagaggggaagataaaaaggggatggttaatgggcacaaaaatacggttagataggctgggcatggtggctcacacctataatcccagcacttggggaggccgaggtgggtggatcacctgaggtcaggagttcaacaccagcctgcccaacatggtgaaaccccatctctactaaaaatacaaaaaattagctgggcatggtggcatacacgtgtaatctcagctactcaggaggctgaggcaggaaaattacttgaacccaggaggtggaggttgcagtgagccaagatcatgccattgcactccagaccgggcaacagagcaagactccatcttaagaaaaatacagttagatagaagaaataagatctggtgtttggtagcacaatagggcaactatagctatcaataatctattgtatatttcaaaatagctagaagagtagatttagaatgttcccaacacaaatgataaatgtttgtggaggtggatatcccagttacccaggtttgatcattacacattgcatgcttctatcacatgtacccctgatatagtttggctctgtgtccccatccaaatctcacatcaaattgtaatccccatgtgattacgaggggagggaggtgattggatcatgggggcagttttccccatgctgttctcatgatagtgagtttgttctcatgagatgtgatagttttataaggggctcttccccgctttgcttacttctctctctcctgctgccttgtgaagaaggtgccggcttctccttccgccatgattgtaagtttcctgaggcctccccaccatgcagaactgtgagtcaattaagcctctttcctttataaattgcccagtctcaggtatttccttatagcagtgtgagaatagattaatacaacaccataatatgtacaactatttttttgagacagggtctcactgtgtcacccaggctggagtgcattggcatgatcacagctcactgcagccctgacccccaacccatgtcagcctcccacatcaagtgatcttcccacgtcagcctcccaagtagctgggaccacaggtgcatgccacaacacctggctaatgttttatatattttttgtagagatggggtttcactatgctgtacaagctgatctcaaactcctggcttcaagtaatcctcctgccttggcttaccaaagtgctgggattacaggtgtgagccaccatgcctagcctgtacaactattatgtgtccataataattaaaaataaaaagtttttgaaagaaagaaaatagaacatggaggagccagcctcagagatgagaactgattcctgaaggccccaggaatacatgactaactctgcttctgtaggggagtaaaaaatggctttcctatagccttctaggttccttggctgggctatgaattaagttaatgtaagactaatgaacaggggaaaagccatatttaattacctatgcatgcatgggagtcttacaaaatatgagacttgaagaagaggcatatgactgaagcttagagcatcctgagatacagaaagcaatgggggcttggggcttctgggaggtggcggccacacaagttatggaagggtgaggggaggaaatgtgtggtgaataaaggtcttcttgttatgcagataaaagtctcccaggtaacaaggtcgggagcagcccttaggagaataggtggtttctgtctaggcctagtgtccacctccaggctctctcctgtgatcccagttaatctcccctggtggatgagattcctgcaaaggagattcaggacaattgagttccatttggaggaaggtctttaggcagctaatgggagctcagaaaaagcctctgtctgcatccactgttccccatgtgcccttggttcaaagcaatcagcacaccaaagtgtgatattttggggtggcatttcttggactccttcaacttcatcctccaagccagacttttcaacaggaaagtcatctgggtgtctacatactggttgtcattgtattcatattttatcgttcctcttctatctagttgtccccaattgttggcaggaaatttattttttattacttctcttcctgtattttgactggaaactggtgttttctgacaacacagcacacaggcagctgggttttgtggcactgagcacataacaaaagggtcatgggcttttggctttatttcctgaaagttggtgctagtgcccgcatttgatgtttctagcctatgaaacacatcaggtgtcccaggaggagatgccagctcagctgccataggtacagagacaagtatggggcagtggcaggaaagtctgaagcaagaacaggactgtggcctgggcaagcccttcctttggggtctgagccccaggggagttatctaaacctaaatgcaggcctgcaggagtgtagcctgtaggacttgcatacagggctctgcagattgaatggggatcaaggtcgccagtgtctccaaggcacagaactactaaacagcttgtcatcataacatagtagtagaggcaggtggtgggccttcagtgaagccacagggaaacatagcaggagcccatcagcacagcctgtgccagcagcctgggggaccttcttggaaaatgtttatttatttatttatcttttaccagaaagattactatgaaacacaaagaaaattattcatgaaaatatacaggaaatcaattatttcaaataaaatactactacgagccataggttctgcatgtttggaatctaaatcctggaattgtctgttgctgttcacctgtctcatttttgctctccagttacccttaagactggtgctgatttaaatattcagggagggtgggtatctaagagggtctgtccatttggaaaaggcagcaaagactatcctctcacccactgccctaacctgtggattatgttgtgagggtaggacctcgtgcctaccctcataacactttcagttctttgatttgtgatctgcttcttgtgtttcactgtgcctggcaaggccatttcttctctgctagttctaatttaggcagatggctattgcttttcttatatatgccaacttttccacaccaaagtttgtatctctagggagctacttctgtttattaacaatgggattttattccttcagtgaaagtagattatgaacaaatagcaaaatgaatgtgtatttcaccaatctcttccagctgcctcttagctcaccagaggggctgagaggagcctctgccttgttcagtcttgaatcttgggtgactgtgtgtggccatttttatgtgagccatttctactgactctctcctcagcctgtcctaatcaagtttctgccccttctgctgcactgatatgctcttcccacaactacccgtgaggccctgtcatgctaaaaagaattgacatggtccacctgtcatttacccaatgcttctgcttatacttgcatgtgaaattaacactcccttttcatttatatttatatttgtattttaaaaatttaatcttggccaggcgcagtggctcatgcctgtaatcccagcactttgggaggctgaggcaggcagatcacctgaggtcaggagtttgagactagtctggccaacatggtgaaaccctgtctctactaaaaatacaaaaatcagctgggtgtggtggctcatgcctgtaatcccagctactgaggaggctgaggcaggagaatcgcttgaacccaagagacagaggttgcagtgagctgtgatcatgccattgcactccagcctgagcgacaagagtgaaactccatctcaaaaaaaaaaaaaaaaaaaattaatcccttgtccgtggatttctctcacatctttcccagctcatctcacaacctctcctatcattttccttcactccttaaggggcttctcttcctcccctatttataagtttgcaaaggtccattctcagcgagcaagcaattttatcctcatgttttacctcccaaaatatctctgaatgcagacctctttctgagttcatgtaccatatgcctaacccctaggggatgtcttaaaaattctccaaactaaattttcttaaaagttctcctaactgaatttcccccaaattgcatacaccattatgcctccaagttctgcttcttttcctaggctatatttcctgacgtgtcttctgcagcccaggcaacagtgctcaggaacacagatccattctagggttcccaaaggggaagctgactctgagaattgcagttattgtactttccttggttggatcagaaaatatggccttgaggatgtggcagatattaacttcaaaaggaagtttgatggctctctgtcctatgtctgtgtccccttagaggtctttatctctgctggtagaaaatggagaggaatcactgtgcttctcttttgcacataatgtcagcctagagatgcatatgtgtaaaaacaaagttggagggggctcaaggggatgaagaatgaactcagtaggattctcccaaatgctctactgtgtccagagaatacaaacgaagccaacacatttagctttaaaccttggagctttaatctttcaagaacacatttccttcctgtatttctagtaactactgtttctgacttttctggaaatcccaccagtttccttgactcccttttccataagaattgagtcataaaaatagaaccatgagaaaagttagtttgacccctttgccctctgaaatgtgctggtggaaacagcctgaggggattgggggtgggggaaatgcctctttaatcgaactggttcttccatctcaaggaaaaacaaactgaagcaaagaataaaaattgctttacattagtcctccacaggaaagggatttttttttaaggaaagaatttacctgtggactcttctagtgtttggagaagggatttttaacctgagaaccatgaatgggctttactgggatatatgattctccagaaactgtgagctacatgtttttgtttctgtgcatttttctcaagtgagggtctataatttttatcagattctcaaagaagtccctgtccccccaaaatgtaagaactactcatttagaggataacctagttgaattatttattgctgtgtaaccaattacctcataatttagcaatgtaacacaactatttgttatctcacagtttgtgtgggtcaggcattcaagagtggtttagttggatgactgctcagggtgtcttatgatgttgcagtaaaaagtgagctagggttgctgccatctgaagaatggggctaaagaatctgttttcaagatggttcactcacatggctgttgacataaggcacttgtttcctgttggccattggcaggtggcttcagttccttgccacatggacctcgccattgagctgcttgagtgttctcacaacatagcacctggcttcccccagagtgagtgactgagaaagagtaaggagaaaatcacaatgccttttataacttagtctcggaagtcatacattgtcaggtctgtcacatgctattctataaacaagacagtccactttttttttttttaagagacaaggtcttactctgtcacctaggctagagggcagtggcacaatcacggctcactgcaggctcaacctcctgggctcaagtgatcctaccacctcagcctcctgagtagctgagaccacagacacatgccaccatgcctggctaatttttatatttttatattttaaattttatttcccatactacatggatatataatttttgtattttttgtagagacagggttttgctatgttgctcaggctggtcttgaactcctgggcacaggtgatccacctgcctcagcctcccaaagtgccaggattacaagtgtgagtcactgcacccaggctacagcccattctttttttttttttttttttgagacagagtctcactctgttaccccggctggagtacaatggtgcaatctcaactcacttcaaactccgcctatgggttcaagtgattctcctgcctcagcctcccaagtagctgggattacaggcatacaccaccacacccagctaatttttgtattttaagtagaggtagagtttcaccatgttggccaggctggtctcgaactcctgacgttgtgatcctcccacttcggtctcccaaagttctgggtttacaggcgtgagccactgcacccggccagcccaatgggttcttcctgcctgctgcacaaacaaaatcaactcaccaagaccatggcattgtagtaacaaaagtgtttaattgacacgaggctggtcactccccataggaaatggggttattactcactcagatcaatctccctgaaggcatgaggttaggggtttttcaaagatagtttggtgggcagggagcatactgattggttgggtcagagatgaaatcatagggaatcaaagctgtcctctagtgctgagtcagttcctggactcaacaggactggtcggcaggtccagatggtgtcatgtggttgtcagaacggcaaaatcttgaaaagacatctcaaaaggccaatcttagtttctacaatagtgataatatctgcaagagtaactggggaagttgcaaatcttataaattctggaataatggctggtaattatttagaattcaagcccctctcatcctcctaacttggtggccatttatttattagttttacaggaacaatttcatttttgggaagggctagtatcatttcaactgtaaactaaatttcgcccaaagttagcttgacccacaccaaggcataagcaaagagagccaacttgtgaggctagaagcaagatggagtcagccatgtagatttctcttactgtcataatttcccaaaggtggtttcagtatgaggattacatgaaatgctggattaataactgctaaaaaatgttagcagtaacaatggtgaccccacccccaatctaaggatttccatttccattcaatagaattatacatttatgaattgttaatcttctacatgtggtcagaagtgattatttattgagaattactttgtagagcaggtgctgtagggcagggagataaaaaagaaattaaaaacagaccctgttctcaatcattctacattttagttggggaaaaaagatacatatgtgtagaacagagggatgctttggaaatccattgatacccatctctttgttgagaaacaggggaagtccttgccttgagtgtaactttgaaggttaagattcaggcgtgggtacatgaatgaagatttaattggaaagggaagctgaaatttgaaggaagaccacagaagacatttcaggaccataccagaaaaaataaaagggaaaagaagaggatttatgaaatcaagagttcacagataaaggaataaacttaaagaaaaagcaaaaagccactgggtgcggtggctcacacctgtaatcccagccctttgggaggccaaggcaggcggatcacgaggtcaggagtttgagaccagcctagccaatgtggtgaaaccccatctctactaaaaaatccaaaaattagccgggtgtggtggtggatgcctgtaatcctagctacttgggaggctgagacaggagaattgcttgaaccggggaggcagaggttgcggtgagctgagatcgcaccattgcactccagcatgggcgacagagtaagactccatcaaaaaaaacaaaaagcaaaaaacaaacaaaagccaggcacttctctgagggaagaaatgatctgtgccatggtaattcctgaaggagcactttatcatatttatccaactgtttattggaagagaaagatattctattaacccttcaagaacaaagaaagtgtctattaggcttctgtaatccagcatggaggatacttaaaaaaaaaatactgaaaaaccaattatctgactaattataactttagattaaaatgtttgctgaccggcatcccatggagctggttctctacatcccagctttttggcttatcccctgttgtgggaggggtcaaattagggtttccaacagctctctcaggcaacctcataggctggggaagagatagaggagaggcctctccaggctggcctcaaagggcatttgcagcatggagggcatggaatagaaggagttcaggaaaggccacttcaaaatatgacactttggtgtgctgattacattgaactaagggcactttgggaacagcagattcagacagaggctttttctgagctccccttagctgcctaaagacaatcctccaaatagaactcaactgtcctgaatccccttcatgggaatctcatccaccagggaagattaactgggatcataggagaaagcccggaggtggagaccacgtgatatggtttagctgtatcccccagcagatctcatcttgaattgtagctcccataatccccatgtgtcatgggagggacctggctggaggtaattgaatcatggaggtgggactttcctgtgctgttctcatgatagtgaataagtctcatgagatctgatggttttatttatttattattattattattttgagattgagtctcgctctgttgccaggctggagttcagatcttggctcactgcaacctctgtctcccaggttcaagcgattctcagcctcccgagtagctgggactacaggcgcatgccaccatgcccagctaatttttatatttttagtagagacatgttggccaggatggtctcaatctcttgacctcatgatccaccaaccttagcctcccaaagtgctaggattacagacgtgagcagctgcacatggcctgatctgatggtttcataaaggggagttcgcctgcacaagctctcttgcctactgccatgtaagatgtgcctttgctcctcatttgcctactgccatgtaagatgtgactttgctcctcatttgcctcctgccatgattgtgaggcttccccagccatgtggaactgtgagtcagttaaacccctttcctttgtaaattactcagttttgggtatgtctttattagcagcatgagaacagactaatacaccatgcccaggaagatattctcctgagggtttctccaggcaacttttattacctgggagacttttatctgcctaacgagaagacctttattcaccatacatttcctcccctcaccctcccataacttgtgtggccaccacctcccagaagcctcaagtccccattcctttctgtagctcaaaatactacataggttgcatatccctaatccaaaaactcgaaatactctaaaatccaaaatttttttgagtgttgacatgagccttcatgtcatgagtggaaaattccacacctgaactcatgtgatgtgtcacagtcaaaacacattaaaaactttgtttcatgctcaaaatcattaaaaatgttatataaaattaccttcagtttgtgtgtataaggtgtatatgtaacataaatgaattttgtgtttatacttgagtcttagccccaagatctctcattatatatgtgtaaatatttcaaaattggagaagattcccaatctgaaacatttctggtcccaagcattttggatgagagatactcaatctgtataggcttcaatcatctggccctcctttgagtcttatattttgaaggactcctgtgcctatgtatgtaactaaagatggtttttctcctgttaatctgtcttatgtcagtttaatttgtagcccaggcaaggagcctagaagggcaaagggaagccatttttcactcactttcaatgtggaagacttggtcacatggctgacctcaggacagtcatataaggcagctctcttgactggggattgagaagaacacagccatactctggttggttcccaggagcattggcttctttgatgtcacaataaagcaaacattggactttctcaaaagttagaaggcaggtggctaggcacaggggctcacgcctataatcccagcaccttgggaggctgaggcgggtggatcacctgaggtcaggagttcgagaccagcctggccaacatgatgaaagcccatctctactaaaaatacaaaaaattagctgggcatggtgatgggcgcatgtaataccagctactcaggaggctgaggcaggagaatcacttgaaccaaggaggcggaggttgcagtgagccgagatcgtgccactgcactccagcctggggaataagaatacaactcagcctcaaaaaaaaaagaaaaaaaaatatatatagagagaggcaggtccaattcagtttgctgaccttggaagccatctgatttctttgggatttgggtctgaccatggaaagttcttaatacttgtggtagcatctgcgattgaaggagtttttcatcacagcagctgtgaaacagtcccctcccaccaccccgccagtttgggaagggcgtctgtgttgtgttggccgtcgcaacaccctcagatcctaccctctgcctcctggacagatctcctgctggcacctaatgttgaagcaacctactggctcctagcactctctctcatttttttcccttgagacagggtctctgtcacccaggctggagtgcagtggcgtgatcatggctcactgcagcctccgcctccaggctcaaggaatcctcccacctcagtctcagcattctgagtagctgggactatatcacgtcttgctaatttttgtattttttgtaaagatggggtctcaccatgttgtccaggctgatctcaaactcctgggatcaagttatctgccctcggcctcccaaagtgctgggattacaggagtgacccactgtgcccaacaggctcctagcactctcaatgcctacggagaagtcttttaggaaaaaaaatagaaaaggaaacaatgattttattgtttttgttcaaataacacatatttatcataaaaatttaagtaatatagaaaagcataacgaagaaagttaaaaaaaaaaaaatacacacacacacacactataaatcccattgctccgagataaccatcccccaacatttgtaaaaaatatgattcaggaatctataggtaggtgagtagacagaacaacagaaacaattttataaaaataaaatcattctctgcatactattttagatgtaaaaagtttaatatcatttaacttaaatttaacagtacaaaaactgaagcaaaacttttttttttttttttcctagatgaggttgctctgtcacccaggctggagtatagtggtgtgatcgcagctcactgtggcctccacctcccaacctctggagtacctgggactctaggtgctcaccaccatgcctggctaatttttttttttttttttttttttgagatggagtttcgttcttgttgcccaggctggaatgcaatggtgcgaactcggctcactgcaacctctgcctcccaggttcaagcaattctcctgcctcagcctcccgagtagctgggattacaggcatgcgccaccatgcccagctaattttgtatttttaatggagacagggtttctccatgttggtcaggccggtctcgaactcccgacctcaggtgatccgcctgcctcagcctccccaagtgctgggattataggtgtgagccactgcacccggcctttattttgttttattttttgtagaaatgagccctggctatgttgcctgggctgatctgcatctccagggctcaagcaatcctcctgcctggaattacaggcatgagccactgtgtccagccagcaaaacttaaaaattactaaattggccaggtgctgtggctcacgcctataatctcagcactttgggaggccgaggcgggcggatcacctgaagtcaggagtccaagaccagccttgccaacatggtgaaacatcatctctactaaaaatacaaaaattagctgggtgtagtggcgggcgcttgtaatcctagctactgggggactgaggcaggagaattgcttgaacccgggaagcggaggttgcagtgagccaagatggcgccattgcactccagcctgggcaacaagagcaaaactccatctcaaaaaaaaaaaaaaaattactaaattggctgctgctttatcacaagatataataattcttaagagattgatctagaaaaaagacaatgcaaaacattaggagattaaatttgcttttttaaaaaaagccatgtttcaattttaagtggtatctattgacttcctgctacaaaagatgaggaattacccgcaattgtactttagcccaatgcctgactctacctcttgatttttactacagttgacccttgaacaacacaggtggaaatttatgaatccacttattcatgggttttcttgcacctctgccacccttgagacaagaagtctaacccctcctcttactcctcttcctcagactgctcaaggggaagattacgaagatggagaccattatgatttacttcaacttaatgaatagtgaatatattttctcttcctgatgattttctttctgtttttttgagacagagtctctctctgtcacccaggctggagtgcagtggcacgattttggcttactgcaacctccgcctcctgggttcaagcaattctcctgcctcagcctcctgagtagctgggattacaggtgcgggccaccacacccagctaattttttatatttttggtagagacgaggtttcaccatgttggccaggctggtctcaaactcctgacctcaagtaatccgcccgcctcggtgtcccaaagtgttgggattacaggcgtgaaccaccattcctggccaatgattttctttttcttttttttgagacagggtcttgctctgtcaccaggccggagtgcagtggcatgatgttggctcactgcaacctccgcctcccgggttcaagtgattcctctgtctcagcctgccaagtagctgggattacaggcacgtgccaccacacctggctaattttttgtattttagtagacacagggtttcaccatgttggtcaagatggtctctatctcatgacctcatgatccagccgcctctgcctcccaaagtgctgggattacaggcatgagccactgcagattttcttaataacattttctttttctagcttactttattgtaagaacacataatataatacatataacctccaaaatatgtgttaaccaactgtttatgttatcagtaaggcttctggtcaacagtaggctattagtagttaagttttgggggaatcaaaggctatatgtagattttcaactgtgcagggagatcagcacccctaatccccccaatgtgcaaaggtcgagtgtatattccattgtcaatgttcccctcatttcatttttttctaatttttattaaaaaaatttttacaacatgctattagttacatattttattatttttatttaaaaatatttttaaattatttaaaaaatttcttgtaggtacatagtagttgtatatatttagggggtacatgaaaggttttgatacaggcatgcaatgtgaaataagcatatcatggataatggggtatgtattccctcaggcatttatcctttgagttacaaataatccagttccattctttaaattattttaaaagtatacaattacattattattatatagttcccatattgtgctatcaagtcgtaggtcttattcattttttctaatttttttctttacccattaaccatccctgcctccccctcaacccctcacaacccttcccagactctgataaccatccttctactctctatgtccatgagttcaatttattttgatttttagatcccacaaataaatgagaacatgtgatgtttgtctttctgtgcctgacttatttcacttcacataatgatctccagttccatccatgttgcaaatgactgaacctcattctttttatggctgaatactactccattgtgtatatgtaccatattttctttatccagtcatttattaatggacacttaggttgcttccaaattttagctattgtaaacagtactgcaacaaacataggagtgcagatatcctatgatttcctttctgtagcagtctcactgctggatcatagagtggctcaatttttagttttttgaggaacctccaaattgttctccatagtggttttagtaatttacattcccaccaacagtatacaagggttcccctttctccacatcctggccaacatttgttattgcttgtcttttccctataagccgttttaactggggtgagatgatatctcattgtaattttgatttgcttttctctgatgatcagtgatgttgagcaccttttcctatgcctgtttgccatttgtatgtcttcttttgagaaatgtctgttcaaatcttttgcccattttggatcagattattatattttttcttatggagttgtttgagctccttgtatattctggtgattaatcccctgtctgatgggtagtttgcaaatattttctcccattctgtgggttgtctcttcactttgttgactgtatactttgctgttcagaagctttttaacttgatgtgatcccatttgtccatttttgcttaggttgcctgtgtttgtggggtattactcaagaaatctttgcccagacctatgtcctagagatgttccccaatgttttgttgtagtagttttgtagtttgaggtcttaggcttaggtctttaatccattttgatttgatttttgtatatgatgagagatacgggtctagtttcattcttctgcatatgaatatccagttttcccagcaccatttatttaagagattgtcttttccccagtgtatgttattggcatctttgtcaaaaatgagttcgctgtaggtgtgtggattcgtttctctcatctcattttgttccctacccacacttctcactgttgtttagttttggctatatatatatatatttgttttgttttttgagatggggtttttgctctgtcacccaggctggagtgcagtagtgtggtctcggctcactgcaacctccgcctcccaggttcaagcaattctcctgcctcagtctcccaagtagctgggattacaggcacctgccaccatgcctgggtacttttttgtatttttagtagagacagggtttcaccatgttggccaggctggtcttgaactcctgacctcaggtgatccacccaccttggcctcccaaatgctgggatgataggcgtgagccaccacacctggcttggccctatgtttaatggactcagtgctcaccacctctatgttacccagtggtatggattaaattgtgtgctgtatccccacaactgagaaaaaggtatgttgaagtccttaccctcagtacctcagaataggaccttattttagaaacaggatttttacagaggtgatcagattaaaatgagcttagtagggtgggccctaatctaatatgactggaaattcgaacacaggcatgcatggaggaaagactctgagaagaggcatagggaggacactgtgtgaagattgcaattatgctgctgcaagccgaggcctgtctggggctgcagaatctggaagaggcaagaaaggattctccttcatgatcctcagagggagcgtgtccctgctaacaccttgatttcttacttctagctcccagcactgtgagacaatgactctgttgttctaagtcatccagtttgtggtcttttgttatagcagccccaggaaactaatacacccaggtcctgtactgtagaatccattttgactcatctctggttggatagatttcattcataagttgtttttcaagaaacgttcatgggtcctttattccctgaggtttagcatgcctgagagtgtctgtttattgcctttatacttgaaggataactaggtgtgtagaaaatccttgtgtcaatcagaaatgacaaaggagatgttaccactgaccccagagaaataaaaataaccatcagagactactacgaacacctctatgcacacaaactagaaaatgtgaaagagatggatccattcctgggcacaaaaaccctcccaagactgaactaggaagaaactgattccctgaacagaccaataatgagctccaaaactgaatctgtaacaaataacctaccaacaaaaaaaatcctaggaccagatagattcacagccaaattctaccagatgcacaaagaaaatctggtaccattcctactgaaactattccaaaaaactgaggagggactcttcctccactcattctgtgaggccagcattatcctgataccaaaacctggcagagatataacaacaaataataaacttcaggccagtatccttgatgaatattgaataaagatcctcaataaaacattgcacactgaatccagcggcacatcaaaaagctaatccacaatgatcaggcagaaataaagcctacttgatcatgaatacccctacttgtatacccctgtgttacaaggttagttcaacatatgcaaatcaataaatgtgactcatcacataaacagaactagagacaaaaattacatgataatctcaatagacgcagaagagtctttcaataaaattcaacatcccttcatgttaaaaactcccaataaactaggtaatgaaggaacatacctcaaaataataagagctatctatgacaaacccacagccaacatcatactgaatgggcaaaacctggaagcattccccttgaaaaccagcacaagacaagggtgccctctctccccattcctagtcaacatagtattggaagtcctggtcagggcaatcaggcaagagaaagaaagaaactgcatctaaataggaagagaggaagtcaaactatcctctttgcagatgacatgattctatatctagaaaccccatagttgcagccccaaaactccttcagctgataaataactttagcaaagttttaggatacaagattcatgtacaaaaattactagcattgctatacactaacaacagccaaaccgagagccaaatcaggaatgcaatcccattcacaattgtgacgaaaataataaaatacctaggaatacagctaactagggaggtgaaagatctctataatgagaactacaaaacactgctcaaagaagtcagagatgacacaaacaaatggaaaaacattccagttctcatggataggaagaatcaatatcattaaaatggtcatactgcccaaaacaatttatagattcaatgctattcctatcaaactaccaatgacatttttcacaaaactagaaaaaaactgttttaaaattcatatggaaccaaaaaatagcccaaatagccaaggcaatcctaagcagaaagaacgaagctggaggtatcacattacccaacttcaaactatactactggtataaactatttctggttaatggctacattaaccagaaaaacatggcgctgatacaaaaacagacatataggccaatggaacagaatagagagcccagaaataaggccacacacctacaaccatctgatcttcaacaaaaccgacaaaagcaacaaggaaaggatttcctattcaataaatggtgctgggataactggttagccatatgcagaagattaaaactggccccttccttacaccgcatacaagaatcaactcaatatcgattaaagacttaaatgtaaaacccaaaactataaaaaccctggaagacaacctaggcaatgccattctggacacaggaacaggtaaagatttcgtgacaaagatgccaaaagcaatcacaacaaaagcaaaaattgatgaatctaattaaattgacgatctaattaaatgtaagagcttccgcacagcaaaagaaactgtcagcagagtaaacggacaacctacagaataagagaaaatttttgccaactatgcctcccacaaaggtctaatatccagcatctataaggaacttaaacaaatttacaagaaaaaaaacaacctcattaaaaagtaggcaaaggacattaacagacacttttcaaaggaagacatacgtggggccaacaagcatgtgaaaaaaaagttcagtattactgatcattagagaaatgcaaataaaaacggcaatgagataccatcttacaccagtcagaatggctgttattaaaaagttaatgctgggcgcagtggctcacacctgtaatcccagtattttgggaggccaaggcgggtggatcatgaggtcaggagatcgagaccatcctggctaacatggtgaaaccccatctctactaaaaatacaaaaaattagctgggcatggtggcaagcgcctgtagtcccagctacttgggaggctgaggcaggagaatagcttgaacctgggaggcggaggttgcagtgagctgagatctcaccactgaactccagcctgggcaacagagcaagactccgtctcaaaaaaaaaaaaaagcaaaaaacggttaaaaaataacagatgctgttgaggttatggagaaaaaggaacagttatacactgttaatgggaatgtaaattagttcaaccattgtggaaagcagtgtggtgattccacaaagagctaaaaacagaactatcattcgacccagcaatcccattactgggtatacacccaaaggaatataaatggctctaccataaaaagacatgcatgcatatgttcattgcagcaccattcacaatagcaaagacatggaatcaacctaaatgctcattaatggtagactcaataaagaaaatgtggtacatatgcatcatggaatactacatagccacaaaaaagaacaaggtcatgttctttggagaaacatggatggagcaggaggccatcatctttagcaaactaatgcaggagcagaaaaccaaatactgcatgttctcacttataagtgggagctaaatgatgagaacacgtggacacatagaggggaacaatacacactggggtctacttgagggtgaagggtggaggagggagaggaacagaaaaaataactattgggtactaggcttagtgcctgggtgacaaaataatctgtacagcaaagccccatgacatgagtttacctatatgacaaacttgcacgtgtacccctgaacctaaaataaaaagtttttaaaaaagaaaattcttgtgccatgttttctttcctttggcactttaaaaatgtgggtcctctgtcttttggcattgtgaaaaaacctgaggaaatttgatctggtttttccttcggtaaatgcttttctacatggttaaccacatgagattttctttgtccttgatgtttcataactgcagcaggatatatcttgatgttgaacagtctatgtcaatttttcttggaacatctatgcccttttgatcagcagattgaaatcatccttatttcaagaaagttttattatttttgaaataatttacacttaatttcttttattctctttttttctggaagtgtttattctctgtcagaaatgctggagatctctttttttttttttttttttttttgagatggaatctcgctctgtcgcccaggctggagtgcagtggcgtgatctcagctcactgcaagctgctggagatctcttttaccgggctcccataagaatagtaattttctctagaatcattaacaagtcttgagatttagctgttgttgtttttgttgttttttttgtttttttgtttttttgttttttgtttttgagacaaggtcttgccctgctacctaggctggagtgcagtaggattgactcccaagtagctgggaccacaggcgtgtgcctccatacccagctattcatttcgttttgtgtgatttcctggtttctgcccaacagatattgaactagagtcagttttttttttttttttttaatttgacagtgttttgctcttgttgcccaggctggagtgcaatagtgccatctcagctcactgcaacctcagcctcctaggttcaagcaattctcctgcctcagcctcccgagtagctgggattacaggcatgtgtcaccacacccgctaattttgtatttttagtagagacagggtttctccatgttggtcaggctggtctcgaactcccgacctcaagtgatctgcccacctcagcttcccaaagtgctgggattacaggcgtaagccactgcacctgctgtcagtttttttaaatggttttttttttttttgtcttctaatgtagcttccatctcttgtcacattttattcttccatttttatcctgaatttattagcttgctttttatcttctgtcattttagaatctcttctttgaattcttatgtcttgtctttgcaggctttttctagaaatagtgttgtctgaaatttctttgagaacatggagaatttatctgaacatattttctgtttccttgggtaattattcttgcggtgtttatttttttatcagccttttgtgtatatttccttcctctgcaatttctatgtgtaagtccaatatggttccctgttggttattgtttgtctttgaatgggatccactactggctgaatagcagtatgaggagtggagaaagagctaggggtgttggagagaatctaggatccttcagcttcaataggttttgttatctcaaacaccctttcagttacttcctttttcttgggggtcatctccccacagcttttggtgttcaggaagtccatgtgacctagacttacaggtccatgggtgcaacctggtggtcccacctccacatcctccttccccactcatccttccccatgactgcctttctggaggcgaggttagcaaggtagttcctgcaggccccccttccctgccattctgcagtgcctgtcagctctctacaggacttccccagtctctggggaccagcctgtgctaccgtattgctgagatattaatagattccaagcattatcagcgaagcttctatcacagatttttggagtaatctgtgtcctaccctgggtccaaggaggcacctggcatctctttcctgttacagttcccatcttacagtaacagcaggtttgcttcatgggctctggtttggtgctgtagttatttgtctcattgaaaatggaggccttggccaggcgcagtggctcacgcctgtaatcccagcactttgggaggccgaggtgggtggatcacgaggtcaggagttcgagaccagtctggccagcatggtgaaatcctgtctctactaaaaatacaaaaaattagccgggcatagtgatgcacgcctgtagtcccagctactcgggaggctgaggcaggagaattacttgaacccagcaggcggaggttgcagtgagccgaggtcacgccactacactccagcctgggtgccagagtgagactccatctcaaaaaaaaaaaaaaaaagaaaaagaaagaaaacgaggcctcttcccctatttttcatttgtagtgctgtgatcagtaggcttcataatgggagagtggagtaaatattttaacaggaagtcttttgttttgaaaggctaattgatattaattaatctatttatggcctgggaatatttacctttgttatgtttttatgtgaatatactataaattataaataggaacattatttttgtgcttgtttatattctatttctcctactttctttctttttttgtttttttttttgagatggagttttgctcttgttgcccaggctggaatacaacggcacaatcttggctcactacaacctctgcctcctgggttcaagcgattctcctacctcatcctcctgagtagctgggattacaagcatgcgccaccatgcccagctaattttgtatttttagtagtgacggggtttttccatgttggtcaggctggtctcaaactcccaacctcaggtgatccgctcacctcagcctcccaaagtgctgggattacagacatgagctaccgcacccagccttctactttagttttaaaagtgtagttggtcatgaactgcactccttagtttctgtttgtttcttttcaaaataagaatgtcttcataactttttatttatttatttatttatttatttatttatttatttatttagttttttgagacagggtctcactctgtcacccaagctggagtgcagtggcgcgatctcggctcactgcaacctctgcctcctggattcaagcgatcctgccacctcagcctcccaagtagctgggattacaggtgcatcccaccacatctggctaatttttgtatgttttggtagagacgggtttcaccatgttggccacgctggtcttgaactcttgacctcaggtaatctgcctgcctccctagaatgctgggattacaggcgtgaggcatcacccctggccataacttttttattataaaaataacacgtgctcattataaaacagtgagcaacactaaaaagaaaaatcacagtgaaagccattgaaatgccaccatctgtacataattgctattaagtttgtgtgataatcttttgagacattttctatgtatacaacaatgtgtcaataatttgagaaaatgaaatcatatatgcttctttgtaaaggttttgttttattatataagtactacatgaacacattagcattgaaaaaaattcaaaggaggcagacaagctctcgcttaatttcccttcatcctctttcctttctttgggaaaatcacttgtctcagatttccaggccttttttctattcatttacatacacatttgtaaacacatagaaacatatacaatttttttttaacatttttgagacacagtcttgctttgtcactcaggctggagtgcagtggcacaatcatggttcaccgctgccttgacctcccaggcttaagtgatcctcccacttcagcctcctaagtaactgggatcacaggcacacaccaccatgcccaactaatttttaaattttttgtagaaacaggggtttcactatgttacccacggtggtctcgaactcctgggatcaatgtttctcctgcctaggcctctgaaagagctgggattacaggcatgagctactgtgcctaaccacatatacagttttttaaaaaaacatatattagatcactgaatatgattgaatttcttattcagtatatttttggttactattgagaaggggatctaattttatttatttatttttgagacagagtctcggtctgtcgcccaggctggagtgcaatggtgcaatctctgctcactgcaacctccacctctcgggctcaagtgattctcctgactgagcctcccaagtgtctgggattacaggcacatgccaccacacccagctaattttttttgtatttttagtagagatggggtttcaccatgttggccagtcaggtctcaatctcctgacttcaggtgatccacccgcctcggcctcccaaagtgctgggattacaggcatgagccactgggcccagcagggatcttatttttaattaaaatttctaatcattttaaaggaattgaattgtgttttgagtatacactatcttatattcatctactttgctcaactgttttattaattcatatgaattacaacctctgccttggatttttaaagttcccaattatgcttttaatactgatatttcttgcatattttgttctaatatttattttccagcaccatatttaagtaacaggggtgatgtagagatgtgattttcaactttaagatgtgagtgcatcaaactcacctggagagctggtttgggataaacttgaccaaagatgggcaagacctgtacattgaaaactacaaaacattgctgagagaaattaaagaaccaatatgtgaaaaaatactatgaattcatggatcaaaagactcagtattgttatgatgtcagttgtctccatattcatctgctgtttcagtgcaatcccaatcaaaatcccagaagtttctttgtagaaattgaaaaactgatgctaacatttgtccgtaaattcaaagaacctggaatagccaaaacaactttggaaaaaaaaaagttggaggactaacactacctgatttcagactaaaaatcaagctacagaaatcaagacagtgttgtattgctgtaaaaactgacaaatagataccacaacagaacagaacagagtccaaaaatagactcatacatatatggtcaattgattttcaacaaagttgtcaaggcaattcaatgaaaaaaaggataatttttttaaacaaatggtgccagaaaaattgaagagatatatgcaaaaaacaaatctcaatctttaccctacactatacataaaaattaagatgaaagacaggatagactggggaactggttgaagaagactaaggagacacagcagtggatgcaatatgagatcctggattggctcttggaacagaaaagtacattgtggggaaactggcaaaatttaaattaagtctgtagcttagttaataaatgttgatttctcggttttgataattgtactatggttatataagttgttaacattaggggaagcaggatgaagggtatatgtgaatacttggtactgtatttgtggcttcttttcaaagctaaatttatttcaacataaagcttcttaaaaattaattttaaggctgggcacagtagctctcacccataatcccagcatattgggagaccaaagtgggtggatcacctgagctccggagttcgagaccagcctgggcaacatggcaagaccctgtctctacaaaaaatacaaaaaattagctgagcatagtggcatgtgcctgtggtcccagctacttgagaggctgaggtgggaggactgcttgagcttaggagacagaggtggcagtgagccacgattgcaccactgcgctccagcctgggtgacagagcaagaccccatctcaaaaataataataataattaattttaagtggaaaatagacctaaattcaaaaattaaaatttctaaaataaaatttagtagaaaatcttagtagccttgagtttggcaagacttcttaaatatgatgtacaagaggcataaattacaaaatagacaaactggacttcatcaaaatttaagacttttgctcttcaaaacacatggctacaaaaataaaaaggcaagccaatgactgggagaaaatatttgccaagtatatatctgacaaaagactagaatatttgaagagctagaacatatgtattttgtttggctcagacagtatttaaagattattttgaaaagattatgagctttctctttttaaggataagagctttagctttttattttttatttatttaatttatttatttatttttatttttttaatttttatgtatgtatgtatttatttattcctgagatggggtctccctttgtcacccaggctagcatcttggctcactgcaacacttgcccccagggctcaagcagtcctcccacctcagcctcacaagtagctgggattataggcacgtgccaccatacctggctaagttttgcattttttgtagagatggagttttgcccaggctggtctcaaacttctggacttaagcaatccacccacctcagcctcccaaagtgctgggattgcaggtgtgagccaccacacctggcctatttatttatttttttgaggcaaggtcttgctctgttgtccaggctggagtgtactggtatgatcatgactcagtgcagcctccacctcctgggctgaaacaatcctcccacctcagcctcctaagtaactaggcctacaggtgtatgccactcacccagctaatagttttatttttattttgtagaaatggagtctcactatgttgcccaggctggctttagctttttagatccaaatatgaatgtacaggaaatacagaagacaggagagcatgttaaatgtcaccagcaaaatccagaccgtggaaaactctgtaggacaaaaggcctagcttctttaacaaatacattgcaagggaaaaaatggtgggagcacagacctacaggttaaagaagacttaaaaatataccagtcactctcaaggtgtgggctgggtttagatcctgtttcagacacactatacaaagtaaaataatattaaataaacattttttgagaaaattataaattttaacactacaggctatttgatggtaagaaattattgaaattttatttagttattatatgtgtcatggttagaaataagagttctatgctgggcgtggtggctcacgcctgtaatcccagcactttgggaggctgaggcgggtggatcacctgaggtcaggagtttgagaccagcctggccaatgtggtgaaaccccatctctactaaaaatacaaaaattagttgggtgtgatggtgggtgcctgtaatcccagctactcaggaggctgaggtaggagaattgcttgaacccaggaggcagaggttgcagtgagccgagattgtgctaccacacttatgcctggacgacagagcaagactccatctcaaaaaaaaaaaaaaaaaaaaaaaaaaaaaagataaagaaaaagaaagaaaagaaagaagagttctttagctgggcatggtggcttgtggctcacgtctgtaaacccagcactttgggaggccaaggtaggcagatcatgaggtcaggagattgagaccatcctggccaacatggtgaaactgcatatctactaaaaatgcaaaaattagctgggagtggtggtgcgtgcctgtaatcccagctactgaggaggctgaggcaggagaatcacgtgaacccgggaggcggaggttgcagtgagctgagaccgcaccattgcactccagcctggcaacagagagagagactccatctcaaaaaaaaaaaaaaaaaagaaaagaaaaaagaaaagaaatatgagttcttatctttacaagaaaatgatgaattggatttacttcaacataattcttaatgaagggaagtaggtggggttgtagatgaaacaaaatcggccatagttgacaattgttgaaacttggtggtggatgcacggggattcattatattcttttgcttatttttaaatatgtttgaagttttcattaattttgttttttgtaagcctttagcagctaataataacttattttttaaggggaacttcctcaaaaaaattctgattttagattctcttgaaaaaaatggaaagatgtggtaacgctaggccagcttccacagtgcaacaaccagccagagttgaaaaggatcacgaggaaggcctgatgcagccacaatcctgaccactcccgggggcacttccacctggcccgctcctgtgtctacactacccacctcagcctttaagtgttggggtcccaatcctgatatggactgcctcacattcctcctagcactctcctaaacccagcccaagccctgtcgttcaagtggggctagcacaaggagggttgcctgctcttcctcaatttttcatgctttttcccagatcttttcttctgtgccatggatcctttttggtcccccaagaatctagggttttaaaactcaaaagccagaaagaaacacttctctctcctgcctcctgctctctgccattatgtgccttccctgagggagtgagaacagaacaggctgagactttggggaaacaggcagggatgggaaggaaaaccaggagagtgtggttaagatgtagctgtagagcttatacctatcagattggcaaatattaaaaacttggataatatcaagtactgccaaaggtgaaggaaaacagaaaccctctgggaatgtcatccagtataacctttctgggaagaagtttagaaatagtaagagaaactaaatacagacagatcttcccacccagcagttccatccactcctagatactgagcccagagaaactcttacaaaacatgtaagaggatgtccattgcagaattgtttgtaatagggacgatttgaaaatacctagaaatttactaataggaaaatagataaaatgtgttatatgcaaatgatgataataattcagcagataaaaggaatgctctggtcacatccacttggatcaatctcaaaaacataactttgactggaaaagggtgagaagcagaatgagatgtataccaaagaccacttacacatatttttatttattttatttattttattttatttttttttgagacggagtctcgctctgtcacccaggctggagtgcagtggtgcgatcttggctcactgcaacctctgcctcccaggttcaagcgattctcctgcctcagccttccgagtagctgggattacagacgtgtgtcaccacgcctggctaattttttgtatttttagtagggacggggtttcaccattttagccaggatggtctcgatctcctgacctcgtgatctgcccgctttggcctcccaaagtgctgggattacaggcatgagccacggtgcccggcccacatattttaaaaatatgcgcaaaataacaccaatctcagacctgcgtgcaaatcaaactacagattgggagggaagacacacaaaaatcacgggaatgggtcctgtggtaagaggagaaaaacgagattggggatgggctgaagggggccaaaaaataaggttaactaaaatacaattgagtccagcgcataccaacaaagacgccatgccttgaaccaagaagtatggctaattcattttgggcacatgaagtctttgcaagcagaaaaaaactaaaccaaaacaatacatcagttaatgtttaacagaagtggaaacagaactcaagggagtggctgtggctacccagaggtctaatatgcacccagaggtggcagaggttggtcactgtgaggtttggatagtgagggcagagggtggcctcaggcaactccaggggaaatcaggtgacccggaaccttcagtccctggtgattacttctaaaagactgatctcattctggggtgaccccatgtcatggccttgagtcactttactcacagaaattcggtcttcctgaggcactgctgactgctttcagggaacttgatggtcacaagattttcccacaaagattgttaccatggggtgctttccatctgttattaacctcaggtttctccagcaaagtcagcatatcctgggaacacagactcctcccgtccacttttgttgcctgctttcagtaaccaaaagctgtttctcaaacggcatgttatagaactcagactaggactgtgcagcttatttttcacatggcggggacgggggaagtggttctagctaacagctctggtaatgcttgaagtcccactcttggggaatgaaggggagaaagatagatgatgagttattttctgtctcctgaatccatccttctcttccttcctcttctccctcctttccttctcaaacatatatttactgctgagtacacaacaggcactgtgctaggcaccatgtgatttgagtctgacattatcacctgccctcaaggaggttaaaatctagtggggaggaagcaatgatatcaagcatgatggaagcgtaaggatgctttgagacacggaggcagacagctgcatctgatgggaaggtgtcagagacagcttggaggtggagcaccttgagctgagtctggaggaacataatggagtcaagaagaatgggaggaaccgggagaggtattcctgctggagaggacagcgtgggcactggctgggagcatgaaacagcgtgaatcactgggaggctgactgtagttcatcatgtctaggtttggtgctcaggactgaactcaggccctatcttctccctgaagcctgcagcaggtgccccaccccatcaagttccagcccccaccgccccccagctccacctactgacagtcgcttgtttcccttctgttctttctcttaggaatttttttggtgtgaagtcttcctttcccagtcttagagagggtcccaagaggccaatgcttctcccacccagtgctcagagctcttattccaccatggggatgtcttgcccgattctgagtgggtacagtgttcaccgaggaggcaggctgaggcagttggtagcagcactgaatcccaccccagcccattgggttttcagtctgaggggcttctccagtgtgtgcctgagcctggctgacacctgggccagtacgcaggtgaacattcttctgggaggggaactgaaagcctgttgtagccagtttctcagtgatcctgatctcctggttttcaggcccttgaatggtctcctgccacattgcatcagggtcggtctgcatggcccacaagtacagcagaagtgatggcatatgccttcgaggctagcttaagaaagacacggtgattagcctgcattagtttctgccttgggctgctcactatggaagccagctgctgtgttgtaaggatgttcacgcagccctctcagaggtcccagaggtgaggaactgacgcctcctgccaacagccatgtgaggacccatcttggacgtgaatcctcccgcctcatatcaagccctcacgtgacagcagctctgcttaatatcttgaccgcaacctcatgagagaccctgaaccagaacaactcaccttagtcgcgtccaaattcctgactctaagttaccattagagatgacacacgttttgctgttgaggctgctgtttcagggcaatttgttacatagcaatagataactcatgcaaagcacttggcaactctaagtggtttttcccactgcgtgtttggggaggcttctggactggggttttgcctcctctgccagacaggaaatattagggttcccaaaagatcacagcagctcactcaacagctccttccctcgctccttctctcttcccagcaaattgaaggtacttccctttaagcaaccaaaatccaacaacagatgcttcaacaatagatgcaaaaagaaatctgaattgggggagggtgagaaaagaaaaataagaaaaaagggaagaaaaagatccatccctgtgaggtctgagaataaaagaaggaaaaggaaaagaaaaaaaaaaaaaaagaaatcaccagtgaacccctacctggctaaaacagagttttctcctcatctccacccccagaggtctccagtcagggaggtgactggccttgggcactggtacattcccaaacactatgtaaacaagccccatcagacccttccagcctccgaagctgtcattgcctcccttttgctaagttggtatttaaacctttacctctggctgtacagcaaggtacttattaccgagtgctcccacatatgaatagacctcgtcttttttcccgttcgtatgtctattgtgagtcatttcacaaaccccctcctcaaacctaagttggtagaggaaaagacttttctcccagcaccctcaagtcaaagaaattcccaggggctgtcaagtgagaagttctggagcccactgcactgagtattctctctggtcaaaatgaactttcctaagaacaaccacctccaataggggagatgctgcagggaccccagatacacccaccacacccagatacaaatggccagaggcccttggaaacacagctcctggaccttaggtcatagctgaggcaccctctgacatacacaacgctgcatcatcgcctggtctgcagcagcttctttttgggttttggcttctttaacaaacacttagtgcttgctatgagtcaggctctcttctaagtatgttagaaatatgaagtcatttaatcctcacaacaacctgcctaggaaggtatttttacagataaggatcctggggcacagagaggtgaaacaatttgcccaaggccacacagtgcatgagtggcagggccagcctggctccatgctctgccctgagatgagaatggacccagggtccatttagtgagcattctgtgccaccagggcactgtttcttggccagcactcctggggctggacagggttgtgtatgttggtttgggctggggggaatccaggggtccatgtccaagcagggcatcagctcttgaggaagcaaggccatggccttactagagagaacttcgtcttccagggccaatctccacagtcagctgagggtctgcctgagccctgcccagggtaggaggggctcttgtgcgcaggctcatacctgcttcctcacccctgccaggtttgcccctatgtttcccaccttcctggaccagtgcccctcaactaagggcagttttgtcccccagaagacatctgacaatgtctaaaggcatttttgatagtcatgactagaaggctgctactggcatctagtgaacagaggccggagatgctgcgaaacagcctacaatgcacagaacaaagcctcaccacaaagaatggtctgtcagtagtgcggcggtgagaagccatgatctaggcccacctcacggcatccttaaggctgagaacccctcccgtgtgatctgtgtcttgttacagcaggggtccagcgtccttggagggccacacccatcctcactttggcgtctcccagaggctacaacagaaagtgaaggactcagtttgtactgcagcctcaagttcttggaaataaaataaggatgttgaggtcctggtaaatgtggtggccattattttgcatcaggctctgtgctgagcactttatatattttatcttatgtcattctcataagccagtctgtgatgctattattatccttcttttatagattgggaaactgaggctttaaaaaagtagcttgctcaaggtcacacagctaataaacctggtgacagtctgctttctagcctaaccaggccctggtatacatacttaggaaagtaaacatggtaaatgcccagggagagcccactcttggcctggcttatgtcctcccctgggatcagcacccctcactccacagcacagttgcagctgaagctctcagggccagctaattctcttcccctctctggttcttacagaaggaaggggaagagtacagagaagcaagagtagggttaatttttgtgcagggacagttaagacagagaggaaggggcagggaagagatggacaagggagggaggcctgggagctttttattatttattatagcaggggaaagaatgggaggtttgtttctaagccataaatactctcctttgatccctgtgtctatcagagataaattagtcactcttaggcctcagaaattaatgactgtcctaatgatcaccctaagtgaccttgcagcattcctaattctcaccactccctgcaaagtagctgtgtcagggtttggcaaggtttggggatgaggcaggactgagcgggatgaaggtgtaatttcattcctcagccccagcctcactttgcagagatgaaattggcctctactcctaaggccagagaacagtcagaaccagatcccaacttctgggctctgccctccctggctttgcttcaagcacagggatggggagcactgcgtaaggaagcttcagggccctgtggaattctgacctgggagagggtggatcccctaggggtgtgcaggcctgcgaggggcacctgaaagcaagagggcatttggatcaggttaacatctgacctctcagcaggccctgcccattcagactggggaagagctttgaagtttcctttgtgtgatgttttcatggccctgatcctactgtactggaattagcccgaggccctgccccttccctggagatttgttccccaactgcaaaagtcttagaaaaataccgcaagctccacccaccatccccacaccactgaatgctttttccttaggctaaaataccagggaggaaaaggcctcagaacccccaccaggagacattctgtgcgtgtttacagtttctcaagtggaaagcaaggacccctggaaccagatctgagggcaggtgcttcccagataagcatgttatggggtggggaggatggagtaagggagggagaagcaagattgtccctggaggcttcccaagccacgggccaggtccagaacagcaaggctgtgggttctggccagagagaagaggaagctggtgaagccaggccttccggccgtgctcagtgagcaaaccattgtgcctagtgtggccaaatatccatctcggggatctctctctgagcaccaatggcttctcctatactattgctcaagtccaccataaaagcagtgtttaaaaacgaagggagaggaagacaaaagagaggaaagcggagagagaaacgggaggagacggagagaagcaaggaatcccaaactagactgctagattctgctagattcggcttttcagagtaaagactctgagcaatagtgccatcttgtggctatgagtaggaattacaattagttttctctctctctctctctctctctctctctctctctctctctctctctctctctcaatctctctccccccctccctccctccctctctctctctctctctctctctttctctccccctccctccctccctctctctctctctctctctctctctctgtcgtctactcatggtgtttgcaactgcaggggcacaagccatggattttgtttccacccgagacaattgcctctcccccgacacctacaccccaaactactccagactctgcaccctcttctacacacctctggggtgagtccacatttgcccagtagaaatacctgctatctgatgtttgactcaactctaagactcattcaacaaatatttattgtgcttttattatgtgccaggcactgtcctaagatctgcggacctgactataaataaaaatgtctcctttcatgcactttacattttaactagggaggcaaatattaaacacatacatgtaaaatataatgggatgtagtaacaagtgcaataaaggaaaataaggcaggggattcagggctatttcagatagggtaattgatgagctacaactttttttttttttttcagagataaggtcttggtgtgttgcccaggctggtcttgaacccctagccttaagcagtcctcctgcctcagccttccaaagtgctgggattacaggtgtgagccactgtgcctggtgcagtcgcaacttttatcagcacagatatctgctaatatctgtgcaaaggcatagatgaggtgagggagtagggcaggtgagtatctgagggaaaaaggacctacaaacacaaagaccaaagccgtctgtctggatcttccctgagatgtgactccagagtagcagccaaagaatatgacactcaggaagtcatctagggttcgaggtgctaaagccaacttttttctttttccttttttgagacaaggtctttctctgttacccaggctggaatgcagtggcgcaaacacggctcactgcagccttgatctcatggactcaattgatcctcccacctcagcctccctagtagctgggactacaggtgggtgaccccatgcccgactaatttttgt

SEQ ID NO: 516 - DNA, 50586 bp, Homo sapiens
tggcctctctcttcagctgcttcatctgttcctccaataaaaacttccttggctttgttcttctgaactaagacaacctttggcttgattgggaactagtgttttggcctctctcttcagctgcttcttctgttcctccaaaggcactgcttgctccttccaccagctggcttcagagtctccagatttcataaactcatttgacttaagaaggactgtacccaggaatatgtacatttagaaaaagaaccggagaagtgagattcttagcacagtggaagtactggtgaatggaaaaatttcagaccacgtcatccccagtcctaggctgggtgtgtgtgtggcagggtatgtggggggtgggaggagatatgaggtagagggtgccctctgtgtgtgtgtgtgtgtgtgcatgtgcgtgcatgtgtgaaattaagaatcttttcaaattaaacccagcttgacactaccatccatatgtctagccccaactataagcaatttagggacaggtttaatcctgtcaatgaaccttgcctaagaagcaggcaaaccatcttctattcttatgctaggaaaatgtggatgcctggttttacaatagctataaatgcatatttcttctttcttttccacagtaaaaattctaattttctctaaggagtactactaggaaaacttcatagcatagtaagaaaacatgaaacctgaagtcagaaagaaagatgggaatcttagctctctcatttcctatctggtgggaccttgggcttatcacttgacttttatgggtgttagttttcctgtaaagaagtttgttgagagggttatgtgagatcacagaatgtgaaggaactagcgtggggtctgccatggtaggtggtcaatatatacataaaaattccctctccttcccaaaaggcaatcctcatgactactgaaagtgagactgtgcaaaaatcagggagatgtgagctgagttctgtttgtcttaaagtttgcttttatgatcaatttttgtaggaaaaaaaaagctgagattgagggggcagtggaaatcccagtgtatgtcaaactttctttgcatgatgggaaggtttacctggctgacctttaatactctttgtcaactgtaagattgggattctaattgagtgagaatcaccagcagttgccataatactctttagcgttgatagtcatgaggcaagagactgccctgttctcatgattgtttaagaccttgtgatctagaaccacgtggtgagtcagagtaggcaaggatgcaagccatcagagaggccaagatttgagcagtagctgcctgggcctccttgcttggtgctctgcaaataaatgccttactttctatcactgcaaaaaaaaaaaaaaaaaaaaaaaaaaaaggaaagaaagaaaagaaaagaaggaaaagaaaaagaaaaaaaaaaaaaaagagaaagagtaggcagtcaaggttatgctgctgtaacaaatagctcctaaatctcagtggcttaaaataacaagggcttatttcttacacatgcaacaggtccattgtgggtttgcagacagttagggacttaggctgaaggagcagtcacagtcactatttcaaatgttattggttggttgctagagcaggaagcctgctttggagggtctctcatggctgttacaactttcatgtagaagggccacacatataactcatgagctaggaagagtccccacagtggggacgaggacatgtgatacaccatgtgctcagaatagggagaactgggcctatttggtgagcagcactacgaatgactatcacgcctttgccatgggggtgccacactacatggggagtgcaagtggtgatcaaattgcccctcacccttctctttcttttgagttatttttatgaagtttcttgctcaaggggaattaccagatcaataatgtgaacagccttgtaactttcaatatgtctactaagcttggtttctgaagatagtacttatgggtactgaagatagatttatgggttttcccagagccttgctgggcttcccattttggtttgacctctttgtagctgtacagcccacttaatttctgtacacctacctttttcatataaaaatgatataatagtaattcctacttcatgggggctggactataagtgaaataacgtgtgcaaagtacacagcacagggtctggcctgcatctactcgctgctggctacctgctgtgtgactgttactcaagtaggcccaggtctttagatttgtcctcagttgcctttattcaacatgtagtgacattacgcatttttcaaggtgagagttaacattctgtatttctttatgcacaaaatataatatttgttcatctattttccctttttaagctaaatataaacagatattggcttcatatatttaaattaattcttcttactttcaagtggtaagcttttatcacatttctttcaccttttttttacattttgttacttgtttggatatggatggtttagattttgctgtgcaagtaatttttacccctatatgtaaaactcgtccttattgtctctgtcaaagtctcatgtgttttaggtagccagaaatttagctgagataattatatttttatatttttctacttaaaagagtagttttaattactgttttctgtcctccatccatttcccacaagtttccagcaaggttttcctcttccctttttccagctctaaggtcttgatagaattatggcagtgaaataatgattaggctagtaaaataataataataataataataataataatcatataataataaagcaaacttaccaagttaatttccccatgcagtattacaaaaatcttttatgggtcttacactaagtttccagcagttttctaaaactagacttcagttggtaaatcattccccaaaggagcaaagggaatattcctttttacggaaacaatggctcttgggaaacaatctctgcatgtggatatggtttcctggatcatgaagttggagtatgcgggggctgggctcaaggagctccagaacctggaaggcataagcccttttgaagaggacttggggatttcttaatgaaccttggtggcattagaatcgggcttgtagacagtcctttgtgaaaaacacagaatatgctttttctgtacaattatgttacgacacttgttgccccccaagtgttcgaaaagatcagggacagaagtattgcaatatagatgttcctcgacttacaatggggtaaataccaataaacccattgtaagttggaaatagcgttgtcacttaacttaccacttaacacttaacttacccaacatcacaacttagcctagtcttccttaaatgggctgagaatgcttacattagcctacagctgggcaaagtcatctaacacaaaacgtattttgtaataaagcgttgaatatctcatgtgatttattgaatactatactgaagtagggtttctattgaatgcttgttgtgtttgcagcattgtaaagtcaaaaaatcctaagttgaaccatcttatgtcgggaaaccatctgtactaatccagaaaatgcagatgcagattttaatagagttggggaaatgatgcttaatttcatttagctttacttttattttgccttgccatttatcttttttttcccttttaaatcagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggtacggctttaaaaaatgccattttactaaaatgtgttttctttttttactagccataaaagaaagacttaaaatatcgattttctgaagacagtgcacacacacacacgcacaaacacacacatggtttgcctttcatatctgtgagttccacatcctgggattcaaccaacctgggattgaaaatataaacaaataaacaaataaaataacagtacaatacaaataatacaaataagaaaccaacacagtgcatcatctactgtcacatgctgcatgacaaagtttcagtcaacagtaggctgcatgtacaatggtggtcttgtaagattataatggagctgagaaatttctattgcctagtgacatcatagctgtctcaacatcatagtgcaaaatattaccttttctatgtttagatatgtttatatgtacaaaaactgaccactgtgctccaattgcctacagtattcaggacagtaacatgctgtacaggtttgtcgcctaggagcagcaggctgtatcatgtcacttaggtgtgtaggaggctctaccatctaggcctgtgcgagtactctctatgacgttcacacaacaaagaaatcacttaaactgtttctcagaattatcccattgttaagtgacacatgactgtatttacacagggcatttacattgtattagtaatctacaagtaatctagagatgatttaaagtatatgggaggatatccgtaggttatatgcaaagatgacacccctttatataaaccacttacgcatctgtgttttggcacctgtggggaatgtttgctgaaaccaatcccccaaagaaactgagggatgactgtattttaaagaatttaaaagggccgtaattaatatgttctattagtccttatgtgggttgagtaaaggtacttgaaatagtgatttgtgaagacagagtacataacagctgaaggaaataactttttactgtaatttgtctacaaaaatgtagaaaaaagcttacataacaattttatagacatattaaaggagtttttttaaaaagtacatgacagctgggcgtggtggctcacacctataatcccagcactctggcaggccaaggcaggtagatcacctgaggtcaggagtttgagaccagcctggccaacatgtcaaaaccccatctctactaaaaataaaaaattagctgggcgtggtagtgggtgccagtaatcctggtgactcgggaggctgaagcaggagaatcacttgagccctggaggtggaggttgcagtgagccaagatcacgccattgcactccagcctgggaaacacagtgagactccatctcagaaaaaaaaaaaaaaaagcacatgatagcaaacttttgggttaagggagcaaatatgaacacaatttattcccttgtctggttgaatagatgttatttgatgtgctcattgctcctagtgagaacatcagatattgtcattagatattgcttatgtagaccggggttggaaaaccatggttgggccctggaatcaagttgtctcctggatttgaatggctcacaagccaacgatagttgtcacttttttaaatgttggaaaaaaagtaaaagaaggatattttatgatgtgaaaatcacataaaattaaaatttcagggtcggtaaattaagtttcactggacacagccacatcctcttgttgtagtactgtctgtagccgctttcacatggcctagttgtgatggagaccctgcagactccaagatccaaaatacttcctatttggccctttcctgaaaacattggtcaactcctgatagagaccctagattgatactgaaaagtacagttattggcttaatcattaatgagaattaaccctttaattgataataggttaagtagttggctggtttgtaactacagcatctctatataggatattgatttaatattagaaactttgaaatgattttctgaaagtagaggaaagtagccagctcctatgaataagctggctgagctctagaatgcattctctctctctctctctttttaatagagatagggtctcaccatgttggccaggctggcctcgaactcctgggttcaagtgatccttccacctcagcttcccacagtgctgagattataggtgcaagcccccaagcccagcctagaatgcattctcttttggtttgggaaaagcataaagaggacaaatgaaagtttttacctggagaggaaagagcacaggctctggcgtcaatgggtctgggtttgaaactctgttccttctctgatctgttgtgcagccgtggccgagtgactccacctctcgaacctgtttcctctgtaaagtggcaattaataactttcaccacctgggattgtttcaaagattaaatggaatcatgtgtatgaagcacccggtgcagtgcttgacatataaatggtgctcaataaatgtgcatggacaaagatgtcatggtgatgcttagtaatatttattcccttcataataatgatacctattactgcgcatgtactatatccaagcctgttctaaactccctgacatgcaacccgatgaagtaggaactgtaaatatcccccctttttacagttaaggacccataaggatgttcccaagatcacacagccagtagatggtgaagtcaaaactcaaacccaggaggccagttcccatacaccactggaatgactgtggtgctgggctctatttggcatttttcatatttgactactcatgcttagaacaatgaaatatctcctttcaattaaatatgttctaaagtggtacttcatgagccatgtggcaatttcaattttatctgtgttctcgttcggagtaagattctgaagtgactcaaggttatatttgactgttgcaaacgttgaataatcatgattttgaaagtgatgtccctgagaacattgtgtgctcattagggtgtttttagaaatcccattccgctctttctatttcctggaggccttgatcttgaggattctattctgcagagaccccagagaaccttgtgtccatataaaaagtgtggactcgtttcccctatttagtttttcttataacagagatttttctgttactgactcacaaaattgaaatgctttttaaagtaattactgcaacgtcatctcttctgagcattgttgtccaggtcatcatgacgatttatagtgctcttcccagatacttcctaaggcctgaaggtagcagtcaggacataaacatatttgtattttagatggcttactttgtcaaagaagagttcgtctcttttttttccccttggacaaatatgctctaactattgtagttaaccaaatctagcaattttatttgtttatatgttaacaaattccttcccctaataatacagtcaaacgtatgcccaaagtacaaaattggcaaagtaaataccaggacaattcttggattgcaaatcccacattggttgataatgatgatgtaattcatagcctttgagatgtatattggtataatgtcaacttaaaaaaacattttcccttaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagagtaagtacttgccattgaggcacctatctatcctggttcaataacaagcatgcagagaacaaatgacggtgcacgtagaattccttgcaggtctttggaatgaaggataacggaaaacagatccatcagctctcctgaagcatcaggttaataagacgtgtgtgatactttgaaaggtataaatcagggtgttgttctgagaacaggtgaacgaattgggaaggttatagggttgcaagatgaaggctaaaacacaccactcaagagagtcaaacagtggcttctgtagaaggtacccttggaaagtgtcctgtgaagctttgcacctatagggctagaggtcaccacatgctgtaactttatgttcaattttaggatacttcaattttattgggtattctaaccagagagctagccttgcacatccagtggaaattgccttttatttgtcttccctaaggtgggtctagctgcccttaatagcaatatttcaaatagtcagagctgccattgattaaaaggagtttcgtttgaaaatgctgttttgagcagtattggctattgtttcacatttgttcaacatttactccgtaccaactgtgtgccggacatggagacaggtgtaaccatgtgtaaatcctggactttgccttggagagtgggccacacttctttgttttttatactgaataatgatcacaactggggtcttttgaggggatttcagagagcttcagagacacgctaagtttaaataattggtctataaggggaaaatatatttttctcacagagcatccagagattcagttgcaccgcattttcccacggactgaggtgtcctgattgtgtttgttttacagtcctgtgaggattcgttcatatcagctccttgcttctggacaggccactgactcaggtctcctgaggctttccgtggaccggcacggtcctgtctctgcgatactgtgcatgaacactagggggcagccgccctacatgcctgtctgtgttgtgatcctcccaggatctcagtggctctcaaggggtggtcctgggccagcagcgcctcatcacctgggtactcaacagacatgcaaatctcgggtcccgtggagacctactgattgaaactggagtctgggggctgtcatctgtgtctcacaagcccccgggtgatgctggggaccctcaagtctaagaagcactgagatcctggaggcttctttctctccctggatgccccagctccatagggcagcgcgtgacttggaggaggggaggaaaaggcgtctggccgtggtcgaaaagccgtctgcccctcaggctgtcctgccatgctgtctaatgtgtactcatgtcaggatttcaaaatgctgtttcgtggaagtgaggatgatgaggcccgtcgtggagacaactcacagccctcaccccccaggtgtcctttttgctcatttcaggggcctcgtttctttctttcttttcttttctttttttttttttttttggtttttttttgaggcggagtctcgctctgccacccaggctggagtgcaatggcgcgatctcggctcactgcgacctctacctcccgggttcaagcgattatcctgtctcagcctcctgagtagctgggattacaggcttacgccaccaagcccagctaatttttgtatttttagtagagacaggggttcaccatgttggtcaggctggtctcgaactcctgacctgttgatccacctgcctcggcctcccaaagtgccgggattacaggcgtgagccactgcacccggccacctcctttctttacgttggctctaatcccttggagatccacttctgcctctccagagagtttatctcttcaattaacaaggcctctgtggccgaggccaggttacacactagccttccaaataggtgtttcttgagccctgtgccttttctagaagaactgagtcttgagtattttgtggcaggcactttggagaggtggagaaggtattttaggtcaggtcaagtttcggggaaaatctatctcgtggacctcataaacatgattgttttcaggaagtctgggagggaaatggttaattgtttatcatagagcaaggactgaagacctcctgtcagcggaatgtgtgtttggctgtggcctcttccagtaattgctctgctgggaaagtcattggccaaggatgctcgattttgtagagagcctgtttcctttgccagacaaagcctgactctcataatgactggccatactggaaaggataacttagttgattagccaaacaatgacttgaaccacagcgtcaaatgaaggctttcctaacggaatctcttttccttacatctttctcagaaaaaaaagaagagaccattcctgtgatcatttcccccctcaagaccatatcagcttctctgggtaaggcccacaaggaccatgcattccacgcacctgtgggggtgcctggtatcccaatgcagggggcttgggacccttgcgtctgctgatcatacctgctccttgggtgcaatgtgcctgggtggagaccttagaactccagtgtgtgaggctggaataacaagtgtgaggaaatatttccctttggccagtttggttagaaatggcataatctgaaaacaggtatactttgcttcatgcaaagcctacctataaaaatctgaatgtgaaaatctgaacgttctggcagcagttatcaactgcatgagaagatgaacagcatgaaccccaggcagagccagcaccctcagtgtatttaaaataattcacatcaccaaaacttggctggcgctctgcctctctctaagactccatttgtaaagtgggctcagctgtggtcagtttcttgttgccagaagagctggtaagctggttgaatggtgccatgaaaatgaccaatggggctttctgcttttcactccatgtggtacagtccatcctggccagcacaggtccacactagtggccagtgagggtacgtaagtgtactgtactaacaaccaactgatgctagtggtggggcggaattgatgtttattgaggatccactatgtccaatgggatcccattcaatctcaacatagaccctgtaggttttattctctcaattttccaaaaggaaaaagccacccagggcatcacgttggctcagtggaggccaaaaggccatgctcagagtcaggctggagttcagattcaggtctgtgtgcctataaaacctgcatccttttatgtgtttgtttctgggtagtgtttttgtaggtctgttactcatttatgaaaccctggctgcacagtcttttaaaaaacaatttatttgctttttccttttgtttagtgctggtttaaattttaaatttgaattggaggccatagaggaggagggcttttgtgcagttgctgggactgctggctggcacttgggttgccactgccacagtgcagtccccatggctgcagctctaggaacaaccacctggaaatctggggcaatgggcacatgggtgatacctactggagccccagtgttctggctccctggggcttcccagccaagttccaggcccagttcccaatcagttgctttggatgcactggaatgggtggtggggccacgtgacactgattagtaggttgttacggctgaggaagatctttaaggtcataggagtggcataggatggagaacggctggcattctcaacccgtggtggggccaggtgcattaaaagacacaccacagggagccatatcacccacgaggaaaaaacaagtgagaaggttttcttcttcttttccttctactcttctttgtgaatgaaaaaaaaaataatttcctatgattgaggcagggggacccagtacatcacactgcacaactgcagagggcaccatctatagaaaacacagagtttttggctgggcgtggtggctcatggctgtaatcccagcactttgggaggccgaggcaggtggatcacgaggttaggagatcgagaccatcctggctaacacggtgaaaccccatctctactaaaaaatacaaaaaaaattagccgggcgtggtggcgggtgcccgggtcccagctcctcggggcgccgaggcaggagaatggcgtgaaccggggaggcggagcttgcagtgagccgagatcgccccaccgcactccagcctgggcgacagagcgagactccatctcaaaaacaaaacaaaacaaaacaaaaaaaacacgagtttttaaagaagggttgatccccagtcagagtcatctgggaatggagagttcccaggagaaacattagagccaagaccagcctcaggcaaagagaaagaatccacacattgatctggattttctgaggtaactgaagtgaggggcagaggaagtcggcttgaatttagcatgtcccgtgggagcgcaggggccctggtgaagccatttaacttcaggtgcctcttggtttttgcctgccatgaagaccagttgtaggaaccagaggtacttcgtaaacagtaaagctctgtgtgaacagaatcatttgagaaaactaaattttctaccaaggaaagaattgggtggtgaggggtgtttgagaagccgaggagggactcagggctcaggtttgctggtgggtgggaggtgctggttctgcagttgacgtgctgtgccttgccatccacagggtcaagactgacaatcccgtgtaaggtgtttctgggaaccggcacacccttaaccaccatgctgtggtggacggccaatgacacccacatagagagcgcctacccgggaggccgcgtgaccgaggggccacgccagtaagtgggccagggtcttctgttgagaactctgtgggtttcgctcttccttttggagacagttatcactatgacccacataccacattaaaagttactttttttgattccaaactgttggatgtttagaatttaaaaaattgtattttgctaaaaattatcttgagaatcaaactttctctgtaaatacttaaaagttgagttgcagttgacatgttggtattgatgttgcattttgtagctgtttcattaaacattgatccttttattttcgcaagttaaaaaatattttggagttcatatctttccattttccactctgcaacctgactatcaaacattttcataaacccttaaaaagaccctgagacctagccacagtatctatagtacctcttctgtttctcagggagctgtgggctgccacaatctctaagggaggttaataattaaaaaaaagaaagaattcagttctcataagcagtcatctctagaaaatgttttcttactctgagactcgaacaatcagaccttttgtaagtgggaacttgttgcctgtgagggagaccattcaacattccaaattgtaactctttttaaaattacagttttgatactttgaattagcctgagcttttgcttgccaaatggttgtgttttttgaaagacttatcacaaaagatctttctggatgtaatttagtggataaaaactatgtgtgggtagcacaatcatgtgcttgcaagttctcattgcaaaagacctggccacaactaaatgcccatctcagcttactcatatgatccacttacttaaaggaacctatattccccctacaaatagaacaaaaatattcctagtggatccactcatctgtgtttttattcacactaacagttagtagtgaggtgtctacagattcctctaacactataaatggcagctatcctggccacagccattcccctgggctgtctgcaggtttccagagtgagagtcagcagtagagatgagaagagacggcaccactgagggctggagtcctggaaactccctgcccttcaatatacaagtgatttaatggtgagggactcaagtttcctcaaactagacgtttctgttcccatgactgtttttttttgttgttgttgttcattaagagacttaaaagatgaacttccccattatctaaccctgtagtgtaacaactgtttgatgccagtgaccgccaacttcagtgacactaaggccttcagggacaggcttagaaactgtcccaaatgaatcacaagtatggtggcaagagctcctaactttatgaaacttgaaaacaataaaagcgcaatgggtacttctaaaggagagtgtttagatgtctacattgtgaaagacaagcttgcattcgatacaatcataattaagtgaatgtttttttaactcagggaatattcagaaaataatgagaactacattgaagtgccattgatttttgatcctgtcacaagagaggatttgcacatggattttaaatgtgttgtccataataccctgagttttcagacactacgcaccacagtcaaggaaggtatgtatgtattttggggagcactataggagaatataacatgttgaatgttccatggatactagacaaatctacttgttctccaaatgattccatagaaattcccttgcattgtctgctagtggagagctgaaaagaaacctcccatttttaaagagttttggtagggtggaggctggactttgggagattatactcaaatgaaaaatttaaatagcaagctgatttttggaaaatggatgaaatggttctacagtaaacttcgaaatactctgtctgcatgtggctctgccttgggtcactaatcagctgtcttcgcatggcctctagaagagggtggattgttctttatcctgaagatgagaaacttcatcctctaagagctggggattgggagctacccagggttcagggcagctttagggtcaaagtcattatatgaccggaaataggtacaaggctacagccaaatcaacccagtgttcatttaaggacatttaaaaagaagaagaggaaaacccacattatcatttttgattaaattgatttcatatcaatgtttaattgttgagcaggagggagagctgccttgaatgtagtctctgttgacagcctgtagctaatggcaggcaagccaaagtgattcccagcatctcagtgatggctcgtggacaatcttacagcaataacataaatacaaattgctccaggtctccatgttttgctggggaggcagccacaaacacagtgtaaactggaaagccaatgatgtgttccagcctcaggacagggaatggcacccaactttcctccaactgtgcgctgtgcaccaccagcctcacactcacctgagccactggtcacaaacacagatctcaggacttactccagatccaccctgtcaaatattcctagggagaggctgcagcctgtgacacaaaaagctcctttcacagtgaagtttgagaatgagggcacacatgtgaagggtggcgtttcagatcatttccagatgagcaggctgggagagatggtggttgtacacatttacccacaaaaatcagaatgttccctctcggggtcagattagtgagcccaaggaacctgtggtttgtctggccctgatgctgggaacctttaaaattttccataacatgagccttgtccctgcatgtggctggccgtgactgatccagggaacacaggctgtaagtctttcaccaggactgagaggtgtattcaaacagctgcccagaatattacagctgaacttatttctaatctttgtggggttttaaaatgtgagaatcctctggagcaacaggctgaggtcatgtcgattcctggatgactaaacagactgtgatagataatagcttaaaaatgcaggattctagtctcatcaacaatgtgtctgataacactctgttctcacatttgctttttaactttttattcagagtctcttcctgtatttccataacacagagacgccaaggagcagaacataaaatagctggacccaagcaatcgtgttggcccctgcagctccattattcaaaatttattttcctttgctacttcctttgatcctcatgacacccatgctcattagaaaagggcagattgttcctggctctgtcacagttggccaactgtgacataaacagacagcatcttaaacgcacagtgtcccactgttggaacaaagttaaaccctcagcacttgcccacttaccctacgatgtttctaacagattttgccctatcacgctcgtttctctaatgccacagacatcactctcaaatatcctccatgttggtgtgagggatgtgctttctgaaaatcaatgcacatttatcaagaaaaacaaactccaatttctttcttatcttgtacacctgcattgccctgtcctcttgtacagtgagagactgttcagctcctgatgtgactctgttcttcccacagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaactccgtacgtcttctcttatggaagtggctgtgtctttttgagggactctgttctttgcctcagttgtctaccaaaggtgccacatttatagtggctttgtagtaaaggactaaagtcttacattctgttttttttttccctaaaaatcagtgacaacagtagatgtgcctgtgagtgggtgtgagtagctgtctgctacttgtgacctatttaacagaatgaggtgctcttaggcctgcatgagagtggaaaacatctacatgagttttgacattcattcaacaaaaacatattatgagtctattttgactagactctatgggagatgttgtacatacagtgatggttaagacatagtttgcctttcaggaagctggttgttcattttgagactgaaaagaataatttagtgctaaagcagaagaatcagcaagaattggtgaacttttttggaaagggctatccaaaaaatagcaattaaaaatacacacattggaatgtattagtgaactgagaattagacccaacttcataacaacatgtctgaaaatagaaggaagggcattaaaagaattgtagacaaactgaataaaatgtacccagagcctctttcatatcatataccaaaaataaaatccagatagataaatgagttcaattaaaaaaaaaaaaactccaatggcaggaaaatcagcacggctggtgactccacctttcaggtctctgttcaaatgtgaccttcccagagggaaggtccccagagaggaccttccttcctctctgtcccctcaccctgctttgtaccattgtagcttttatcaccaccagaccttccagtatagatttgcttgttgattttcaatttatgtttcccacccaaatggaagacccatgaggtcagagagattattttggtcccagctgtatttccagtacctcaaagcaggcatttaatgaatatttgcagaataaatgaagatgggatgaactctctcttgttcattaccaaaagacttgcaagagtaaaggtgagtaggcttaattacattataatttctgcacaacaaaataacaaaagcaaggtttagacaaaattgtgtcagacaagttcaaggaatgagtaactatcatgtgtagagttattcaaagtcatagaaaaggcatgtgtcttagtctttttgggctgctacaacaaaataccataactagggtggcttgtaaacaacagaaatttatttctcacagttttggaggttgagaagtccaagatcaaggtgcgagcagatttggtgtctggtgagggcccacttcctggctaatagacggcagccctcctgacttaatcacctcccaagggccacaactcctaataccattgtattggaggttagggtttcaacatatgaattttgggaggacacaaacattcagtttatagtagcatcatcaccctacagatgaaaaaatgtgagtaggggattgcagaagagacacacataaaggaactcatggaaaaatgacactttcagtaagaaccaggggatgtaaattagagcaaatttgagataccagtgcactcacacactatcaagtgtttaaaagtttttatgaaacactctcacactttaattcaatttataatttggtgctgggaagaagaaaggcaacatgagccaagtcagttgggtgctggaccagcttgcatcttcttgcaagagcccaggatgtgcctctcttcttggctctgttcagtgatgtcatgttggtagcttaaaatctgtggccattgtggagtctttacaccacagaaattggcagttgccacaaatcagcactctcttccccagtacataacaacaaggtttgagagatgcccagtgatactactcctgggaatttagcttaggaaataatttaataaaataaaatcattagagatataaaataatttaataaaacttattaccccaatgatgaaaaattatgcagcaattatcaattataatgatcaatactataatgaccaaattatcaaaattgtaagacttaaatgtttacagtgttaaggaaatattatacattgttttgtacaatttttatggttacaatattgacatttgtttgcatctagacaaggagaaaacttaaaaacttggactttgaaggcagactttgtgagttcaagttcaagcactgccacatggtgcctctgtgatcttgggcaaatcctttaatctcaaagtacatcaattttctcatctgaaaaatggggataatcacttagtccaaattaacttagctatttagctatattttatatttccatttttcctatttttctatttcaactatagtaactgtttaataatcaaaaacataggaggaatagacagaaataaaaattgttgtacttggactacgtgttgacaaaccacagcctgtgggccaaatgcagcctgccctctgtttctgtggattaagagtattaggaaacagccttgcctgtttgtttgcagactgtctttggccacttttgctctttgaagatagagttgagtagttgagatggcaaaacctagaatatttactatttggtcgtttacaggaaaagtttgccaatgcctggtttaggtgaaggcggttttgagcagttaacttttgaccctcgcttttctattttcctgttatcatctcctctttccttcttctgttttctaagcattcagggagggagaagtacggaggggccggcagaggcctttgaacaccttattagattttaaccggaaaggagaggagagtgaggtttgagaaggaggattcggtgaggacgttgcacagggttctttgactgcttctgccttttctttatcttcaggcttggggccacgcgcttgcatctctcttccttcctcgaacttctccagtgctctctggagtcccccgctttagattctggctgtttcagcaatgacccagaaaaggagctgactgcagccggaggagaaccaccatcggctttcagactctgccttgacctcacaggttacgcatttcctcccctccactatttcagaagtgtggggtcacacaggtagaaaagatgcgagacaatcggggaattttgagtgctggatttatgctaatattaaggaataagtgtgatatttgcattgctgcattcaaaaaaggttattatctaagaggcaaactaaatatttatttatttatttatttatttatttttttgagatggagtcttgctctgtcgtccaggctggagtgcagtggcgcgatctcagctcgccgcaagctccgcctcccgggttcacgccattctcctgcctcagcctcccgagtagctgggactacaggcgcccgccaccgtgcctggctaattttttttgtatttttagtagagacggggtttcaccgtggtctcgatctcctgacctcgtgatccaccagcctcggcctcccaaagtgctgggattacaggcgtgagccaccgagcctggctgaggcagactaaattttttatgggtgatgtgtgagatttgcttcgaagttatccagtggtggatgggagaatacatgaaataagattggccaaatgttgataactgttggccttggtgatgactgcaccctgcttccttatatcattctttctacttttgtatatgtttgaaaacttccataataaagagtaaaatacaatccagcaaaaactcaatacccgctagacaagagaatgtgtagctcttacaagtaataaaatgcactacagtaaaaaacaacatggaacaatatggatgaatcttagatatatattattgaatgagtcccagaaacatttcttagaatgatgtccttttacataaagtgaaaacaactaaagttaatatgctctctctcgaatatgtgaaagcatcttcatatatattcacacacacggttaaaatgtagtttttgtcatatatatgctcttaaatatagatgtgtgtgtgtgtgtgtgtgtttgtttggatagtgattacatcagggttgggatggattaggaaaacataaacttcattaagttctagatctcatgttaggtagtagactgtgattgtttactttattattaaacaaacagattaaaaaaaaacacaagctattcagggaccaatatagaatctgtgtcttgaaccaaggattatgactaacctaattctgtgtccctaagtccaatttgaacacacaaacagatggacaagtgaaacaatgtggtttcttttcttaaagtggcctatctcctctattttttgttgattctgttgttttaactttctgaaggtgaattttttcacccccaaccctacaaaggctggggagagggggtgataaatagtttttggaaacctcacacttccatgcactgcccacaggaaaaacccacgtcttatgtaataaatgccacttctgcaagaactaaggatgagagcagacatcaacaacagaagccaagaataatttatgagctaaaaaacaaatgtgatctctcaagtattttgaatgctatgggaatatatagggactctttcacagaaagggtgggatgtttgtttcttgtaagttcctcaaggcaggagccttctcgttccttgatgcaccccagcaccgggcacggtgtcttgctgcggcacaggcatttaagaagtgtctgcagaatggatacagcgtgtgtcacttggacttttccagcctgtgtgagcaaatgggtcttatcagtgggactcagctaagtttctctgctcctgtctctacactcaactctcattggttttttccatgatgtcctgccaatagttcacttggacacacaaaggtgctttgtgttttgtggttgctttcctgttcttgcggtcctcacccattggcatctctgcccatgccacccatcagggctactcgttactgctactgggctccaagaaggcattgccaccagtggagaagccatccagacgccacctgggctgtagcctctgccagcttccgtgctggagccagcttgtgcactcctgaaagctcctcctttcttggctcatgggttcagccagtcctcaaagcaggggtggtgggctagaaagctccctcccacagggctcaggcaccagcacattctcctcctccttggcatgcctgcaaaacccacttcctcattcttcagaaaagcaaagcaaaacaaaacctcctacaaaggaactcccagaacccactgcccagtggtttttcagaaactgcccagacagctaccagacccctggtggaggccgagcttcaggggccaggaactactactcagccagcttccaggacaaggggagagaaagctttagataaaaaagagtgggagaaataaagcaagaatgaaggaggagaaaccaacatctaaatgtctacattgtgcaagattttacatgttttgctcaattgaatcctcaaaaaaaaaaaaaaaaaaatccaccaggcaaagattataattcacattttagaggtaaggaaactgaagctcacctaatttaaaaattacctcctagagagtgtggtttagatgtgcagcagcaatgggcttcttaataccgaatcccaggattcgacagctgagaaacagctggcccatgcaggggctggtttgagtcaaggttacagtcaggagcagagcaaatatttgcttttctaggggaagactagctaccacaaagagttcatctcccgaaaccggtagaaggtacatctggaatctgggggaccagggggactgtaataaggattccttcacagggaaggaagaatcagaagtaggaaccgagtgtcctctcctacagtatttcccagctttttgttctcttagcctgtggcctgtgaccaatcaaggcgtcactgtcctactggatggaggtgaggcgtccagcgtgcagtcctgccgctgggtctgaggctactctctcaggaaataagagtgtgagtccctggatccttctgagcccactgcagggacaatgtggatttagcccccagaaagcacagaaacagctaagaacagtctgtgaattaaattagtctcaaagccatactatacctcaggctgactgttcaccttgttatatttcccaccccaaattgctgttttcaaatataggctttattattcaggtttggtgaggccaacagatcaggagacaatagccattgaaaatacagtggtatcccccagatcccagcaggaggggcacaccacaccatggcggttgggagggtgcccagagaagcactagggccgatcaggaggctgagggagtgaggggaaggtgtgggcgagagctcttccgatggtttctgtgggaaggagtgggtgaggcagggtaggcaggcttaggattggctggtttgaatggtttccttgggctcttggtgcatgggctgtccctcactgggtgtggatagtgaccctgagggtgagagttccataaaagaggtggttggggtgtggctctggattggtcgatttgcatttgaaaagcatgttgcagaagtaggcaagttgtttactatctctaggaattggctaaaccagggaaaggcccaggtatcaaagcaacaaggtcccacgtaccaaagcatcagaaacacatggttaatacaactgggacagccaagtgcaaaggggttgccggaaaaactccaataggcctgcgcactggggtggagacttgggaagttcaagccttttgcggcggggaggagcctggctcgtcctcttcctgggtggaaccagggattcaatctgcgaggcgggaagcacactagcagtgctctgcctttgcggagggtccctgtttctcttttttcccccctttttgcccaataaattccacttgtctcacccttcaaagtatctgcaagcctaatttctcatggccatgtgacaagaacctggctgttagctgaactaaggacaaaggtcctacaacacaattacatcctgccttgtctgctacagctcatcagaagctctgcacagaaattaagtggccaaaagtaaacagccaacaaaataaatatgctcccaattttattttattttattctctcaagaataccaaatatcctttatgaagcatggtaaaacaactgccataaaaccttagaagcgttagcagcaaaagcttagtgccgcatagaaatgtagtcttacatttgtagcctgggcaatatctaaaaaggatgtacactaagcctcaaaaattttaaaattaaagcctgagtttctccacagctccttcttgctccatcccagcaaagaggctgctccatccaggagaggggactgcagtcaaggctgtcttccgtcttctgcaaggaagggtgtggctccttagggcattgcattggcctcgcatgtccccttttaatgtgtcccaggcatttatacaagatcagcacagccctgaccccacctgcaatgaattttaagacaagccattctctggtccctggagcagtttttctggacaaatgttgctcccaggaatccatacccagcagtaacagtgaccacagcagcagttcggagatatcaggggaaagaatgggggatgcaggtggacctcagtccagtatcatcagcatccctctgctgattagagccacagggtggcccagtatcctcgttccgcaagccctccaggacattcttactcctgctgtcagtgggagcacctcgatttctatggttaggtctagaacccatgacttgggaatgttagctctctttggccaattattccagcaggaattagtgacagtaccacctttgtcacatctaggggaaatttcaccgtgcatcttatctcagcatttgggaccctgggctttcttgaataatcttcaggggtagctccccagtctcccaggctccagtccttttttggagactttcttccccatctagcatattcggagcttctcactgtgtttttcccgtaagcccatgatgatttggcttctgtcttagtgacagagcttccccactctgttgtcctcaaggcgacagggaccatgacctcctggtatggaactttctaggcctctgcaccttttctgagaagagggctcttccccagccgcactccaggtgcaaaatgaccctcagcagatcactcaaagtgcttccacccctgggtgagaatgaccttcttgccatgtactcctcagtatgcaattctcttcctcggcttttcaatgttcaagatgctgtatggtgtttctgttgcatagatattttttggaagtggagaggtatgcctcgagtgactgtgtaccagttaagcgtgggtcctcagcggcagactgggatcatctagagaggtgaaacaacaatgccactggtgtctggacccatgcccagggcctctgctgtaagtgattggggtcctgggggattctaatgagtggcatgggctggaacccctggtttgacttcttttctttctaacacctgtggtctggtactcccggccctttgctttttgtaccagaaattcattcattcacttactgctttatcctagcatactcctctagatttttgtctcatgtgggtcttccttgtgggagctttaaaatcagtaaatttagacttgccaaaacaccctctgtttctgattttaaagacaagcaaggcaaagtccctgtccaacacctccacgtccatctaggaagttcagtacttattcctggcgtgtccgtgtcccagtgttttcccccagtggtctgtttaactatccatgtgttcccctggatccctcagaggaatccagcctgatcgatgctgtttggaaagccgaggtctacaggtttcccaatgtcaaagacatgtcaaatgaatgaatggatgaaatacgttggtgcttggtatccgtcggcggtgggatgttctcacagctaacaaggaaggtcttccctgtaatctaaggagaagatttgactagtagcccaggaatcattccctcctgctcagttaccagtcttcttcctctttaagattgcctgctgccaggctgtcaatggcactccagccttgagctcctttatctcactgggaaaagaaccctcaagttctcccctttagtttcatccttaatgtgttcccaatgaaataggggacacttgggagtttggtgtgagcagagggtaacttttccaagtcatcatgggcacggttctgtgttttctgctctctggattcagtttcctgtttaaaagcctgaaagaatatcgctgttcggcacggagtacttgctgagctctgactaaatacaagtctgtgattaaattatttcagactctaataaaaatatttttagaagaaagtcctttgggaattatgtagagtgctgagtgcatttttctcggcaaacacttggacctgccttgtctttctgagtcagcttttcctcagctttgtccatcctggggaaactcaggagacgtatcttcaaagtcaaaaggctgggttgatttcagacacctcatggagataaaggatcccgataagacttctcatggtctgaccagcgcattttgtatatgtatttctcctctttcttcttcgtttaaccctttagctaaaacttttctgtaacacacttgaaatgtcaatctttcaagggagaaaatttatgaaggggttaccttcagcttcccttttctctgcacccccatccctgaaatacagacaatctggtagtagggtggggtggctttgggagggcacgagtttcttgactttctcatgccaactgacaatacctacaccaaaacttttaactaaatcacaatttttctccaatagcccagcattttctcaatttcttctagcttaaaagcagattttttttaaacttttattttaaattcaggggtacatgtgcaggtttgttacataggcaaacttgtgtcatgggggtttgttgtaaagattatttcatcacccaggtattaagcctagtacgcattagttatttttcctgatcctcatcctcctcccatcctccaccctttgataggccccattgtgtgttgttcccctctatgtgttcatgtgttctcatcattgagctcccacttacaagtgataacatgtggtatttggttttttgttcctgtgttagtttgctaaggataacggcctccagctccatccatgttcctgcgacggatatgatcttgttcttttttgtggttgcataattttccatgctgtaaatgtaccacatttttttcagtctgtcattgatgggtatttaggttgattccatgtctttgctgttgtgaatagtgttgcaatgaacataatgggtgcatgtatctttataacagaatgatttatgctcctctgcgaatgtacccaataaagtggttgctgggttgagtggtatttctgtctttaggtctttgaggaattgccatgcagtcttccacaatgattgaactaatttacactcctaccaactgtgtataagtattcctttttctccacaacctcgccagcatctggtttttttttttttttttgagacagagtcttgctctgtcacctctgtcgcccaggctggagtgcagtggcgagtggcgcattctcggctcactgcaagctccgcctcctgggttcatgccattctcctgcctcagcctcctgagtagctgggactacaggcgcccgccaccgtgcttggctttttaataatagccattctgactcgtgtgagatggtatctccttgtggttttggtttgcatttctctaatagtcagtgatgttgagcttttttcatatgattgttgactgcatgtatatcttcttttgaaaagtgtcttttcatgtcctttgtccactttttatggggttggttttttcttgtaaatttgtttaagttccttatagatgctggatattagacctctgtcagatgcatagttttcaaaatttttcccccattctatagattgtgtgtttactctgttgatagtttcttttgctgtgcagaagctctttagtttaattagattcaatttgtcaatttttgcttttgttgcaattgcttttagcatctttgtcataaaatgttttcccatgcctatatcctgaatgatattgcctaggttgtcttccagggtttttgtagttttggggtttacatttaactctttaaaccattttgagttaatttttgtatatggtgtaaggaaggggtccagttttaatttgcatatggctagccattattccatcaccatttattgaataaggagtcctttctccattgcttgtttttgtcaggtttgttgaagatcaaatagttgtaggtgtatggtcttatttctgggtgctctattctattcaattgatctatgtgtctgtttttgtaccagtaccatgcgttttggttgttgtagccctgtagtatagttcaaagttgggaagtgtgatgcctccagcttcgttctttttgcttaggattgttttggctattcaggctttttttggattccatatgaattttaaaatagttttttctagttctgtgaataatgtcaatggcagtttaataggcatagcattgaatctataaattgcattggacagtttggccattttaatgatattgattcttcttatccatgagcatagaatgtttttccatttgtttgtgtcatctctgattcctttctttctttctttctcctttctttccttccttccttctttctttctttcttagtttctttcttttctttctttcttccttcctttctttctttctgacagagtctcactctgtcccccatgctggaatgcagtgttgcaatctctgctcattgcaacctctgcctcccggggtcaagtgattcttctgcctcagcctgctgagtagctaggattacaagtgcacaccacaatgccaagctaatttttatatttttggcagagtcaagatttccccatgttgaccaggctggtttcgaactcctgacctcaattgatctatctgcctcggcctcccaaagtgctgggtttacaggtgtgagccaccacacctggcatctctgatgtccttgagcagtggtttgtagttctccttttagagatcttccacctcactggtcagctgtattcttgggcattttcgtctttttgtggcaattgtgaatgggagtttatgttgatttgattttcagcttgaatgttgttggtgtatggggatgctggtgatttttgcacattgatttttgtatcctgacattttgctgaatttgtttatcagcttaagaagcttttgggctgaggctatggggttttctagatattggatcatgtcatccacaaatggatagtttgacttcctctctttccatttggatgcccttcatttcttactccgtctgattgctctggccagaatttccaatgctatgttgaataggagtggtgacagagggcatccttgtgctggttttcagggggaatgcttccagcttttgcccatttggtatgatgttggctgtgggtttgttatatatgctcttattattttgaggtatgttccttcaatacctagtttactgagagtttttaacatgaatggatgttgaattttattgaaagccttttctgcgtctatgagataatcatgtggtttttgtctttagttctgtttatgtgatgtattgcatttattgatttgcatatgttgaatcagccttgcatcccggggataaagcctattcgatcattgcggataagcttttggacgtgctgctggatttggtttgccagtgttttgttgagaatttttgcattgatagtcttcaaggatattggcctaaagttttcttttttgttgtatctcaaaagcagatttcatttaaaaaatctattaaacagctattatgagatgctgcacttggtgagggttgggaaagacacaccagtggacagcacagtgcttccttcctctccaaaaacttgtgaaatgagtgggcatgacatcatcacaggactggaggacatcaacaatgtcagggtcagtgcctcttttggtttggccttttcctcgtggtcacaagatgattgttggagtgtcagacatagtgtctacattcctggcatgcagaagggaaagcaaaacatcagtcacgtttttacctgtatctggaagcccttccctgggctccctgaaggcttgtgcttatgtttcatcaactggaatttgccatatgggcttctctgtcccaagggagccatcccagtcttaagcactcaattttctactatacattagtgcagactttttaaaaggtttctaattttcattaattacagtcccagcttcctacgaacctagcaaaatgcttcaaagacagcaggatggccatgccacatgagccttcagatgtgtccctctgctctgcaacaaggatccgtgatctggttcccaggcctgcctttccttatcttggggcaacttattcccccagtggggatattgttttaaaggataaggggcagccagtgctccctgattttggaaaggaggtgaatctggggtaaggcaaaatgtcagctctacatgcagtacaacagtcccagagtgctcagtcagccaagacccagggtgggttgacacttacatacctgagttcctgttgagcacgtggcttattcttttatgctgagactctcagaaagaaagaaaggaaggaagaaagaaaggagaagagaggagagagggagagaggagaaagagagggagaaaaagaaaaagaaagatgagagcagagaagaaggaagaaaggaaggaaaaaggaagaaggaaggaaaaaaagagagtaagaaagaaaggagagggaaggaggaaggaagaaagaacaaaagaaaaagaaaaaaacaaacaaccaaataagcaaaaatatctaaactgaatcacagaggagaatgtagtcaatgcaagttaccacaatatgctgtgggaacacaggaggggagaagtggtgtccagggtggccatgtgtgtcagtggtggagggcaaataggaaagaggacaaggtcagtgcataaatcacaggtgaaagaacatcttgtgtattcattcattcattcattcattcgacaaatagtaatttttcctttcttggctagggaatacagacctgtcccctgtcctgtgggagcttaaatctcatgaagaagacagacaaagataatataatgacccagataaaatgtaaacttgtggaaagtgtagggaaggagagagctgtgtttgctgtaagtgggtataaccaggggatttcccccacccagggaggtcagagaaggatgtttaagggtgggtgagatttcaacacctcagaggagggcgagatatcctattaggagaaacagactgggcagtgagcagggctggaaagggctggccaggtgtagggaaagatgagtggtctggacccatgaaaatggcagggaatgaatgagagacaatgaggtacgaggctctgcgcctggcagtttctatgtttggagtttatgttacacttagaacaatcctgtaaggtaagaattcccttggtttttgttctcctggaggtagatcctgaggtaaagacttggatgcaggcaatttatgggggaagtgattccaggaagcaaggataagggggcagggagactggcccattctccctgcccagtcttaattggtgtttccatttaaggaaacaccatgctaagggtgacttacggaggtcacctgccgtggctgatggagttcgtgtccaccaggactttctcaaaagtacatacaagttctcccacaatttttttcttgaaggaatggacatagctcaagaattaggggttcctgagacaactactgcaggtgttgtattcattttaaagccaaggatcagaaaatttcagtcccttgcttaaatttacatggctggtaattgacagagcagggacttgaacttaggtggattgtgattgcaaagttcttactcttaccatcataatttgctgtcctcttccctatgtattaaaacataattgtctaatggatattaatgtcaatgttgctatgatattttttctaacattcattaattcttccagccctaaaggtgatgttgaacctctgattctgctacagtactaagatttattatgtcactggagggcagtgaagatatgatgtgacatgatgtacagagcaaaccaactggccctgtgagtacttaatccaagcataacattgtgaaagggataaaaatagagtctgtggtggattaaagatgcccatgaattctttgctacttctttcatttaaaaatggagtttaaatcctcttttcctaaatgcggggtggtcttagtgacttgattgaccaatagaatgagacagaagtgactttctgggacttctgggaatccctgcagcttgcaactggaactcttgaatggaacacttgctcttggagtcctgaggggccattgaaggtatccaactactctgaggctcccatgctggagagatcccaggtaagtgctccagttgagggtctcagctgaccccagtcttccagctgtccttgccaaggtgccagatgtatgagagcccctccagaccagaccatcttttagtccagtgccaccaagtcaactctgttgatgccacatggaacagacgaaccactcagctgtgccctgtccaaattcctgacctaaaaaattctgaggtaaaataacatatttttaatgttaaacttctaagttctgggctagttactcaggaagggaggactggaacatgaccaccactttctatttcctgtagtcactgcagtattactcttcttagcagactatgtagcatgtttaatgtaggctgaaatgttaggttgaagttcagctgtttggactaagttctgttatagacacatttagcaatcattggaagtttgggaaactctctttttctctgtttgttagcatgcctggaactttgaataatgcatctgaagaatctgcccgcataggtaaaaacatgctcccttcttgtcattgaattttaagctgtggacacaagtcttatgagttcatctataaacataagcatagaaagcagtagaagccacacctgtggtgaggagctctccatatggggttggtaagtaaagcaataatcatgggtatgctttctgagagaaagtatagcagaaagtagaacaaaatcttgggggaatgcccacagttaaagaggcaggcttgaaaggcataagaatgatatactagactttggggaatcagggggaagagtgggagggtggagagggagaaaacactacacattgagtactgtgtacactgctcgggtgacgggtgcaccagaatctcagaaatcactgctgaagaacttatctatataaccaaaactacctgttcccctaaaactattgaaatagaaaaataataaagaggcaagcttggaaggcaaggggatggtttgcagagctcacatcaaggatgggggagggtttcagcaggaggcattggtgtccaggtcacaaagatgtccaggataagatcatggcttacttgccttgcaggcaccctcatgatagttccctgtgacctcagttataagtttgtgtagtcatatatgtagtgttgggcaaaaaaactttttgtcactagttgtgttactgatttagtgaggcatctttgggagcaaagccttgccgtgattttgttttttatataaccacagccagctgtctcctgatatgcccttatccacttggtgtgtgggggaaccacactaccgagtctttggtctattttttacaacttttcacaaaggttgagttattagagcattctagttctgatctttttaaattttactttttaaaaaaattttaagttctgggatacatgtgcagaacatgcaggtttgttacataggtatacatgtgccatggtggtttactgcagctatcaaccctcatctaggttttaagccccacatgcattagtatttgtcctaatgctttccttcccttactccccactcccccgacagacccccatgtgtgatgttcccctcactgtgtccatgtgttctcataagacttgctcttgttcacttaaagttttaatctcatggtctagttcttttgattcactgctgtgtgcttgtggatgtagggggttggccacttcacatcccctttttctcccccgggctcacagctctgctttggttggtgctgtgggtgggggaaagagaaagccctcaaagaccccatggtggctgcctctggccaggcttctgtcctctcccttctggtggcgcggcctctctctcttgtcctgaatagccgcaggtatacttgctgcttcaagccagggctgctgtctggaggtgggggaaggagggcatgggctgttttctcgagggtgctagggagaatgggctcattctccacagttccctggggtttttgacgatgttaatacccccagtaccttgatcttttctggctgaggaatcctcaacattttagaccactgtcccgtagcacacctcccattaagaagaaaaggaggaaaggaggcttctctgagctctcactacatcccagacatcatggaaagcccttttaccaacgtcacctaatcaagtcctcttgatcctgaagaaaacagaggttgagaaggcaaagggctgcctggggccacagtgtggtgcatggtccgtggcctcgccaggcttctccctgagctcttccagtctggtgtttatcccacaccatgcacacatctcccaatcaatcactgtgcctctgagaacttcctttagctgaatggtgtgttgtttctagatgtgttaacccaaagttcatgcagttttccaaatgtggctgaagctgggttttgtgtaaacacaggatgcgggcttgacagcagccggctgcactgccctttcactagggtgggacaatgcaggagggatgctgccaggaaatggtcacagtgacccctgggtttcttttcagggctgtcatggatagattggagatctttatctcgcaaaatagtaaaggtgactttctggaagtcattttaagggaaaactgtaatctcaaactacttccagagaagtacaactatcattcctgtctactctccactactttgtcagagcttttaaacattttactagcttgcaattttactgcgtggaagacttgcaagtcatctgcaagggtgaggtttccctgtgtgctcactcattttaggtcatggagaagtattcatttgtcctgatggttggttttggtctccgggtttcctgtctagacccgctaaatgcctactggtctcatggctgcattttgaagtcatcaggttagacttggggcatgtttgaagtaggatctgaatccaggggaggcaatggcttcctgacaagggtagtttctcaaaacctgggattttcactcctgcaagttaggagtgggcatgatgagaatataaaatcatgaagcaactcaaatcagacttacttagtatactagaacaaggagggtatcccttgatgttggcagggacaaagaaagtgaattttctgtttaaatatcattaaggaagtgtgtggaagtcagtcacgaaggggtggtgcagactaaaacaccaaaaggttcaaatgagctctgagtcaatcaatgcgtgattaataagtaaggaatcacttcagggaattaggggtgtttcttttattaaaaaaaattaaaaatagaactatcatacaatccagcaatcttactactgggtatatatccaaaggaaataaaatgagtatgcggaagagatatctgcacccccccaccccgtttattgccgcactattcataatagccaagatgtagaacaaacctaagtgtccaacagtgaatgaatgggtgaagaagatgtggtgcatatacacaatggaatactattcagctatataaaagaaggaaatgttgttctttgtgacaacatgaatgaatctggaggacgctatgctaaatgaaataaaccaggtacacaaggacaaatactgcatgatctcccttgcatgtggaatctaaccaagttgaattcatagcagcagagggtagaatggtggctaccaggggttggggagggttggaagactttggtccaaagatacaacttttcagttagacaggaggattaagttctggagatctattgtacagcatggcaactgtagttaataacaatgtattgggtacttgaaaactgggtaaacatgtggagaaatagaaatgcttttacactgttggtgggagtgtcaattagttcaaccattgtggaagacagaatggtgattcctcaaggatctagaaccagaaatatcatttgacccagcaatcccattactgggtatataacgacaggaatataaatcattctacgataaagacacatgcacatgtatgtttattgtggcactatttacaatagcaaagacttggaaccaacccaaatgcccaccaatgatagactggataaagaaaatgtggcacatatacaccatggaatactatgcagtcatgaaaaagaatgagttcatgtcctttgcagggacatggatgaaactagaagtcaccattctcagcaaactaacacaagaacagaaaagcgaacaccgcatgttctcactcataagttggagtcgaacaatgagaacacatgggctcagggaggggaacatcacataccgaggcctgttggtggcggggtggggggaaggggagggagaacattaggacaaatacctaatgcatgtggggcttaaaacctagatgagggttgataggtacagcaaaccaccacggcacatgtattgtgccccagcaatttctggagcaggagaagcagggcacacctcgtgataggtggaagatctgacagggaagcttgactatcagaacagggagtgaccttgtggatcatgctgtcctcagaggtggcacaaaccaaagagcggggcttgccagagatctaggcgaagtcagagagaaagcatcatagcagcctgtgctcagaagtccctgggaacgtcctgaaccttccgagggtgaccctggagaaaacactcaccactgagtgactcacagcctcttctctgagccactgaagtcaaaacagggatccgaagcttgctcccggccacttcaccttgtcgttgagcatcctcttcctctggaaacactggcctcctagttcttggtcttttcttctcttctttcctgtagagtctgtgaaaaaaaaaagatgaactcacactttcatgtagttaatactaaacttaattaatcctggcaacagcctatgggaagggtgtggcattgcttactgcactgatttaattgagatctgaatagttctggggactaagatcccacaatcctagtttttttttttgttttgttggcaaaatcctgcctagttttttttgttttattgggggatcaagttcctggattgctatttgtagacagcatttaccttaaagcaggtgccttcaaaggagaaactccttactgttagaattttagacagcatggcagggtcttgaagtagatttgtgggaatttccctgggaccctcaggtcacatgaccatttattggccctgctctgcagggcaccttaggtgatgtattgcaaaggcagatcaagggaaagcagatgttgccatggaaatggccctgcccccattcattattaaaagttgttgttattgttgttttttggcagcatcaaatagcagtgaaaatttttgaggcagctgacctaaattttgaatgtgatctcatagtcagggttcttaaattagtgaaaacgaatatgcttcctacaggaaattatttaaaaagatgacacatgaggatttagtccagaagccactggattgaaaagatacctcagtgtgtccaacctgggcagaaaagtcctgccaaagaaacatttataaggttgcttttaaattggatttgataaaataaaagttacaataaaaaaataagctgggtttgagttaatagtagtaaaggcatgggtatatgttgttatttatttgagttatcagtgctggtatttttttaattgcatgaagtgagtttccaagagcagaattcccacccatactgggccatggaaagaggcgagtttaacttaagacagctcagtttgcattcatcgtttgggagccagttaaatggaaggtgaggtggcagttgttagtgccgcgtttgtcagtgggtggccgaggatggtgtcttgtccaactctgcggaactccggctgctgctctgttaacccagcaaggtcttctggtggtggctgcagactctgcactctcccctgtgccgggactctgggtcttgcttctgagggtttgctgcagtcaagggagagatattttcaatgcctcttggcaggggaaattatttcctgaattgagtccaagcaaaaaaggatcttctgtaatttggtgaagtatcgagtgccaggacacaccctgactggcaacatcactaaatgccctttgtgactgctggggctcagggttttattgtgtaagctcatttaggccaattttacgtgggcagcacatgtactgccagctggaacccttgttctgcagacagccatgactgtggaacatgtccagcacccatgaaaggcctggtagatgaataaatgtgcagaatgggtgtgggcctcagcagtgtctgaccaatacaaacagagctgcttgtgtttgggtcaacttttataagtggagatgatctggggctagaaccacaatgatcacatgtactgggtgatttgtggaagagaagtttatatactaaaactacatcactcttgaatatttctgaaaggacacataaaagaatgtgaagtgtggctctctctggggaggagaacaagggttctgggatgagcagaactacttttcactgaatttgctttaccaaatgcgtatgttcattttctgtttagataactagactgggtttctctagctatattaaagatcaccatgtgatcttagatgtacatcacttaacattgctgaatttcctgtttcttgtttgcaaaacaaaggatttgagctagagacttttaaatatctttctagctcttcatatggattcattttaagacaaaaatactgcaggaagtttttgtatctaaaaaccattttccatctaagttagttaagttgattatgacacctacagagggcatttcagcccctaatgcctgttccactgagggctaagacgatggtttatcttgacagcagcaagcccacagatgtcaaaggtcactcatacatccctccctgactcttaacatgggggaaggggagacagtgcatcacttccggtagatccaatagctgcaacagatcttcctctgtgtgtgtggatgagtgggactatttcaatctttttaagtcaagcccaaaactgggacttgggccaacagctgaaggaagccagcagcctgttggatcaggatgcacgaacacttcccaaatgcctcttcaaatggccttgttttcagaagccgtcctcttgttggacattgacaccagccggtgctttgaaagctgctgttgatggctggttggctggtatccttcaggaaacacttccaggatggaaatattcatgttttaccaaagccaaggagcttaaataaatagattgtgatttcttctctcagcggaggaatttaatgtgctagaggttattgttggccggccacggtggctcatgcctgtaatcctagcactttgggaggctgaggtgggtggatcacctgaggtcaggggttcgagaccagcctttccaacatggtgaaaccccatctctacgaaaaatacaaaaattagccaggcatggtggccagcacctgtaatcccagctatttgggaggctgtggcaggagaattgcttgaacctaggaggaggaggttgaagtgagccaagatcatgccattgcattccaggctgggtgacaagagcgagaccctgtctcaaaacgaaaaaaaaaaatagaggttactgttaacatccagttgaggccaacagataaaatgaagttagttctggaaggattttgccttaccatggctgcaatgggctcactaagtcaaaacctagtggaagtcctgggaagtgaggtcatcccaggattgtggtttgaagagccccaggaagagggaggcagcacgtgctggagggcctggtggtgtctcaggaaagacctcacttaggccaagtgccattgtgtgagtgaaaccactggggtcttcttggactgaggccagaaatgcaattttgttggtgatcgaagatgttcagactcccaagggtcggctccttcaaatcattctcattccaaagtgctgatttgttaattatagcagggatgtctctttccgttatttatggaggtatctggggactgaattaggcatctgaaggcagcttggggagtgtgaaatgaatgtcagtggaatcactgcctggcgagtatgaggtcaatgcctgacggaactttcaaacagcatagcgcagccattaagagcatggttcctggacccaaagtaccctggactgagtcccagcctctattaaattgggaacattggagaagtttcctgaactttctttctctgtctctgttttcatatctaggagttgatataatttcatcagataatttcaaggtttggtgtgaggattaaatgagatattacatgctaagcacctagaacaatgccaggcacatggaagcactggggtgtgtgagttgcaatcatcatcatcgtcattatctggggcagggctcagcagacttttctgtagagggtgagagagtaaatatttcaggcttttctggccacaccgtctctattgcaatgacttaattctgctgttatatttcaaaagcagtcataggcaatatgaaagcaaatgggcgtggctgtgttccagtaaagttttatttatagaaataggtgatatgtggggttctgtcctgtggctgtcgtttgcctgacctctcatctatagaattaccatgatactgaaacactaggtagaaattactgagtcagagcaagggctaaaaagaggaatgtttagtctttctccttaattcaataactatcctatactttgtgggcaggtagggagaccgaggcacccattctcatattgtgaagttggtaaaattcaactctcttgactcttatattttagttccttctctccaatcctgggcagcccagtagtcacatggctggaaataatccattttgatcatttgcggtggagttagagacaaaattcctaaccaagggctagctaccagaaaggaatattaaagtatcatgacggatggaatctccattaaaaggagatcttagtggccaatgtcagatgcttctgtcccctcaatggcatcccatctaaggggatgtgtgatgaactcacagccagccttgaccaacagcaccctccaaggacagcaaatatgatggctggagtctgaactgcccttagacccgcgggagggcccttgcgccaggccgtacaccagaacccaaagacttccttcaaaacatattttcggttgcataggaaagtgttttgaaagtttagctgaaaattgagcaaaaggaaatagtggaagaaggttgccagaggatgccatgaagggaggaggaaatcgctggcttgctcttgggatccagagaaagtgctgcttttgtttcaagctgacttccccaaactacccgaagtgaatgtctaggtaggagctgggttcgcagaataactgtgccccctccctcctctttgtggagagggtgtagttttggaccggcttagaaatccggagtgagaaaagtgaggcgtggaactggggtggggacctgtcactccaggtgcttggtcctagttctccctagttgggtcactgtgttactgctcaggcttgcagcagcctggatgagctgggaagggggtccttaggttttggggtgaggggatcccctggacacattccctggacacaaataggtaggaattcagattaacattcttaggggtacattaagtaactttgagctctctcagcaggtgccatgtgagtctccatgtgtggttgtgttttaagcccaggaagtgctaggagtaagctggaataagctagaactcacagctggttcttccacatagaggtgggtgacctgtgttctgggaccgcttgatttctccagttcatcttctgaacatgtcccctctagatatgttattcacaccgccttggctttagtccaagctattctagctggggtacggtcctttcccttcaaagcaatcattcattcatcaaattttacacatctataggtctaagtaaaacaaaaattctcagaattctagttaattactgttatttgtatgtgtgtgtatgtatacatatatgtgtgtacatatgcgcatatattttattatgttttaaaaacttgtctcctatattttctaattacgaggagtgttggggtagtggatgtatgcagggtaaaaaaaatcaaaagttttttcaaactctcaaaagtggagaagtctgctttgtcatcagaatgtgtattcctagggccttcacatctttggtctgattaaatcattttaataccatctctaagacagcaaaggcaaatgctacagtattacgtttagttcacagatgggaaattgagacagggaacttaaagtagcaaatgtccagtgttgcaaaaccagtacctgaaccaaacctagaacccaggtctttgacttgtggctgataagttggggtgcttaaaccttcctgaattccatggtgtcttagcatcttttcttttcttctttttgttcactttaaattttaaattagtcaattctgtaatgttagtaactgaccgtctgctcacacggaagtcatttatttgctactttcaaccattcagaatggagttaagaatttggaattacctcttaaacagctaaaatagacatcacgttagttatctattgctatttaacaaaatttcttgaagactcagttgcctgaacaatgataatcatatattcgccccagtttctgaaggccagctgtttaggagtggcatggctgagtggttgtagctcaggtctttcatgaggttgcagataagacgtcagccagggctactgtcatctgaaggctcaactaggtctgggtgatcggtttccaagatggcttacaactggaaaattggtgccattgatttagctattggcaggggagctcagttcctggccacatggactctccacagggcagcttgattgtgtcttcctgacatggcagctggctttctccagagtgtgtgatcacaaagttcatgatggaagctgcaataccttttatgatctagccttgggatctacctcccataatttctactggtcagtcctgatttaatagtttaatatactctcagggccttatttttccccttctgtaaaataaaggtgtccctaggtgacacacattttccttacaaagccagcattctgtgacttacaataactatgtgatagaatcttagtgaaggacattcatgtggctgatagtgcagaggtgagaatggcaatgattcaagggctaacacctttgctgcctgggcttttcttcaccatttccaagtgagacccacagtgagatggcctgggaacacagcactaggacctctaattccagctccatcattgaatagctttatgatcttgggcattgactgtcttgggatttctatcagagtatcaacctcccaagattgtagtaaggacagtgccaatgacagggtttggcgcatagtgtttgagcaatagcctttgattatgataacttctaacatgctccgtagtggactgaggatgcatgagaatcctggtccaccagcaacagcaggatagaacatggagccatggtttctgagctcgttattaacaaaacatcttagtgagggcggagcagtaattagattctccagaaaacattggacttcagtttcctggaagtgcttttatagctttgtaataccacagaagtaaacatttttctcttctgcaattgaagggctgagtgagtccactgagcgttctcttctttgggagtgtttcctttggataacattcaaaacagcaaaatcctattacccattccagagtggaaagccccattttgactgtgtttggccaaagattaacttcaaattaatacctaatgagcaggcaacttctctcaacatatttattaaagtcatatttcaagatttctaatgtatatggttttcacttaggaccttttttctgaatcatggtcaaaatatatagacgaataaaaatgtaaaactttttacacataatcccacttatttatgactaagcacttatattagtaaatttttttttatttgcaagtgacagcttatctcaaagtagcataagagagggagagagagaggaaagaaagaacctattggctcataaaatgcttgagtaagactcagaaacagatgataacagcttcaggcatggctagatccaagggccattagggtgttttatctcagtgtttcttggacaggcatattagccattggtagctcaaggcataccttatatttgcacagcagcccacatgaggaaagatcacctcccctgacatttctggctgaaagagcccagggaacagtctgacttgttcagcttgtgtcccgtgctcctccctgggcctgtcactgtgtccatgaggatgatgtcatctatctgatgagaccagcctggccaacatgatgaaaccccgcctctactaaaaatacaaaaattagctgggtgtggtggtgggcgcctgaagtcccagttacttggaaggcagaggcgtgagaattgcttgaacctgagaggtggaggttgcagttagccgagattgtgccactgccctccagcctgggcgacagagctagactctgtctcaaataaaacaaaacaaaataaaataaaataaaataataaataaataaataaataaataaactaaataatctgcttgatgaggcctgagagacacgtcctcacgtccctaaccattctacaactcaaatagtgtcagtctgcctttgcatcaatgtctcctcatttctacaaatagtaagaaaaatattcttctggtttatttcttaacgctgtcatgtaggtaaattgatgatcaggtgattgccttccgtcgtgtgcttgatttttctgggagtgcagtgttgcatggcaaagacaggtagagacatctacaatgttaagtaagacgcaggcttccaaacccaaggccggccactctagctgggattcttggaggggtatggctcctcttcccttctctttttgggatagagagagagctccgtctcttcctgagtttttaagtccctggctatttcatccagagcccaaagtagaaagtcaggttaatgtgaaaagcttgatatgtattcttgataaaaactcaaagcctttgcagagtcttgcattggttgaaatcaggggctggcgcctccaaatgaaaggcagccaccattcgtgttgactgacgctcaaagccatgccatttctgacgagtctatgtccaatgccaagtctgtggtgtttttttttttttttttttcccttttcagaaatgaaggagtggaatcactggggatacctcccgcaataggaaagccccttgagaactgaaacaagtcatctgtttctcaggaggagctgaccaagagccccctcctttcgtgtgaatttaaattccccttttcatgagacttttcttaaagacaaggaaaaaaagctatcaggggaaaatgaataatatgacatcgaaagtattgaaaggcttgaaatgatcccacatgtgtcatctgactttgagaggtgaaggggctcccgtctgtacgtagagaggctggcgtgctgcctggattacttgtctgatgtcacatgctaatgggatcccagctagaatgctggcaactctgactgtaacaacctcagacacctttgcgcacagcttcagtttcaaattaattttcacatcctccttaggaaactgggccctccgtaatcaacagaactctgcatcgcacatcctaacattgaaactcacctgagcacaaggatcctacagttctcctagacagacctcaagaacccgcacagaccctcggggcacactcccctgtgtgttttggaacaaatagtcactctctgtgttttcaaatgtcctttggccttttgtcaaatccacactgacctcttttcaaatgcgtgtggtcagtgttatttttcaaaggccctttgaagtttgctttgttgccttccctccctgtgggtcacagagcaattactggaagatttgtgggaggccgcttttggctttgtgtacatgtgaacgcctgtttataaatcaggtgagttaagaactgtgatgtgggggtccccagcttccagctagcagcagcttcccaattccttctgcgtgaggatcaccagaaaataaccaaagccaaaatttcattctgagtctgtggggttttctacaacaggtcccgtgtcttctttcttggccccatccttccctgtggcttccctctccttggagttaaatactggctggatgtcaggctggggaccctcagtgcaccccactggcccaagtggggcaccgggagcgtgttccaggcctgccaaggtggcagtgtgtgcatcccctctctcagggttcttctagctgtaatttcaagattgggagcttttcctgacagcgcagagtccacttgccctacatttaattgacttcacaaactttcagttccctgtctgtaaatggggttagtatgtaaatgggactgctgcaaggatacatgagagaatacctatgggattagagggacccttgtcctcaccactccatcaggcaaggagggaagcccccgtcagattaattggataactggagctgcctgcagtcataaaacgaaatcatgtttgtatagggacctctacgatccagacacatcacttcattgcatcctcatgcccatcctgtgcggaggttatggttgttacctcattttgacaatgaagcatcaaaggttgagaggtaaagagacttttcactctgtaacctatctttttcccactagggtggaaccactcataaataactgtattcataaaatgttacagttccgtgggaaacaacgcaacttggcaactcgtagaaagactttgtgagactatgtggggctatttgtatcttaagctaattgaggcaaagagctagggaaggagacgggctttctatcacagccctgcctccgtcctttccttatgaggattccagactctcccacatatcgtgtacctgatgacaaggcacaggataaggtgaccagaggtgctcagacagtggctttctcaccagaggtaatgacattctgatcaagattggattgatcactggctcttctcatgccacattttcacatcaagtgttgaaggccactgtcttcttctttgtcctgtggttacacaacattgagtggaggaatgttctggccgtgtgtccacacagccttgaggcatcccaagagagtgggaagatcaaagatttgggaatcagaaaaagcaagtgagaagaccagtgctgtcatccaacagctgtgtgcctggaatcactctgacctgtctcaacttcattttactcttttgtaatatgggtttttgacacctacattgcatggctattgtgaggatttaatgagataaagtatgtaaagttcttgtcacagaagacagtcaacaagttaaagctgacatgtccttccacctcgagggtctcaaacctcaagtgcatgctgtctctatctctctctctctctgtcccctctcatcgtacccttacaccctttggacaattatgtgacctctcagagcctcagtgtcttcaactctaatagagaatcacagagttgctggaatgcccaggacaacgaaattctaaattaatgctttcaatcccaggtgcagtttccctgtgtttgtgcagggctgggccgagttaggagcctgaatctctctccacctccatggcttctccaggaggcttcatcttgctgcggaggtggactgcagatggccactgccaccactcctcagagggcatgttatactggtggagttaataactgacacctgggagattaggtctgtggctctcctttctctctagtgatgatcagttctatccatggggactcagaacggagggccagagaggactgcagaaacaaagtccagagatgtgaagtgacttgtccaagatcccaaagcttgtccatgtctgaatcacgataaacaacttcagggatggtctctctatgatatttaaaacagtgtgtgttgtcttctgcttttcctttgatttggagcctgctgttataacactgtcttgttggactgccacgtgtccactgggaattgctcccagagcagaattggactcagcagggctgcagcggagtgtggtgaaaggactgctgaacagggtggggagcagaggtctgagggccagtctccctatccactgctgacttttcttgggtatttgaggttttcctaggtttaaattagttgaataaaatagatagttttcaggccttttgattgttcaatgctctggaattggagccctttggacagaagaaatttacatgtcaccttaaaacatacataaaaaagtgcaaagctgctccagttgaagttagaagaggaaagcaagaacctctttccctgggcacccctgaagcacattgcggaaccctgggcctcctcagagcacagtctggaaacctccagactggaggcctctaagatcttctggtgggatgataagtgtgagatgcatccagaggtactaccaaagatcttcacttctccagggtcctcccaggaatatacatttgtctcagaagccagcaaactcccttgtcttcccttcacttcctgcccatgtgccaaggtggtaggtttcagagttaatggaaagctgggacttgaccctgttcctcaaggagcttattcttaaactttcaaggcagatgccccacgaatgtttgaaaaatagatgaaaacacctcttttgagggatacagaagccaaaaactgtgcctagcacccagtcctcagtaagaagtacatttggcatggtgcccagagcatatatgcttatccatatgaatgccataaaaaacctggagagaatccattctctttgtttcattaaaaagatgctggtggtgagccactgacgtgcttttgtgatcccttaatgggttgtgctctggagaacgctggcacgggtgtgctcactggttactccctgcaaccacactggggtcacatttaggtctcttttgctacatctaaggtcagcaaactatgacccactgacaaactgtgggtggtcacctacttctgtatggctcagggacactctgcaagcgctgtgagctgcaggacccaagctgaggtggttccatctgtccctgtcccctacttggcttccagcacctgcctcccctgccagaggactcaccttcctgccacacagggcccatgctggtcactcctacagcatgggggctctgctgttgcaatgcggggcgccaggctgcagaatctaagtctgggaattggtgacgtgttagcttcacttccgttcagctgtccagagggagggggccgggatctccaggaggagctggtttggttgtccctggggcaaagagagaaaatgaccgtggtggccaagtccccttcaactccctaagcccactgagctggcttgccaggcccctccctccatcaggctgcccttcttcccaggaccgtctccagtgggttcagggcacactgtgcctgcccacaggaagcccaccccaggcagatagggccaggcatgcagaggtttctctcttgttatagaagtatctacattatataaatacacacacatatatcatatatattttatgtatatataacatatgaaatatgcttcttggcctacagtgtctaaaatatttactattttagaaatgtttgcctctcccagtgctacctgattatggctgtgcgttacatgaccctataaagatttaactgcttttaataacaataaacaataatattagctaccatttattgaggctcagaaaggttgagtaacttgcctaaagtcacacagctagtaaatggcagagcgggatcttgcagtgatggtttcgagggagaggagaatcactgacagacttggttcctgccatgcagatgcaggcgtcccctgggacttcagcttctccagggccaccctcactccagaactgctggtcagctctgtgacccatctctcctcatgagcttgctctggggtggctgccaaagcttctttttaattattatggtcatgcgtgagaacactggggccagaagcttctatttttccagcgttttctttcctgtggggcctcccagcttcagccattcctttgtaacttggctgacacccctccagtttccacttcacttcatgggttcagagaagagaccatggttgctaagccctgctgagtgtcatttctggtgtgtcagagttgacaattctcctgcttcttgactactcctgactcatctttacagaacagacacatctcacttcttgagcatcactgaagaatgttctgtaaagtaaaatttccaggaaacagagcttactgctcagaacactcaactttagaaacttggaactattttgcacattaatctttgcagaatcaatttcaccatggcttgcactctgaagcagagctcatggcacacatttaaccttttctgaaaacttagtacacccacgcattcttaagcagaggtcattgcatacatttaatcttttcttggta

SEQ ID NO: 517 - DNA, 20001 bp, Homo sapiens
ccattcagtgtagtttaattattgttattatgattatgtcatctctcagaaataataaatcagattcctgagcctgtaagatgggagagaagacctggaattccagaaaaattattccaggagtgtcctactctgcccgactcccatgggatttcataaaacagaataatttcagaaaataaaagggaggaggtggagaccaaaaaaaagattgctaacgttttatgttatcaagtaagacgttaaaattcaatcaaacaaaacaaagcaagccacaaatgaaacaaataagcctgctatcacctaacctcgccattgtttctaagcaaaagggcatttcaacatcaaaatgtcacaaagaaataatcttagaatgaagaatggtactttgtataaatttaaattaagtgatgaaaacatcacttaatttattccatttcctgtttaatagaggtcagtgaaaacgttatctcttttggtgccagtatgtggacaaacatttggaaaagattggtggagtccactttgccaagtctgctgtcatccaactagttgatgttgctggtagacacctacattgcttctctgtttctatgcaaggtcacactacaattaatagagtgctctgtttttctataatcagttttgtggacaaatatcgtgcatataatctgaccatgtcaggctgcagagagttactgctggtactgaccatgtcagactgcagagagttactgctgatactgagatagaatagaagatcacatgaaaattttaattttctccttaaaaatttctaacacttgtcaagcatatattattatgttccagacgctgtttcaaggttttatgtaaatatattcttttaccaaagctccacagcattctttttagtaggtgaaattactattctcatttacagaaaaggtgtataaggcatacagaggttcagtgtcacaatctagtaaatagtgagctcttactccatcacccaactcaactcatcatctcttcatctgcagagcttgtcatcttgtgagggagttggtcacataaccagatttttaacaatgtaagactgaggcaagcataaatgacttaggaatatatagaattaattattggaccatcctgaggtccaggctgcttctccctcctcctcttcctcctcctcctccccctcctcctccgtcttctcctcctcctcttcctccccttcctcctcccttcctcctccttttcctcctcctcctccccatcctcctactcctcctccttctcttctcctcctcctcctccttcttctttttctccttcttcttctttattcttcctcttgaaggagtttttcttttgtataacattaatatttggtggggtgcagtggctcacacctgtaatcccagcactttgggaggctgaggcgggctgatcaaggtcaagagatcgggaccatcctggccaacatggtgaaaccccgtctctactaaaaatacaaaaattagctgggcgtggtggtgcatgcctgtagtcccagctacttgggaggctaaggcaggagaatcatttgaactcgggaggcggagcttgcagtgagccgagatcgcaccactgcattccagcctggcaacagagtgagactctgtctcaaaaacaaaacaaaaccaaacaaaaaccaaaaaacattaatatttataggttagtctactatgataatggaatttgaggggcagaaaactttcttgctatgctcccttcactatttattgcaagggaatatctgtaagcaagagggtgactttatatggctgttgacatcatagattttgtttgcttcttttctgtttggttaattaagttaagcttttaacaaatctaaaccctggatctaaacatgcctatacatagaaaagataaataatacatgcttcattgtatctgaagcatttatatctacagtttttaaggtttggcatggaacttcttggagtacatttatttcctacttggaatattaaaaaatgagacaataccaccagaaaagaacacaaaaggcctagcacaaagggctggagtctctcctgatactgaactctacttcctcccatagcatgctgagggagggattcccactgttggagtgggaagcattttagtaacatggttctcatgaaggtatgttaatactgaaacatatattaagcctactctctgtgaaatcaggcttggttgggactattattctactcctatggcacatggaggccatgtgatcaataatacttcttaaaatcctgctgttttaattcaatgagtttagtgcctagagatcgcaactataagagagcaagggaaatgatgcaagagagcaaaagagagctaattcatgcatggccttgcaggctttgttaagaagcatgcaaatggttggaaatcactggtgaattttaagcaatgaatctcaaatggtcagatagaaatgtggaatattcacatggcagtgtggaagatgaattaagaggtcaaagattggagaagaagctattgtaattattagatagtaggagcttgggctgtaaagtcagataggccaatgttcaaaccccaggtctactacctaatagctgctttgaaacctgaaaagcagcttcaatctttctaagcctccgcttcttacctatatggaggaagatagggtaaatgggcagggttatttgagatgtaagagattatttgaatagagtgttccacagagcacctgccatattaaataaatagcattattatgtcatgcaatttttaggtgtccatcacatttttccattcatatgcaatgctaatatcagaaaattcttggaaagctaatgacatttttttctttgtgcaactcagtataaaacctagaatgaaaacttcaccatgaaaagcacttactgcttaaaattaaccctgatgaacatacacatgattgacagaacatcttaacctgaaactgaggagtataactctctgatgggagagaaagaagggatgaacaaattgcacaacaagaggctggtcggtggtgagcatgttgagagcagaggcaaatactgcacaaaaggctggacctactagttagattcatctgcagtctggctcaagctaaaaatcctagttctttctcctcataagcttttctgagttttcgatattatttcctcataaaatagcactttgtatcaaaatggaattccttgaatgcaatttaagactgggtctgtgttattactaagtgatcctctagctccattttttgcctctacaagtagtttccaaagtagaatctgtagtcttgcaggtggtttgaagtggctttttggaaccagtaatactcttgcagtagactgtatttattcagtggtgaagcaatgaggtcattgtcatcctctagaataatgggtttatttgacggcgtcagatgtctacattcgaacagaaacactgctgctccaatcagcagtgaatttaattggatactttttggttaaaactctggaagaacaacttttggacacagaatgaagccatgcataagttggactgaactgatgaggtgtagagtcctttgaactttttgtgatcagaactaaaattaatttttccctatggttttaggatgggaagctctgtttcctaagccatcaatttctttttacatttttccaaagtaagttgagtaaggaaaggtttccgtgacagccacttacagatagtagatacaatggagataaatatatatgtatatatttacaggttaaaactggtctctcctcacattaagtctttaatgaaatgtttcttctataatttataattatttgaaaacaaaaagattattatttgaacaaacagccaaatgaaaatgatccagtaattcaaatacaatctatttctccacatcagcacaacagttctaacgcaggacaggatgaattaaggaacagtttattaccaaaaggataaataaatggggatggatagaataagctaaattatttctcttaaagcatatgcgttatgcatagataacattggcagcagcctcattcacagtgagatgtaaaggctctcaaagatccttctggcttcgggttctgcaccttatgttccataatgccacagcttctttaactgatccctcttttgggaggggctttctgatgtggcttatcctttcttctactgtctatgtagagattagcactttgttgatagagacccaggtgtacagtatgtttctccatgtctcacctcgactgctcatggctgtcccagaggtgtgcagaagcagcctaccagagatatatgactagtgagacccagcttgtgtagctaagctgggtcagtcagattttcctggtgctctgaattgagaaatactgagacatcacggccatgtgtaggaagtcagaaagttcctttcgggccctggccagcaaattctgacatgtaagctgagaaaggagacaagatattggctacagggtgaggaaatggagaaagacggaggaaaggagcaaccatgcagagagaaactgaggcttggaaaggggagagagagacccagaggagatggacagctcaacactccagttcttgcctgactcttgtccagcagcctgcccctacatccttagaatagtagcactttctctccagtagcttaatatactataggtcttggattttcacaacctaaaagctaaccaaaaacaaatattaaaaatgtttccattgggaaatgtgtttaagaaacattgacatgatattttgtaagtgcctgttggttagaaccaagttaatgaaactgacgaactggccacacaatgggcttaagtgaacatggcaggaattgaaaaggtctggtgggaaggggaggttcgggaagctctaacatcctgcactggttattcctgagtgaactgtgggctgggagtctaaggagatgagagagaaacagtgcaagtaacacatttttttctccctcagttagatgactttcactcagttgtggttcagtgttatgccctaaacttccattgaggcatcagaataaactgccttctgaggctcacacttgcttttcatactaagctgtggttagcgttgccatctacaacactgcttgtgttccttttaagttttatgtaggacatttcttccaaagctgagtgctaggtaaaattttgcttcctcttaagaactgtcatgatttgtcttcatgaacattgaaaaaaaccactgaataaattctgttaccatttttattttattttcttattgtatctttaacattgttattaactatattcaccgtgttgtacaataccatttttattttggttgtcaggaagctcagaggtaaagtcctggaggagcttctggcccgtatatctttatcctctttcttttcttccaggcacagcctcttgggtttaattccatgttcactagatttgacattgacacattaatgttgtaattcatattttaatattttattgcatgcatttctttaagccatatcagactgaaactcaggtttttcccccagtgtctttattgactctgttcctgttccttctgcctggaaattctttaccaaccctcacttccacccaccacaagaatcctcacatttcctccacaggtaccacctcctgaaatccctgctgttgacctcagaccatgggccctgccctttgtttggcctatgctcaccagacaaagctgccctgcatttgctgttatctcactgtccctctctctacactgccagcccctgagggcagaaactactcttcatggtgaagctagtgccccacatgtgttcagagaataaatggatgaagcacttgctgcttataaagaattataattgatcacgatgcagtactcactaggtgtcaagcaggtatttacgttttttttttttttttttttttacatattaacttatgtaattgcacctcgtccccttaaacaggtagtgaggactattgtttcctcctttggcaaatgagaagacaggggccagaaatgttaaacgacttgctccagctcacatacctagtggcagaggaagtattggaatgcggtggtctaccacctgaacctcacactgatgtgctttgctgtgctgcccctctgtgtcttcacatacaaagcctaaattcatcttttgatgtgaatgttttagtcaatatacccttttatttttttcgcaccatgctatacatatataggcattcatatggcccagatctgaagccttccttcactcctttgactctccttcgatcctgcagctgagttactagatgcaaaggaaatataacctcgttcagttcctagcacatattagacaactgataaatgaaaactgttatctttgttattattattgttattactaccagttatcttcttgctaaactgccgttttctttagggcaaggatttttgtcttattcatctcaaatataattggtgcttgtaaatgttaatttggattgaactgctcatggcagattaaaggatggcaagcttgtacatctgagaccagagacaaggtagttctgttctttcattcaatcaaaaaacatttattgagcacctatgtagcagttactactctagaccatgagggatccaaccatgaggacacagatgatgatccctgttccacggggtttgtgttctggtagaaggaggcagagaatcaaaagcataaaaagctgaaatatataatatgtgagatgtgctgtagagagaactaagcagaccatgagaagagggagcactggaggcattccagttttagaggtggtaatggaagaacttgctgagaaggcgatacttgggtaagatgtaggagagctgagagaaggagcaacatggcggaatggaaattagccagggaaagtggtccagcagaggaaatagcaagtgcaaaggctctgtcttagtcctcttgggctgtcataacaaagctaccatagactgaatggtttaaacgacagaaattgatttctcttccagaggctgggaagtccagaatcaaggcactggcacatggagtgtctgtgaggggctgctttctgttgcatagacggagccttcatgctgtatctcacgtggtggaagtggcaagacagctctctggggcctctcttataagggttattactccattcatgaaggtggagccctcaagacctaatcacccccaaaggcttcaccttcagatactgtcacaatggtgattagatttcaatatgtaaattttgtgggagggcgggcacaaacattcagattgtagcaggctctgagggagaagtaggatgcacaggctttgggagcagcaagccagccagtgtaggccagtggagggtttgtaagtgggagttacacaaatcagggcagtggggagatgcagattgtgtagaacctcgcaggccattgtaatggttttagttttcccttgaaataacacaggaagctacagaaggggtgtaaaaggggatgtgagatgatataacctattttgatagcagtgttaagaataaccgaaaagataggatggtaggcagaatatagatcacaaaggcagaaggagaaagaagaaggtgtttccgtaatctgtgacaatgatggtgctggctcgttccaggttggtagcagtggaagtcatgagaattcttccactgtgcatatattttgatggcgacattggcatgatgggagatttgatgtggagtgggagagtaagagaagaatcacagatgactgggtctgagtgatgcaaatgatggagttgccaaaactgagatgcagaaagctggaaagaactctatttgggacatgctagatttaagatgtttattagatatctgtgtggggatgttaagcagataactggagacttgagttcaggggaaaggactagaaaggagagtcaccatttgggagacacaagcctatagatagattttaatgctgtgagactgatggcaccatgaagaaggtgagtatattgaaaaaagaaaagatgtccaagactgagtcaaagagatgaggtagaaccagcaaagaagatatagaagtaacagctaaggtgggtagggggggaaaccagagagggcgacatcccagaagtcaaataacaggagattatcaaagagcagggattgatcaaccatggtcaaaggtgcactgaggacaaagaatcttgacagttacatctattacagcaacatgtgactcagtgttgacattagagggaacactttcttcttcaagcaatagaaggtcaagggagttgggcagagctgctatctgtaaagaaagggaatggctaccaggaaataaggggtcaacaccaagtctggaagggacacaagatcaagctggaagccgctactcccagattttggagtgggaggaaacagaatcttagttaaaacaggtttacaaacaagcaagaatttcctgagaaattattttgagtacaatgtggtgtttctagttgatctttgtaggagatgaatgtgtggcgtttgaatgtttcagccagctcatgatatgggtaaaagaatgaacacagtctccatttggaatgtacaagtaaaagtaaaataataataaaatataattgtggacatttgatccaaatgtatgtggaaaacatttttaagagaaaaaaaatgatcagaataactacattaccgcatttttaaaatgtcttggggttgctgtcattttatcctttttaaaacatccttttagagtctaccaataccctatttttacagaaagttgattttatttttggactgcacattaatttcatttcccagcataatgaaattccactgaacaatttcactatccctgaaaagtgatttggtcattttgagtcagaaaattggcattaggcagaaatacaagatctcccattactttgtattaaaaaataaaaaagctaaaaagagttttctgtttttaccgcatctagtgatcattcgggtgaaaaaaagtgtgtgttccatcttttgcagtgccaaatttcatcgcctttccttcactgcacagcttgttaaacatgaacaagcactttggatttcatggcagcattaaaattcttacttaaattgccttggaacttggtgaccccttaattaatgcagtcactgctcgacactttgtgtaatattgtttatagaactgatagaaaaaacacatctgtgctgcaagggctgcaaatatagtgaaacagcaaacgtagacaaacgtttaaatgtagccatgtgaaatgtcccaacaatacacacagaatatagttgctgttattattatgattaatgttgctattttaaagatcttgcaaagaaggactgtgtaaaaagatttaaataccaggcttgccttgggttttgttctctgatggagttgctgaaggaacttgagcatgaaaacgacatgttccttccactctggtgggtctctggagtacatacgagaggaagctgagactgctaacaaagaactgagctaacaggttactaaaattgtccagattaaaacaatagagctagacctacactagaagagacaagggcaatggctatgaggtggtagatgttaatgggatatttcacattctgctgtgtctttgattctagaaaatataagaatgacccaattctctcttctccagagttttcaattctaatatttgtttcctaacttcactttggttaggtgctccaatgtgttctgtttccttgagtttgctaaattggtgctacttctttctaaagagcagagcttagcagctaaagcaactggttatttctttatgcaattcggtaatctaaaagttatctttgggcaatcttaactcattgtataaatccattattcttttaccaaatcctagaaatgagaagagacatcaaattttttcctatgtgccaactatgtgtgccttacttacttcatctggttcactttatggtaaaacggagaggttacaatttatattttggaaataaatctagcataattgactatggcagaatgtggtgtacaataattcctggtattctattggcttgtggattaaaagtagagattgaaaataacccttcaaaactcttagcccaagagcattgcctgctgatatatcttaggcataaatctttaagtagaaattacatttaaaacaatcaaatatttaaaaagactattatgactatttatgactcttatattaatcttgagaattccaaaggagattccagtcataatagccttgcttcctgtgccaatttttgcttaacatgaaaataggcaacagaggccattgttcctctgtaagtgctattagcacatggacaaatgctctcatttttacatcttctgcccccttctggcgcctggcccttaagatgcagccaataaattgtgttgaaactgtatattctcaatagcagtctaatttggcatattaatatgatataggaaaaaagcctttaatgataatttacataaaaactacaccattcatttatgtacaaaaagtcccacatgtacccatttatcattttctgagtttctactgtgtatagcaggcagtaattatggctgagatcttctgaaatgattatagcactgctctcatccttcagttcactgtctgatggaggtgacaaccctataaattattacaaaacagtatgaagtgttgtcatagagatgggcaaagacttatcatggtatgcctggaggaggccttgtcaagcttgttttgatctggaaacacacaatcatatatagatagatgctagatgctagatagatagatggatagatagatagatagatagatagatagatagatagatagatattttagagtcggaggcagtctcagaggttgtgatacaaacttttattctctcttcctagaaaagttaaataaaactgtctttcaaatgaatcacagtaaatagcatgaataaagacactccatcattcactagtataaataaataattttcctttaacaaataattatgtaacatctactataggccagatacttcttaagaactcaaatattattatctgaatttaatatattgaatatctatttacataccctagtgtcttctgttctaacttcctgacagttacaaattctagctttcaactcttaatttccctctccttcccaaaataatattttctgtattattggtttcaactttgtataggaatagaactgaccggaattcaaaaaagtgtgaatttaggaacaggtacactggtgaacagtttatgttctcaaagattttccagccaagaaatttttttaaagcataaaatgatggctgaacattgaagaccatgaagactctagatattcagaaacaacctccaggttcaatagagaggataggtcctgggcaataggttcttctcagtaagagaagaagtggttatttaaggaagtaaaatgaaagagaccaatgaacttttgcaatagttagctatgaagagtacagaattgatttcaaaaacaatttttttccttttcacacttttcccatcctccttgctgactactagacatgaaaaataaattctgactactttctgccattttgggaggtaaaagtgagttaaggtcattaaattgtagcaattacatagctgcattgttttttgagactctagcaggagaaaaaaatccacacactgatcagcaaagaatattctttcacatatgagaaagtgactcttcagtggaactcaagcatagaaggactagaggaagaaaaaacttaaaagtcacataagacatatgatttctggtaatggcagagtggcttgtttgaaataacctgtctataattttaaaatatagaaaatatatttgaaaaatacaagtatttaaaggctctcaatagcaaatatggagaaaaaggaatgaggttggaaaattggcagctttaggcctaaaggccccccaagcctctactgccccatactcagcttgcatgctgcttcatctacagagagctactgccttattggtatgaggtgtcagaggatacagctcaggctagcagaacaatgaccaagttttgggagagtacctggaaaaaagggagccatagagagtgtgaactcaataatttactgaaaaaatccacccaagaactctgtctgcaaggggggagactttgcagggggttttcttaaaaaatacagcagctggaaactaaggaaactgtattattctgttttcacattgttataaagaattacctgagactgggttatttataaagaaaagaggtttaattgactcacagttccacatggttgggaaggccttaggaaacttacaatcatggtggaaggcaaagggaaagcaaggcatgtcttacatggtggcaggagagagaaagggggcaagtgccacaattttaaaaccagcagatcttgtgagaagtcactcactgtcatgagaacagcatggaggaaactgcccctatgatccaatcgcctcccatcaggctcttccctcaacatgtgggggttataattctagatgagatttgggtggggatacggagccaaaccatatcatttcactcctggcccctcccaaatctcatgttcttctcacattttaaaatacagtcatgccttcccaacagtcccccaaagtcttaactcattctagcattagcacatttttcaagtccaaagtctcatctgaaacaaggaaagtcccttccacctgtgagcctgtaaaatcaaaagcaagttagttacttccaagttacaatgtaggtgcaggcagtgggtagatgctcccattccagatgggagaaattggccaaaacaaagaggctacaggtcccatgcaagtccaaaacacagcagggcagtcattacatcttaaagttccaaaataacctccttttattaatctcttatatccagggcatgctgatggaagaggtgggctccccaggccttgggcagctcagatctgcagggtacagcccccatggctgctctcctgtggctgctttcatgggcaggctttgagtgcctttggcttttccaggcttacagtgcaagttgttagtggatccaccgttctgggatctggacaacggtggccctcttctcgcagctccactaggcagtgtcccggtggggactctgtgtgggagctccaaccccacatttcccctctgcattgccctactagaggttctccatgcaggacctgtccctgcagcaaacttcttctgcctgaacatccagacattttcatacatcctctgaaacccaggaagagtttcccacacttcaactcttctgtgtacccacaggcccaacgccacatggaagccaccccggcttgaggcttgcaatatctgaagcaatggcatgagctgtacattggcctctgtcagccatggctggagctggagcggctgagacacagggcaccgtgtcccaaggctgcacatagcagtgtggctctgggcccagcccataaaaccatttttctttcctaagcgtctgggctggtgatgagaggaattgctatgaagatctctgaaataccctggagacattttccccattatcttggctattaacattcggctccttgttatttatgcaaatttctgcagctggcttgaatttctccccagaaaatgggtttttgttttctaccacattgtcagactgcaaattttccaaacttttatattctgcttcccttttaaacataagttcccattttgtatcatctctttgtgaatacatgtgactgtacgctttcataaaaagtgaggtcacctcttgaatgctttgctgcttagaaatttcttctgccggataccctaaatcatctctctcaagttcaaagttccacagatctccagggcaagggcaaaatgccaccagtctatttgctaaagcatagcaagagtgacctttactccagttcccaataagttcctcatctccatctgagaccacctcagccttgactttattgttcatgtcactatcagcatcttggtcaaaacaattcaacaagtctctagaaaattctaaacatttgacatcttcctgtcttcttctgagccttccaaactgtttcaatgtctgtctgttacccagttccaaagttgcttccacattttcaggtatctttatagcagtgccccaaactactggtatcaattttctgtattagttcattttcacacttatataaagaactacatgagactgggtcatttatgaagaaaagaggtttaattgactcacagtcccacatggctggggaggcctcaggaaacttaaaatcatggtagcaggagaaaaggaagcaaggtacgtcttacatggtggctggagagagagagacagagagagagagagagagagaaagaggtagagacagagagagagagagagagagaggaagtgccacacttctaaaaccatcaaatctcatgagaactcacttactgtcatgagaacagcatgggggaaactgcccccatgattcagtcgcctcccaccagttccttcccttgacacatgaggattacaattctagatgaggtttgggtggcggacacagagctaaaccgtatcaagaactaaggggagatttcagctgatttttaccacaggggaactggagtctggactttgagtatagtcaaagtgactatcttctagaccaaaaaccattgtttagaggaatatgaaatattccagagtcttcacaaatgtatcatttataatgtgtagattcaatttaaaaaatcactcaacatgctgagaacaagcaaaatgttatccatagagaagaaaaaaacaaacagtcaatataaactggcctgagaggacccagatgctgcaattatcagaaaacttttaaagtagttattataagtatgttcaaaaacttaagaatgttatacatataatgaataaacagatgggtaatcttagcagatgaacagaaactgcagagaaaaataccaactcaaattctaaagatggaaagtgtagtaactgaaataaaaattttactagaagaatttaacagcagaagaaacaattgaacttcaaggcaggtcaaaataaaatatctactgtaaaatctggaaagaaaaagaaagtgaagaaatatgaacagaactgtagagacatgtgagactaccaagcagtaacctatgtgtaatgaagtcccagaaagagaggcaaaggaaattttcttttaaatgcttgaaaacttttaacttatgtttagtgagacttacacaagataaatgaaaagaaaacaccgggaacatcacagtgaaactgctgaaatacaaagataaaaaggtaaccttgaaagccgctaaagaaaactgtcacattacacacaagagtacaatgatagaaatggtggctgacttctcatcatcaacaatggaggacaaagtaaatggaacacatctttgcagggctaaatgacaaacactgactacacagaattctacatacagcaaaaccatctttccaaaacaaaggtgaaatagacattttcaatatatacaacaattatttatcaataaaaaagaataaaaaagatattttaaacaaaaataaacaggaaatttgttgttagcatatctattctgtaagaaaagctaaaggaagttatctttttcaggctgaggagaaactataccagatggtaattttaatctatgtgaggaagcaaatcactgtaaagagaaaataatgtaagtaaatagaaaagacttaagatttttttcttttcttaattttccaaaaaaccacgattgtttaaagcaacaattataacaccatagcatggagttcataatgtttataggcataatgtatctgacaattatagtgctaaggatgatggtggtgaattgaactatattaggtttccacaatttttacatgaggtagtaaaatatcaagaccaagtgaattattttatgtttaagatacatgctgtaatttctggtaaaaccactagtaatactgcaaagaaattatagttactaaaatatcaataaagaaataaaaatggaatactaaaatattcaattataatataacatctaatatgtaacataacataaaataacacctataaataaaaaagaaatacactgaaactccaataaatgaatgaaataagaagcaccaaggaataatccacaaagaaaagaaaatagaattgtcagcccagcttggtggctcatgtctataatctcaacactttgagaggatgaggcagtaggatcactagcgtctaagagttcaagaccagcctgaggaacataatgagaccctgcagaaaaaaatatccctgcatggtgatgcatttctagtagtctcggctactccggaggctgaggaaggaggattgctttagtctgggaggttgggaggttgaggctgcagtgagccgtgattgcaccactgcactccagcctaggtgacagagtgaaaccctgtcttaaaaaaaaagaataaagtaaaaagtaaagtaaaatagtcaatataaagggatgtaggcaatttttgaagaaaaaattcagaagagctttctgaaatcattcaaagctatactgttatttgaaaagacagccagcaagaaatctctttgggagatgttctaaaaatttctaggaagagtctgaaataagcttgcattttttcttgccttatgctgtaaatttatcttcagactttaaataaagtccactatactcaagaatcttgtgttaatagtgtttggagaaatgttattataactaccattatcaatataatttatcctgctatttttcctgactttctacttttacaagtcaatgcaagcccatgacctactctgtgctaagcactatgctatacacttgtgcattttaccttttagtctggattcacacccatttcacggagggaaaaatatggaggcttagggagtgtaagtgacttatcgcaaatcacacagctagtcggtggtggatgagcaagttggtatctggctctctgactttggtgtcaacatgtgtaatcatagagctatgctgaaggaagagagatggtacccgcatgcaaaaagtaagctaaaaagagatgctgccttaaggcttagagttaatgattggtagcaggtgtagatgttaatagttaagaagaacactgcagactggaagatgttgaagcattcaggcagctattgtctgtattacaaaatgacttacgattaacatgggataatgataatttaaaaaaccaagtgagatacaaaattgtagtataaaaatgtgattaacatacatgtatttattattactcatataagaataacgcaggaattcaaatttaagaagtgatatatcagaatattaagagttacctctgtgtttggaaagagagatcacattgatctctgctgttctttatgcattgtattttcaaattttctatcttgaacatatcttgtttccatacgcagaaatgtatttccaaaagaagaagaaaataaaaacacggccatttcaactgccccaggaagaaatgtaaaaggataaacataatttcatcaggctttaaagagtgtctctcatggcaactgcttctgagaatctgatatcttctctgagggaaactgctcattaaacagttttcaataatgtggtaaagaaatacagcaaagttattaaagagatggtggctctcctagggtacacataccacaggggccagaaccattctttaaatatattttcatttgactactgctcctacggactgtggccatattaccatacctaatttctaaaactcctttttaatgggggtcattcttcttgccttaaaactggctcattttattgcctcagtgactttgtggagcctggtggttttatgttttttgatactcacatatggtttggtttttgctaaatcaaaggatatagtctgcgtgtgatgactttaggagccttttaacacctcacctgctcagtggttgctaaaattatctaaaagtgtttacttgttaattatacaaattacagataaggtttaaaaaacagagcacctggaagtggtcatgcatggcagtaaaattacactaaagtatacatgtctacttgttacgcatctatctatctatctatctatctatctatctatcatctatctatctatctatctatctatcatctgtcatctatgctttaaacaatcagaattgatggggatttcaggaatcccaatatttctgaaatggagggtgaggaataatcaaacctcaaaccacagagtttttgttatggacagcgtattcttgtcttattgagtacataccttgtttattaaacagttctgctccagtttgaccctagccaaaggagtttgtatggctctgttgaaagactgtgaaggtatgtaatggacatacctgggtgaaagtcctcttttcctctcctctggctgtgtgattgaaggctgggtattcagtatctctgaggcctggtttctgtatctgtcaaatgaaggtcgtgtaaaccaatgatctactctatgccaaacactgcaatgtgtatgcacttgacatgtgtttaatctttgaattcactcccatttcgtggatgagaaaatattgaggctcattggtttgttacgggggttaaaagagagaaggcttgtaaagtacaaggcacaggtgtcatgtctcataggcactcaataaatatttttccaatactccaatgtcctttgacaagggcaaagcacaccaagagaactaactccaaccgtaaattaatgactttaactttttaagcacctatttattttctgcccgtaaagatgtgttccttctttttttctctggtgaatttctatcctatatttcaagttcacattttatcaactacacgagtctttcatattcactctatgaatgctcatttttccttccttcaaatttctgtgtcttagaatttatgccccttgttctggctccatatatcattctgttggaattttggtctattttgtaaactttagagcccaagagttgtagtctaattttatgatttacttcatgaagattcaaggaaaaatatttaatattttgggtcctagtttccttatttgcaaaatgaggagggcaggaccttaattcaatattccttgagggttagtccttaggtcaagttaaataacgtatgtggaagtgtcaactgcatatatgtacacagtgggttattcacaagtgctagttcctgctgtcaatagtccttcctaaaactaatatttttgaagcacagaccatttcttattttttgtttgtatctaatacaagcccactgtcatgaattattctggtcacattgaaacatgcagcttcctacatgtgctgttctatgacaagcatgttgaaattttttacctaactaactcctattcatccttcaacacacagctcaggcctcacttcctcctggaagcctcctgggcttatttaggctggggtttttcctccattcacaaggcactatgtgtttctattattttccttattatattccattgcccacatacatattttagagagtaggccttgagactcttaagtgatttatttgtcattatatccctagaagagagttcaggtcatgaaatacagttgctcaatgaacagttgctgaatgaataagtgaaggaatggatgtagcaaaagactctggggaactgagtgctgcaattaagcaaaacatcaggtaagatcctggagatgtctgattgccaatgagtatgttcagcattaaattaccccacatactgttg

SEQ ID NO: 518 - DNA, 40001 bp, Homo sapiens
ggtaggtctattttcagttttttgagaaacctccatatcattttctgtagtaccaatttacattcccaccaacaaggtacaagaattctctttcctccacctccttaccaagacttgctatctttcatctttttgacaaaagtcattctagcaggtataatgtgataacttattgtggttttaatttctatttctgtaatgactagtgatgctgaacagtttttcatgtacccattggctatttgtatgtattgcttttgagaaatgtctatttaggctctttacctttttttaattgaattgtcttattgttattgagttaactgagttccttatatatttctaatattaaccccttatcagatgtatcacttacaaatattttctcccattctgtgggttgtctcttcagtttgttaattgtttcctttgctgtgcgaaggtttttagtttgatgccatcctatttggctatttttgcatttgttgcctgtgctttctgggtcatattaaaaaaaattttttgcccagacaaatttcatggagcttttcttctgtgttttctttgaatagttttccacattgagatcttatatttaaatctttaattcattttgagttgatttttgtgtatgttgtgaaaccaaggtctatccttcttttgcatgcgggtaactaattttcccaaaaaccatttcttgaaagagactgcccctttcccagtgtgtgttcttggtacctttgtcaaaaatcaactaaccataaaaccacattccattgtcaatgtgtctgtttttatgccagtaccaccctgttataattacaatcactttatgatgtattttgaaatcagggagtgtgatgcctcctgctttgttctttttgttcaagattgttttgctattcatggtatatgaattgaaggagtattttttctaaatctgtgaaaaatgacattggaattttgatagatattgcattgaatctgtttattagtttgggttgtatggacattttaacaatatcagttcttccaatttttgaacatgggatatctttccactaaaaaatatttccttcactttcatcagtgtttcatatttttcagcatacacgtcttttaccaccttggttaaatttacatctaagtatttagcatttttgttgctattgtaaatggaattgttttcttaattttagtatgtagaaatgttattgatttttgtgtgctgatgtatcctgcaactttattgaattcagtttatcagttctaacagttttttgatgaaggctttaagatatatatatatacacacacacacacacacacacacacacacacacacacacacacacatatatgatcgctgtcagcatacagagacaattttatttcctccttccctattaggatgccttttgttttttttcttttgcctaattgctgttgataagacttccagtactatgttgaaaagaagtggtgaataatgggcgtttttgtcttgttcttgatcttagagaaaaagatttcaatttttcactgtttagaatgatatcggctatgactttgtaatagatggtctttattgtactgagttacattttctttatacctaatccgttaaggtttttattatgaacaaatgttgaaatttgcaaaatccttttgctgcatttattgagatgatcatatgatttttatccttcactttgttgatgtggtgtattacatttattgatttgcatatgttgaaccatccttgcatcccagggataaacaccacttgatcatggtgaacgtttcttttaatgggttgttgaattcagtttgctaattttttttgagaattttttgcatttatgttcatcaaaaatattggtctgtaattttctactttctacttcaaggacagtctctttgtccagcttttggcatcaggataatgctagccttctaaaaagagtttgaatgtattccttctacttcatattttggaagcgtttgagaagaattagtattaatattaagatgtttgttacaattcagcagtgaagacttcaggtcttgggcttttctttaatgggagactattgtgtctaatataaatacagctactgctgctctccttcagttttcatttgcatggaatacctttttctacaccctcactttcagtctatgtgtgtccttactagtaaagtgagtattctgtagggagcacatggttggctcctattttaaaaatatattcatccactctaggttttttgattggaaagattaatccattcacattcaaggtaattattaataggtaaggacttgcttctgctgctttgtaatttttttttctgattgttttgtaggccatttgttaatttcttcttctctttctgtcttcctgtgaggtttaatggttttctgttgtgatatgttttgatctttctttttatgcttcgtgctactactgtaggtttttctttgtgtgtgtggctaccatgagacttacataaaacatctgcttcttatgacaggttactttaaggtgataacaactttaactgcacacgaaaactacactttcacttcctctcctttacgttttctttattttgatgccaaaacttgctttttttttttttttagtattttgtattccttaacaatctattgtagctagagttatttttgatagttttgccttctaactttcatagtagaaataaaattgctttacataccgttcttatagtaatagagaattctgagtatgactatacattacttattctactaagtttttaactttcaatttgtttttactttattaattaacagcctttaatttcagcttcaagaactccctttgtagtttctataaaggaggcctagtagtgatgaactaccttagcatttgcttgtctagaaaagtttttatttctttcccaattctgaaggtcagttttgccaagtaaagtatttctggtaggcagtttttttccttcattacattgaccgtatcattccattttcttctggcctgcagtacttctgttgaaaaatctgctgaaaaccacttggggtttcttttgataatttgattacgatatgtcctggtaagctccttcttgagttgaaattgattggtgacctctgagtttcctgcatctggatcttatttaattatttaacttaattataaattaagttaaatttaataccagggcaaccaccaagaacatttaaaaacatatagtacacgaaatgacaaaggaattaaagtgatacactagaaaatatctgtttaacacacaagaaggcagtaatacaggaaatgaggaacaaaaaagataggacatgtagaaaaaaataacaaaatggtagaaataggtacagttgacccttgaacaacatggctttaaattgtgcatgtccacttatacctggattttcttctgcctctgccgcccctgagacagcaagaccaactactccttttccttctcaggttatgcaatatgaagaagaggatgaagatgttttctctagcttactttatcgtaatgatactgtatctaatacgtatttcatacaaaatatgtgttagttgactgtgtgttattggtaaggcttctggtcaacagtaggatattagcagttaactttagggttaacttttaaccaattaaaatacaaaaattaagaataaaaaagccataatcaactatatgctgttgtgaagaaactcattttagtttcaaagacacaagtaagttgaacttgaaggatgaaaaaaatatatactatgcaaacagtaaccagggaaagctagagtggctacaataatatgaagcaaacaagactttaaagcaaaaattgttactagtgacaaagaaggacattatgtattgataaaaaggtcaatccatcaagatagaaacattataaatacatatacatctaataagagagcttcacaatagaggtggaaaagctgacagaattaaggggaaaatagatgattaaataacagttaaagactgaaatactgcagtttcactactgcatagaacaattagaaagatcagtaagaaaatagaaaatttgaacaacactataaaccaagtagacctaacagatagctatggaatacttcatccaacaacagcctaatacacgtttcacaagcacacatggaatattctgcagaacagatcatattttaggccacaacacacatcctaatatattcaaaatgattagaattatacaaaatatgttttctgattgtaatggaaatagaagggaactttctcaacctggcaagggtatctgtggaaaatccagttaacgtcatacataatggtgaaagtctgaatattttccccataagaacaggaataatacaaggatatcattctgtttattgttgtgctgcaagttctaaccctagtgtattaatctgttctcacagtgctatacttgagtctggctaacatatttttaaaaagaggcttgattggctcatagttctgcaggctgtacaggaaaaatagcagtttctgctactgggaaggtctcaggaagcttccaatcatggaggaaggcaaatgggggagtgagaggtcttacatggtggaagaaggagcaagagagagcgatgggggaggtactgcatacttttaaacaaccatatctcttgagaacccactcactatcacaagaacagcaccaagcacatggtgctaaaccattcatgagaaatccacttccattatccaaccacctccctcccatcaggccccacttccaacattggggattacaattcaacatgacatttggtgaagacatagatccaagccatatcacatggcaactagacaaggaaaagaagcaaaatacatacatactggaaaggaagaaatgaaactattaagagatgtcatgatcttatacacagaaaaggctaaagagaagaaggatcaagatggccaactaaatacaggtactatgtgcttccaccatggggaagagccagaataggaagtagatactcaaatttcaaacatatcttctaggagagaatgtttggattcatcacagaagagatggaaagcaccagaaataagtaggaagagagtttgaggcagattgtccagctaggaacttactgagagttgggagaaatgccttgatgtggggaaacagtaacagagaaatacccagacctctgaaatgaactttaacaaacctggcatgggagaaaccatcaacccactaggtcctcgtgcctgacatatggagctgcctagattttgcacagagacgttgctccagaaagggttcctacacagaatcccacagttatctgtgtcaggagcagcctcagtcaggagccattttcagaaccaagatgctgtggacctatagaccatggctgcaaccactgtgctgctccaagaagggagaggggtgaataggtgcacccatacacccctgggtgggtacttgctgtcctgctacaaactactgttgagactgagatataagtggatcacacttctccagagtcttactcatgctgcttgcctggatggtgtcccatcccctctggttccagaccaaggcaccattttgagagcttagtggtgggctgaggcttgccttcgacctgagctcaggctgacaaggttaaagccaccccctgaccaaggactgacaggaaatccaggctatcctatatatatatatatagtcatacccagtgctctgaaacaggctgctgtgagactgaaacatgatcagaccacactctccacagctttttgctcacactgcttgcctaggtcatcctccaccctttctgttcccagtccaaaacttcaccattgtcttgattttgggctgatgcactctagctgccacccagccaaagagggacagggaagccaggttctcctatgcatacctaggacaatactcaatgccctggtacaggctgctgtgaggccaagatttcagtggaccacacttcccaaagcttcttgcctattcactagaatggggccccaccctccccagtcacaagcccacaactgacaccattttgatagtatatagacagcatttggtgacctggtagcagcagccacagcaggtattttagtctcgagacagaaactggagtgcttgctcttgaatgagggaatggtcccacagccagaattgagcaatgagtgtggagagtacccaagcagtaggtgctgcaattaggctctctcccatcactgaactagagggggaaggtaatcgtggaagctgaaggcagcaagacttgcagctagggacagctttgtgacctagaaccagtctccacatgttatttctgggtgccccagcctgctcgcttgctcagcttggggacagtgctctgccagctccaaagagtggaaaggaggtggagctcacttccctggagatctaacccttggcacaatccacccctgaatgggcagtgcagcctgccaaagttcccttgggtcaaagaaaatgtgaacatggtgccagctgctgaaggtgtcaccactaaagcccaggaatggaagtggggggcagtcatctctccagcctgcctccctctttggtgcacctttgtggactcagctgtggctcttcccatcttggaccagcgaatggactaaaagagatcatttcttgggcttccgtagtgcctccacctcactgaagatgaatgtgcatgcactgggaaaaggcacgtttcatgcttctctgttgcttccactcctgcccctatgcgctggttcctattcttaagtgccacctactggacttcagcctgaattacaccaccaaacaaaatcatattgctacaaaaagtgatgtctgagaaagccactgcacaaacctacctgcaaccagaaaacttgtaaagacccttgataccctgaaagcagccagagacaaagccaactgaccatacacaacatacaccacagttattactcctgaggggaaaaaccaataaaatatcaagaagtaccatccaaaatatagcaaattcaaaaaaaaaaatagtgttagctttctcagatgagaagaagccagcagcataagaactctggcaatacaaaaagccagaacatttcatcaactccaaaggatctcactagctcccaagcaatggctcctaaccagaatgaaatgtgtaaaatgacagacacagtattcaaatatgaatgggaaagaaattcaatgagatccaagagaaagttaaaatcgatcacaaagaagccagaaaaatgaaccaagattggaaagatgacatagccatattaagaaagaaacaaacagaacttttggaattgaaaaattcactacagaatttcaaaatacagtgagaagccttaaaaacaaactagattaagcagaatttcagagcttaaaatcagtcctctgaatcaactcagtcagcaaaaataaagaaaaaataattttaaaaaatgaacaatggcttcaagaaatatgggattatgtaaggtaaccacatgtatgacttaatggcattcctgggagaagagaaaagaaagtaagcaacttgaaaaaaattttgaggatctaatttagaaaaatttgcccaattttgttagacaggtcaacatgcagataaaagaaattcagagaactcctgtgatatactatataagaagaccatccccaagacacatagtcattatactatccagggtcaatgccaaaaaaaaaaattgaagtcaaactattgctctttgctgatggtataattctatccatagaaaaccctaacaactccacccaaagactgctggaactgaaaaacaaattcagtaaagtttcagaatataaaattgatatataacaattggtaacatttctatacatcagtagtgttctagctgagaacaaaatcaagaatacaatctcaagaaaataaaatatctaggaattcatacaacaaagagatgaaagatttctacatgaagaaccacaaaactgctgaaagaaatcatatacaatacaagcaaatgaaaaaatattccatgctcatcgattagaagaatcaatacagttattataaaataatcatactttccaaagcaatctataaacttaatgctatcgctgtcaaaataccaatgccatttttcacagaattagaaaaaatctattttaaaatttatttggaaccaaagaagagcccaaatagttaaagaaatcctaaataacaacaacaacaaaaaagaaagctggaggaatcacattggctgacttccaagtttattctaaagctattaaaataagctctaaagctactaaagaaagctggaggcatcacattggctgacttctaagtttattctaaagctactaagataagcttctaaaagtaaagtaagctactaaaactactaaagtaagcttctaaagtaatcaaaatagcatgatagcattacaaacaatatacacatagatcaatggaacagaatagagaacctagaaataaacccacatacctacaaccatctgatcttcaacaaaatcaacaaaaataagcactggagaaaggactccctatttaacaaatggtactgggataactggtgaaccacaggcagaagaataaaactggaaacttacatctcaccatatacaaaaattaattcaagatagattaaagatttaaatctaagatctcaaactaaaaatgatagaagaaaatctaggaaatacccttctagacatagacttttgcaaacaacttatggctaactcatcaaaagcaatgacaacaaaagctaaaattgacaagtgggaccaaattaaactatagagcttcttctgcacagtgaaagaaattaacaacagagtaaacagacaggttgcagaatgggagaaaatatcacaaactgtgcatctgacaaaagactaatgtgttagtctgttcttatgctgctaataaaggcaaactggagactgggtaacttataaaggaaaaaggtttaattgactcatagttccacatggctggggaggcctcacaatcatggctgaaggtgaacaaagagcaaagtcacattttacatggtggcaggcaagatagcatgtgcaggggaattcctatatttataaaattatcagatctcatgagacttattcactaccatgagaacagtatgggggaaatagccaccatgtttcaattatttttacctggccccacccttgatacctggcaattattacaattcaaggtgagatttgggtggggacacagacaaatcatatcaactaatatctagaatctgttagcaaattaaacaaatcaacaagtaaaaactaaaaatccagttaaaaatgggcaaaggacatgaacagacccttcttaaaagaagtcacacaagtggccaataaacatgcaaaaatgttcaacatgactaatcatcagagaaatgcaaattaaaaccacagtgagaaactgtctcacaccattgaaaatggccattattaaaaagtcaataaagaatagatagtggaaaggctgtggagaaaagagaacacttatacactgatggtgggaatacactatgggaacagtttggagatttctcaaataacttaaaatagaactccaatttaatctagcaatttcactactggatgtatatccgaaagaaaataattcattgtatcaaaaagtcacatgtgcccatacgtttactgcagtcctattcactatgaaaaggcataaaatcaacctaggtgcccatcaatagtggtttggataaaaaaatgtggtacatatacacccttgaatactatgcagccataaaaaagaacaaaattatgttctttgcagcaatatgaatggagctggaggccattatccaagtgaactaacacaagaacagaaaagcacatactgcatgttctcacttataagtgggagctaaaaattgaatacacatgaatgtgaagacaggaacaatagacactggggaccactaaacaggggagggagggatggagtggggaatgggctgaagaaccatctgttgggtactatgcttactgccagagtgatgggatcattgggatccccaaacctgtacatcatgcaatatacccatgtatcaaacctgcatgtgaaccctttaatccataataaaagttgaaattatttttttaaaaaagaaaaaatcttaaaggtagcagagaaaatccaaattacctattactgtatttctcagcagatattttataagccagtagagattatggcatatttttagcattcttaaagaaaagaagtgccagccaataatttcctatcttgctgaactaagctacataaacaaaggagaaatgaactgtttcctagacaaacaattgctaagggaatttgtcatccaaagaccagccctacgagatatgcttaagggagttctaaacatggaaactaaagaccaatacttgctaccccaaaagcacatgcaagcacacagcccattgatcctataaagcaactacacaaacaagactacaaaaggagatagggagatctcaaattaacaacctgattttgcacctaaaaaaacctaaaaatataagaacaaactgaatccaaagctagcagaagaaaagaaacaacctaaattagagcagaactaaataaaattaacccccttgaattatacaaagaatcaatgaaacagaaagttggttgtttgaaagagtaaagaagactgaaagatcactagctagattaaccaaaaaggtagagagatccaaataaacacaatcagaaatggcaaaggtgacatcacaattaatcccacagaaatacaaatgatccttagagactattatgaaaatatttatgcacacaaactggaaagtccatagaaaatgggtaaattcctggaaaaaatctcccaagattgaatcaggaagagacaaattccaaacagaccaataatgagtaataaaatggaatcagtaataaaaaaccttccaaccaagaaaagctccagaccagatggattcacagccaaattctaccagaaacacaaagaagagctaccaaagtagagctggtagcagtcttcctgaaagtattccaaaaaacagaggaacagggaatcctacttaactcattctatgaaaccagtatcatcctaataccaaaatctggcagagacacaatgaggaaagaaaacactataggcaaatataaaatactggcaaaatgaatcttgcagtacatcaaaaagttaatagaacacaatcaagtaggttttattcctgggatgcaaggatggttcaacatatgcaaattaatacatgtgacctagcacagacagaattaaaaacggaaaccatatgatcatctccgcagatgaagaaaaataatttgataaaatccaacatcccttcatgacaaaaaaccctcaacaaactaggtattgaatgaacatgctcaaaataataggtgccatgtatgacaaacctacagccaacattatactcaataggtaaaagttggaaccataccccctaagaactggagcaaaatgaggatgtctactctcactactcccattcaacataatactggaagtcctagccagagaaatcagaaatgaaaggcatccaaatagaaaaagaggaagtccaattatctttcttcagtagtaatacaattgtattcctcgaaaaccctaaagattccacaaaaaagctactagacctgataaacaacttcagcaaagtctcaggatacaaaattactgtacaaaaattagtaacatttctatgtagcaataacatgcaagctgagaaccaaaccaagaatgcaattccatttacaatagccacagaaaataaaatacctaggaattcatctaatcagggaggtgaaacatctctacatggagaactgcaaaactgctgaaagaaatcatagacaacacaaacaaatggaaaagcattccatgctcatgaaatggaagaatcagtatagttaaaatgtccatatttcccaaagcaagttacagattcaatctattcttatcaaatgagtaacgtcatttttcacagcattctaaatttcatttggaaccaaagaaaagcccagataccaaaggcaatcctaaacaaaaagaatgaagctggaggcatcacattggctgatttctaagtttattataaggctacaataatcaaaataacatggtacgagtacaaaaaatagattcataggccagtggaacagaatagagaacctagaaataaacccacacacctgatctgatcttcaacaaaatctacaaaaataagcaatagggaaaggactccatatttaataaatggtactgggataactggtgagccacaggcagaagaatgaaactggacccctacctctcaccatatacaaaaattaactcaagatgaattaaagattttaatgtaagacatgaaactataaaaattctacaagtagatctaggaaatcctcttctagacattggcttaggcaaataatttatgactaagtcctcaaaagcaaattcgaccaaaataaaagttgataattgggacctaattaaactgaagagcttctacacaacaaaacaaactatcagcagagtcaacagatagcctgaagaatggaagaaaatatttgcaaactatgcatctgaaaaagtactaatatccagaatttgtaaggaacttaaatgagtcaagacaaaaacaaataatcccattaaaaggtaggtaaatgttataaacagacactcctcaaaagaacacatacaagcagacaacaaacatataaaaaatgctaaagattatcaattatcagagaaatgcaaactaaaaccgcaatgagatatcaacttatgccagtcagaatggccattattaaaaagtcaaaaaaaaaaaaaacaacccagatgttggcaagactgtggaggaaagggaacacttaaccactgttggagggaatgcagattagttctatggaaagcagtttggggatttctcagttatccagcaccatttattgaacagggactcctttctccattgcttatttttattaattttgttgaggatcagatggttttaggtatatgggtttatttctgggttctctattcagttccactggtccatgtgtctatttttggtaatggtatcacgttattttgattaccatagccttataataaacttagaagtcagccaatgtgatgcctccagctttgtgctttttgtttaggattgctttggctatttgtgctcttttttgttccaaatgaattttagaatagatttttctaattttgtgaaaaattaggtctgtggaaagcagtttggagatttcccaaagaactaaaatagaattaccatttgacccagaaatcacattactaggtatatgcctaaaggaaaataaatcatttgcacttgtatgtttatcacaacactgttgaaaatagcaaagatatggaaacaagcttggtgcccctcaatggtgaattagataaagaaaatgtgatacatatatggcatggaatactacatagctataaaaaagaatgaaaccatgtcctttgcagcaacacaaatgcagctggaagcaattatcctaagtgaactaatgcaggaacagaaaaacagatgccacatggtctcacttataaattgggagctaaacattgggtacacatggacacaaagatgggaaaaatgaacactagggattccacgtggggtggtagggagggagccacgggttgaaaaactatcgttcaaacctcagaagttcaaacctcagtcccatgtaataaaccccatgtaacaaatctgcgcatgtacacccaaatctaaaatttaaaaagaaaaccctaaatgataagcagacacacacacacacacacacacaactactagagctaataaggaagtttacagaagtttcaggacacaacagcaatatacaaatatcaattgtaattctctacactagcagtgaataattcacaaatgaaaataagaaaatgattctacttacaataacctcaaaaggaatataatattaagaaacacatttaaccaaaaggtcagagttatatattaataaatacaaaatatagtaaaaaaattaaagcctaaataaatagaaagacatcctgtgtttgtggactgaaatacttcatattgttaatatgacaatactccccaaattgactcatatagattcattgcaatctttatgagaattctaactgccttgtttgcagaaatggacaagctgaaccttaagttcttatggaaatttaagaaactttgattattcaaaacaaatttaaaaaataagaacaaagttgtacgacttgtggcagaatagatatacagatcaatgtaatagaattgagagttcagaaataaacccatatatctatggtcagttgattttcaacagtaatacaaacaccatttaatggagaaagaaagaatagctcaaaggtagaaacagccttcattttcattgactgatataaacggataatcaatgtggcatatgtatacaatggaatattatttagccattaaaatgaataggtactgattcatgctgcgacatagatgaaccttaaaaactttatgctaagtgacagaagacagacacaaaaggccacatattttcattaatgtgaaatgtccggaataggcaaatctaaagaaacagaaagtagataattggtttccagggactggagagagagaaaaatttggagtgacaggtacaggggttcttttaagaaaatgaagatattctggaattagatagtagtggcagttgtataataattgtgaagacattaaagatcactgaattttaaacttcaaaatgatgaattttatgctatatccattatgtctcaatttaaaatgcaaaaaaaattatatagtgggtcatgtagatctccagtgcaggtccaaatgctttacatgtattcactcttttaatcataataatgatcctataaggttttcactatatctcccctcattttacatatagggaaactgaagcatgaaaagcacaaagaggttaggaacttgcccaaagtcacacagtgatgagtgctggagtcaggacttgaagactgacagaccagtttcatggtccactcagttatggatgaccactctaggaaggcatagtgctgggtacattatggtattctattcgtccctaacaagagctatatgaggtaattgttataattctctcttaatagatgaggaaagtgaggctaaatactggtaacattgcctagagtcatatctccatgaagacaatgaaactagagtaatcaaaagactcatatatagagaatattagattgttctcatgccctgaatacacaaatccttcctgttttcttgcacttgaagccttattgtgtttatgtctgtatcaatttacctgactttagaaaacctatccccctgctaaatacatttacattattaaacagagcaggtagaagtcttcaagtgaaattaattttgcaggctgccgataaggaggctgaacacaggaagtagttttacaataaactactcagttttatctacgtcaggaaggagggcggtggcagcagcttcacaggaggacctaatgaatcactgcaatctaatttgtccaaataaactttcttttaagacagttcctagctaactatgtctatcaattccacagtgtggtgtagaagcttaggtctgttaacaaagagaaaggcaatgataaggtatataatgataattatatacaaatgactgaagtactgagataagttttggatttcttgaggataagagaaccccaggaaaatcagggataaaagaatggataggagcacatttttcattaaaaaaaaaaaacaaaatcagaagaaagcaaaacttagattaattttgttaataataccatctgacctcttgttcagctgtaggccttggacctcagtgcggtgaaagggaaagcattgatgttgaaaccaaatatgttcctagtggcctctgcctatctttataaacttgagcaagtttcctaaattatttaagtcctagtttcagtttctgtaaaatgacaatgataatacttgcttctcagggtttttatggggatttactaacataatgggtaattttttagtataactcatggcaatgtacactgggtgcttgataaatgtgttttcctttcaccttctcccatattcctgtgaccttgtaaaggatgcccttgttttccatgcctatatcacttctttctcagccccttttactatctggatttctaatatctctatcaatgggcttccaagatcttcccatgcatactgtatttccaggaaaggattaagtatggacttgagatatagcctctttcctctcagttattttaagcctcctgttaggacaagatttccagatcctttaccacccaagcatggtctaaaatgtaggtttattattcttcaagtatggtgaggccaacagatcagaagactactgccactgaaaatacagtttgttcccaagaggaggaagtagagcatgccagtcagggcccttgggggagcacactctgtggaagcagatgcgtcaagggaaaaattcaggcaagagcatttattctggtttcctttagaaggaaaaagtgaggcaaggtcagctggcttaggattgactagtttgaataatttcagggggataatgacctagagtgtaagaccccaataaatgaggtagttggtttgcatatgaaaggcatgcttccaagtgagctgttcgctatctctaggaattggttagccctgggtaggacactttctctaagctcatcgaggcaccaaacacagaaactagaaaacgtggtgattacaaggccacatcctacagtgaaaatagcataagatttggagtattaatccaaattttaggtctaactggtagaagatatgtgaccttggacaagtcactttacttctctaagcctcagttttcccagggtaacacggactttcttcacagggtagtaatggagattaaatgatagaaactacgtgcttttcacttcctaatgcagtatgggttccaggacaaatgattggagcaacagaggtgaagggagtacccaggtgctcttgtagccactgaggctcagcagtaaataatttagacaaaagggctgccctcatgtagcttacattctggaaatgatatgataaccaataaattagtaagtaaatgtgccatatgtcagatgacagtaagtgatatggagaaaattaaggcagacggtatggggaggtgaaagttacagttctttagggtgttcagaggaggtctcataatgtttaataagggcaacatgaaagggaaggccaggaatagataaggaaatgagacatttgggtatttgggggggaaatatacctggtagaggggacagcatgtgtaaaaaccttgaggtaggagatgggttgtgcctggaatgttgaaagactacaaagaagaaactagtgttgagagaaagactgttacaggtagttagacatgagtggggcaggatagggatcttcccccacccactaggaatgtctggtggtggtttggcaattatcacactgcctctttaaaagcgttaaattggcagctggcaccagggagaggccatatcttgatggtccacgtctgttgcactaaagtgttaattgagtgcagatgccagggagagacaacttcctggacttgcgcattaaaagacaaaatggcagagtatgacctaccaggggcactctactggaaaagggaagaaagcctgagatgggcacacacacacaacttcccaaacacactgtgcatgctcatctcccaggggtaaggagggcactgcacatgcaggcagcccaccttaaggggagaatcatgagaaaggggccagcctataaagtcctagaatcaaaggttgaacattacacttgaccttcagatgcctgcttgggtcccttccaagtgaactttcctttctttcctgttctaaagcctttcaaaataaacttccactcctgctctgaaacttgcctcagtctctttttctgcctcatgcccctgagttgaattctttcttctgaggaggcaagaattgaggttgctgcagacctatatggattcaccactggtaacttggataccttccaccagtaacaagacgagtgaggtggaaattggaaagggatggagacttggagaccatgggaaccagattctggagggcatcacgggctggagtgaagcatttggcttttgagagtagggcgatggggaacccacaatggagaggctgcatcaggggcaggacatggcctgatgtggaagtaactggctcatttttgttgctgtgctatgaacagactgtgttgtggaataaaagtaaattaatctcaggagacaattgtgatcatggaaacattatccaagataatccaagaatggatgggggctagaccacagggcagtgatgaggattagatgctgggtggatttctgaaggtagaggtgacaggatttgctgtctgatcagataagagattattagaagaagggggaattaaggaagactccaagggttttggcttgagcaacttaaaggttggagtttccattaatggagatggaaaaactgtgggacaacatagtttgtctatgagggtgagggggtggtgttggaatagaagatgctcttgaaaatagaattggagatgcctgttagatacccaaataaagatgccaagaaggcagttggatgtgtagtatgtggaggagctctaaactggaagtataaaattgtagagtcatttgcatgtaaattacatttgaagctttgaggcttgatagaataataaaagaggtgaacatggaaaaggtaaaataatggatgttgagagtcttctgggaacaatccccagctttgacctgtaaatccacttactatccatcatttcagcatcattgccccactccctttgctctattttccccatagcacacaccaccttccaatatgacattttacatacttgtttctgtatttgtgttcattgtctgccccctccagtatctccccctcatatgctgcactgaattttagctccttaagggcaggcatcattgtttattcagtaagatatcccaggcacctaagataatgcatagcagttgatgctaaataagtatttattaatgaaggaaagaaatagtgatttttattaatttctctcttgaaggtcttttagtcttagaattttgactttctaaagccaacatatcaaaaaaagaaagctaaaacttatcaactttttgcattcattaacagctaacatctccaatgacagtttcgagcaagatctcaaaataaatgatattgaagacatttccctggtcaagagacagcagggagagaacaaacaataatgttaaaagagaaggaaggtgcccaagaaaacctggctcctggactgtaccctgatctgtttgaaaataatgtaaggtgtaaaattaccaagacctggcttgtcttcaggactaagtctgataggaatagctttgctaataatttcaacactgatttaattcaacattaacataggtatgccacaaatccttattaatgaggaaagatttgttctgcattaacactattctaaaaagtgtgccagctgttgaaggtataaaaatgagtaatgatggtcaatattcagttaggatatggtcacttaaataataaagaatggacgcagacaggaggatcataggacacggggtttaagttagaaagatctgcaaagcaggtacgacttggagtgggacttgaagggtgaatagcatgactttttcagtcacaggtctttcctggacatttactttttgttgttatatggaccctgacagctcataatcccatcttcctagatgacccaaaggagtcatacagaaactcaaaaggttcaaaagcaaaatctttgaccctcttcactctttcataaacatgtttggaattcttactttaggtcaagcactggacactagaaatatcagtttaaataatccgtgagcactaccctcaaataatttatgctctatagcaatgtggttcttaaactttaggctacatcagaatcaactggagattttgttgaaacataaagttctggcccaagctcctgagttgttgattcactatgtctgtggtagaacgcagttattttcatttttagcaaattctcagataacgagatgctactagtctgggtaccagctgtacgaggaagcatacagctaagtaggtcagtgattaccaatcagtgtggtgagtacatgaaacagcaggcaaggtttgggacagccctgtttgaaatttggaagtgaaaatcatggtgcacaaagccatccttgctctgcttccctggggattctctgctgatgaattactggcttccctaatgatgtttcttacagagaagtatcagaactgcagttcttataaattctctcatctaaagagttttcatgttcactgtcaatactcaaagtcttagctacaaactaagtacttctggatcttgattgatttcattgcaagaaaaagtaagaaacacatttaattcatgttggttgaaggaaattgaggtagaaaattagacactttataaaatctacacataaccaaaaattcaaatggatagtagaatcgggaaggataaattatttatgtctccacagcaaaaagaattcaaataagaatatgcaaccaatgaacttttaatggatcaatattattctgtgtcaaagtagtcaaaaatatttcttgagctgcctttctgtgcatagcatgttgggatatgatgaaataaataacaacatgaggagtgatccacggcctcaaatagattgcagtatagttagatggataaaaagattaagtcatacctattcactcatgagaaaatgtattttacctttactatataatggaaactgtgttacatgctgagaatactaacataaactaatataatactaacgtaattctatgtaatgggtatgattatcattctcattatctatatatgaagcacagaaatgctaaataactcacttaaagtgaagaagttagtggagtcagtctttaaacccagaagtctggcctctttactgttgtattatacctgcctcagaaaacaggcacactagaactgatgatgaagatatgctcgtttttattcagagttgttttctggggttgggaaagcacttatttgaagaaggttcttttgctttgtcaagttagacacttgggaatatttgctaagtatcgtgtagtcgttttctattgctgtgtaacaaattgccccaaaactcaggagcttaaaataacaaacatttggcatcttgcagtttccgtaggtcagtaatctaggcacagctgatctcagggcgtctgactcaggatctctcacaagatggcaatcacagcactggtgggcactgtggtctcatgagagagctggacttggggcagatccgcttccaagctcactcaaggtattgtgagaggcattcaggtcctcgtgtgctgctggactcagaggtttgtggaagcgttcgggtcctcacgtgctgctggacggagggcctcagtccctcagtggctgttgaccaaaggcctcgcttagttccttaccgtgtggacttctccaagggcagctcacacatggggattggcctctatcaaagcgggtaagagggaaagattgggggcatgcccctagataaagccacagtctttgtaacctaaacctaatctcagcaatgacaccttataatttctgtcatgtgttatgaattagaggcaagtcagtaagtccagttcaaacctaaaggaaagggagtgcacgaggatgtgagttctgggaggtgaggctctctggggccatcttggaggctgccgactacagtgtgaactcttattttattcagaagatttggtatatttgctggccagaaagcaaggaactgttctaacaaactttctgaatctctgaaaaaaactcatgaaaagaagagtgaaggaggcagagtcccggatattcttagccagaccctccatgagcttggctgccatctgacacaaacatgtcagcggggacggaagatgagcacggtatgtctgaggcacggagcctgctaaagtattctgaaagtcagatcgatcacgggctcattgaggttctagtaatcctgcagaaaagccacagagtctggcttttaatagagggaaaggtgagccacagctgtctcataaaatgcgaggatgtctcctccatgctggctcccttgctgatatgctgcatatgctcaagtcacagtgcattttgtttgtcttgatttttcatttctgttttaaactcatgctaattcctgaaaggataaaggaggcatatagttaaaatgtgattctctattgagatttgggttttctggggcttcttaagaagactttgctagccacagtagctgattcctctgggtttctggccttataagattctagctaagctttcagtcttagcttattacatatagagagagggggcaaggttaagaacacctccatactttttgacttgttcaaggatcactcagggagtattttatttgatgctttcaaacaatatgcatggccagagttattatgattgtcattatttgggaaatgaagacagtgaggtttggagagtttcgatcacctgctaaagatcactctggacacaggtagggaaagggccaatgcttgatgcaggcctggctgactgaggggttgctaactcatggtgcatctctcttctccactgaggaaatagtccccaaagctataaacagacaaaccaaaaaaagccctttatactcttggatgcttgcacttatagatcaaggcctatgtttctcctcctttcttgacacccagtgctgttgctggtgtgagtgctggggttggcactccagggttcatcagtccatgtatgggagaaataaaccaagggctttggagcatggcacattccagttcaaatcctaattcctctctctaccaccttggtgaagttactaacactctttgaatctcagttcctttacctgcaaaatggagttaaaagtgtccgttagtgtgcggtacttagtaagtgcaagtgtttgacaaaaggaagttgctttctttcagtggagtaagagacagtcaagtgtttggtgcttgtctgaggtttgctagattccttcatcaactggaagggtccaagttatgatcttacatagcctgatatctttaatagaaattgttagactcagtcttcactattaaagttggtctttgtgtaagatgccaataaaattacttctccctgaaatgtgtttctgtcagactattatcccccaaacctggctgggcattgatgagggactccactagagcacgttccagcagcccataataaaaggaaagagccactgaatcagaagcagataaactccttatagtccacttgagaacactggcctggttccctggttttgctgaatgttgttgcatgtggacataaatcacctactcattttagagaaattttacctgtagctaaaaatctaaggagcatttgaaaagtgtagacatacgtagactaagagaaaataaaagccaaattcaattacatggtacaccttaaagtaagtgtttcaggaacagaaaaacccaaataacatctaatacatagattccactaggaggaaactgagtgcccctcaggttttggaaccagttgaatggacattgatagatttgtcttcctttcagattaaattgaacttctcatgtgaaagtagtttcccagcttctgctcttgaaagctacatttttttccttaactaaatttctcttgtttagatgtcttagctttcaagcagcttgaaaagtgatacattggagtctgggaaggtttaggagaaattatttatttgaaaattttgagagaaaggaagagtctttggcagactcttccttccctctggtgaagtggcatgtggcaaatggacccttcactgggcttcagcgttttctctcaggctcaaatgcccaaaaatgtacaaaatgacttttcaacaatttttcataacttgacaagataaatattataagggctgaacgtgagcatttgtgaaaatgagggctgtcctcgaaagagtggcaataccacataggagtactaagcggacagcaggcttggctgttaattagataatgtgctgagaacttgtttttcctttagcatctgtggacataacctcatctttggggttagctggcttacagagagatactaatgctaatttatagctcaagaaaatattttaattttaggcattgacagataaacatatctagacatgacagagacattcacagaagtgtggaataaatgctattgttcatatgtaattacagactccctaaggactgagcctgtggattattcaattgttccagttcttgcttatattccgaagtacagcaggacccttaccttatcccttatgcatagctgagcagtgtggttttagaatagggtttcccacgtggacactgttgatgtttttggttggatacttctgtgttgtaggggccgttctgtgaatcatatgatgttaagcagcgtctctggcttctactcactagttgtcagttgaaatctccctcccccaccatgactataaaaaatgtctcaagacattgccaaatatctcctggggcaattgaccaacttgaaaatcactatttttgaggaatatctgttgtgactcataatatttttgcttactttcttatctcagaatctgacactattttctctctcttcgttccacttcttcaggcttatcataatcaccatgttattgaacaactatgattaggacattagacactcgtgttttatatacaacaaatatttaccaagtgtagattgaaatctagggtaggtgtcagagactgatgggtgaaaagcctaaaagatagatgcaggcaggcaggatcaggaagcctcaaatgcaacagtaagcagctggaaatacacacacacacacacacacacacacacacacacacacacacacacgtatagtcatgaacaaggcaagaccatagtgctcaaagaaattataacctagttgggaaaatgatgcattcatgttcagaaaaacagtaaaaggcagcctcccccacataccaaatgaatggcagagacagtaaaaaacaagatgagaaagaccgcactggactaaaaagaaaaaaatatacaggatgaattaactttctattgctgctataacaaattactaccactttagcaacttaaaacaacacccatttattatctcatgcctctttaggtcagaagtccaggttgtcttggctgattcctcttctgtaggtgtcacaaagccaaagttaagatattggttggtgggggttgttatggagtggttctgggaaaaaaagctttccaagctcagccaggttataggcagaaaacatttccttgcagctgtaggattgagctcctcttctccttgctggcggtcagctggggactactctcagctttgtggcctcctctggtccatgcgtggggagtcctgcatttcagaggcagcaacagcacaccaaatccttctcatgcttggaatctctcttacttccccttctgccacatctcttctgcctctagacaaaaaacgttttctgcttttaagaggctcatatgattagattgggcctacccaagtgatttaaaataatttcccaatctcgaggccaataaccttaatagaaccatgaaagacaatgtattaatagtttctggagattagggtgtgaacatctttgggaatggcatcattctgcctacagagatgattgaagaaggcagtagtgagccaaggacagcaggattctacacatggacttgatgaacagtggggctctaatgaaaatttttgcacacagagcattttttaagtaaactttttatttcagaataattttagatttacaaaaaagttataaagagactttctatatacccctctcctagttttcctcatttggtaccttgtcaaaactaagaaatgaacattggtacattgctacaaactaaactccagccatctgcatatctcttgcttttccgtgaatgccttctctctactccaggatcaaacccagggtaccacattgcatttaattatcatacctcccagtttcctctggtctgtgacagtttcccagtatttcctttttttcttaatgaccttaacagttttaatgtgtgctggccaaatgtccactagaatttctcccaacctgggtaagtctgatgttttttcctcatgattacactggaattaaactccagagcccttccagtcaccttacatgatggggtcatgatattcgcatgacatatctggtgatgtgaacctttatcacatggttaagatagagtgtgccaaagttctctactataaagttactaattttctctttccctactcaaggggattttttgaatgatttattttgacatactgggtagaagggatttgaaatgaaaggggggcttttattagaaaataatgattggactatgtgcctatgtaggtgtaaactatagagatagttgtacttaaggcagagagagagagagagagagagggaaagagagagataaatgaggaaaattcaatagaacctagtgtttatcttgaaggagagggtcagagggtcaaggataatttcaaagtgtcaagcatacacaataagattaatgacaatatcaatgacaacaaagtataggtgggaaggtaaacttggatgataactttagttttacttggattattttaattcagaggattttattgttcttatctatagggccatccaggaaacagttgaaaatgtggaattgaatgtcataaagaaggtcaagattgaagacagccagtttgcaataaagtactattaaaatggaaacattatttcaaaggtctccaaatatgttcatttcctaatcattgcaatttattcaggggaaccaaccttccatgccagacatgtttttggctatcctcatctcaacctttcattatgacttcagaataaaagcaaggtgaggtcaaatatcagatccctgcagggagataacctgggctctttgtctgatggaatctcagcatctgacagctcactgctcttcagggaaatccagggcagctgctttccttgacattcaaaatttagaacttagaatggagccaagttcttcatggctgctcctctctcctcctctccagtgatccagcaaactgagtgctttgctggcagccctaactggctcctggagttttaagacccataagggaaggaactatgtataatatttctctttgcttttgcaaagtacttgccatggaactagaagcatatcatatcactggggggaaatatgaacttgaaagttagatggggctgggcacagtggctcatgcctgtaattccaacactttgggaggctgaggctggtggattgcctgaggtctggagtttgagaccaccctggccaacatggtgaaacactgtcactactaaaaatacaaaaattagcagggtgtggtggcatgagcctgtaatcccagctacccaggaggctgaggcaggagaattgctggaacccggaggcagagactgcagtgagctgaaatcacaccactgcactccagcctgggtgacagagcaagactatgtctcaaaagaaaaaaaaagaaaggaagaaagaaagaaagaaagaaagttaaatggacttgagttcaaaaccttgctctgtcatttacagttaagcaacaaggcaagttatacaattatttggagctgcagattccttccctgaaatactaagaaaatagtatatacttcacagaaaggttgtaaaccttgtatatggcagtaaattgaagctcttagcacagaatctggacatagaagactcttgataaaggttaataacaacagacacctacacagtacttactaaggatcaggcattgcactaagtgatgccaattttaccccttcattttaatccccacggcaacccaatgaggtaagtagaccattgttatccccattttatagatgaggaaactaaagcaaagactggtaaaatgacttgccctacatcacaaagagcagagatggaattagaatccaataaatctggctttttaatctgtgctcttaagaactataacatactgttattatgcacctagcaccaaacagtaatccacaatagctcttattattattgttaataaaggttttttaataacttaagcttattaagccattaatgtaggagaagacaagaatatttgctgtgcccacttttacttaacactagtttagctcttctagtcaatgcaacaagaaaaatgaaatatttgaataatttaaaaaactatcattttttaagatgttaactttccaacataaaatcttaacataacacatgtaaatagtaaaatggctggttatcgaaagaaaagttcaaattcaaaagctttcctatatagaagttatattacacagaattcttgggcattgcgaaggcccacagacatatttaggatttgatgctggcagtcgtctgagaattcagtgaagaatgttactcagaatgcctccctagaacctctccaacatggtagtgtcaggataaagatactcctcagctttcaatgccatcttcctttagctcttctccaacaaccttctcgagtcccatcatgtttccactaagagtctccttaggacacttccagcttgtccacaaaactgagttgtgcacaacaatcattttattattattaaaattttgtgggtcaggaacttgagaaggccctagctggctggtttgtatttggtccttctaggcagctgcatttagatatcagctagacatcattatcagaaaacttggcttggctgtgagttcaagatgttgtacgcgcatggttggtggttttcctggctatcggctgagaactcagctgtttctgtcaaatgggctgtcaaattgtgacctttctagcaaggtagtctcaaggttgttggacttcttacacaatagccagctttccccagagtgactgcccaagagaatcaataggaagctgaatgacctattctgacccagccatggaagacacacagcttcgcttctaccttactctgtttgcttgaagcagtcataagcctgccagattcaagtaaaaataatctaacgaatagaataggagacagtgtttgtgacaaaaaagtgactaaaagattaggtgatataataataaaatttatcatggtaatttaaaaacttaattataacttcagataccacacttatttttctagcttttgcaagtgttaattgccaataagttccactggatccttctctgcgacttgccattagctgaagaagccactttggccaaagaagtcctgtccacttctcagaatctcatttctaatgattggttgatgcagaatataaacaattttcttcttagtacaatttaggacaattctgaaagttattgaagaaagggggcaccaaaagacacccattggttcatctggggaatacacatgttcttcccatctttgtgatgtatgaacaaccttctgatgatcagaatcatttgtcctgccaggatgttgattccttcagttgctggtctcttggcaaaaagagtagagtcagaagtgaccaagcagcagctgtcacttgggttagtaggactcagctctttcacttggtagaattgttttccatctaggaatcaaaacgtctaaaccagctttggaaatgggaggtccaggttcaccaagtgggaaattcagaatgacggtaaatgtagcctctcttacttccactccttggtttcatccatgatgtgattctcatattggatctcaccataatatcacatggcatctttccctccagtggacagttccctgattatagctttatgagaccctaggcagagacccagctaagcggtgctctttttcctccactgaagctatgagctcatgaatgtgagaaaccacagcctggagctgatgtagagccttttcctgctctaggcctaggaggatcagcgttatgtgtccactctgccaagctcaagtcctcaattatgcaaccaaatcctaatctagatgttgttatgaatgtattttgtagatatgattaatagctgcaatttgttgactttaagtacagaaaattacaccaaataatctgggtgggtgggcctgattgcaatcacataaaagaccttaacagcagagctgagatttccctaaggaagaagaaattttacctggggacagcagctttggttcctgtcaaagaatttccaggctgctcttcttgattgtctgcactatggatttaagacctgcttagccagcccccaaaattgtgtaagccaattccttataacgaatcatatgtatattaacacatacacatatacatatatgcatatgcatgtgtctctgtgtgaacacacacacacacacacaatgatgtatgtatgtatatcctacaggtctgcttctctggtgagagaagactgactgactgagagaaggccttactaaaatttggcagtttttggttgttccaaagtccacccctttcaagtagaagcagggggttagtctctctctatgcttctaagaagaccctctggccttagtctttggttggacatgaatcaccttcagcccttcattgtccatcttcacagtgttcattgtgcacagcaacattcatccagttccgtagtcctcataattattaattctcaaatatttcttggtcatcttttacattgcacatatcaatgctttctcctttcttggtatgcaatcttggttaatactggggagaattttaataattactccactgttatatgccaaggaatgtccatgctccaccaatcaccatttttggggtccttattgcctgccagtctgcaagttatctaactgagttccagtaatctcattttagaattttgtctcttagactcctggcactgcctgtcataggttgggttccctgggaagcagacagtgagatgggaatttacgagcagaatatttattgtaggaatgctttcagaatccacacctgtggaggaataaaggtagcaagattgggcagagtgatgctatagcaatattgacattggtcaattctatgtaaagttatgaagctgagttggcccttcagagttgtctaaagttgaacagggggaccaggcatttatacccctatgttgaccggtcatcaaatgtgcctctaaatccagggaagaggcaaaaattgtgagagtcagctctgtttagttgaaggcaagttccaaaaaagaattcagctgaaaactgctggctgctaaaactcccagaagtagggaaatgagggttttagacctgtacaggggttgtaggaggtaccccatggcatccattacagcctagcatcaaggcctattgctacaaaaaacagtctaccaggttgggatccacatacatggatcatatctttaaaaatgtcccagtatttgtaactgggagtccttagaaatataatagccttgaggttgagtggggttttaaagtagttctattgtcagagaaacatgctttagagataaaagttttctcaacttccaaagcaaaccaaagattcctatcattgtccctacaggaaatgggcttctaaagtgatagaacttctagcatgtaatttgtttctatgtctctgcctggcatgatcatggaggaaatgatatcagagcacggaaagtaggacagcaagattgactgaccaaggttcttattccccaactaatgcagagagataggattcttcttgtccaggagtattcggcatgtgctatggatcaagggtctcctcataatatttccttttctttgctttgtaagtgggagtgtttgagattattacgtttttccagccagttttcagttggtatgcttcagatgatgaaaccgagtacttactttattcatagacctcagaatattgaaataggattttagtagaaatacaggcagaatgaatattcctttgattcaaagctcatttcatgggatgaatcgttttaagattcattttgtattatgaattatgattcatgatatgtcatgacatgaaattagcatgcagtatctggaactgactttaggctataaccccttgggcagtgttgaacatgattttaattgtacatagatacttgtaatttgttagatagagcaaatgtttgaaaagaagggtatatacgcttgttggtcactaaaggaagactcaagctattgttttaatgtttagcctgttttttccaattacatatcctcttatctttaagataagccttatcatatgtcctcagttggtcagtgaatcataaaatctctctgtattgcaccagctatagagttgaaatgttattcacctctggccaagaatagcgacttcttgagtatagagttggtatatgttaattaccaacatatacctttggggcagaaattaatgttctgctccacaattaatgtttgaacgttgaaaggcaggctttctttttcagctgaggttgccaaagtgggagaacataaatacagattacaaagtggccctctttctcactgcatggaagatgctacctataagaaagaataaaaccaacacagaaagcgaagaaacagagctcgagaaaaaggattgatagtcatttgggcacctctctgcaggtgtacttgaaataacttctaaatccagacttcttggtaacatgaggatgtaattttttcctttagctcaagctagttttagatggttttccaccactcatgaccaaaaaagtcctgactatagacatcatctgtaatctgtttgctacagccaatggccttttaccagctgttagtctcattcagttcttcttaatatttccccaggataactggtccttggcccctgacagtctctttcccactgctcagaccctcccatcttgggctattcaagaagcacaatcaggagttcttagcttggttccatttctgccatcaatttactgtgtatctataggtaaattaccttacttacctaggcctttatctcctcatttctaaagtgagaatttgacacaaaattactcattcagctctaaaatcctgccattttatagcaatagaaagttggaagaagaaattgtgcgttagaagttgcataaacttaagcatatgcttgattcaaatgcagatgcactcaggtgaaataatttttaatttctctttttaatgttgaataaagtcatgatgttctataatatgtgcgcttttttccaaaatgaaggaaggagacctttttcttaaagttgtaaaggatccaacaatgcccagtgttattgttgcttgaattccaattactggggaagcattctgcacatctttactcatcacatttcaacatgtcatcttctctaagtgaaaccagttgtattaaagcagctgtgaaactccagtcatcctcctcctttcactaaaaatgtaatcataaaaattttaaatgcacatattcattttcttccccttcaaccatgcaagtacacctcggcaatattcactgcaaaagtggttatcaggtctctctctatgaaaatcttaatggaaaaattagatacacaacagtctcctgctaaactaaacatctgattctattacttggaaaaacagttaatattcatttttgcatctgccactacaaatctttctagctttgttatttttcttcctctctattcttttcttccattgtgtgtgtgtgtgtgtgtgtgtgtgtgtgtgtgtgtgtgaattagggaaaagagaaaggaagcatttctcagatattcaagctaatactgtactaaatattaaaactgcagaatgtcaagataatatctacacacagaaagggtcttgccttactcacatctaagaaccttccatttctttgtttcaaattaaatgaaatctgagtcccggcccctatttctcacagtagataagaaatttaatatctttttgttgtggagaactcttaccctcttgagattcattttggaacccttaagcaccacgaaattccaaagcatttggctcaggccctatggcctgtctacaatggtcagcaggaatgtaattgtctaaatctgagtggttttttgaagttgactgcattactgtttctatattaaacttgtacaatgagattattcatgaggctaggagccttacctcctcatgtgcagcctttctactgtgcaatatcactaatagaagtcctatcacctttctcaggagggcagtaactaacactttcacctgtgggatctcttccctcctccacttgcttcctagtttagacagaagttttaaaaaaatctatatgcatctatctattatctatctatctatctatctatctatctatctatctatctatctatctgtctatcatctatctatcatctatctatctctgtctatcaattatctatctatctatctatctatctatctatctatctatctatctatcagatttgaccacacctaatctttaaagccctccttctctaggttttgaaaactaaggccagggaaagttgttttctaaaagtttgtaaacttctattttgagacaagacagataaaaacaataaataaccctctcagttaatgtcctggacatatttggggaggcttaggggaaggaagtgatcgttacgtgtattactaatacagtgtagtgggcaggaagacaaactgtgttcatctgggttcaaattcctactactccacttcattgtgtgactttgggctgattatctcaactctctgtgcatgtttccttatttataaagtgagggtatattagtactgaactgatggggttgctataagttaaataagttattccatggaaagggcgtaggaagttgtcaggtgcctagtgagcactctggaaatgtttcttattattcgtcatattctgagcctgacttatttgaactcaatagccctcaagatataaggtacaatctcataacatggccttcagaatcagaggtttaaatcctgactctatcaagtgtcagactttgggggaagccgtgtaacctctgagccttggtttcctcatctggaaaatggagatattagtatctattcatagggcgattgcaaatattaaaagaaataatgtatgtgaatcctttattagatttattaaaaaatgtttaacccttcaccacagtgaggaatttatttcctcctctcattacacactgtccaactttaagatcacacctttgtcaaaggacgccttagttcatctttcttccgaatctctgattgcccattttcgtgatcacagggctagatacaaagtaggcatgcaattattataaatccctgttgaatttatctaactcctctgggactgcagaagtaggcctagatgatctttcaatcggctgtccccagtcattagaagaagtacaccatctgtagaccagatctgccagcaggactcaacctccccagctacattcatttttcatgaagtagagcctcgctgggagagtgttcgttcttgccatggacgctctgtctcgagccaagtggccaggctgcctgaatgcaagcagatgcagtgtgcctggcctggaggagtcatcagaagggcccccaggttgcctgggaggatgcatctggtgcccgtgttgggccaagtttaacacatggacctgttagcaatattaatgactgtcctcacaaggacccagccaaatgtcatttatattcagcagtcttccaactcactctgtgtggccaggctgagtgggaggagtaagcaatgtgctttcaatagaaatggcatttattctttgagggaaccatgaggagctcagctcacatccatcaatttcgtgtttattattgtttttagtcaatcaactgttaaagagttatggtttttgtactgcgtgcccatccttggcctaggcactttgtggagtggcacagaggagaactgtttcccccggaatattgatttacaagcattcattcacttcccccattgttatcaaagagtgaccatgtgttaggtattggtgataactgaagaaacgagacagaacaatgcagcctgagacagtcatagaacatttcacagcagggaaggatttggcattgactaaaggatgggacagattgggatagctaatgtctttcctgctttggcccttttaatttaacccagcccatcaatacaaaccgtcagagagataatgcaaacagcttctctagggacccattttctctctcagtacttttcaggctacctactagctgttgttggagctgcaatttgagtgtgagaatgtctatttctcaaacctaagttaacatttggaggctgttggtaaataatgtgctctggttctcttatttctgggcatatgaaagagataaactttcttccccttttgaaattatgtgtggtcatgtgactaactttggcgaatgaaattgaaatggaagtgaaccgtgttacttacagatggaagcttgagagccagtgtatgactcccaacagccctttcttctaacacatcatacaagcccatgcagggatggaaccccattaatgttggagctcctggtggaactgtactgatgtttattgtgaaggaaaagggcatgcttgatgtgttaaatcacagagatttgggggctgtttgttaccgaggcataacctggcccaacctgcctgaactgaaagcataagacaaataccagttataatagaggaccagtgtagtcatgggcaaaacagatggctgcctacccctgaggacaagggagtcttagaattcctcaaatataaaaaaaaattatctctcatacctgcagtcacaaagaaccagtaattctcaccccctgtatcttctccaaattatggcaacatacttcctgtcagaatgcaaatgtgatcccctacagctgctatttaggcagcctcacagactgagtttccagctgtgtttctttctagcccagtggttctcattctctgtgtttgcatggccctgtggtctaatgcttcatccagacacaatgtgactcacctttttccctccttcaacttttaaggggaagaagttgatgagagcaattttcttaattaaaaaagatcttctgtgcattgtatttaaaccttttacctggtactgcttattgctagtgaagtgtagtcctaaataccatatataatcatttcagttacaagtatttgaatctgacattcttcatggtgtcatagaaagaacaagaaggtgtttaggtattctatgcctttaatcacctcaagaaacactgaattattactcatttctgtctcctggttcaaggattcacaaacctagctgtgcacatcctctggaaaaatatatgatacattaaaaatgaagggttccaggagaaaagaaaaactccccagggaattaaagcacaagcagctcagagccagctcacagacaggatttggagactgagagctttaaagtgttcaacttcagtgctgtgcacttgcaagagacatagggcacgagaatggaatttgcattctgtagttaaagcaaagttctggccctgggcagagagcagaagagtgtggtacaagggaaagggcacttgacatggtatcaggagagaagggacaacctgtgttcgcagagcttcactatcaggatggaggactgaggctgactataaacacataacttcacaatttgttgcaggacattctttttttttttttagtaagataaaggcataaatcaataaataacttcccggctgcttcagggaatttctgcaaattgatttgtccatacaaatggcttgcttattggcttgcctatccaacctagtctattcctcagactcacttcaagaccccactgaattgtgctaccagtcctaaaccatgaccttatgaaccaagcccaatgacaattgatttcctgcactgaaagatctgccttaagtcacttgagctcagaccccaaaattctctattctcccaatctcctccttatgggatactactatggttctgtggagataatatttccatttcttgcattaagtaagagttggtgaaatacagtagattaggatcatacatttatctaggtcatatgtcaccttctccttctttagaaatgtaaaagctgtccttttgactatttgccaaaaaattgcaaaatatattctaaacagcaaatttattttctctcacctgtttatttacacttgctaattaactagtccagtaccaactgcacagggattctggttgtgttgatgatacatttgaacaaattaaaaggaaacaaatatgcatgttttttggccaaggagtccaagtttcaaagccagtctgcattgcatcttttcccaagggaaattcaaacagctctgtaaagagaaggatagctagtgcaaatggaaattctatagtctcatatgctggtgctccctccttaaattatcatttccagtttcattattgtcaaagaagtagatattcttgctgttgatgatgatcctatcctcacaaaatacaaagatgagtttggggtgtttggacttttctttatgaaagctctggctgtaacacaattttgtttgcaaacgaagactgctttttgggttttatccattctaaaattaattagccctttttataattgtagctggcaaatctcacactccaacagacggcaaggccacttttctgctaactccctcattgcaatggtttctgcaaatcagatccatttctaacaaaccagacaccaattttagaattttgctgtctaaacacaaacagaggaaataaatatcccttcccacccaccaacaaacacccagcacttactgagcatctaccatgggcaggagattcatttcacgaatgctcacaatagccctatgaattgggtactgtgattaggctcattttaagaggagaaaatggaagcagagagagcttaagtgaatttccctatggcagccactataagatgtggggaccctgggatgagatctttacccactgcccccacgacctgtgcacctaaccacattctccacggtggcctctagctgatgcacaacagaatttttcttattaaacaaacctcaaatatctgcatttggattactacactgtttttttgttgttgttgttattgttattgttgttgttgttttttgagacagagtctcgctctgtcgcccaggctggagtgcagtggcgcgatctcggctcactgcaacctctacctcctgggttcaagtgactctcctgcctcagcctcccgagtaactgggattacaggcatgcaccacgaggcctggctatttttgtattttagtagagacagagtttcaccatattggccaggctggtctcgaactcctggcttcaggtgatctgcccgcctcagcctcc

SEQ ID NO: 519 - DNA, 20001 bp, Homo sapiens
aaaatagtctctgggtcagatgattttgcatgactttaggttaatgttaagtgttctgagcctgcttaaggtaggctaggccaagcttcgatgctcagtaggtttggagtattaaatgcatttttcatttacagtatttttaacttattatgggcttacaggaacctggctcccatcataaatcaaggagcatctcttttggttgtggcattgtatctgtcctcacacaacccctgtgggtcttgaccaccatcccaggccccagagcccctgcctcagactgacccttgcacctcttcccacctgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcattccgagtccaacagtattactgtagttatctggggaaagataaacgccacccagggcttgcttttcacctgtgcaatattatattctctgacggggccaggacagttcatttctggctcttgtgggggccagttcccagagagcacagccagtacaggcggctcccaagcctgccaagggaggaaggacaagtgaccagctttcctttccctacaggggcaccagctgcaggaaacaaaaggaagggtgaaatgtccctctagaaatagccgttcccagtggccagggcactagctgaagtgttgattttccaaggtgcagtattagaacaaatggacctgatccaaaaatatgagtgagtcttgtccttccaatcacagtgaccgtggcacccaggggtggaagcagaggctgcagagctccgctcgatggctttgggtcccagctcccctttcctggtcccaggaccttgaacaacttgtttgacccctctggcccccgtgttctcctccctcacgtacaaatgatgctgataatgacacctctgttgtgcctgactcccagcgttgagggtcaagtgctcagacctccctgtcttccagtgtcagcaactgtgtgcagcggtaaacaaacattcttcattgcactacttctgcacacttcctgaggagtagctgtcactcaaaatcacagagtaacaggaagagaagatgaactggttaaccatccccttccaggcgagtttttccaagattcccaacagctcagctgtcactccaaggaccagcagctatgaggttaaagactgcacgccaggtgctggggtcacctaggtactccctggggctcaggattcttgaggctgcaccatctccacttgggagttggcagaaaggtcccaaagatctccctgggaggattacggggaatgtgagctcagtggggggtccacctgtcagaggagctggcaatcctggggccgtggtgggggagatgagctgggagctcacagaagcagtgatggcagaagcctggtccaaaagtgagaccttttcctggtgacccgagctcgcaggccttcatctatgaaataaagggcttggctgtatctgcatggcccacactgatcttcagaacaccagtgtggcaaaaatggcgataaataggcccaatgaatatgcacaagtcagtttagaaaatgatgtatcatgtaaagtgaaagcagtgcaggctcctcagcgtcttcactggcccagtgtggatgctgacactggtgggaggggagctgtgcacatagcctttcccaagcatgttgaaccagagaccccatttgctcacacgatacctgctaggaactcgtggaccaagtggtcctcggagcacattttggaaacactcaggtaaatggtttctaacatcccctcctgtggcaatgccatttcaggtttttgagcacccacatcttccaggtttgggagcacagatcactgtccagtgagcacagaggaggcaccagaacctacacatagacactcattggggtgaaaaggctccagaagaggatgagcccagggctctcgaggcctcctagagagcaggtgcctatgtgggggaaggatgatggtaactcattcctttctccctcattgggcccaggggctgtctatactaagcttgactccctggccactcacctccccttcctcacctccctttatcctcactcttttgcctgcctagtgtcctggaaaacaattgaaacacagtctgctcccagtctactgggtccccagacccagccagaatcaggctcagcagcagtagtgatgacatggaagctgcagagctggtttgtcccaggtggcctagctcagatgccacgaggagggaactgttgcaggctaactgcagaggccagatggccacaccagagagcagggcaacttaaagagataatgcacacacacacacagagtgcacactggtggacacttgtgggcaattaataatcctctcttagattagggaccaggtttttaaatctgatacttcctccagcaatgcactaagtcattctgcagcacgtctgcaaccagtgttagttggggtaaataatgcacaaatttgcacacaccaaagagtcaaaaagactgttaagaaggaagaaagaggagaggaaaggaagagaggggatggggcagagaagggctggaagaagagggaaagggacagagctctgtctgtagaaaatcccagcttctttgcacataagcctcctttaatcctcgaaataatcctggcaagtggatatccttatcctccctttagatctgtagaaattgaggtgcagaaaggtcaatgagctttactggaggtctcacagtttctaatggcagaggagccatttaactcaggcctgtctggcctcccttcaggaggttgagatgagtcagcaggagctgcccagggagcagagcaggtggcatcaagactcatggatgctggcatgactgaccagtgctgggatcagagaatccccagccaggtctctgccacccagtggccctggacagtgatggcccaggcacctctgccagcatccccatccctagtcagagctggcctggttgagaggtctctcctggtggcgagagataatgcagtggagcctatctgctcttggtgggatgattagcttatagagatagcaagtgctgccagcccggtcacacctcatccacacttccagcacccaggacgcttgcacccaggccagtcttatgaaaaggaaagtgatcatctagattacatcatgccaaagcatccctaccaacacttcttagatgatttgtgcttcttcaaagtgctcattcccaaactaagagtatttagtgattaaatttcagattcagagacagatagataatatatatgtgtgtgtgtctgagtatatagctgtaatccacaaacatttattaggtaccatgtaagtgttgaaattacatagctgaatatagcagcctctgccttcaggggtccctagcttaggggagaagataaacatgtaaatatatataagccctaaagtattatggatgctgagagagtagtgatacagatcaatttaaaacactaaggagagagagatcagttctatcttgggagtgagatggacttaggaaaggctttagagaagaagggaggcttgggccagttgcacagtatataagggcttgaccacagagcggcttcagtcccaagctaagaaattaggactttgttgcataggtaataaagagtcactgaaggaacaagtcagtctctatcatatggataagataatgatcaagttaaacaagacaaaagatgaaaatgcaccatggaaattcacaaaggggcttcaaaagatctagcaaggctcagaccctgcctgtggagctggaggcctccccaccctggggctcacccactcctccagctgctccattgtttagtctgaatttcacatgacttggcccatcctgcctggagagagatggatctcatctattcaccagaagaagcggcaggaggtcaaggctttgagccaattgttatgtaaatattagagagaattttttcttctttttttaatggaaggaactccccttcatgattttatctttttgtcctccctggagagaatctgctcaattgtttttcattccttacctaaagatttttatcatcatagcaacgggaatgatttaggggccaacagtactttagctggcccactgccacaagtagaactacaggcattttaatgtttgcaatttagcatgtcagcatgatgctatgaaaagagagtggctctggaattggacagacttggacaaaaatctcatctcaggcactaactagctctgcgtgacctaggaagagttacttaacttctccgtgctccacggttcttaccagtaacatggtgacaaaatatttgcattttcatgttttgaatagtaagttaaaggaagatataaacttgccaagaattgtgaagggtctgaggttttgccctgcttttaagtgagcaattcggcctataccagtttcatagatgctgacagaagacatgagatacctgggtcagagataaaggcacttacagcccagcaagcagcatgacatcagcatatttgaatggcatctcttcatctccaagttagacgtgggtgatgtgggtgatctcagaggatgtttatccatatggtgggtggagttccagaagagaaatcttgaaccaagaaaatcagaatctcataatgggcagtaaaatgcctgccttttgcactggagggagctactactgggtcttccaagtctgtttaatacacaaacatcctggaaaaggtagtcaagaacacagtgcagttcctgcctcactcaacagatgtgaaaaatgcaagagacccatggagaattgtctcccaaaaaggtaggcactgcctaacattgtgcctggtacctgtgagtactcaataaatacatgttgaatgaacaatgcaatgaactaaataacagggctcataggtctttaaagtgtcccagctttctctccagaaaatcaaaaacatcttctgtttctcaaaccacatgcaagagtttaaagcagaaaacttttctccatcctctggccagtgtatgagagatctcactgcaggcttggtcttttttattggtttgctatgacaggaacacatagaggcatacagctgtgagaatgttttggttcatgggtggatccataaatccagagccctggcaataaggttgggtggagttcgccagcctctattctaagatcatcctgtaatcaagaggtctcttgccaacattatagacctccaaagctgatgttaagatatgcagatctcctagtttttttagaaccaaatacaaaaaaaaagccaccttttatttttcaagtagctgaaattattatcattttttttctctcaaaaagtacttagaaacaagttctatattcagctttctcaagataaagcttcctctgggcttactgagattccccaagtcagagtgaggccactcctttctccagggaaggaccttttttgttttgttttgttttgttttgtttttgagacagagttttgctctcgttgcccaagctggagtgtaatgatgcaatctcggctcactgcaacctccgcctcccaggttcaagcaattctcctgtctcagcttcccaagtagctgggattacaggcgtccaccaccatgcccagctaattttttgtatttttagtagagaaggggtttcaccatgttggccaggctggccttgaactcctgacctcaggtaattcgcccacctcagcctcccaaagtgttgggattacaggcgtgagccaccgcgctcagcccaggaaggaccattttgttcatagctgcagtgcacggacattgtcttcttaaggtaacaaatggaggtgttagggtgaaaggatggtaggcatccagacctcagctcccaggcagagataacaccattaattccttcattcggaacacaaatgttctctgcatttacactacaggtggtgcaatgccagagatttggagctgagcaaggccttactggctccctggaggacactggctgcaataagagatgtgttaaaatagttcaagctgcaagggttccatcacagaggaccaaatggcctgaggggaagtcagggaaggattgttggagggagaattctgacatgggttttgaaggagctatctaggtgaggggatgacaaatgcagagaaatcgaggtgatattggaacctgcaagtgtgcagttcttcctgcagcttcaggcatgtatggaagtaaccaaggatgactccgacacagagactgcaaagaaccagctaatgagggggctggccactatgctgtaattgaaggtggtaagagccctttacaggaggaaagtgggtgcagatatggtcagatttgcaaattatgttgcatccaatgttgagaggaattagaggttgtactctggggaggaagacagcctagaaattactgaggcctgaacagggaaaagcaccttatgagagatctttcaggatgagacaaaatccagttaattttttttttaaataaaaatatggaacgcttcatgaatgtgcatgttatccgtgcacaggggccgtgctaatctctgtatcattccaattttagtatatgtgctgcgtaagtgagcaccaaaatcctcttttaacacaattgtgaatcaatatgaccctgaattggttatgaagcaccatgtgtacagaacacaatagcccctggagcaaaagatcaaactagacctgttgagtttgtggatgaagaccgttcatctgcctttgtactaaaatctctatggaataaaccaagtttttaagtatcacatagacacatctgcagctcctctgcaacaaaagatacctaaccaggatcccaaagagaaaatgaaagcaaaggattcagaagggctacctcatgaggcctggcctctatgcctctgggaggccagggggaaggccattccacccagacttttgacctgagtcagaaattttaccctgcaagttttcttctttgggatgagtattagaaagctctctgccaagtacgtccctccaggcagggaggaagcagggagaatagtgagaaggcccaccaccttccctcttcatctggagacaggagagccgaaagggatgccgaggcatgtgtgtggagtgtgtggtgggagggacacaggagggaagaaaatgtagatgattccaagttcactactcttccccggctcagctctgacacgcttctcaggtcggaatgccatcctgtgcccatgtgagaacatgagaccaaaaaaaggctgtgctagaagtcaggcaagtgtttcagacaaggtcataaaatccagtatgggactcgtgtcccactttctcattttcctaagaaatgaggtcatggagatgccagagggagcaggcttcacatatgttataagtactggatacctgtgcaatgctatcatctgttccatactgggcacctgtgcaatgctggctagctgtggaatactagccacctgggcaatactggcacctgtacaatactagcatctaagcagtactgaacagctgtgtaccactagcatctgagtaatatcaacacatgtgctatgcagaatacctgtgcaatactggcccctatgcaatactgagcacctattctatactgggcacctgagcaatactggctcccatgcaatactggacagctgtacaacattggcatcaaacaatgtttgcacctgggcaatacgtacctgtgtaatactgggtatagctgtgcagtactagcatctgatcaatactggcacctgtgcaatactagatatttgtgcaatactagataccagagcaatactagtcatccattcaatactgggtacctgtgcaattactagacaccacatgtgggctgacaattgaatgaatctgttggtgtcttgcagttgatactcactaggtgaataagacaaggcagctcctgggagatgacatggagcagagtcaggtggctctcctcttggagttttgttcctcattagtaaaaaaggggtgataggccaggtgcagtggctcacatctgtaatcccagcactttgggaggccgaggtgggtggatcacttgagaccaggagttggaggctagcctggccagcatagcaaaactctgtctctactaaaaatacaaaaattagccagttgtggtggcgcgtgtctgtaatcccagctactcaggaggctgaggcaggagaactgcttgaacccaggaggcagaggttgcagtaagccaagattgggccattgcactccagcctgggtgacacagtgagactctgtctcaaaaacaaacaaacaaaaaaacccccaataaaaggggggggtgggggttgataaaccttgctcctttcttcttccttaaacttagaattagccaatgtagtgagatgcagaggtgcctaaaagtgaagaaagctctttaccatgagtatttttcattcctttcaataccctgttgaaatgtattatcagaaagatattttttgtttgtttacatggagagagattttcccctcacagacatgtttgatttttaaaacaaggctggagattttaaatagcaaagctgaattggaattcttggcagctaacagcagctaccccccagggaggtagaaggaagttctgtagcttgtttattccacccactattaatcacctgccattgaaaaatgattctaacaggaaaaaaatgtgcagctgccttactaataaaaaatacatatatgcatgtatatttgtatatatgtatgtatatatacaccactgacccttgaacaacacagatttgaactgagcaggttcactcgtatgcagattttcttccacctctgccacccctgagacagcaagaccaaccccgcctcctcctcagcatactcaacatgaagatgaaaatctttctgatgatccacttgcacttaatgaatagtaaatatatcaaatatattttctcttccttatgattttctttctttataattttcttgagacataggtctctctctgttgcccaggttgcagtgcagcagtagaatcatacctcactgcagccttggactcctgggctcaagcaaccctcccacctgagcctcccaagtagctgggattacaagtgcaagccacctcacgcagtccttatgattttcttagtgatgttttcttttctctagcttactttatgatgagaatatactatatgatacatacaacaattgattaaggttataggtaaggcgtctactcaacagtaatctattagtagttaagttttgggaaagtcaaaagacttattcatgtatttctgactgtgtagggatgggggtggtattcctaaccctcacattgttcaagggtcaactttatagggatgtagatatagatagatagattcgatttagatatagataggtagatgtatatgtatacacttgtatatatacatgtatgtgcatatatatgtgtagtaaatatgggtgtacctgtgtgtattgcattttaacatattaaattaggccagagatcatttgaaagactcttacccaaagtcactaggctcgcactggctagtgaatataaacgtgggcatgacctctctgacagtacatgtggcagtgtgccaagaatcttgtaactgttcgtattctttgatccaaaaattctacctctaaaagtctatcctgaaaacaatatgctgaaatatgggccaaaatttccgtttaaaaaaggcttataacagctctatttgccatagaaaaaaaatagaactatttaaatttgcatcattaggggaatgttaagagaattatgatgcagacttgcaattaaatattctacagcaagaaaatgatgttacaaagaatttttaataagttgaggaaatgcttatgatataatgttaagtgaaaaacagtaaaatacacaatatacccactgtaaactcaagcatgccaaaaaagcacagaaaagattggaaaatttcacctgcatattaagggtaattacttagggtactaggaccattaaaagaagttccatcagaatcaagaagttttccaagaccccacccgcttcagaggctgagacaggagggagcatcagcttgtgcctcttctctttgccttccaggatcagacacctttatgaatgtctttatgggtcattgtttccagatacttttctcctaccaagtacttttccacatcccctaccaaaaatatataataaaaagaattttaaaaattagatgagcctcaccaagaattggcactgttgtaaattgcagagtatttcccagcccacgcccaagggggtggtctttagaatcaaaagagaaaaagtgaatcatcaagattatcacccaaactacagtcaaggcccttcgttcagagagggattccagacctgtgcccagctgcactgctaacatgccatgagtgtttggaagcgaactagggtgggactgactggtgaaatgggagagaactagggccctcagatgctagaaggccagctaagagatggggcaagggattttctaaggctacacagtgcattagacatgagttctgactaacatttctaagtgtactaagcatttactatgtacaaggtataatctattaactcatttaatgctcaaaacaatcctttgaggtaggtattattattttctccccatgttacagatgaggatatagagaaaataaacgttagaaagctcacccaaattgcatagcacgaagtggcaaagcccagagctgaacccaggctttagccagtacacataataactacacaatgtgttagaaaatgctagctctgagacggaagatccacactgagatctgggaatgtggggtttagccaagggacctgcagaagaattgctctaagagggcccagacaccctcctgcttgcctcaaggcgagtggggatgccaagccagcatccccatttgcagagctggcatctattcccattgaagtaggtactttcccaagcaaaccctcaggagcagggcaaacatgttctcagagataccccacaaggtagctgtccctttgggatttccctgctttaccagagatgtctgcctgggatgggataatggaggtggtaatggtacatccttccagaaatgtcttatctggatacaaacagttaattctcaggatagaggaaagccctgggggatggtgttgccctagattcaagtgggaagctttgttcctaggccaaggcagagcaggacttgcagggccctgagacagcccagcaccacccatacaccatagtgggagaacataccttcattccaagtcaccaagcgtgcatgcaggaccttctatgtgcctggtcctgtgtgtacactaggtctatagagaagaatacctgtcctcagggaggtcccagaggcagcaacaataatagaaagtaacccccaaatggcaataaagcttgctaactatagggagagagaaaactacagggagagagaaaactgcaggatgcttcaatggtcatcttcaatgacccagaagatggtgggatggagagagaggagctggtcaagaaaacctcagaggaagaactctgttagtactgaatgggtaagaacgtatgattgagttatcagagttatcagttatctgagctagcaaatggaggatttcaggaagaggtaaatgattaggtagaaatggctgtgacatgtccaaagtgctgtgagtcgctggagcatataggtggagtggggaaggtggcaggaggcaagcctagagaaggaaacaggaagatgctcactgacagccctgcgggtccagctgtgaagtttctactttgctctgtaatcctcctgggatccccaggaggattctcagcagggagtggcatcaccaaatttggaattcagaaacatcgcttttagtgtcatgagagggaatcttccttcaccacaggccaaaatgataaaactcctgccatttttcaaagttcctaatttagaagaacccattatctctagaaaggaagtgaagagcatgcaaatacgttccctgggtatctcaccttacaattccttaacattcacctactaagacattaaagtccacaagcatgtaaacttttacagcacatgaacctgcacccctttctcagattacatgacaaagcaaaactaggctgaacgctcatgcagcaaaggaaagctcatttaatttaggcttaatatcattattatcactttttttttcttttgagatggagtctcgctctgtcactagactggagtgcaatggcacagtcttggctcactgcaacctccacctcctgggttcaagcaattctcctgcctcagcctcccaagtagctgggactacaggaacccaccaccatgcccatataatttttgtatttttagtagagatggggtttcaccatgttggccaggatggtctcagtctcttttatatactttgactttctgtcaagatagcacatgtaaacttcctctttagatgcatcccttctgttctgaatatatggttataagagagaaagcactgaagagggaaagtagcctcaaatgcaaggaggacgtttctgtggactcagaaaagaaataaaaatgcagaaaggcaccagcttgctgactgaggaagtaaaagtatttgcctggcaagggagacccagagttagaaaaccagactcatagcaaatgggccccgcaagcaccaagtatgttaagcaaaattaagtccatacttcagatgtgtgccaaaaatatatggaggactgagtaatgaaagctagactacatctaatccgattttcagaaggggaagaaatggtgggaggtaataggtgactgagaacttcccaggattaattaaaggcaccaatcttcagaatacagaaatcccaaagacccaaataggataaatacaaagaatccacacctagccatatcatagtgaaagtgctaaatagtgatgagaataagaatgtattagcagtaatgtgagagaaaatacaggctaaattttaacgtgtcaacagtattttggcaaatgtcttctcaacagcaacaaaggaagccatgaaaacaggaataatactttcaaggagaaagtagaaaaaattgtcaacctagaattcatatttgacaagaacatgatgataaaatataagtaaatctaaacaaatactgattttatacaaataataattattattatgtccaataagattagaaatatggttaaaactaaaagactgggcatcaatactgtatttagaaaggagttaaaattaacatgttcttggttcctatattgtttggggaaattataatttattaaattttgactttgataagttaaacagacctgttaaatacataacagaaaaacatgtataaattctaaaccagagcccccaaaaaatggaataagaaaaaatatctaatcaattcaaaagaaagcaagagaaacaaatatagaaaagattggacagaaagtacaaaatgacttattagaaaccaatcaattatattagaaatacaattaatgcaaatctattaaattttccacttaaaagagaagattgtcataatagaaaagtaaaacacgctatttataagaaataggtctaaaacatatcaatgcagaaaggataaaagtgaaaaagtaaaaaaaaatgcaaatatcaactccccaaagctaatataatagttataaacttgtatgcatctagaaatacggttttgaaatatataaagcaaaagttggcaggaagttcacagagaaatagacaaatccatcattatttcaggagatattgacacagctgtcttgcaaagagaggaaaaaaggaaggaagggagagagagaaagaaggagacacacaagatttgaaaaatacaccagtcttgatataatagagatcaagaaggaaggtaggtaggtaggtggataggaaggtaggtagagatgatagaagatagaagataacaatggacggatagatagataataattagtatccacagcatccaacagtaaagaaatacacattctcttcaagtctacatagaatatttacaaaaattgagctgggcacagtggctcatgcctgtaatcccagcactttgggaggccgaagtgggcagatcatgaggccaggagttcaaggccagcctgggcaatgtagtggaacccctcctctactaaaaaaatatgaaaattagccaagcatagtggtgtgcacctgtagtcccagctactcaggaagctgaggcaggagaatcgcttgaacacaggaggcggaggttgcagtgaaccgagattgtgccactgcactctggcctgggcgacagagtgagactccatcacaaacaaacaaacaaaaaacaaatatttacgaaaattgttaacatactaagaccaaaaaaaaaaagtctcaactactgtcaaaggattggtgtcttggtatcttataaaccctaatctctggccatgatgaaattaagttaaaaatcaataacataaagataatttatatatatattatatatacacacacaaattatatatatattaaaaatatatatatacacacacgcaaattcaacaacatatttcagaataacacgagtcaaagaagaaataataatagaaattagaaaatatttaaaagactgcatatgaaaatgaaatgaaatgctaatttgatattcaaagggtcttcaaaacattcatagaaaatgcttataaaaaaactaagcatggatttgaaaatttttttgcatcaaaacaaactcatactaacttgttataacatgtctgtcaggatctagtttgaggcactaagaaggataagacatcgttttgaaaagggcccttatcaaagcaacatgaattctgctaaaattgaagcaaaaacaaatgcaaatttgtggtgaagcttaggtaggtggaagaaggatgaaattattggtaccttatgaaaagtttgtggaaacaatgcccccaaaatcagcagtttgcatatggataacttctttaaagaaaggacaagaagatgttgaagatgaagcccatagtggccaaccattcacatcaacttgtgagaaaaaatattaatgttgctcatgccctaatcgaggagggctgaagattagcagcagaaacaagagacaccaccatagacatctcaaatcattcagcttacaaaactctgactaagaaattaaagttgaacgaactttccacttgatgggtgcccaagccattgtgcccagatctgctgcagacaggaccagatctcccaatggaaattttaaacaagtggaatcaagatcctgaaccattccttcaaagaaccgcaacaggagataaaatgtggctttacctgaagacaaagcacaatcaaagcgatggctaccaagaggtggaagtggtctattcaaagcaaaagcggatgggtcaagagcagaggtcatgggaacagcttttcagatgctcaaggcattttacttgttgactttctggagaaccaaagaaccataacatctacttattatgagagtatgttgagaaaggtagcagtttctgctttagcaaaaaaatgcctggggaagcttacccagaggatccttctccaccactacaatgaccctgctcattcctctcatcaaacaagggcaatttcatgagagtttttatcggatatcatgaggcatctgccttccatcctgatttggctccttctgacttctttttgctttctaatcttaaaaagtttgtaaggggcacccattcttcttcagctaataatgtaaaaaagactgcattgacatggttaaattccaaggaccctcagttctttagggatggactgactggctggcttcattgcttgcaaaagtgtcttgaacttgatggtgcttatgttgagaaataaagtttatgtttttaatttttatcttttaattaaattttccatgaaatttttgaagttcccttgtatggatggaaacgtatatccttaaatgttaatagtaggaacaagaaaggctacaatttaatgaactaaacatcttaagaaaaacaatagaacaaacctaaagaaaatggaagggagagtacactaaagatgaaagcaaaaattaatgaaaaataagcatatacaatagacaaaaaatgctaaaaattggttctttgaaatggtaaattttaaaacttcaggcaaaagtaatcaagaaaaacttgagagaaggcatgaataaataatttaggagtaaaagagaaaacataacttcaaattctgcgtgattaagaaggcaatacaaggacagcaacattataccaataaacttgaaaacttagataatatgtgcaaattcattaaaaatataacttaccaacactgaggaaaactaaaaaacaaaaattttgaatggttctatagccacttaatggagcagtagctagaaagatccctttccacagagagagcaccgggtctgagttccacagagagctgtatcaaatacccaagagatgaacaattccaaatttactgagaatcctccagaaaatagacaatgggatcattttatgaagctggcataccatggattcccaaatccaaccacaacagtgtaagaaaataaaattacaggcaacctgtctctcatgaacccagatgtaagaaaatcttaaaatatattagcaaactgaatccagcaatgtataagaaagcttatatatcaccattgggtttattctggtagtgtaaggtggatttaacattttttaaaatcaatgaatgaaagtcatacattcacagttcaaagggaaagatcagtatctcttagttgaagaaaaagcatttgatacaactttactttcattataaaaattcctagcaagctagaaatagaaagtttctcaacccaataatgcaaacatcacatagaagagtggcatgttaaaagcatttccctaaggttaggaggaggtaaagggcccattatcactgcttccattaaacatcatactgcgggtcccagctcccaaagacaggcaaggaaaatattgttatgaagatcaggcaagaacagccaaaacagtcagtacttgcagatactatgactgtccatgtagaaaatccagagaatctacaggtgaattattgaattaataagagaatttaccattactctgtagggtactagtagaggtcactttttaaaattgcatttctatacactaacattttaaaatgtcatttgtaaaggtatcatttaaaattgtctcaagcttataaagttcacaagagtagatttaacaaaggatatacctgacctatatggacaaaattataagcctgatttaaaaacattaaagaatatccgttgtctatgtcttcaatgcattccaaagcacacaaagcacttattgtgttttgaacacaaaagtggttggattttttgtttttgtcgtattgtggttgtgattgtgtagcttgatctgctgcttctgatactgacaaagaggaacaaagattaagaatagccaagatggtcctgaagatgcagacttagacaggaggactcaccctgtcaaagactaggaattattacacatctcaagtaattaggcaatgaggtattggtgcagaaggggagaaaagacaaatggaaatgagtagggagccaaaaattagagcagcacatccattcaacctaattcgtgacagaactagattgaacttctaggagaaaactctgacttttgaggaaataaagaaaatatgttttctaaggtcttgatccttctctgaactttctcatttctgctattggtgctggtgtctctgggcccaagaagatctggggcccaggcctcaggaaggggcactgttcgggtgttgctggtgcgtctcaggggaacagttcagaggctgcaatggaaaggaactgtcactactatgaggaagaaccagggctggctgattctcccaggaacagggaggagacagaaaggccacaagaaacagggaggagccattcccaggcttgcctcacagaggatcatgggggcaattagaggagcctaacaaagagaagctggcaaggtagaaacctggtttgcagtctcaagttcggcattgcaaaatgtaaaagggtggagctggggctgagagacaacagcttcatattaaactgaacaggattcaagagccagggtgacctggtgcctgggtccctcttttagactccctgtctctgtgcttctgacccacattttgttccagccttttcctcacttcacgcctctgccttaggctcctcaccactcatctgcttcctctacctcacttattcttccaggttcaagtcaaatggcaaccccctccccagggtgacctcagcctgctcccaattccttcctggacaccccgaaagcatggcttctgaactcaaccacctctgtcagctttgccttgtctgtgagagccttgggacaccagcaggctagagcacaagacccagggtccgggattcagaagagggtcctgatgctgcccaagaaacatcatctcctcccacttgccatccacactggccccagcaaccaggattgaatcaacgcctgagctttgctctagcagtgcaggtggacaagacttcctctgagactcatcgatcaaaacaccacttcattgttaattatggtcccatgaagccctagatatctgaagcctctgatccctcttgtccatcttcccaaagtaccacaagaccatttcccttcttcaaggacacacccctcccgctgctgctctgcaatttatataggaccctccaggttcacagacacacaccctccagccacagttgattggcccagggggaagtacctgatccaagctcagccaatcacagtacttcacacccaccccatttatagttgattccttccaaagacggcatttgactcaagttgggctgactcagggcccttcagtgggattttttaattgagtccagagaacatatgtctcagtcctcctgtgctggtgggatgcaaggggatgcaaggtgatgccaggcaactcggttgaaagctctgggcaagcatgttgccctccatggacacagtggagaaaatacaatttttaaaatgaaatcctacagaggaccagtgtaacttggtcacatatgcaagcatcacatgctctttcctcaggaataacagttgaagaaacta

SEQ ID NO: 520 - DNA, 40001 bp, Homo sapiens
tccctcacttacatcttatacaaaaattaattcaagatggattaaagacttacatgttagacctaaaaccataaaaaccctggaagaaaacctaggaaatattacttttcatgttgacactcaacccaggagagcacactccccctacttcatctctctagtctggattaaaatatccatctttatgctttcttagaaccctgtatggctcttcctacactgaacttgaaatgatcattttatctagctgtcacttgaagtaagttttccccataaaatatggaccatctgattacatcactagtacttattataccacctggaatatggaaggtgcttaaaatattattgaggtttttacaaagaaggactagcaaaattaaataattgtctgggcatgagattcttccctctgttcttattcctcatgctttgtattgtccttccaataaagggttcagaagtgcatcagatatacataacattcatgctatgaacatgaggagtatgggagaggagaaaaaacattacttagtgttgatggtttctcctgataagataaaacacataatgagtatttaatcccagagtgaacatggtgagatgggagacacccatttgtgattcctatagtttgcctcagtttccatgtgtctcccagaatgtgaacatcttgctataacagtatgtgattctactatttaactacacatttatctttctatctgggaggaaaaccaattagaaacccacttcacccataacaaaataaatacttttctattccaatacataggaaatactgtgtggtcataaatattgaagaatggtattctgaatcccaatttagcatgtctttgtgggagatttaagggctgttcaagagtattagactctacgaattttctctgttgccttgtagtgattatgtgtgtaaacttttcatgtcagatggatatgtagtcaacacctggttctattacagactagcagttaaatagagaaagttatataatctctggcctccagttctcttatctgcaaaatggagataatggggttgttgggaaattaaataaagtattattatggggaatagttcactcaatagattccacgaagtacagggctctgcaatgacaatgcatatagttattagtattactatttttatttctaattattttgctgtcctgtatttctgacttggtacccttgaaactcactgagcaattctcttttctctggtcatcacttttctgcaaagccccattatcccagagtggcagtaattttctcaggtctactgaacgaagtactttgataattatatttaattaattaattaattttgagacagaatcttgctcttttgcccaggctggagtgcagtggcatgatctaaggtcactgcaacctctgcctcacagggttcaagcaattctcctgcctcagtctcccaagtagctgggactagaggtacacaccaccacacctggataatttttctatttttttagtagagatgggtttttgccatgttggtcaggctggtctcaaactcctggcctcaagtgttctacccacctcagtctcccaaattgctgggcttagaggtgtgagccactgtgcctcgctgataattatatttaaattcaaaggggaaactttgatttttatagacattaagcatttctaacatttaaaagaagttcctctgtatattctttatgtcatattctccatggaaactatttttatttttaaaatgatttatttctaaaatcctgaaaataaaggaatgaataaaaaccccatcattaactttcttatccattaaccaactagaatataaaatacatttcacaatcatgttgggatttgtatactgtattgatctgcaggaatctacacaagaaaaacattgctctatgttttctggagggagaaaaatgttacttgtcacttaaatttttttttttttttaggcagagtctcgttctgtcaccaggctagagtgcaatggcacaaccttggctcactgcaacctccacctcctgggttaaagcaattctcctgcctcagcctcccgagtaactgggactacaggcatgcacaaccatgctcagctaatttttgtatttttaatagacacggggtttcaccatgttggccaggatggtctcaatctcttgacctcgtgatctgcctgcctcagcctcccaaagtgctgggattacaggcagcagccacggtgcccgacctgtcacttaaatcttatatcattcatccaattttccactctacttagaataagaacattaatttatttctcatttataaaagattaatatgatttcaaaacttgaaatttatgactaaaaataataaatggaaaaagtcgtttctagatttgcatgttttcaaattataaattataattttaaagttgggttatggccatttagagaagaattggtcacgtaaagatgctgtgttcaatactgctctaataagagatttatcttggattcatgttcctaaaattaatgattaattagtttaatttagtataatacctcatggaggccctgtcctctgttctcaaatttcttcttttaaacagcagctttagcacaggaagagctatttaagattcaggttcacgcaaattccctatagcaatcatcttttatttgcaatatttctagtgtacacattagttactttcctattccagagacattttgacatcttagcattacccattgctcaacatgtgaaattagcataacatttttttcatatctttttgggaaagtcatctttcatctaaagatcgggaataatgagcatttagttgaatgacattctaccttacagtccaaaatgaacccaatttgaaggtcaatttcttcctttctttgttaataacagaatagctcattcagtttgtgggcagatcactaatagaatctcaattacagtccctccaattggttcaaattagtaacatctcatttgcaagaatcaccacctgcagaggagttgtcagatgcctccattcatgttcatcaattgtgctgatgacctggtattgcaaggaaaaagcaactcctgggtagattcacaagaagtctcattcatccacgtgctaattaaaatagtttctttagttgaacaccagaagtattgaataaaaatctgtaaatacagagagtgaaagctccattttaaatattcttaaggtacttaccatttttttatgcataaagacatacgggtacagtcaatgggtacatacccttactaagaaacgcccaccagcaaagattgtgaacatgtgactaagcggccatctatattgaatcacatattttcaattctggattatgagctatatacacaggctggttgggaatattacacagtggttggaaatacccatagcaagagtaatagctatattaattatcaatgtgaagtatcttacaaaagtaaactgacattgacgttgaaactagctgaggaagaaagtaatgcctattttacaaagtatagataagcaagtgtttatcatgtaaacaagccataacttcctagagactggtaagaatcactttcagaaaagtgaagggtaagacaaagtcaaacatcagtaaataagcaagatttatgacttcagtggaacctgattccttggaagttagttagggaagataagtacaaataactgggaagtaaagagtgcagaaggaagaacagcttttccatgaatcattttcctacacatcactgttctccattgtgtcaataaatatactcaaaaatcaaaacatttgttttgcatctctacggaatcagccttgcctaagctaaatgtggtacctggaccagcaggagagtcttcacctgggagcttcttcaatatccagaatctcagatcacaccccagactggctgactcaaacatgcagcttaaccagatgcccacatgattcacattcccataaaagcctgagaggcacaggcctaagaaaacattcaattataaaatgaagtcacatctgccttttcacccccttgttttgcttatccttctgtcttcttagaatgccctcctaatcatacttttaattctggattgcatctcttacatgatgcctgtatgaacctatatgaactttaatttactgcttcttctgcactaatttgtatttatggaattttttaattgagaaaaaatgtgatgtttatgtacatttgtatctttagcagttggcactgtgcttgttttataatcggtgatttataaaatttcatggattagaaaatccagatgatttggaaatcaagtaatgtagtcaaatgtacaaatcagtcacaaatagattatgacaaatgaagaggtctactgtaaagccaactcaatcaacattgaaatttagcaaaattatatcataataatgataattgctttgtttttatttgcattacatatacattactgttcacaggtctttcaaattggcatatgaactaacagcataattctcacaaattagacaaaatttgtatttatttacataatctgtattttgtatattcaagatacaaagaaaataatactttcaaatagacaagtaaaggtatatatgaccaaaatagaaattatttgcacatacttaaaacatttttttgctgccttttcttattaggtcttctaggtaactactactgtagttattagaatggtgcaaaagtaattgttgttcttgcctttgaaagtaatggcaaaaacgacaattacttttgtgccaacctaataatatctctcttttgaaattgcaaagaaaatggctaaatgcttcaacagctgaaaatttgaaacaaaataatttatatgtctgttataaattttatttaaaagagtatataagcttatgcacagagtattataaaatgtcaaattccctcctgagaattttttctcaggaaaataaatgtacattaaggaaaaatagtggcttaaaagaagacattagattaaaagtgacttttattgttctttttttgtttgaatctctacagtaaacaagtattttttaataacatcttttaaatgaaatccaacaaaaagtatcatctaaacaccaggaaatatgcattaaactacacatgtacgataaagacatagctttgacgtatggctacacggtttatgaatgtgattattttctctctctttaatgacaaattcagtcagataaatgtcaaattagaaagcactctggcaaaccttgttatatgtaacccgcatgacttatttctactgttttaaatctacctggttagataggattcttatctttagtttttaaaatatttatacgcacagagttaaaaaaatagaagaggacttataatgcaaattcttgatttctcatagtactctttccaccagccccaaccccactgttctgttttcatgtttgatgattattgcaatagttttaaactgaaagcttaaactgctatttcccaatttagattaaaaaactcccgcttatctctcaccccctctttactccccactctttctcattttttacataaggtcttatataatcaaaatctacctcatgttctattaatttttaataatactatgtgagatgaaaatattaacttccttatatttctctctaaagggtggaagaatatgccagcccaaaatatgccactttggcataaggattattatcattattattattattatttgagatggagtctcacactgttgcccgggctagagtgccatggcacaatctcagctcactgcaacctctgcctcccagattcaagctattctcttgcctcagcctccctagtagctgggattacaggaaaccgccaccatgcccagctaattttttgtatttttagtagagacggggtttcatcctgttggccaggctggtctcgaactcctgaccttgtgatttgcctgcctctgcctccgaaagtactgggattacaggcgtgagccaccatgcccgaccagcataaggatgattttgacttgaaggcaattgagatgaagcagatataagaaacgttctcttccttcccactatttgtctaaaggcaggacatatatttacaaaggtgttcttccttgttcctctagcaggaaggacaaaagttaatcaccaggagacaactttagactcttatcagcctggagcccacacctgagacatctacataacaaacttaactcactagcctttgtctaccactagtttccgataaacttaccttttcagaatttgcagcccctagatgctcaaggtgtttttcctttgtcctgtgacttctctaaaaatgtatggttctttgttggagatgctatgtaagccagagttctaaactgcctccttgagagttattcatccctgagttttctcccatgtaggtataaaatacatgcgttaataatcttgtgtttgtttttctcttgttagtctaccttttgttataagagttctagttgagaacttggaagaggagaaaaaaaaataccttttcctctcccacaacttcaaatatccttactctttttcttcactagtttttatgagattactgtttcatttccagagcatggtcatatttacattttttctacttatcaaaattcttggagatttgtctattttataagtatttgcaagaactagcttttggatttgtttattgttgcttttcatagcattcttccttcctcttttttagttgtcttctactgactataaaatatattttttccttccaagtcaattgttttctttctttggttggcttatataggttttggtcacccatgttgctggtgattctttgctaaccatttatatataagaatgagaacagtgttaataatttgaaaattccgccaccgccaacactaataatggaattccaggatctgtcctcttgttaaatatcccctcctattaagaagatggtagaaaatccatatttatatacagagtttgataatgatgtagggtttttcttttccctcacatttcaagctggggacttccggctgtcaaagcccttcccaggccctgcttagccatgttggcatgcctcagctcacctgtgttatagcttgcacccatgttcagcggttcccaagctcttgcagcgtgcccggggaagaatgagggtaccctggacactgaagggtgaggagggcagagaagaattttattgagcgatgaaacagttttcagcacagaggggatgtagtagtggccccctacccaaaggtgggaaagtcccccatgtggctggatccagaggcttttatggactcagaatgaggagtgcatgctgattggtttgtgagcatgcagaaacggttaaagcgaagacaccacccaaagttgggcacaatagtgtaaaaaaaacagttaggaaagggtaggtatatgtataataggtgaagagtggggaccaatcagaggaaagtgtgccaaataggaagacaagttctcaatctgatcggcggatttaacttgtagctcggctttcaggctttaaaatgtcttcagcttggaggtgggatttcattggggacttgccccatctgcctaggcatttcgctgcttcctgctgctctcaataaccacctcaagtttagcaattagagagtagctattacacctcttacccccaaaagtctacaataaagggagttttgctctttgatatccatgctatcagttggagtcctagttctccacagtcagctaaatatgcttaatgcattgtgttctgacttttgaatagaagaaaacaccaagctatggtaggtcttagtgaattacccagggtatggggagggatggtgagaggtggaggaggaaaaccctagagagcatctggttccatgagcagctttccaatgcactcccctttgttcagcatctttctcaccccatcatccagcactgtggacaccaacactgaaatctttctgaagtttgtagccctccttgcattattctggctgccaaatattattaattttattgtttttttatttaaatatatcattaaccttttataaactttctgcctttttgagtgttgacatatcttgtatactcatggatctctcattattttttctgctgttatgggcttttttttttattttcttttcatgtcattgcttcatatgagtgaggtctaagaagaaagggaagacaaatatatgtgcttgtaagccatcttgaactgtctatctttatcagttatttgttcaacttaataaaatcacaattttatcttttaggtagtatacatgtatataaaactgatgtgtaatattagttaagaaaaatggactattaagttttataatttatatctaaagaatcacgtttgatccagtttataggttaaaatgaattttaatccagagtgctactaagaatctcagtgagatctaggacttcataaaaaattaccatatcttaaaatattatgccaaaactaatgataatcataataatttctacataaaaaaattggtatgtattctctgaagttgagctgggtatggttttccttctgattctccaaggttccttttgacatggattttatgtgatccttatgcaaatgaaatgcacatgaaaaatatacccagctgaatctaacacataattaaggattctatatttagaatatatagaatatatcagtaacactgccttgcatgcttttacaaagcaaagcaatctattaaacattttacgggtctgagattacataatgttgacatcaattccatgtggtaggtaaaatatttaccctctttttacaaatcaggaaactaagactcagacttgctaaggaatcgtatctgttagttctccagtggtaggtactttccaactccacagctttggcatctatggggagaaaagactgagggtcttttgaaagcttttaaggccagtctgaatggacagaactgggactgtagaagcctgaggttgagcaatggcaagctatgaacctatccctttcctggatgtggccatcatcaagccaacccctgggaaggagaagggagtatttatccaaatctatggtgtcatcatataactgataactcatggcctagacatactatcccattgcagatatattaaagttgaacataaaactttcagatatatatttttttctcagactggagaaaccgcacccaaccctggccttcctgatataaggactgacccagatgcacagaccagccaagaaacaaaccattctgaactattctgagcacactaactctcccttccacacacactcccagaaccctagcattcgcagccttacctacactgcctaggctttcaaaagcaacaaaaagtaatttggacagagattacctgtcatatgcaaaagatgcttgtctatattctgctatagaacatgcctaggttcatctggaatggtgtttacatgctcattccagccaccaccaaggggtctttgaaaagaataattttacaaatttatactgtcatgacaggtgccaaataatgattttatttttataaacgtatgcattactgaacattatattacttagtttatttgaaattaatattacattttctaaaatgtgttacttgtcatattttgaaattaacatgtctccataatgcctacaaaattgtattaattttaactcttttataataatagatttttcctaacaaaatctattatgcctttaaaatatgtatttaattatgtgttgtcctcttagacttttattattttatattgataaaaagattatcataaattatatttgaaatatagaatacaactcagtaataaaagggaatgaaccactgatacacaaaacagcttggatgggtctcaagagcattagggtaaatgaaaaaagctaatcacaaaaggtcacataatacatgattccatttatagaacattattgaaatggcaaaatcatagggatggaaaacagattagcagttgccatgatctacggatgctgagaaaggggtaggtattgtaaagggcacaaaagatctttgtagtgatagattaatttgatttcttaattggtttggtggttacagaaatctacaggtaataaaataacctaaaactttatatacatattgcacccatgtcagtttcccagatttgatattgcattataattacgtaagacgaggtaaccattggagaaaactgggtatagattgcatacgaccacttggcattatcttcacaactttctgtaaatctataattacctaaaagtgcaaaaaattttaaaaaattgaggcttggcccggtggctcacgcatgtaaccccagcactttgggaggccaaggtgggtggatcacctgaggtcaggagttcgagaccagcctggaccatatggtgaaacctcatctctactaaaaatacaaaaaattagccaggtgtggtggcgggtacctgtaatcccagctacttgggaggctgaggcagaactgtcaatcctgggagacataggttgcagtgtgctgagatcgcaccattgcactccagcttgggcaacagtgtgagactctgcctcaaaaaaaaaaaaattgaaataaatatttaaatgtaaaaatgcattacatttagaaaaaataataagctttactagaacaatatatatttccttgacacagctattagagaggcaacatagcatttttggctaagaatgtggactgtagaggtagaacacatacaagctctgtgactgggcaaattgtttaacctttctgtccctcagttctctcatctataaattttagttaatgatagtatctaccttatagggttaatattaggattaaacttttaacaatttgtaaggcatataaacagttcctggagcatcataagctgtaagagggcttattaggtaaataaaaatgcagactataatattgttactattgatattgtaagtaattcatgcaataaacatttgttgattgcctattataaggtagaattattcaaagtgctggagatagagcaattaaaaaagtaagctcctgacctgaacttggagtttatattctagaggaaaaagatataaaatcaattaataggtgatgtcataaagctaaaaatgggaaaggaaatgacacaggcaaacagggtgaaggctatagaatgacaaaggatactgtttgcatgcagtggacaggaaagtgtcctctaaggatgagagatttgagctgggatgtgaatgaaaggaggagaaaattactgaggcaggagcatgcttgttgtgcctgaggcatagcctggaggctggaatgactgtcatggccagaaagagaataaaccaacagaagataggtggtcagcacagaactatttgaggccttataggatatggtatgggctttggatttttttctgaaatgggaagtcactggagcattttgagttgggaaatgaaaggacttcatctgcatttttaaagaaacattgtataccttatcaccaatacattataaggatgtaagagtgaagaaggcaagtaaacgtttcctatcgttcctgtaaaaattgccaaaactttgtgacttaaaataagaaaaaaattattcccagttttagaggccagacgatcaaaatctgtttcatcaggctagtatcaaggtggccacaggactagtcccttctggaagatacgggggagaatccttgtccttgctttttctatcttcttaaggccacctgcattccttggcttgaaacctttctgctcacatcaatccaaactcttgcttctgttgtcaaagcccctacttcttcctttgagctccttccattccttttgtggttacacttgggttcttttaggataatccagaatactctcaccatctcaagatccttaatataatcacatctgcaaaatatgattttgccacataaggtaacattcacatattccaggaattaggacattctgcctcctgcagtaaactttttaggaagctattgcagaagtccaagtcaaacgcagatggcttgaaataggtgatagcagaggagggaggtattttgaaaatatattgtctttgaaatgtagagtagatttgttggtggattggatatagatattacaggcagtcaggataatgtcaacatagcaaactgagcaactgagtgattgttggtgccattacatgagatgggttgactgggagaagtcccatgggagcttctgggcccagagatggtcctggagtatgttaaggttgagatttctactacatatccaaaaagagtaagcaattggtttctcaaatcaagaggtcaggggaaaggtcagtgctggagatagtaataggctaatcattgtgacattgatgatattaatgccataggataggacataattatcctgagtataaatggagaaaatgaagaagttcaatgacgactgaaccctggaagggcaacacttgaagaagtgagaatgttgagtgagggggaaaaacaagtagtatgtggtgtcctagaaaactaaatgcagaacatacttcaagaaaagggtgagcattggtgtcaaatgattctaaaagtgtgagtaagctaagaactgaaaattcaccattagattcgacaatatggagagcactgataacctggaggagagcgatatcaaagaggtgatgggaaaaataaatccagaatagattatgttaaaggaaaaggggttttattttgaaaaattacatatgaagcacagaaaaatatgtagaaggaggtacttccaagtgttaaatgcagttatccccaggtactgaaataatgcagaatagtgtgtgtgtttgcatgcatttttttggtttctacttttgttttgttttaactttattttaggttcatgggtacatgtgcaggtttgttatgtaggcaaactcatgtcacaagggtttgttgtacagattatttcatcagccagatactaagcctaatacccaatagttattttttctctacattgattttgtatttggaaacattgctgaagccatttgttagttctaggagccttaggtgaaacctttagggttttctaggtatacaattatattgccagtaaagagagatagttttatttcctcttttcctatttgcatgccttttgtttttttctcttgcctgattgctctggcatttcctgtgctatgttcaataggactggtgttaatgggcttccatgtctcgtttgaattctcaaggggaatatttcagcttttgcctgttcagtgtgatgttggctgtaggtttgttacagacggcttttttttatattgaggtatgttccttcaatgtcttgtttcttgagaatttttatcataaagagatgttgaattttattgaaagattttcccacatccattgagataatcaaacgagttttgattttaattttgtttaagttgtgaatcacatgtattgatttgcatatgtttaaccaaacttgtattccaggaatacagcctacctgatgatggtgaattaactttttaatatgctgttggatttggtctgctagtattttggtaaggatttttgtgtctatgttcatcagggatattggcctgtaattttcttttcttttttttgttgtatctttgccatgttttggtatcagtgtaatgctggcttcatagaatgaattagagatgagtctcttctccttgattgaaaaagttcattgcttgtataatgagactttctgtagagggcataatagtcacaaagatccaagatctgtacagctttagtgaaggaaaggtgagtagctttagcttatattgtgggtaggggttggggctgggataagtgctctattgggctggattttgtgtggttcagatgtccatgtttctgccaaggaaaggagcgtctgagtttttgtattgtcttgttagatgtggtacaaaagacaaagggggaaatatgaaacctgaaggttttcagcaggtttgtgaaaaataaaatcaaacgtttattacactgaggatatggggaattttttgcttgataggccatgggttcccaaatgcacaaggggcgttttctgcaaggatccaactgagtggcaatttgagtcaattagagagatgtaccaaccaataaaagtaagtacttactaataaaaagtaagatcatgacagataaagaatgaccagagaaatcctgagcttcttgaggtaactgtgataaactgggatacagaacatattgagaacagcaccgatggtatcttagaaggaggtgaataattagttccaattatggactccatttggggacagtaatagtaataatagtaacagcaactaccatatagctagtactgttaaaataatgcctttttttcaaatgcaatttttaaatcctaaacagcctattgaggtatgtgtttgttccacttttagaactgaagaaatttagaatcagaggcactatttatccaccgttttatagcagataaatatcagctttgggaacccaaaccaggagtgtgtgattctaaaggctattctctttcaatcatgctatgctgctttttttcagacaggagtagctaaacctaccttaggatttcacctagtaatttctattcacttaatagagaggcatttaggttgaatgacttgctaatattgatttgattcacccaggaaattctagcccgaagaactcaatatattttcgaaatatttctcatttctttctaactcatgccaaaataactgaattaaaagtgaaaaatccaatcacaatccatcatctctagatatgtttgtgtcatgtaactactgacgctgacaactaccagatccactccttgggtggatacctcctctaattatatgtacaaagccaagagctgatagtaaatccttcactgctttctattgaaggttctattctgtagtgattcatcgcatatcaattttaattcctgttaaactaacacttgtcatgaacaattctattctgttttactttttggtggaagaaatatactcctaagcagctttatttaattgaatatatattttttaagctgtaaacatgagatggatgctagtgatttcagggccaagagaaaaaccttattaaactccataaggaatgagtagcattgtctccaatgatgtatgaactgttattcatgttgagttgacatcttgctgaatttaaatgaactgtagcacttcttgtgtacactgtcacttttagaaacaggttttatacatttgaatgtatatactgcacaaagttttaaaaaatggggctataaaagctgcacaggctgggcacggtggctcacgcctataatcccagcactttaggaggccaaggtgggataatcacctgaggtcaggagttagagaccagcctggtcaacatggtgaaaccacatccctactaaaaaattcaaaaattgtccaggtgtagtggcaggcgtctgtggtcccagctacttgggaggctgaggcaggagaatcacttgggcctaggaggtggaggttgcagtgggccgagatcgtgccactgcactccagcctgggcaacaagagtgaaactccatctcgaaaaaaaaaaaaaaagaaaagctgtaaaatgggcacttgattaactttgtcacaaaatgatactagggaaaagcctgaggagcatgcttggtattcaactcaaagattttgtttctctctccaaagtaaaaaatgttcatttacgaaaaatataattagatagcctagagaacatagtctagagaatgtgaaggcctcacaaaattgtttagtcaatattgagggagcaattttaagaattgtgaatagacaaaaaagaaagttgcccaaaataatgacgtatgacattaaaagttaattaatgtaaaaatcaaacaatgcatggaaatatttgaaggtgcatctccagctagactgagatatttttacaatttattgctgtatctacttaattttgtttttgctttctctatggctttttgttaaatgattgattaaagataataatgagcattttatttttattttatttatttattcatttgtattctttgagatggggtctcactctgtcatacaggctgcagcacagtggcataattacagctgactgcagcctcagcctcctgggctcaactgatccttctacctcagcctccaaagtagctgaggccacaggggcgcaccatcacacctggttaatttttgtatttttggtagagatggggttttgccatgttgctcaggctggtcttgaacttctgggctcaagtgatcaacctgccttggcctcccaaagtactgggattacaggtgtgagccactgcatctgaccagtaataaacattttcataggttcatacatttgacaaagaatattaatctatattgtctcatacataagacaagaaagatcataatcatcttggaatagcttggataaacaaggtttggaaattattagaattgcctaaggtcacacagcaatttgagacagaaacataaatcatttacttaaaagtctatgcttccatctatattattctgtgagtcatgagctaaaatgctttattaaatttaaatatatattgcttctagaatacaaagtaatctctttgtaaatgttacttgtgattatagactattttgtattttaaccaaggggtaatatgtcaataaagaatagtcaactttttaaagagacagggaaaaaagttcctcaaagtcattgcccatgctgatataattactatataatttagaatcataaaacagagctgatatttgatccatggctcacaattatgttttgtacttcccagcacaaattaaagatgctgtcttatctttctttactctcatctataacatcaagaaccatgatagatgcacagtaagtgctcattgttgctaaagaagtcagattcagggctgacttgatatgaatgtgagtttacaaatggatctggacctaaaaggaattttattagaataatgatgatgcacaaagccataaaaatttcacttctatgccctaaagaagttgagactagctcagaaactgaaaagtaaatttcagaagtttttttagaccagcatatttttgtaagttgagccaacctttaaaatccatgagatacaaccaaaaatatggatttcttaattctccagaatgttgaaaaatatggcaatctcttaccaaatgttattaccaagtgttggccatgagaggcagttgtctcctactgggaacatttttgctctattgtttgctattttctctgactggcctggtctttgtcattcaagtgacaagtgctacattttctgactttccaggctgctgtaggcatttgagtttgtaatttaatgcaaagggaggaagtgtttcttgacttaattttttttaattgtttaaatttttgtgggtacatagcaggtatatataattatgggttacatgaaatgttttgatatagacgtgcaatgtgaaataagcatatcatggagaatgaggtatccattccctcaagcatttatctttggggttacaatctaattacactctttaagttattttgaaatatacatttattattcactataatcacgctgtagtgtcataaaatagtaggtcttattcattctaattttttttctacctgttaaccatcccatctcctccccaccctcttactgcctttcccagcctctggtaaccatccgtctactctctatgtccatgagttcaattgttttgtgttttagagccccaaaataagtgagaacatgaatgcttttctttctgtgccttgcttatttcacttaacataatgatctccagttccattcatattattggaaattactggatctcatttttttatagttgaatagtacttcattttgtatatgtgccacattttctttatctatttatctgttgatggacatttaggttactttgaaatcttagctattgtaaatggtgctgcaacaaatttaggagtgcagatatctcttcggtatactgatttcctttcttctgggtatacacccagtagtgggattgctggatcatatggtagctaaagttttagctttttgaggaacacctaaactgttctccatagtggttatactaatttacattcccacaaacaatgtatcctggttcccttttctccacatcctcatcagcatttgttatttcctgtcctttagatataagccattttaactggaatgagattatgtctcattttttgagatttgatttatatttcctctgatgatcagtgatgttgagcaccttttcatatgcctgtttgccatttttatgtcttcttttgacaaacgtctatgcaaatattttgcccattttttgatcagattattagatttattcctatagagttgtttgtactccttatgtatcctggttattaatcccttttcagaggggagtagtttgcaaatactttttcccatcagtgggttgtctctccacttggttgattgtatcctttgctgtgcagaagctctttaacttgatgtgatttcatttattcatgtttgttttggttgcctgtacttatggggtattgctcaagaaatttttgcccagaccaatgccctggaaattttcctgaatgttttcttgtagtggtttcatggtttgagatcttaaagtctttaatctattttgatttgatttttgtgtatggtaagagatagtggtctagtttcattcttctgcatagggatatctaattttcctagcaccatttattgaaaagactgtcatttcctaagtgtatgttcttgacatcttggtcagaaattagttcactgtaggtatgaggattcatttctgggatctttattctgtttcattggtctgtgtgcctgcttttataccagtaccatgctgttttggttactatagctttgtagtataatttgaagtcaggtaatgtgattccttcaggcttattagtttgccgaggacagctttggctatttggatcttttgtggttccatataaattgtaggacttttttttctatttctgtgaagaatatcattggtattttgatagggattgtattgaatctgtagattgctttgggtagtatggacgttttaacaatactaattcttccaatccactaacatggaatacttttctttctttttttctatcctcttcagtttctttcatcagtgttatgtgattttctctgtagagatctttcacttatttggttaagttaattcctatatatttaattttatgtgtggctattgtagatgagatggttttatcatgaaaggatgttgaaattcatcagatactttttcagcatcatataagttttattcttcattcttttaatatgatgtatcacactgcttgatttggatatgtagaaacatccttgcatcctagggataaatctcacttggtcatgataaataatatttcacttaggtttaaaagcaaggaagagataatgaaagtaaaaaccatgagactagttgattttttaatctcaaagaaataaaacaaatttttcaatgaaagtacagttttacttaattctatccattttagctattttccaagctgttctccaagatctaaatctcatctgttttccatcctctcccagaaaatcagtaccactatctttaagtaatctgtattaagcactagttgttctttttaaaaaaaatggaattgtaaataaaagatacaagtacattttttgaagagataactggcacttgtccttaaatttttattaaaataactaaaatactctgcataagaaatgtctgtgattagcttatacttacattttataacttttattgcacaatggtccacagaatttaagtattgattactacagctttgtagtatattttaaactcgtgttatgtaatgccttcagctttgttctttttgctcagattgctttgactatacaaattattttgtggtcccatatacattttaggatttttttttacatttctgtgaaaaagtgtaattggtattttgctacggattgcattgaatctgtaaattattttgggtaggtttgtcattttaacaatatttattttaattcatgggcatggaatatctttctaattttgtgtccactttaatttctttcatcagtgttttatttatttttttgcatagatctttcacttctttagttaaattgattcttaggtattttatgttctttgtagctatattgtaaatgagattgctatctttgtttttatgattgttcactgttggtgtacataaatgctattgagtgtgatactggcataaaaatgaacatatagatcaatggaacagactagagaatccagatacaaatctatacatttgtagtgaacttatttttcacaaagttgccaataacatacaataggataagaacagcatcttaaacaaatgatgctgggaaagtggatttgtagaagaataaaactatactctctctttcatcatatatataaaatcaaaccaaactgcattaaagacttaaatctaagaccagaaactatgaaacaactagaagaaaacattgggtatgctccagggtaaagatattttgtgtaagaccttaaaagcacaggcaacaaaagcaaaaatagacaatgggttttacatcaaactaaacatcttctgcacagcaaaggaaataatcaacaaaaggaaaataaaacccacagaatgggaacaaatattgcaaactacccctctgacaagggattaataaccagaatatgtaaggagctcaagcaactcgatagcaaacaaaacaaaacaccaataataataataatcatcatcatcatcttatttaaaaatgggcaaatatctgaatagacattttaaatacatacaaatgaccaacaggtatttgaaaagatgttcaacatcactagcagtcagagaaatgcaagtcaaaaccataatgagatgacatctcaccccagttaaaatggcttatatctaaaagacaggcaataacaaatgctgacaaggatgtggagaaaaaggaaccatggtacactgttgatgggaatgcaaattagtactaccactatggagaacagttcgggggttcctcaaaaaactaaaactttagctaccatatgatccagtaattctactgctgagtacatatttaaatgaaaggaaatcaatttactgagatatttgcacttccatgtttattgcagcactattcacaatagccacaatttgcaatcaacctaagtatccatcaacagacaaatggataaagaatatgtggtatatatacacaatggaatattattcagccatacaacagaataaaatcttgtcatatgtagcaatgtgggtggaactggagaacattatgttaaatgacattagccaagtgcagaaaggcaagtatcacatgttcttactcatgtgttggagccaaaaaagtaaatttcccttaagatagagagtatattggtgattactaggggccaggaaggataggggcgaggggagaataaagagagtttgattaatgtgtacaaatatacagctaggttgaagaaataagaactagcatttgatagatcagtagggtgactaaacttaacattattctattgtacatttcaaaatagctagaagagaataatttgcatgctcttagcataaacaagagatatttaagatgatagatactccaattgccctgatttgatctttctacgttatatgaatgtatctacatgtacatatattctgtacatattttgggggtacaaatactattgagaatagtaatttaaaaagaaactttaaaaaataattttagcattaaagttaattattttaatgctttaatattatttatataaagttattattttaataactttaatttgtaaagtaaaattgcaaatttgaaatgatggatgattattaactcttagcactacagattgaatatttacctcagtggttcatgacatcattccagcaatgaatatctcaaattgcccataatattttatagaatctgaaacttatttaacacattttctcaaaactataagcagaacatattattttgaaactttttctataagtagtaaacattttaaggtttggctcataaaaaatgtctttgacttcaaaaggcagagctaagatttttattcctcttcatattttgctctcaacattacaaccatgttgacttgcccacagttaccacagtgcctgcacaattccaaaaggcacaagcaaccagcatgtggtgtttggctgtaggagagcacaagacatatcatgacgagtgtgttaaggaaatgggattgccacaatattaaagaaaaagtttattacagataattgcttgctctgtttatgctttttctgtagaactaggataagcaatttaggttacagagatttataacagttttcatgaagatgtatgaaatcccaaacttgcaagcttttttaatccacctataaatcattttatacatttaatttcttcctgtataaattttatgagaccatacacaggcaaaaagtttaaattactacgtgctttctgaagagggagttttctctgggattttttcccccacatgttccctatctaatacatgatataaattttgagttcagttgtaaatagtttttaaaaatactgttttattgctcaaacatttgcaaccctgtaaggtatgagacaaaatctagttttacgatagaactacctcaaagctgggtttgtctacactaaatgagagacatgtctcataaatctcaagaataacaagttctaatcccgcatcagaacagtatattattattcagaggatttgatctagaaatgggattaacttgacttttaaccagaggtgcttgaaatgaagtaattattatacccctagtgctgtgcatagctagaggtagaaaacatggtttcaatttactagaaacttagatggttttcctactttggtttcctaaagggaagtcttaggattctgagttaccgtgacaagtcctaactgagctcaaggagaaacactcttagtcagattcatagctggtatcgtactctttggaagcacattaaggcctagggaagtgatattattagtttactattgagagttccagtagtgtttaactacattcttcagagctatctaacatattatctgacttgacatgaaatgggacaatgtgtgcaaaacacaggctcttacttagctcctgctgtgatgcaggggatgaggaggtgatgataggcttgatgaaatatagcatatatatttctaattctttttcaagcagatattttaacttcctctttgacaaaacatattaataattgggttaagacagagaataaaatgtgaactccttgggaaacctcatggattttgctcgtcttcaaggtaatgaatctagtgcacgtggttttgttcaggtgggctcattgaaacgggactttgatttatttagcttgtgtcttatgttttccccaacaatgagactttctttggaaaatgcaatttccttttggcacagtttcaactctttataagggatctgtctctattcatttcttctactttttctttagggaaacagagcttttgcactgtaaacactttaatttgtgaagagtagcatgtctgttcacacagatacacacatcacaaaagcaccgacttttgtatctgactgcactaaggaaaaaagtcattatgtataaatattaaaataactctattgccagtgcagtgaaacctttaaaaaataagatttttatctgtctctgctttaaatagataagttcaatcaaatatacctggttggaatataaatctttaattttaagatatcatttgagaatgatttatgacaaaggagaccttttgttatctctgcctgcaatgtttccccacatgtaaattatttaattaattagattgatattgacaaagctcttcctagaagtatagcacatctgtgccttggaatattaagccttattaagtctacctctgaaaatatgaagtgacactgactattattcataacgtaataaagtctagttcattacagtggtcaataaaaatttcagaaactccttttaaaaagtaaatattagatttaattcatgagcatgtacacatgcacacgtgtatatatgtatctgtgtccaattttaaggaaacttccatgcttacattctccaggattaggcacttgcagaggaccagaagcttagcaatttggttagttataaagcttttttgaggaaaccatttaatcgctcttagcattatctagaaaatgaggatgtcagttagttcttaagtttcctttggtttccaaaattctaggaagctatttactttaaagcagcggttcttcaagtttagtatgcatcagaatcctgaagatagctggtccctacccccagaatttctgattgagtatatcctgagtgaggccagagaattgcattttaaccagcttcaaagtggtactgatgtagattctgggaccacatttggaaccagtaccagaaggatctgaacaaagtgttaacacagattttttataattttgaggttaatggcatgtgaatttatctgattttaacactaaaggatatttcttctatcctaaattttgtgggccccacaaatgagcaatatttacaaactaagtgtatcttttaaaagagtttctcccttataatgctctgattgtgtaactgaggattcatctatacatgcttaatacactggtagaaattatatttaaatgaagatccaaataaaggtaagtagacaaatgtctaggtaaggaaatagacaagagattcttcatataattgttaaatatactagagactctaaggtaattttaatgttatgtaaaagactataaaaaacattagttagttaagtgcctcttcattattgaaattcaggttacctgtcgggacactcaaatgcaagtagttagttacctgtgctaaaatggtaccattgttggctatcaacttgcattttaaagcaataagttaacaaaattgcattatgtttattgttgtcatcaaaatataactggcaacattaatcttctagaatttaatttcacttgggttttaattccattccccattgccacagggatttattggatttttttcatactcaactttatagagtttatgcatgagaaaatgatacgccacagtactgaagtaattttctagttgatagttttagtgtcatcctcttattttccagtattttacatacaataaaagctctatgctactaaattttgacttggtttaacacaaacatgatgcttatagtatttccctaaaaagataatcaattcagctaacaacaataccaccaccatcaacagtaacaaaaatacttcccaatgatatgctaatatcttattagaaacaatagcattaactgatctaaatttaactcattaattttggctatggcattacagtactttggttgatttagagaaaagactctaatcgcacaaagaaccaaattttaacactgtgagaatcagtttttaaattcataacaattctgtttcaagatgctgtttcatttcaattcataagaaatttactgagcatatgcattctgttagaccttgaaatacaaaattagatttggtgtcctggatgcccccgcccccaaattacaatgtagcagttaaaagacgatgaaatcatgggaatttggtgataacattaagcaacagaactgtttatacaatatggtagagagatatcttggagaagagattttctgggagtgagagctgcatgcctcacaaagggaataatatttgaacatgtttgtcaataattattagttttgacaaaagtcatagaaaggtactctagggagaggaaatttgcatacataatcacactgtcataaagacaacacacatgttcagggaactacagttgtggtagtgatggaggatgtgatgagtgtcaagataaagataagaaccatgtcaggaagggcctttcctgtcttgctacggagtttattatgaaaagagaatccactgaaaggtttgaagcaggtgcatttgaagtgggccattttgaaaaataactcaataatacacagaataaattgtacagcagtgatcctgggggttagcaagtctgttaaggagacttttcagaaaaccattagaacaacaattagcatttgatcaaatacaatgaaaaataaagagaacaaagatatctaaaatattaagaaatctgttagctaatcagatacagtaggcaaagaatcgtattatgcaccacacagctattttccttatgtaaccaagtgaatattgatgccaatgtctgaggtacttaatagaggtaaagggataaactaaagacagtttattttcatatgattggttatacggaatctagggctccgtgcaacagccaacttaaaatatctaatagacaggtggatacataggggtaaatcacaggaggaaactgggatcaaaggtgaacatatgatcttcatcaaaattttgtaaataaaacatgaatacgtgaagggaagtaaattaacaagagaatatagacaagaacagaaccctgggggtaccagcatttaaagcgtaggcagaattatacgcatctcgaaagagaattaaaaaagagcatccaaagaggtatcagagaaaaagaaaagccaagactgaaatttttttgaataaaataaaagtcaagataaatgctttttaatgccactttctggacagttgtctggggggacttgcaccaacctagttctcccccttttgtcatgtgcagcttctcaagaataatttcataatgtgctaggaatgcaacatcctgagatagggggtgactggccagaacggcgctggtttttgtttcagtccctactggaatgcaatgttcttcagtgatttagcacagtgattcctgttgtcctggggtataaagcccaaggtgggctgctttgcagaactcctcaactgtggcgcaagtggggcacatgtaaacaagattttcgtaacttgggcagctttcttgagacttggaggattggattaacatgaatcctaagcttctaccccttactgtatatctgtgaatcataagatttcttcatttaatttgtacatggtttgtatcaccagattaatgcaaagtagtacaagacattgaagcccaagctgcatgggctaaaatggtaaccggtgcacagtgaatctctttcacaccatttatttaattcagcatagaattaataagtattggccgggcgcggtggctcacgcctgtaatcccagcactttgggaggccgaggcgggcgaatcacgaggtcaggagatcgagaccatcctgactaacacggtgaaatgccatctctattaaaaatataaaaaattagccgggcgtggtgccgggcgcctgtagtcccagctacctgggaggctgaggcaggagaatggcgtgaacccgggaggcagagcttgcagtgagcagagatcacgccactgcactccagcctgggtgacagagcaagactctgtctcaaaaaaaaaaaaaaaaaaaaaaaagaattaatgagtatttactatgtgccagttactcagggatacagtgatatacaaggtaagtttgatcccagacatcatggaggttacagagcattgggaagaaatacagttaaaaaaaagtgataataatgagtagtgaattttaagataagaaaagcataaggtgcaatgtaagctcacaggttgagtccttgacttacacaggaggagatctgaaaggctctttggacaaagtaactttgaagtcaaaaccttaaaagctaaatactaattaacccagtagtaaggagaggaaccaggtgtgaaagcccagagttgaataagatcatagcacatttaggacaataaaaattgtatgactggaaagcagcatgggaagttcaaacaagatagaagttctcatcttacttggcatgtgaggaataattgatgctggtgaccattttctccctgaaacactacttcctttaagttccctgatacactcttgtcattttccatctaactttctgcactcttgttctcagtcactttgccatgtcatcctcctttacatagcctcaaaatcagtcttcactatgtcatctccctgaataatctcatgtactcccatggctcttattggcttctacatcacgatcatacagccttccatacacttatctctagtccacactttgcttctgagttccagacacagttatccaactgccaacttggcagctccctttaaaaatatcttttatttcagattgaacatatgcaaaataaagccttgatcttttgtgtaaaatctggttcctagaaactactacttatctcaagggaggcccagccattgaagcagacttgcaacttagatatagggcacccattcctgagcctaccacattcctcaactcactatctaagatttgcagggtaattcatggtaaaagtagtttgaagtacttgtccctctactttccttttctgccatttcaagcaagactcttatttcatcccttagggatgtttgctctaggactgagaattttctctaaaatgctgtctctttcggtccttgatagcagtctagatgtggtttcagactagagttaaaatcttttgagtgtggaaaaaagaagccccaggagatggccagcctgaaagtagatggccttatgctggcccagagaagggtagattttaggaaggaagtgggaccctacgtaatctacaaaagcaggaggcggcaccctaggcttcaaccacgagggtgaagaatgagctttgaggataggtattagaactatttctgaacacacatttatttttggtgtgatttttagtctacaaatttaatcatgcaaggagtaacatctctgtgttagcatacaccctcacacagattgcctcaaagttcaagagatttatgctgtagctcctataatggggaaagggaccctaatcttcagtttttcctcatcaagtttcactttctcattgcactcaattttgtcaaccacttttgtttaaggttctcaaaaatagagacagaatacttgtatggacctgaaatgtgccaacaaatgagtatcttattctaggaacactcctgaaaacatcatccattaaagtgagttatcgtggttttattttcattttgtgagacttctctggaagataaattggcctacatgtcctagatgagtacatttggttatgggtatataaggggagtttcttaatgcaagaaaagctaggttataaaaatatttttgtactctaatttgaaggcccagatataatcagtcttgaaatatttatatccccctagtatctgagcgacccaaccatctgtcactgaacacagtcctgaaataataataaactaatgctggtacaggagaacttgtatgtttaaaggtccttttactgaagcattatttctacttgagagttttgggaaactagaagtctgattacatgttatatatctcttcattttttttttaaatgagtatttaaattttaataacccagaaccagaatcatgggacaatcttgataatttctgtcactatctatgtgacctagagtaaatcatctaattacataaattttagttttatctgttaagtggtaactgatctcagagatctaagtttcaccattttaagatgagaattacatatgtatgtatatatacacatacatacgtatacattttcttctctattgcttcatttaggtatggtatatattagaagagtaagttctattttgaggaaaataagtcaaagttgctctatgcgaagactatgtgtgtgtttactaacctccttatatgtgtaagaatgcgtgtggctagtgcagccttttttttcctaaaaaaaaaactgtgtcatcatttttctatctattgatacattaaaaatcaccccaggctgggtgcggtggctcacgcctgtaatcccagcactttgggaggctgaggcggggggatcatgaggccaggagatcgagaccatcctggctatcacggtgaaaccccgtctctactaaaattacaaaaattagctgggtgtggtggcacacacctgtagttccagctactcaggaagctgaggcaggagaatcacttgaacccagaaggcagaggctgcagtgagctgagatcgtgccactgcatttctgcatttccagcctgggcgacagagtgagactccattaaaaaaaaaaacccgaaattacaggcttagaacagcacctataatttacttttactttgctcaatattccacaagttgggcagtgcttgcctctgtctcatgtggcagtagctagggcaaattcactgaggcttgatgatccacttccaagactgcagcctcatatgggtggtgacatggtttggctgtgtcccaatccaaaatctcatcttgaattgtactctcgataatccccataatcccaatgtgtcaagggagagatcaggtggaggtaattgattcatgggggcagtttcccccatgctgttctcatgatagcaagtgagttctcacaagatctgatgggtttttaaataaatatttggtagtttctcctgcagtcattctccttcttgctgccctgtgacgagggtgccttgcttcccctttgccttctgtcatgattgtaagttccctgaggcctccccagctatgcagaactgtgagtcaattaaacctctttcttttataaattacccagtctcgggcagttctttatggtgtgtaaaaacagactaatacagtaaattggtaccgaggtagtggggcactgttataaagatacctgaaaatgtggaagagactttggaactgggtaatgggcagaagttggaacagtttggagggctcagagtaagccatgaagatgtaggaaagtttggaacttcctagagacttgttgaatggttttgaccaaaatgctgatagtgatgtggacaatgaagtctaagctgaggtggctttaaatggagatgaagaacttcatgggaactggaactgagccatgctgaactgcgagtcaattaaacctctttccttcataaattacccagtctcaggcagttctttatagcagtgtaaaaacagactgatacagatggtgagttggtgttggctgttcattggaaatctagttgagactatcagctggaggctttggttcttcaccatgtgggactctccaggaactgtttggcttcctcacaacatggattctaagggtgagtattccaaaggtaacagtgttctgagaagcaagcatctctttgtcccaggcagaagctgcaaggcttcttgtgaccgggtgtcaggaactccagaaagtcatttttcaccacaatctcttggtgaatgaagcaagtcacaaaattagccaaatttaagaggagtgaagttcaactcttttcaatgggagaagtagcaaagaatttgtgcccatctttaatctgatacaacctgttttacttaagagtctttactaggaactgctaactgaggttcctacttcagttcatattttactccagattttctaaggtggaggtaatggtgataattttctgtttctactgttaagggagatataaaaatcattaattatagctctaaatgatgagttgagaaataaaatgagatatacaaaatacaaagagcagtcgaaacccaagaaagtcttcagaaaggaagtaacaatgaactagccatttaagtgtgatacattatgcacccacaggttcaccatgtatccatgtgcaagtgtacactatgaaccattgtaagtggactggaagagcctgagttattgggtagaatagggccaaattcattccaggcacatacatggtcaaagcagggtggtcaaaggcatgcaaccatgaaaagaagcagttgagttcagaggcaggtgaatatttgcgtatggctaaacaatattgcacagattaatttaggaaattaggacctgaggtgccacttgaagcaatgtagcaaaaatatttttggtttaatattaataaatttgatttttttcccaaatattttccctttatccttcacccattcaagaaagaattagtgtgttcttacctccaagaagtgttatggcaacatagaaagcaaagatagctgggtttgagaataaacacgtttcctttctttggggtagaatataagtactaaataataataactcaaacagaaggtgcagagaaagaagctaataagtaattctttgttactccctataaaatctgcaaaatgtcatattagactagccaatttattttcacctatattatttattagtattatttttatttaggcttcagcatagagagaagaagaaatgatcttacacctactttcttcatttctactcagcttatggaaatgcagcagactactctgtgcactttaactaaaatagtcctgctgagaaaggcacttcccagactgggatttcatctttcatgcagaccgcagacacattgtataagtaatgcatacattactcctgcctggatagggtgatctttcacttgtaaggctgcctctccaagaagccattgtagcttcacttgtagttatgctcttctaatttttgaaaaggttagcacagctttatcattaatagccacttgatcattgcagagattaacaagtcatgttggagacattagtcaaggaagctgaggaatccatcatgaggtctttacatccccccagactgtgcagtagcacattgatgggcattttcatgctgctatctctaaattgcatgcaggaattgaaagggtatgtttattagatatgaacccattggtttttaatcaaatttagagggctgcaaacagagctatctaccaatctttagcttttgctgacagtaatggatttatcattctccccatgacattcctcataggatagtcacaccattttctattagatccccgaaaggctctgtgatgatctagggaaccagtaacctagcatggcaaaggcagagctcctgaattaatgcctgattgtaatttaagcaacatcgacccagcaaaagggaaagatacataatgaatattgtagagattatttcagaaggctggtgttacaataaataaaatacagtgagagaaataataaactgcaccactgaaaaacacaccactctctcaagattctcaacttaataaaaatttcccagattcccctcactgccattgaacttaaatatgtttcaatacccaagatttacccatgcttcaataactgtagtagagagcagggttggcaaactacaaccagtaaaagacatccagtcctccatctattataacaacattgtattggaaaacaaccacactcattcatttatgtatttttcgatggttgttctcatgctaaaagagcagaattgagtagttgtaagagaccaaatggcaagaaaataccaatttattttttctctggccctttacagaaaatgtttgccatttcttgcaaaggtgctagggcagagaaaatagtactttctggatatgtgaaatttttaagggaatttcatacagtttaattaagttttcccttttataaaatatagccttctctaacaccttagaacagttaatatagatctatctttaaacgtacatttttttctgccttttttttttttttttttgagacggactctcgctctttcgccaggttggagtacagtggtgagatcttggctcactgcaacctccacctcccagttcaagtgattcacctgcctgtctccagaatagctggaattacaggcatgtgccaccacgcccagctaatttttgtatttttactagagactgcgtttcaccatgttggccaggatggtctcgatctcttgacctcgtgatccgcccgcctcggcctcccaaagttctgggaatacaggcatgagccgccgcgcccagcctctgccacttttaaaaagtatatccaaaatgatttaaattttacttaatgattatttaaatcctgtttgattttttattatgaagtactgtacttatgctgtgctagagatattcagagtaattcagagaatattcaaggtaaacagagtaaatgagcacttattctaggaacaggcaggcacttgctttaaaaaataaagaaataaaataatctgatgttagctatggtttgcacacttgtttctttatactaaaggtaaagtgaaggacatagaaccttgtttctctgtaaggctgtctttctgaaaaaaacatgaattttatgatgaaagattgaagtagacttttcccaggtggtttttctctcccttcaggaaatcattatcatctttactgtttttatccttatccttagatttgtcattgggcatccaaaacatttcttatgactcctacatcactgaagcagtgaaaattaggcacttcctcgtcagcttgtaccagtttgccagtttcacaaggtgggaggcagatgtgtctattgccatgaaaaaaaaaagtgatattttggtaaggactatatcttagaaaatccttaaaatttgatcaagtaatattttattaatataaaaatgtggcttttttcttcttttaagaacattataggcacattcatgtaaaattatgagtgaaactcttgtacattatttgcataattttgataaaacattataggtaataatattttatagatagaaatatacactgacttataagttaaacaagtgaggaaaaattgggaaatgcaaaaatggtaaaataacaatatcttattaatttttctttcgccaaataagttcctatagtaagctagcaataatttgttagcattgccaactcatgtggctataaaatgatcttttagggctggctgtgttggcttgcttctataatctcagtgttttcggaggcaaaggtggcaggactgtttgcagccaggagttcaagaccaacctggacaacatagtgagcccaccatctctacaaaaaaataaaataaaataaaaattagctgggtgtggtggtgtgctcctatagtctcagctactcaggaggctaatattggaggttcatttgaacccagtaatttgaggttacaatgagctgcagtcatgccactgcactctagcctggttagcagagcaagacccggtctctaaaataaaaaataaatataaaataatatttcactgatgaatatatgactctgaaaaaatacttgattatagtttcttcaaatatacaatgaaaatgataaatgtatatatatcacatgatttttgtgagtaaaaatttgtaagtcaagtaggatgatacctggtacataaatagcctttagtagtagatagcattattatttcatttgttttttatcaaatgattattgaagagaataaacaaatatgaaatataattgagtacttttataatgtttttaaatacaaattaattataaatcttatgagattctgcaattataaaatattttaaaaagtagcatctaaatatttaaacatatacataacttgttaatacatgcatggatagaaatctaaaaaagaatttattttacccatattttaaaatgatcaggagatcaattatacagaaacatattttttataatgctgatttacacatagttaacatatagtaacaataatattcaataatttgttgataggtaaacatgtgataaatactattctaagggcttatatctttttatttatttacttttactttttattttttgagacagggtctcactctgttacccagtcttgagtgaagtggtacgaccacagtttactgcagccttaacctcccaggctcaagcagtcctgtcacctcagcctcctgagtagctagaactacaggcatgcaccaccatgcctggttaattttttaaattttttgcagataacatggtcttgctatgttgccagaggtggtctccaactcccggactgaagtgatcctccaaccttggcctcccaaaatgcaggggttacagttgtgagccatggccccagggctccttttattttataatgaaagattagcacatttgatctctagtacatattattttctcatgtttccaaatgaagtgactgagatattaaaaagctacaaagatgattggggaattcataattccaattcaagcagtatgtctctaggcctatgtatcttatatcagatcactcatggatgttaattaactactcacacatttgttccattttcaagttgaattttttttccaaataaattcttcatttaaaaataatttccaggagtgatattagtaaaacagcaaacaaaaactctaagtcctcattccttcatgaaaacatcagaaacaaacagaaattgactaactatccttataggaccctggaaaacagccaaagacctatagaaagcaagcaaatattcaatcaagaaaaggcaaattttaaacagtagacaattttacaacatttttacttgctcttttcttacccaattcttggcatggcacagttctggtcttgaaggagcagtaaggcagtttcaaattccctctctcaagccaaaaggagcaagttatatttcatttgagatgttataaactgtctggggactgcctgaaatacttatctctgtctcatctaactcagatctcagtcaggagaacaaggtggcaatgatcaagaaagctgcaggggcactacagactcacagattcctggagtaagagattacaggaaaagcattaaacagaccatctaagctccaaggagaagttggaataagacttttcttgcaaattaaatcattcaaaagcatgtatgtatgtaggagaattgaaaagtgacaagcaggcccagacgaggcacatgcacggaaaaattctcagaagactttaagctttttactgtgggcttatctcaaggtgcaaagtatgtccaacatatcagtagaggacttctctgacaaagagacaaaatacaaaaattagaaaaggtagtttatttttgttttgttttttcctcacactctcaatttttaacaacagtaaccaagaatcacaaagcctataaagaaatagaaaaacacattccaagaaacaaaatgaatttccagaaactatcaagaggaaacacaagcataaaacttaacatatttagatttcaaacaactatcttacatatgttcaaagagctaaagaaaaacacaaaaaacttaaaaaaaaacaggaaaataatatatataaaaaaaagaaatatcaacaaaaagatagaaatttaaaaaaaaatctggagctgacaacaccataactgagttgaaaattttgttagagggaatcaaagacaaatttaagcaagatgaagaaagaattagcaaacctgagtacaggacaattgaaatgattgaatcagagcaatagaaaaaaaaaaggaatgaggaaaagtgaacaaagctcaaggaaattgtgagatatcaataagtgaactgatatacacatttaggaatttacagaaagagagagaagaagaaagattattcaaacaaataatggccaaaaatttcccaagtttgataaaatgcataaatttacaaatccaatctaagaagtacaatgagctacaagtaggatacacctaaagagacccacatcaagacacattgtaagcatactgtcaaaaacaaaaaacgaagaaactcaaaagcagttaggttaactggggtgactacaacagtatcagacaaaatatacgttaaaagagacaaagagaaacatatattgataaaattgtcaatacaccagaaagatataataattatagacatgtgtgcatcaaacgtcagacattcaaaatgcataagcaaacattgacaaaataaatcaagaaaaatatattgttctacaaaagtagtcggagacttctatactgttctagcaataatggatagaatgatcagacagagatcaataaataagtaaaagacaaataacaatgtagactaatagaacttaacatgtatacagaacactcacttaataatagcaaaatatatacctctcttaaatgcacatgaaacatactctagaatagatcatatgtcaggacacaaacaagtcttcataaactcataaattgaaaaataagtcataaaaattatctttttgtatactatgaaatgaaaatagatatcaataacaaaagaaaaattagaaattcaaaaatatatgagaattaaacatacactaaacaagcaatgggcgaagaagtcccatgggaacttagaaaatactttgagattaaggaaaatgaaaatacaacataaggaaacttatgggatacagcaaaagtactgctaagctggatattcatgtctaataatacttacatataaaagaaaaaaaagatgtgaaatcaacaatgaaaccttataccttaaccactagaaaaagaagattaaaataaatccaaacagaacaaagaaaagagtaatggatagagtgaagatgaataaaatagagaatagaaaaacaaaaaaatcaatgaaattaaaatttggttcttcaaaaagattaacaaaaataacaaattttagctagattgagcaacaaagaggaaatgtaagctcagaaatgataaaggtaatattagaaacaaaagtagagtcactgttactgattttacagaaataaggcttagaagagagtattatgaacaattgtaagccaatgaactaacttcgataatatgaactggaaatatacaaactatcaagactgactcacaaataaatagaaaatctgtatagacataactagtaaggagattgaactggtactccaaacatttccaaccaaaaaaaaaaaaaaaaaaaaaagccctggccctgaagacttcactggtgaattatacaaaacatttaaagaaaaattaacaccaatcatttgcaaactcttcttaatacatgaagagacacaaacacttcattcattcatcctgtgagacaagcattatcttgataccaaagccagaaaagacatcccatgataatggattggttgaactactattgttaggagggcaatactactcaaaatcttcagacttaatttgatccttattgaaatccccaaagtgtttttgcataaattaaaaaaatcaatactaaaatttgtatgaaatttcaaaagactttgaatagtcacaacaatcttgtaaaggaagaacaaagttgaagaattcacacttcctgattttaagaatgactcttaatgctacaataatcaaaacagtgtggtactggcataaagagagatatagagacctgtggagttgaatagagaatgcagaaataaaatctatacatagtcaaatgatttttgaaagggatgctaagactactcagtgcagaatgaaccgtctttttaacaaattgtggtgggaaaactagttatccacatgtaaaagaataaaattggatcacagccttatgcaacataccaaca

SEQ ID NO: 521 - DNA, 20001 bp, Homo sapiens
ttagatgctggaaaagcatgataatcagaatgtgatgtttctgtgcttgcaaatagttatctgtccatgtgctccaaactcagactagatcataacctcctttcaggacacggattaagtcttacatgtctttagattccctgccttgcatctttgctcagagtaggcactcaggaaattcttgttgcagtgggttgaacaattctgtgacatttgatctcagaacagtctccattcatgctgctctgagccaggagaatagcctacacaacgcccatctgtgatcaaggtggaggccttggttattaactcattaatgattgcaccaaataacatgaatttccaacaagagctgctggaaaatctggggagtttacaggcttgtaatatactgtcactacctcactaccaccttatctgggaacctttagagaatcagccttccatttggtcgtgctccggtatctagcataactgcaaaatggtgagcactttcttgataagcccaatactcttcaataccatctaacagtgttgttttggtcactcacttggtcccagccatcttaatgccattatgaggtgagacttataacctacagcttgttatctggtgacctcccaaagagccaccaaagaaaccatggaaacgacttctctcatgggcctcaaatacagggagcatttcctctccctgactaatataggaccagattcattcttcttaaggtcagagtcaacctccaccatcactgcctgggtgaccttggccaggggcattacctctttctgccttgacttcatcatctctaaagcagtgctcataacaagacacagctcatagggctgcgaaggacagaacaatataaattgctttgcccagtaccaaacacacaagtaagaattcaattaacttaaggggcaaataccttcccagaatctttaaagcaatgaaatccagccccagttttataccatcccaaattctgaaaagaaacagtgttaattcactttaattttaaaagtgccatacagcacttttaagaggagtgggagggtgccatgaagtcaaaagatctggtgtttgcaattccaaaaagaggtcaggaatcatagcctaggagtggactattttggtctggtctcactgccccaaccagacactgcagaaattgtcctgcacctcctgggtcacagcaaatcttgaaagggacccatggaaaaaggggcctctctcaggatacacagcaaggatattacaggagatagaattccagaaaaggacatggaagctctgggacaaactttgctcagcaaaatcccaaacttagtttacacgttttccaatgtaaatttaatatacctctcaaagggagataaacataacaagtacatgccctagtggtgtagttctttttctctttctttctctctccttccttcctttcttcctttctttcttcttctttccttcctttcttcctttctttctccttccttccttcctccctcccttccttcctcccttccttctctctctctctttctttctttctttctctctctctatctctgtgtggctgtctctctcttaagcagttcagatttaagaatataagatgaatccttactatgtacttcaaataaatggcaatacattcagctttctgaatcactggcagcagacaagccctgtaaaagctatcatatgagagcatttacttgcattcagtctttaataaattaaatatccctgtttcttattcataaaggcacaaatgtggccactgacatatggaacaattattgccttttgattacagataaattttcacttctgacaaggctaagaactttttagcctagaaacccagactgctttattcttaatattttctagaaaaggaaattctatctttcattaactttaaagtctgcacagatttattcttaatgataaagtatcctcatctgctacatcaaccaccagtgattattagcatggagatattgttttaaatctaaacacacatagtcaccagccatcctttctggattgcttagaaatcaaataagagatgagctaagtgtagaggagaaattggacacaaacctgtcttcctttgccccacccattttccaatttcctggaaatgcaaatattgaccttgagaatttcaaaggtctctcacaattttgtacctttttatatcaacaaatcagtgtgggcaagctcataaaactcttgtcagtatactcaaaagagttgaaaataaacaaatgcggttataggttaaaataagattagtgaaagggaaggctaactgttgttatatcaagtagtgttaagcacaaactgatcccttttctagatagatgattgatagataataaaaagacacatagatagatagatagatagatagatagatagatagatagatagataatcattactattatttagccagtgtgggacattgagcctgaagattccttttctattcaaggaaatagattctcttagccaggtcttcaataaggtaagggcatcactctccacccatcactacagggcccagaacaaccctgaatctaatgggagcctggaatcaaagggacttgcgagtggattaggtagaagttctgagctccacaaaggaaaatgtgttcccaacattcaaatcactgccctttctggactgctcagtgtcagaatgtgaggagtcagctactggacacagccacccttttacacatctccaaaggccccatactcattgtagtttatatgtgcagtgcccagcctacacagcaggatacaacagccttggtcagcagttctgtctgtccaggtaacacagtggccagggtgaagctctacaaatagattaggcactccagaaaaacacagcctttttagcaaggaaaggagctaattggtccagtaaacactcaccaagcgcattcatagcctgagtaagagctgagacaagaacttgctatgcaggactctgaacacttttacaactaatcttcatattgtccaagtaaggtaagaactgaaggacaatttcctgagattatcaccaggctcccaggcccttgttctaattctgatcttaacgacctgtgtgatttaaggcaaatcactcaaagtacatatggtaaatctctcaaccatatcccatttatacctaccttgcttagatgaggaagtaaacatgcaaagttttgaatgttaaaagtgctaaacatatattcactattattgttattacaatgttatcacgatggggcagtgttagagagaacatggaattctaatcactcacctcctggccaatttatttaactgttctttgactcagtatcccctttccataaaatgagcattaaaaaaactacactaggctgggcgcaggggctcacgcttgtaatcccagcactttgggaggccgaggcgggcagatcatgaggtcaggaaatcaagaccatggtgaaaccccgtctctactaaaaatacaaaaaaattagccgggcgtagtggcgggcgcctgtagtcccagctactcagagaggctgaggcaggagaatggcgtgaacctgggaggcggagcttgcagtgagccaagactgcgccactgcactccagcctgggcaacagagcaagactccatctcaaaaaataaataaataaataagtaaaaaataaaaaaactactctaattacctcattcaatcatctgtgtacccaattcatgatacattgtaggttctcaacaaacgtgaagttccttctcttccttttgccagtagtgttccaaggttctaaggaggacttctattttaaaagggtgatcattcactccccaggaatcctattccagggagcccagagaaatcccctacaaagaactgggtccagctgcatggaaaggaatttcacagaatttggctcttcctccacagattccttagctgtcttttctatcccagatatatttaacacaagcagctcaagggaattgaataatatctctggcctgatctgagacacgaagccatctggagaacataacttctaacacttattcctggttgcatcacacctaaccacaaaacccatccatgctcagggtctctccatcactttcctctctccatggacttaaatgcacaggcctgcaatgacctttgaaagcttagcaagagcaatctattctccctttagtctcctctaggctgtttccctaacgagggaacagtaatatggagaaggcaaattagaaataaagccaaactatccaaagtaagtaatttctgccttgttctgcaatgtatggcacatgttttcctgggagcaaatttgttttcttaattgggttttatttaggcaactagcaaaattaatttccattccctgagcacttttcatctgatagcaatggggcagcctgagattaaatgttccctatgaataagcaaagaaggaattgtttgtgtggcaaatcaataacagcacttctttgatacagacctaaagatctcaaagctctatctcagaaattgtacgtagtgttttgctgaacacccaaccatctattaaaatctgccttcctcactgcatatttcatcttaattcttatcctggtaccattcccaaactttctatccccattgggctaaagctactccagaaatccttccacacgagatgcaatcattatactgctctctgccacgttgtcccaagccaaatagaactggctgcctcaaatgcctggaggtggcttattgttactaatacatgttttacagcataaagaatggctgagtatcctacagtcctgaggtttggctctatttggtgggctgactctgcctgtgaccaagaaaacagctgagtagcagggtggtaagtatacataaggcaactagactcttagaaaaaagcagttagaaaatgtattcaataaatattcacatccaattgtggtctcttcctttaactgtgacaaagggaatacaaacaaatcatcagcacacaattagcgctctatccatggaacagaatttctcaaaatttccacgtgtgacccaccctaagactgccacgtatgcccagatgctagtaagaaaactgcctgagatgcaaagaaggtgccgcttctttggttacctttgctcactgtcccatttgttttctcagactctggttttggtaaatcttctttgccctggtagttgacaaagggccagatttgtagctggtcagtggtttgaaactaattggtcaaaacatcagggtgttttcctaaagcaggaggaaataaacagccctaactgtaatagcatttatcaggagatttttttccataagcacataatacagacaggtagagagagaatcaacatgataacaaattcatcagtataattattgtcaatgaatttgatccaaggtgacttaagtgatttcatttggagagtaaatgttgggaacaaaagtattaggatggtagtacaaagggtggttaagacatgggtgatgtggtccaacctgggttcaaattgcagttctactatttaccagccgtgtgaccctgagctagtaatttaaccttgaagcttcagtttccccatattatgtgcttagtgaagtataacacacagtaagaacttgacaaaaatgagcaacaataaagcctcaaataccagactgttatggaactgttttagtctcagttttaactaagcccaaaatggttccaataatttccaaatttcaatgttagataccagacaacttgaacaggatttacaaagcagatgttctaaaactctttcatgacccttgtctcctcacccactcatgagtataaaaaaataatttggtacaactagtagaattagaattaaagattggagtggaatatttttttggaaatgtctaccctcacttcagtactaatgagagagacttcaaggagatcattcagtgagcttgttatgggtctcctggatgtcaagcaacacagtaaatggaaagtgggccacacctgaaaaatataaaggaccagacatagctagagtcctgtgaaagaagaggagagaattgtcactgggaagtaattgcattcccacaaaaagaaaatctcagatgtgggccacatgaaagagatggcagtaaggtggggagagtggccttatagttccttcccaggagagacaaggtaggcagaactctaagatgcccttcaagattcccaccccctcccatatacgtctgtatgattctctccccttgtataataacccccattggagctaggcacagtggctcatgcctgtaatcccagaactttgggaggccggagtgagcagatcacctgaggtcaggagtttgagatcagcctggagtttgagaccagcctggccaatatggtgaaaccctgtctctactacaaatacaaaaattagccgagtgtggtggcactcgcctgtaatcccagctactcaagaggctgaggcaggagaatcgctggaacccaggaggtggagggttgcagtgagctgagattgcaccactgcactcctgcctgagcaacacagtgagactccatcccaaaacaaacaaacaaacaaacaaacaaaaaaaacccattgggtgagacctgtaagaatgataggataacactttcatgattaggctactagtcagttggctttgagttgatcaaaggagagatttcctaagtgggcttcacctaattaggtgagactttaaaagaagacagtgtcagagagacgtgctagcctggaagatgtagcctccatgagttctggagctgccaagaaatacatgttgccaacacccatgtgaacttggaagatgaccccaagcctcagatgagatcacagccctggccaacacgtggatttcagcctagtgagaccctgagcagaggacccagttatgctgtgcctcgacttctgacctacagaaactgtgaaatagtttccgtaggtcagaagatctatgaaggagtggatccttcatgaatggcttggtgccatcctccccataatgagtaagtttttgctctattacttcctgaaagagctggttgttaaaaagaaactggtacctccccactctctcttgcttcctctctctccatgtgatctctgcacacaccagctccctttcccttcccttcccttccaccatgaacggaaacagcctgaagcccttgccagcagcagatgctggtcccatgcttcctgtgcagcctgcaaaacaacctcttttcttataaatcactcaacctcagatattcctgtgtgtcaacacaaatggactaagacacctcatttgtgatagaacataacagatgaaagatcttcagtagctggttgctgaaggaagagtgccaaaatctcacaagtgctcacaggagaatcaggttcagccttctgcctggcccaccatgctccagtgcctgctcacaatggtaccagacacgcagaccttctctgttcccctaccttcctcccatactcacccccaacttgaacccaccactgtgggaatcagggtcagaaaccgtaatcattaagatggggagaagggtagaaatgcaacaccaagagatgtagaggaggcctctcagctccccacccccttttcactgccagcttcctacctgcatgggcctaatattttgaaggaggaagtttgagtgaggctcctagtcttgatcattacactaaactgaccctaagtaaactgagtaaatacaagtatctgagtctagcttccttctttctagttaaagtagctagagaagattttgtctctgaaaataagaagatacattccaggcctagtcgagattttatctaagggtaagggaaaaaatgactgggtttacaaacaaacactgagaagaaagagttgctttacagtagcaccagcctagtctgttgtttgaacataagagttactgagatattaattataattaaatacaccaagataaatcttcttctctgtttctcaataggaaccatccaggtagaagaatgaagtgagaaaatcaagtccacattagctgaagagagccttgaaattgacctagtgtcatgactgacaatacggatcaggccatgaacagaaattctgccactgggttgtgatgaattctgctctaatggggatctcagacgtttaaggggaagggaaaaggggaaatggttgggagactcaacatggcttttaaggtcaagtctaaaatgatggcgacagctcccctgacaaccctcttgcctcacagaagtggaaaggatttcttgcacactaagaataaacaattttcccagggtaactcattatttattcagtgcaagtacaattgagaacagtccctggcaagatctgtaatttacctaaaagtcatggttttcactcctaaaaagaccaattgctgtctaaaagagtattttcaatataaattttcttcctgagatacaggtatgcatgagtggtaagtacatacaggcacacactcacagacacgcctcctttttaacagatgtccatgttttgttaaagtatgagaaagcagccaaactgcatttgtattttcactcctacagagaaaatgttgggccatagagagaacagggagtctcaagcagcaagcatggaaaatgatgatgagacaattgggttaagaagaagggcctgggatggctccagaaaaggtgcagagagaggcagatacataaaaagcaccaagccagaagcaagagtgaggaccccagcatcccttcaacttatctagcttactcctggtgaggactaggcctggagggctgggctctaatggcaaggtccacatcaccacatttggtcctcatcagaaaggaggcagctgcttagggagtgtcctcctgagcagtttcatccctcattctgaaagagttagggctgaccattgcatacttaagcagtgagttatgcacaggcttactgaaagtctctgtctgtgaccttgcttcctcccacctacattccctgcctggaatgcctctgtgacactctttcttctctttattgaaatcccaggctacctttaagacccaactcaacacctaccactccataaagtccacaagtacatccctcatctctaaattcctatgaaatttagaaggaaaggagaagggaattgacatgctgagatcatctgctttatacaaaggatgagtttggatggtttccattctgtttcagttctctctcactgtataacaaaccatccccaaaacatagtggtttgaagcagccattttactgtgctcatgaattctgtgtcaggaatttggaaacggcaaagcagggacaattctcattgaacttgctatggactttgagcgagatgactttcatgactgggagtgattcaagtcactgaggactagaatagctcagtttggaggatccacagcgaagatgtcttcttcactcacaaatctgtgcccaagctggaatagctaatgaatagttcaactggggctcaaccagaatgcccacatgtggccataccagcatgatagtctcggggtagtcaggcttctcacatggtagctcagagtttcaagaataaaagctctgtctggccttttatgacctagtcttggagcacagagtatttctgccatactcttttgctccaagcagacacaatttgtccagtttcaaggagaagatacatagaccccacctctcaatgaaagaagtgacacagaatttgcagttgtgttttaaacccaccacagataaaaatcacacatttaattctcacagaaatgtttagaaagtataagtatttctcctttatagatgaggaaaatcaagactccaagaggctaaacaagttgattattagtctcgtgcccagagaaaggagtccaagtttgtctgatttcaacaccaccagtcttttcatgcagacattctgccacccttgagtccttatcacaatgagacttctgtaatcctaaactcattaatagcacagattgtatcttgtttcttgttacatacatatgacctaaaaacctaaaacaattatgaaaattctcaatattagccaactggtttccaccccctttctcctgctacaagcattgcacctttcatcttgctttccctctttacactgcataggtaaacggactttctgacaccaaggctgctccctctccagggacagaaagtatagcagaaagtcaagtacacaaaaacagaagttgctttttgtttcctggcagaaaaaaatgtaaaaagcaccatttattaattcaacaaatatttataaagcacctactatgtggccaacagttttaagcaacggagataagggattgactaaagtttctgccctaatggactgatattctaggagctgacatgggctagtcaatagattaaaatataacataatgtcagttaatgataagtgctataaagaaagtagttgggcactgttttagacagggtttcagagaatacaatttgaaaagttgacaaagaaaatgaggttagacagtcaatgaagggcctcctgtaggatctcataggtcacagtaaagattctgaattacatgctgagtgtgatgggttgacacataaaagttttaaagcaataggaagtaacatgatctaatttacattttttaaaaggtggcttgtggtactttttttaaaaattgactatagaggagcaaggaagattaaatatggtcataaattttttgacacttctctcattgagaaaagggatctatttttccttcccttaaatccaggcagactctgtaattgttttgaccaatagaatataatgaaaatggtgctttgacagtttttcaggcttacactttaagaaactggcagcttctacttctagtgtcttggaaaactcattcatgtaacctagccaccatgttgtgaggaagcccaggtagccacaagaaaaggccctgtggagaactgaggcttccagatgacacttctagctaaactcatatccaagagcctgcaccaacatgccagtcatatgagtggaccatcttggaagtggatcctccaacctcagttaagccaccctaggtgacaatgcaaggagtagaaacaagttgtcttcctgaactcttctgaattcctgatccacaaaattgtaagcataagtttggtgtattttgttatgcaaccatcaataaccagaacaaaagacaagagagaaagcaggaagaccaatgaggaggctattgcagtaatctaggtgagtgataatggggtttagggtgctatcagtgtaaagggtaaaaattgttaagattcagaatgtattttcaccgtgaaggaattggtgactatatatggttgcctaaaatcttgcgtggaaagaaaagatatctaaaattcatggtaaaaattaaagtattaagtgttttattaagtgttaggcattgtgctaaaagtcttctatatgccttacctgatttaaacgtcatgacagcctgtgaggtaagtactattgttaaccatgatttatatatcaggaaactgaagcacagggatttaagtaaatttcctatgtttcttatttagtgaatagttgttcctggtaacttgaatacaggcagtcaagctccagaatccatgtccttaccagtcttaaccactgtgttatacaactgcactatattctcagttattccagaaactaactacgtgactttcagtaagtttcttgaccttcctggggttcagttttataatctgtaagctgaagaggctggaaaagacaagctttaaagtctctgcaaactgtaacatcctgtgattctaaatgccagaattcttagaatttgacctgtttgtttctggaattcaggatggataacctcaagtgtagtcacaagaaataacagacagaaagtttattacagaccctagagatattccaggcctgtgcaatatatgaaagataaggcactttaaaaccatccccctcaagacaagagcatgcacccagggtcagctgcagcttgtctccccgccttctcttcttctggctctgtggcccagggtgaccagcaagacctcccagaagtttagtcccaaggttcatataatgctgactacaaaactgcaaattcattctggagccccaaattggacaagctcctcatggatgttacatggagaaagaagcagttctgagttttatccctaggtctgccagtctatgacactcctcatatcacctcaagcatgttaccaaaaatcaaagtatttttttaaattgagaatgcatgctgggcttagttctgagttccaaatgcttctgtttatctcaaattgtttcaaactctcaagataccatgaagaaaattatgattgcagctagaaaagcactttaatcttcttagtgaagggtggcatgtatactcaaggaacctgaagcgtcattttttaccaatatgatatgattattcttcctacaagtaaaaccaaagagctaagtttttgagcacttattatgactgagtctggtgtttcgtgtgcattctttcctttgacatgcatattaatattatcatcccattttcagatgaagaaactgacatttagaagcaggaaggggcagaactgagatttgggttcagaaagtcaagcacgcagagcacaggctcttaaccttacaccatactgctcctctcctgtttcttaaaacacaaagctagattgatctctcctatagatgttgcatgttaaagtagtgtaagaatgaagctctcaatgccaagattacaaccaaaggcccccagcaacctgaaagtcaaattttctgcatatataaggtgctaggagtctgttttaatccattttgtgcttcttataagaataccacaaactggataatttataaagaaaaaacatatttctcacagttgtggaggttgggaagtccaagaggacctggtagaaggcagaagggcatgagagcacacatgatagcaagaatccacacccaaaagccctttagtaaaggtgctaaacccacccatgaggatggagccctgtggcctaatcacctcttaaagttcccatctcccaataccattatattggcaattcaatttcaacatgagttttcaaggggacagacattcaaaccatagaagagtccttttggactttttcatttcacatagcatgaatattttagtgaaattcctatccacccacccccactcacacatcaggaagaaggattgctaatattattggacagatttcaagatgctgatggaaccacagtgggcagagacattgtgtattaaaagatcttatccaggagggcttacttttatccgcttctagcttccatgtctctggctggttaagatctacactgacctggtcatcttgccttggcctctgccattattgcattaaatggtcagcctggtgagctgagccagacctcctaggaacctggcaatcttgatgtctgccctctgatttccatgtagctaaatggccaagaaagcaagccaggatctacctcagacctacctagtttattctcttggctgtctccccatgcagagggttttgctgaatgagcgaagacctacttgggaactggttgttgtgatattttttcttctctgttcactgagctgcagcactctcctccctcctgacaaggtcccaggttggtagtgatggggccatgtttcagtgagtggaattgtggtgtggtgttgcctggccctacatggttttctttcacaactcccagcctctgtcctcctggatcagttatggagccatacctgagcaggttggttattgtgttttcctttgcagcacttgtttctcttccctgtgagccatggagtaagctgccctagtatatccagaggcccgaattcttctgtcttctcaaacctgatcataagtgcatgtaccattgcaagtatctctgtaacccgtggtttggtccaagggttcagatttagagatttggggcttgtggaagagtagctcttgtgggtctctccctgagccctctgtgccaacctggccttctctagagaatactgcattcatgaaggggacatttatccagtcactgataaggtaaaatttagcttcccatttgtcagttttagtcatgggtggagcttacttcctgagaaacttcctacagtataggtgtctagtccaatgcaaaatttatgcattcttaggtcccttgactgaactatatctcaacatcaacaaaacctcaccccaaattcctaccatgctaactcagctttcatcagagggctctatgttgattcatctgacttcagcccagcttatttaaaaatttgtattttgtttctcatctattgttctttgtgtgcagtatctgtctcaggaaaaacagaagaatgcttggaccagcacaggatccaggcatccctctctcttcgcccataatactattaaattctcacttaattcctaataattctcttctgtttattaaagatggaaaccagaaacaacattgtctctctgctactggagagaagcagaagagtgaagataacataacattgccctattacacgcaagggccaccaaccaagttcagatggaggaggataaagctatgctttaagaaagccactctaagtttgcccttacaagaagcatgtaaattgggtttttatagcaatgtttccatagaatagatgaaaacccagaagcctatgggcctcaaatgacctgagacattttcaatagcatcagcaggaacagaagtgccatgaagcatcctgttaaatcaccagtgcctcagcctgaccacagaatcttaatgtgagagccttataggtcatgtaatttaactcatagagaaatgatgctcacaactccctggggattttgttaccagtctctgtctttcccacagctggatgtttctaagcatagaaacatcttttactctaacctgcctcctaccaatgtcaaaactgctgtactgaggcatcaaataagtctaggtcctcttacaatttttatctccttgagtttaaaaaattaatcatcatgccctgatgatgggccaagagactcatcaccctgagctaccaccaaggctcttcagaaaattaaacttcccaatttgaccatgttttctcatgagacgtgatttatagacctcatgccattatgttcccttgtgtctggatgtactctagattgtcaaagttatttgagtgggataccaaaagagaacaatattccagatatgctgtggtcatcacagagtagaacaggaccttccccctttgttgatatgaataccaatgcctcttcagtgacatctatgatcttgctacatttttagcatctacatcacacaagtggctacccatctgcacgtagtcaaggactcggctttaaaagtgaaaagttgactaggtgcggtggttcacgcctgtaatcccagcactttgggaggacaaggcgggcggatcacctgacgtcaggagttcgagatcaacctggctaacatggtaaaaccccatcgctactaaaaaatacaaaaaagtagccaagtgtggtggcagatgcctgtaatcccagctactcaggaggctgagacaggagaatcacttgaactcaggtggtggaggttgtggtgcaccaagatcatgccactgcactccagcctgggtgacagagtgagactatgtctcaacaataataataataaataaaagggaaaagttacgaaaatgaccaggatcaccaggttaccaacttcttccttcactgagcctaaactttttcctggttctaaaagccaattttttagtcctcatgtatggtgacattacctcttcttgagaaacacactgtaggtggctagagtgggagtccagctataatcatggtgcaacactattgaaggtgcagggagtgacatctagaagcaaagcaagtggaacattaccaggagctcctaggaacatttcactggggcccatccagccactcagagagtttaagaaacttgcccaagactgcagagctcttcagtagtagagctgaataaatttgtctgggtagtattcttgttcactactctatattctctaaccagccaggtttagtgtttctcaaattatagctcatggaccattacatcagaaccttaaaaacaaaggttcttggataccactcccactttattgaatcagattctctgatagggctctaaaattatctttttcccaaacttcccacatgatccctaagtgcatcattgtgtgggaaccagtatcataggtaactttgactaaaccattctccacctaggaggagaggataaagaccagaaaacccttaatgaaagtaacaggatctcccaggtatataaatggcaatgccttctctcttagtctgtaagatgtactaggatacaaacaaaaaacagaaaaagtaaaaagaaaaacacttaccccatgaacatcaaacagtggttaagcaacagtgcttacattatcctgtcttttttgtttggtgggaaaaatattgctaaaagctggttggttccatgggactaaaagataagaagatcaaaagattttaataattgctagtcactgctctactggtaaacaacatgattatgtgagccatcaacacctcagggatctctgtcattcactgacctgaaatggaatagagttcaagacgcaagataaggctcctgaggtaaataggaacccatcataaaggaccctgtagtccttgacaaagagtttagactttaactcctttcagataaggagttgtgacagagactggctaagtgttctccaactctctttcttttcctgatgggtagaaagattgaagctggactacgtttcccaacctccctttggttaagtgtggtcatttgactgatgtttggtcaatgggttatgggtgaaagttttgtgctctgcttccaggcttcggccataaaatcttcccatactatccttcagtttctctttttccccatccaaccatctagaagttaaggactagaggaatctaaaaattgataaagtccaaagaaggaaggagcctgcgtccctgactcatcacattgaaagctgcccattgcactctcatattacactagtgcatgagcaagaaatacatttgtatttcattaagatattgaaatttgggaatttattcagtacaatggctagcattatcttaacgaatacaggaattattacaggacttatggtaatatgatgagctcttttatagaaaagccatcctgatgtcacaccacttggcaaaaattagatacaaaaggtaagtaagaatatgagttacttacaaggaatcttctctgtttaaaaaagaacaacaatcaagaatactaatgattgcacagcttagaatgacttctatgggtcatttgattctgtaatctgcctatagacagctgaatatctatccaccattccagttgaagggtaattttcttatttttaaagagctccaacaacttatactccctctcatagtaatccagaattgtcctttggattaagatatttttctttatgtataaatatcattttgctgcatttgaaaaattgtctctgaacagctggtatggcagtctgctagttttcccccaaatatactcttctttccttccaaacactcatagtttttgtagggcacatgggcaaccagttagaaactatgttttccagtctttcttgcaggtaggtatgactaggtgacaagttctttctcatagaatgtgaatggaagtgttgaaggtaaccacccccagccagacagaacatttgttaatgtcattggcaaggctatgctttttcagaggtcccggcaaccaggtgctctcaataaatgttaaatttatttctaccccatttaatctgttatgaactcaacacaatatgcttaatatgatactattttctgagtgtaagaaaatggacaggaaagtaaaggacaaggaattgactattctggctcattgtaccatagtttaaggtttctatttggtgctcacttcccaggcccgcactgtccctctaagacaaagagaagctgtttaacgtatgtttaaaccagccatcatttacccctctttttctcacatttaaaaatgacattcatctttgaagttttacaaaataaaccagcataatttctgtaattaggaaaaatacagataagcacaaagaggaaaatgccaaattctcataattccattcatactggtaactttatcattctagtctttttaattagcatagatctatacctttttgttttgtttttacaaaaataagaccattatcattacatggagttaggtaactttcctttgtttccttttttagtccctttagtctctctctctctctgtgtgtgtgtgtgtgtatgtgtatcagctttattgagacataattcacataacataaaatccaaccttttcaggtcttttaaagtgcataatgtagtgatttttaatatactcaaagttggcagccatctaattccagaaagttttcaccactccaaaaagaaacgcagtatccattagcagtcactccccattcctgcctctgctcagcctttgtcaagcattaatctactttctgtctctgcgtaattgcctattatagacatttcatacgaatggaatattatcatctgtggccttttgtttctatctttttacttaacataatgtttttaaccttcattcatgttgtagcatgtgttggtaccttcttttcctttttaaggctgaataatattccattgtatagatttacatattttatccatccatcagttgatgatggacatttggtttggtaacttgttttttacttatcaaatttttattaacatggaagtgatcctctttaaaatcagtttactgcctgcagagtattccattgaatgagaagaatcattctattgaatgagatgcaccatattacaaactatattgtgataacatatttttgcaatactgtctcactgtaagttagacttgggcagccagaatgaaatccaccggtcctcaagttgcatatggggcaggagcaggggagagtaagtacaaatatggtataggataagatagtgaggtgagagggggaggccattttcttaagctacctaccattaaggagagcagattccggaatatgctgctgacaatgtctgttatctttcaaacaagatttgcctgaccaagggcagatgtaggtcacagactgtcaaggtgtgatgctagtctctttcagacctgaagcggcctgaggcagtactctcctagccctaaaaggctgaatataaatcatgcttgttggcaatttctgctgacgtgctgcctgacacatggctaaaagcctttctcagagctgagaataaattccaagacagcaatgacagctataacaatgctgccacatgttaaagtgtttaaaagccctcaacaggggtagtcattcaacacaacatcctttacttagatagatcctgcacattgcaagacaatggggtggggggtgctatgctgaagaagaaagggagaataaagatagttctgcaaaagactacaggggtgaggtttacaagcaatgtttagatgaaggcgtcccggttccaccctcacctcccctagcccaagggatcaagttcttctaaggcatttcagtcatgagcagatgtctactgtgcaacaagaaaatgggacaaagggggatagagcatcgcttgaaagagcataataaacacaaattatgctgcttccaatagaccgtacggctttcatttgcaatctggcttat

SEQ ID NO: 522 - DNA, 20001 bp, Homo sapiens
acatagtacaaatccaactcccacataaacagtatctgctgcaaaatcatgtagcacccacatatttgtttaatgaaacaaggcccaaacggaaaagttacaatctaatttaaagtttagatgcctggggacaattctgataatgtttagaggtagataattgtgggaaacagaagaaacgaaagacaaatattggcagtgactgaaagaaaattaaaaggctacattcagatccatgagcaacaccaagaaatggtatgatgtaacatactagagatttcatgagtatttgatatctaggtacatattttcctcaagtgctaggagccttttgacttccacaggcaataacttatgaaaaatttattattgcaaagcattcaacaatggccttgcgttcacaaaatttaactagaagtcctactgctttcagagactaaagacttctaggtagataaagctctaagaaaacttaatcctggtatctagataatgccatgaggtatacacaagggaagaaagagatgcaaaacaatggaagaataaaatgctttggaagccttcatttattcccacaggatgggtaccacactccacaaacattgaagaaagtcactgagagtcaacattttgtaaatggatgaggtacagcaattaattacaagaatcttctgttggctttgttttgcttttcaagattaaaaaaattagaaattacataattgggccttgatgtttgtgtggcttggaggatgacttattgcaacattttgactgatgtttacaagaaactttgcaagttacttattttcactgaaggatgcaaaacattcaaaatttacttgaaaggggaatagcttcgtaaaaacatctgatgaccagatttggctttagctaaaattatacatttttattattcttgtttttgcatctggtgtgtgtatatgtgactgacattagagttcttctcccagaaaagaccctctaaatatattctcgggttctcattctcagtggccaggaagaacatcccagaaaagtttgtcacagtgggagtggggaattaggggttcagagacaaggctggaaaagaatgatggaaggaaaacagttcaacagagaacacaggtgccctgggacatgggccctgggtgctgatataaattggccaacctacaggctctcaactgtataaccacatttcttgttctgctcctgactgtgaccaaaacaatctgggcacccccaggtgattccatggtgctaagaagacaataagttcaactgctgtacagacccattacttcccgtctattttaaagccaaaaacatcctcatctctccggtacatcactaattaaagtctttatcacttacagttttgttacaggacatggctcagagtatgagctccagagtcagacttcctgggttaagcgcctgtctatactactttacaccactgtgccatgggcaagttactttacactgtctatgtgctattctattctcctcatccattaaagatgggctagtgaacatttgttgtcatcatcctggtttttagctaaccattatttgaagctcttttcatgtttggagaacctcttactttatgaatcttggcacaagacacagcttgcctctcattatggaaactggaaatgcagaacatttgtcatacctgactcccttgcagcttgggtgcagttgcatggtcagccctggcccatcaaactcactcactcggaattttgcctcaaaaaaagcagagacagtggagaatcattctgggggtaggtggcacagctctggccagaaggtccatgctctcaggcagcaggggctgaagggacagtgaggacaaggaggttggcagcatctgcactgcaagtcgaggcatctgaaattgtagtagtgtccattctggagcacaattttggctaaggcagaaagtaattgcttaacagaaatatatgaagactagaaggaaacctttaactactttccacccaatacaataatatgcaaattgttagctaggttcataaatctggccaagccatactttctaaacaaaaaccctgttgctagattcacacaacttagtcttaaaccgtaacagacttttctccaggtggcaaacattatagtgaacattcatactttcaccacccactcctattcacctgtaagggcccttctcaaaaatcccttcctgggtgcagccttttctaactcttttaccaaggaatgaacaatcgtttccttccctgtgtttccctagttcttggtaagtgtctcctaagagtgtttgccacatggaattgtgctttgcatgcctgccctggagattcgtgttctcatttcctgattcctagaatctagctcaatgacagtcagttaatgggccctcaacaaataagtataagatttagggtcaaggacacagtttgggcggaaacaaacaaacaaacaaaaactttaatcatcaagacacagcttggtttcagccaggaaatatatttggaaaatataggaaaaacatagaaatgtgattttatgttaccttgttggcagaggaaccacaaaaattctaacatctaactagaaggggaattaagtgaacagatcctgacattccagtaaacatttttctctaacaaactcccacagacttttcacatcagttcttgaattatttgcaaagccttcaattgatggaggccaaagatgtcaaatctttgaatgacaaggagcccagaatacttctcctgtttagtaaaggacatcagatcaggctcctagaccataaaatcaaatatctacttgatcagatctcatcaaatacttgttttactcttctactttagttggtaagcctgtgagtttttgtggagttctaaacataccctgcaataccaaattcaaaaaagaggttgggggcagttggaaagaaaaaaaaaaaaaagcaagaacctaaatatgcatgggtgaagccagtgcccaatatagggattcttgtcttcaatgcattcactgcagtagtccatggtcctcattaaggcttctaatccactgacttctctctactcatgaagagagaactcatgttctcacttcctttcttacccagatcaagtctgatctatcactaaaattactcctggcaaatacctgttaatccctcccactctttgcttctgtaagccctgccttgcgaaatcccaaccctgttcactgtggcatgttggtacgactcaccctttatgtaccatccctttccaccttctcagagaggctgctctgtctctcttgctaattcccactggtttctaaacatgctgtagtgcctttcatgtcttcaaaagtactcccttaacccataattctcaccagagaccactactctctctgcttcccttgacagtcaaactttccccaaaatgttgactacacagtctatatgcactttgtcattgcctatttactgttcagcctactgtaatctaagttctgcctctacttccaaaactacccctactaaagtcaccaatggcctctaagttttaaaattaagtcttcttctcactaaactaccaaacatattcaacaaacttggcctctctccccttgttgaaacaccctcctctggtccttctatgacaccgtttctcctgaatgttttcttacctctcctactagtaccttcttaagctcattaacagtaccttctttatgtgatatttaaattttcgagtttttcagggctcagttctgcgggttctttctattatattctttttctcagtaaaatcttacacactcacatggttttaagtagcatctgtataccaatgtattttcaacctatatctttaaccagagacccttatgtccaactaattctttaacgtcttctctatgtctcaaaaatatttcaaccctggtatattcaaaatggaatctttatttccccctccaatttgcttcaactccacccttctctacttcagtaaatggcatcttctccatccacccaattacactaaccccaaatcctccttcatctcctcaactaaggcattaacaagtcctctcaattttaccaacaaaatatctgaaatctgctaacccctgctcatctttggtgctaaccctggagtccaagctactgtgatcttttcctaatctaaagcagtaatgctccatcacctattcttgtctcctccttcaattaattttccagagtggtctctggctagttaaatctagttgtgttattcctttgcttaaaagggtacagtggcttattgtattaatcagggctctccagagaaacaggacaaataggttttaagtatacacatttaaggagagatcgagaggtttattataagaattggtccatgtgattatggaggccaaaaagtccatctgcaagctggagaaccaggaaagctggtgatataattcagtccaactccaacggctaagaactaggagagccaatgctgcaagtcctggtctaagtccaaaacaccaagaatcaggagctctgatgtctgagggcaagagaagatgaatgttccagctcaagaagacagaaaattagctcttccttgccttttttattctatccaggaattctatcaatggattagattatgcccacccacagtggtgagggcagatctttactcagtctactgtttcaaatgctaatctcttctgaaaacacctccacagacacatccagaaataatgtttcaacagccatctgggtatcccttagctcagtcaagttgacacatattatcaaccatgtcacttatcattcttctcataatctggcccctgcctatagttctagacatatcccatacccctcactctcacacatataccatgttccagccatcctggtcaccttttcattccactagtgctccctgttcttcccctctccatagccttctcacttgtgcttccatatgcttggaatgattgtctctccaactcactttttggctaactcttactcatccgtcaagtaactttagcacgattcttagaaaggtctttcctgaattcccaaactaatgtaaattttaacctttgattatactttatatttttccacaatagtttttggaacaatttgaaattatataatttttcatttaatttttatttcccagtagactatacattctttaaggacaagaactgtgtgtgttttgtttactgctgcattctcagcatgtacatcagcgtgtggttcattgatagccatttgttaaatgaataggaagttaaagtttttgtaaagctgcatttggctgtcctcacctgatttaaggagggaaggaaactgccaactctaaaggggaaaaaataactatatgcctccaagacacagaaggacaacattcagggcaattagcatggccaggatgttacagaataaagccccagctcagttctctggatacctgttgtagaaagaaggcctcagaatatgagatcagaccaaactggagttataaactctgttagacacagttgcaactattcagcttaatttttgtgtcacgtgcctctcttcacattgttggtgaacttaattccattaaaccaccagacctaaggcttcaagtatggtgtacatactcttgcaagtatttacaagtatatacttttgtacattttgcacaaaagaataaggctgactgcctcttatcactgaacggcgctctgatttctctgtccacaggtataaacaagaacattttgcattttattttatgattcatcttgttacagatataagataatgagcctgaaagagatgatacatggatggaaaaaaaagaaaattcagggctgtgaataatattcctgtagattcccaagtaaaataaaataataaacaaatctcatatcactccgggtccagatctcgtgattaaagtgttatagtccagaaatcccatcaatgttcattggaattacatgtactaacaaccagaaaagaatcctcttatcccccattgctgcctctaaagggataaaagaacaaatcctagaaattatatagtttgcttcactttcttatttccttttcatgaactgtcttattccgaagttaaaaaaaaactatgcttatatattaatatcttccttttgccaggtgaatatttcctaagcataatacttttctattctacagagtactcaagccaaatgcattgagaatgagatggctaataattccttagcaacattggtaaataaatctaaagttatattacagcctgaaaaatatacctaagcttaaatatactgtcttccatgctaaatgggaggtcaataccattcaagtcaagaaattagctcagcaaaattttgctctttctaaagggctagtaaaacttaaattaatcaacatctgtaatatgagatttcacaataagggttaagcaagaacaaactgagttcaaactttgttcttcttaaacctttttgaatctttaatgacttgaggttttgctttaccttgggtcatttctgaatattaataatagtcatgaatggtagttataagataacaggtattaaacagattttccactaatcccaaagcaactcatgaaagttgttttcttgaacaaagcaccagaagatacttcactggcattcttttctcctgaaaacagattataagaaaattgcaaccaacaaaacattctgctaaattatggcctttgtactttaagaacaaacaaaatgtccctaggtgcagtcccatagcactaaggaatttctaatagagctatcttttgactccattacaactagcccatgagttcacaagtacatctgtctcttggaattcaaaatagagatgcagttgttaaaaagaggggtgggctttagagtctgcaaaacactgaagctatgggatgcagattctagagaatactgaagctattttctcaaactactgtgatctctgcttactgagttagggtacagtaagtccccacttatccacggttccactttccatgctttcggttacctgtggaacagtacaagatatttagagagagacagagaccacattcacataactttcattacagtatattgttacaattgttagttattgttggtaatgtcttaccgtgcctaatttttcttttctttttttttttttttttgagacagagtcttgctctgttgcccaggctggagtgcagtggtgcaatctctgctcattgcaacctccgcctcccaggttcaagccatcctcctgcctcagcctcccgagtcgctgggattgtgcctaacttatacatttaactttagcattgtatgtatgtacagaaaaaaaagatactatatataaggctagatattatatgtagttgcaggcatttactgggggtcttagaacatatttcccatgggtaagggggtctattttatgaggcaacttgtaataaactgagatgtagcttgagactatgcgttatcacaatcatacccaataaaccaggagcttatacttcaaatgtcatacatttttcctttgcgccctgtgtactttcccagtttgagcaacaaaatcttatctgaaaagcttattttcattctcagagctgagtgcatgagaacaagcaactttaaaataagcagaagtaatgcaaaatataaaaataaatttaaaaggagaggggctatggaaagtaaagtaaacactaaggaaaataatgaccatttgaactaggcttactcttaggcccaaatagcctactcctaccctctgacagatacagaccagtcatccaagacacatgatccacgaagagtcggctttccaaaggtctttgtatagtggaatctgcactgcctcactggtgacactgttcaacttttcacctttgaacacccaagaaagccagtgccaaaaagagcctctgtgttctctcctaacacagcaaacactacggcattccaagtcagccttcgagaggcttctgagaaaccaaattgtatccattctctccattcctcttttctcagccctggactgtcagagagtcagagttataggaggaaaacttgagccttgaaggactgaaccatctttaccagcctcaggacctagtcaggatcagaactggcctctcatttgaaaaatgaagaaaccacagtctagagatgacgtgtcacacgcccaaggtcataccaccaatggtggcccatgtttggaggtaaaatactatttggcccgacaatgtgtttttccgtttccaccctacttccatccctccaccaagccagagagctggaagaaaggctgacttatgcatccttgtgttttgcttgtttatttgtttaaaatttttaaaataatatatgagggttcagaaggagaataaccagggaggaagagcagcagtgtgcagcattttacaatttcacagaagccacttctccttgtagggtagtccagctacgagctttctgcttctccatgtttcccaaccatgttggcggcatatcatctctccagccttgagagttacatatggtgtaagatctcactgtgtaaactgacagcagaaccactccaagttctcccccatagaaagggactggtgggatccccctgtgtcagaaaaacagaaagaatttgtattgcaaatagcaacttttctatagggggagaaaggctccatggtccttattctaagcaagaggccctaaccttttgcacacagacctctttacagtcaggtgaagtctgtgatggcttctcataattgtgtttttaaaagcataaaacaaaacacataggcatacaaaggaaatgaatcatatttaaatactaatatcaaaatattttaaaaacaaatcactgatatattaatatacttttaattaatgcattaaataataagatctagtttcaggtctaatatcatattcttgcagtattgttgaacataaacaatatctcatgatataggaaacaaatacaatgtgatacaaaaaaatctgtgatttctagtaatgactaagtcacagtactgctaatactactataattagttgcctatattcatagtgaaagaaaatactaaatttcattagtgattcatgaaaataaagccgtagtctctttttaatccaattacacagaattcctgagttctatccatgaaccccagatggagaatctccactctaaagaatcattataacttatgagagccgtttgtcccacctaagaagtacataccatgtgcacttgagcgtactcaatttaacatttcttaacatcattacctttaaattgaagattatccaggagccagtaagaattagattactctgccatcactttcactaaaccaatagctaatatattctcattagctcaattagtgcatgagcattatttcccagagcgagatcatcacaccagaaaatattgattattcgcatgtattatagcaagtcttaggtgcaggtctgtctgtccctgcggctgtacatgcagaccagatatcagctgagaatgtggtggtgaaacactggttaaatgagtgtagagatctccatttatcagagggaagtaaagaaagatccactgtacagcaaatggggagtttgcctgccttcagtttatggagttagacaaaatcacgacactgacagaaattcgatttagtctacaaaattggctttgtcttctattgtctttactaatgttcctatcccattctcttactctttctctaagcctctctaggtaataaatgcattcctgactaaactctatctctaatcatcctctctatggctgcatattagtttctgttacttgattaaattatgtcacgagtaaggcagaatacatgctttacttggcgaagcactgagcacagtgctaggcacattatagcaatttgtatacaaatatttgcccattgatcagaagtaaataagaaatgtattaaaatgagggaagtacatttactaacttctttgatgaccattctttgttttcatgagtgttctgttctgaaataaataaagacatcagaggggactggcgctttgggattcattgggtggtagttgctgagtataggtaacattttctttggggcaggcaggttgtatgagtaagaatgttatttagcatggaagtgatgtgatggtccttggcaacagcaacagcataacagcctagttttcatttcctcgctcattcattcattctacaaacccattgagggttcactaggtgagaaagaggaaagaaacctggtgcagaccttaagaaaacttaagcttgggaaggtaacaataatctgattgatggcctccttttctttcctttactgctactgaatttaggctttgaatcactgaaatctcttccagtctttggctctcatttccaatcatttgctatttgtgcaacataaccttcttctccaaatcaaactgctgccaagtgaatcttaataaaataattataacactattgaataatagataaatagataacccaaatgttcaacaatagggaaatggctgaggaaataattgtatttccacaaaatattgtacaaccaataaaagctatattcatgaagggtttttaataatatggggcattgatgttgttatattaagtacaaaaacagaaaataaattgtatattcagtgtgatatcaaccatataaatacacacacacacacacacacacacacacacaaagaaacaaaacaaggccggagagaaacataccaatatattaaccatacttatgactataagtaatgataacattttttgttatattttaagttctaggatacgtttaaagaacgtgcaggtttgttacataggtatacgtatgccatggtggtttgctgcacccatcaacccatcatctacattaggtatttcccctaatgctctccctcctcagctccccagcccatggcagtccccagtgtgtgatgttcccctccctgtgtccatgtgttctcattgttcaactcccacttatgagtgaggacatgtggtgtttggttttctgttcctgtgttagtttgctgaaaatcatgatttccagctttatccatgtccctgcaaaggacatgaattcatccttttttatggctgcacagtatcccatggtgtatatgtgggccacattttctttatccagtctatcattgatgggcatttgggttggttccaaatatttgctattgttagtgctgcaataaacatacgtatgcatgcgtctttatcgtagaatgacttataatcctttggatatataacctagtaaagggattgctgggtcaaatgatatttctggttctagatccttgaggaattgccaaactgtcttacacaatgttgaactaatttacactcccatcaacagtgtaaaagcattcctagttctccacatcctctccagcatctgttgtgtcctgactttttaatgatcacctttctaaccagtatgagatggtatctcattgcggttttgatttgcatttctctaatgaccagtgatgatgagctttttttcatatgtttgttggccacataaatgtcttctttcgagaagtatcttttcatatccttcacccactttttgatggggttgttcattttttccttgtaaagttgtttaagttccttatagattctggatattagccttttgtcagatggatagattgcaaaactttctcccattctgtaggttgcctgttcactctgatgatagtttcttttgctatgcagaagctctttagtttaattagatccatttgtcaattttggcttttgttaccattgcttttggtgttttagtcatgaagtctttgcccatgcctatgtcctgaatggtattgcctaggttttcttcaagggttcttatggttttaggtcttacatttaagtctttaatacgctttgagttaatttttgtataaggtgtaaggaagggatccagtttcagttttccgcatatggccagccagttttcccaacaccatttgttaaatagggaatcctttcgccctttcttgtttttgtcagatttgtcaaagatcagatggttgtagacatatggcattatgtctgaggcctctgttctgttccattggtctgtatatcttttttggtaccagtaccatactgttttggttactgcagccttgtagtatagcttgaagtcagctagcatgatgcctccagctttgttctttttgcttaggattgccttggctatacaggctcttttttggttccatatgaaatttaaagtagttttttcttattctgtgaagaaagtcaatggtagcttgatggggacagcattgaatctataagttactttgggcagtatggccattttcacgatattgattcttcctatccatgagcgtggaatgtttttccatttgtttgtgtcctctcttatttccttgagcagtggtttgtagttctccttcaagaggtccttcacgtcccttgtaagttgtattcctaggtattttattctttttgtagcaattgtgagtggaagttcacgcatgatttggctctctattattggtgtataggaatgcttgtgattcttgcatattgattttgtatcctgagactttgctgaagccgcttatcagcttaagaagattttgggctgagacaatggggttttctaaatatacaatcatgtcatctgcaacagagacaatttgacttcctctcttcctatttgaataccttttatttctttatcttgcttgattgcactggccagaacttccaatactatgttgaataggagtggtgagagagggcgtccttgtcttgtgccggttttcaaacttccagcttttgcccattcagtatgatattggatgtgggtttgtcagaaatagctcttattattttcagatgtgttccatcaatacctagtttattgacagtttttagcatgaagcagtgttaaattttattgaaggccttttctgcatctattgagataatcatgtggttttcattgttgcttctgtttatgtaatggattacatttattgatttgcttatgttgaaccagccttgcatcacagggatgaacccaacttgatcatggtggatatgatctacctttttgatgtgctgctggattcagcttgccagtatcttactgaggattttcacatcaatgttcaccaggaatattggcctgaaattttctttttttgttgtgtctctgtcaggttttggtatcaagatgatgctggactcctaaaatgagttagggaggaaaccctctttttctattgtttggaatagtttcagaaggaaaggtaccagctcctctttgtatctctggtagaattcagctgtgaatccctctggtcccaggctctttttagttagtagtctattaattactgcctcaatttcagaacttgttattggtctattcagggattcagcttcttcctggtttagtcttgggagggtgtatgtgtccagaaatttatccatttcttctacattttctactttatttgtgtagaggtgtttatagtattctctgatggtaggttgtatttttgtgggatcaatggtgatatcccctttatcattttttattgtgtctatttgattattctctcttttcttctttattagtctagtcagtggtctatccattttgttaatcttttcaaaaaaccagctcctggattcattgattatttgaagggtttttcatgtctctatctccttcagttctgctctaatcttagttatttcttgtctcctgatagcttttaaatttgtttgctcttgcttctctagttctttcaattgtgatgttagagtgttgattttctatcttttccactatctcctgtgggcatttagtgctataaatttcctttaaacactgctttagatgtgtcctggagattctgttacgttgtgtctttcttctcattggtttcaaagaacttatacatttctgacttaatttcattatttacccagttattcaggagcaggtcggtcagtttccgtgcagttgtgtggttttgagtaagtttcttaaccctgagttccaatttgattgcactgtggtctgagagactgttatgatttccattcttttgcatttgctaaacagtgttttacttccaattatatggtcagttttagaataagtgtgatgtggtgctgagaagaacgtatattctgttgatttcgggtggagggttctgtagatgtctattaggtccgcttgtccagagctgagttcaagtcctgagtatccttgttaaatttctgtctcattgatctgtctaatattgacagtcaggtgttaaaatctcccactattattgtgtaagagtcgaagtctcttagtaggtctccaacatcttgctttatgaatctgggtactcctgttttgggtgcatatatatttaggatagttagctcttcttgttgcattgatccctttaccattacataatgctcttctttgtcttttttgatctttgctggtttaaagtctgttttatcagagactaggattgcaacccctgcttttattgctttccatttgcttggtaaatattcctttatccttttattttgagcctatgtgtgtttttgcacaagatgggtttcctgaatacagcacaccatgggtcttgactcttcatccaatttgccagtctgtgtcttttaatttggggcatttagcccattaacatttaaggttaatattgttatgtgtgaatttgatcctgtcattatgatgctagctggttattttgcccattagttgatgcagtttcttcatagtgtaaatggtcttttcttcatagcatcgatggtctttacaatttggtatgtttttgcaatggctggtactgatttttcctttccatatttagtgcgtccttcaggagctcttgtaaggcagaccttctggtgacaaaatctctcagtatttgcttgtctgtaaaggattttctttctccttcacttatgaagctttgtttgtttggatataaaattctgggttgaaaattcttttaagaaagttgaatattggctcctactcccttctggcttgtaggggttctgccaagagatctgctgttagtctgacgggcttccctttgtgggtaatccgacctttctctctggctacccttaacattttttccttcaattcaaccttggtgaatctgacaattatatgtcttggggttgctcttcttgaggagtatctttgtggtgttctctgtatttcccaaatctgaatgttggcctgtcttgctaggttggaaagttctggttaatatcctgaagtgtgttttccagcttggttccattctccccatcactttcaggtacaccaatcaaacataggtttggtcttttcacatagtcccatatttcttggaggacttgttcattcctttgcattcttttttctctaatcttgtcttcgtgctttatttcattaagttgatcttcaatctctgatatcttttcttccatttgatcgatttggctattgatacttgtgtatgcttcacgaagttctcatgctgtgtttttcagctccatcaggtcatttatgttcttctctaaactgcttattctagttagcaattggtctaaccttttttcaagattcttagcttccttgtgttgtgttagaacatgctcctttagcttgaaggagtttgttattacccaccttctgaagcctacttctatcaattcatcaaactcattctccatccagttttgttcccttgctggtaaggaattgtgatcctttggaggagaagaggcattctggattttggaattttcagccttttgcactggtttttcctcatcttcgtggatttatctacctttgatctttgatgttggtgaccttccgatggggtttctgtggatgtcctttttgttgatgttgatgctattcctttctgtttgttagttttctttctaacagtcaggcccctctgctgcaggtctgctggagtttgctggtggcccactccagaccctgtttgcctgtgttaacaccagcagaggctgcagaacagcaaagattgctgcctgttcattactgtggaagcttcatcccagaggggcacccgccagatgccagccagagctctcctgtataaggagtctatcaacccctgctgggaggtgtctaccagtcaggaggcatggtggtcagggacccacttgaggaggcagtctgtcccttagaagagctcaagcactgtgctgagagatccactgctctcttcagaaccagcaggcaggaacgtttaagtctgctgatgttgtgcccacagccaccccttcccccaggtgctttgtcccagggagatggaagttttatctataagcccgattagggctgctgcctttctttcagagatgccctgcccagagaggaggaatctagagaggcagtctggctacagtggctttgtggtgctgcggtgggctccatccagttcaaatttctccatggctttgtttacactgtgaggggaaaaccacctactcaagcctcagtaatggtggacgcccctcccctcaacaagctcaagcatcccaggtcaacttcagactgctgtgctgacagtgagaatttcaagccagtagatcttagcttgctgggctccacggggctgggatccactgagctagaccacttggctccctggcttcaaccccctttccaggggagtgaacggttctgtcttgctggcattccaggtgccactggggtattaaaaatactcctgcagctagctgggtgtctgcccaaatggccgcccagttttgtgctggaaacccagggccctggtggtgtaggcacctaagggaacctcctggactgtgggttgtgaagaccatgggaaaagcatagtatctgggccagatagctcagtccctcatggcagggtccctcatggcttcccttggctaggggagggagttccctgaccccttgcgcttccggggtgaggcaatgccccaccctgctttggcttgccctccgtgggcttcccccactatctaaccagtaccagtgagatgaaccaggtacctcagttggaaatgcagaaatcacccaccttctgcattgatctcactgggagctacagatcggagctgttcctattctgataaaaacattctaaagtaaaagtttatagagaaaaattatgagaatacataatttttatacatttttaaatccattatttcctggtattaaccaaaaaataatttgaaaaatgtaaatctgattatgtaaatcataatcccggctcataatctttcagtgccttactctgccttagtgatctgacaccaattctcttagatacactagccttcaaagacctctctgagctgatggtgtttgcagcatttcttccttctctcttctcacattctgatctgatacccccaagctgtccagcctctgaacctttgttcaggctgttacttcttcccagaactagattaaggaaagagccagatggcaaataccccagcaatgcttaaagctgtaatgaaatggaacaaactgtgtttactaggactcccttcagatacaggactgtaggtgttaggaaggaataatttaataaagacacttagggatggggaatattggcaggggtaagtgtgaataaccacagatggtaggtagctacactgccttccaaggagagtaggtccaggtaactgcagggcttttctcctgctaagtagggtatacaagcttgaggccaggtctgaatgacttcaagcaataaagaagaggcttctgttgggcttctctctctctgctaaacaaatgctgagcaaatggatttgatggcaaaggccatcagtctgaaggaacaccaaatcacaaactggtcagagcacttacagctctgccctgtttcttctgcaatgctctcaattatctcctcctccagggccttctaccacacaccaccatctgaacatctcccttctctgaactcctttagctcttagttgatacagcacttctcattccactctgccttaagactatctgaggatgtgccttatctccttcagtagatgaaaaacttctagaggacaagatttatttttaattgtacctcatatactagtcaatgtatattaaataaatgaatgactgaattaattggagaacaagtaaactatctcagtgctaaaccaagaagacagagattaatgagtaataagaaaaggtccttcagatacattacaaaaggcaacttacttggaccagtttgacatagggcggagtgagtaaaggacagaggcttactgaagattctaccttggcctggccataaacctagagaaataaaaccctgaagtgtctagggccctgctcagagcacatttcagtgtcattatctgtctgacagctggctctaagcagtcctatatcgttcatgaaaaaatgtcattgaaatgtgaataatttgaagctcctttggcattccctaagtaatttcacctagacaagcagctctccccagcctgatgtcacattgagttctttggttggaggtaggagttgaacaaatgctcagacccgcatgctatatataggagaagactgcctcacacattctaataacaataaccatccctgaactatttagccattgcctgccatatttcacactcctatttcctgactcatttgcaagagtcaggcctctgctgtgaatcaccctccactgctagctcaatccattattccagaattaaccttcagactcagcagaaaatcccaaatcccagagtaagtaatcccttacacaggtaaattggaccatctccccttcaatcctctggggacacatctcccctgggatgctgttcccaaccaagtgcctggccagctcctcacacagtctttccacaatgacttcactgctctctccagtcatcactgccaaggcacaagtttttcacttcctacacagtttctttggtgggaatttcacttgtacaggatctggctgtccacatagaccagaattttcttaaccctagtcaggtggtcttttttccccctccacatcagagatccacaaatagcatcttcttataagaatgaactgcttatgtattgtatcattcattttttactttgtaaggttctcactaaaagctctactttaaaagtaattcaaaaatggcaaaaataagaatacaactcaaagaagatgcttcagtatacattaggttacatgctgccccttagtacaatttaaacattttaagtccattttgtctgtgactaattgaccattctaactttcacagtgctggtgaaaaatatccaaatggatcctgttaaactagacagtcagtatttctcagaagtcagtattttcagctcttctaagtgaagattctgctacaaaaaatcttccttttccaaataccagaagtcagcctattagggacctaattatgtactgagatttataggggctctaaagaaatccgtcatccctgtgactcctccccacacaacaggctgccatgggacctgaagctgctggaaacaacagctttacccctttgagtaaaggccatgagttttctggccatctccccagtggacagtttaatgtctcttcccacatgctagacccagcaagtaaagtgaagcatgctgcctcttaagtcatttcatcctcttttggacaattctagtttcttttaaaaagattccttaatatataatagtaaaaccaacgtccaatatctaccatttagaatttacaactttggcattttgtcattttattcatttttataaaaga

SEQ ID NO: 523 - DNA, 40001 bp, Homo sapiens
cggtgggctcgtggtctcgctggcttcaggagtgaagctgcagaccttcacggtgagtgttacagctcgtaaaggcagtgtggacccaaagagtgagcagtagcaagatttattgcaaagagcaaaagaacaaagcttccacagtgtggaaggggacccaagggggttgccactgctggctccggcagcctgcttttattctcttatctgcccccaccccccgacatcctgctgattggtagagccgagtggcctgttttgatagggtgctgattggtgcatttacaatccctgagctagacacaaaggttctccacctccccactagattagctagatacagagtgtcacacaaaggttctccaaggccccaccagagtagctagataccgagtgtggattggtgcattcgcaaaccctgagctagacacagggtgctgattggtatgtttacaaaccttgagctagatacagagtgccgatttgtgtatttacaatccctgagctagacataaaggttctccaggtccccaccagactcaggagcccagttggcttcacccagtggatcccgcactggggctgcaggtggagctgcctgccagtcccgcgccctgcgcctgcactcctcagcccttgggtggtcgatgggactgggcgccgtggagcacggggcagtgctcatcggggaggctcgggcggcacaggagcccatggagggggtgggaggctcaggcatggcgggctgcaggtcccaagtcctgccccgcgggaaggcagctaagacaccgagaaatcacctaagatttcttggtgagaaatcgagagctgcgccggtgggctggcactgctggggcacccagtacaccctccgcagccgctggcccgggtgctaagcccctcattgcccggggctggcagggccggctggctgttccgagtgcggggcccgccaagcccacgcccacccggaactccagctggcccgcaagcgccgcgcgcagccgcggttcccgcgctcgcgcttctccctccacacctccctgcaagctgagggagccggctctggccttggccagcccagaaaggggcttccacagtgcagcggtgggctgaagggctcctcaagtgccgccaaagtgggagcccaggcagaggaggcgccgagagcgagcgagggctgtgaggactgccagcacgctgtcacctctcatttctaacccatcatggctctctttctgctgagacgagatctaccaattggagttggcaccctagaagaaaggtatttgtcatcacagatcacagattacctggagaggcatagtagcctgttagaaagagcataggccttggagacaggcaaacctggattacatttttcagtgccatttactgagctgtgtaaattcagacaaatgaattaacctctcggagcttcagttctttcatctgtaaaatagatacgatacttcctacctcagtagtttgaatgtgtcccctccaaaattcaagtgttgccattttgatagtgttaacaggagaatttaattacactcagatttaaaaaaaggtattaagaagtggggcctgaaagaggtgattaggccatgaggacaccttcttcattaatgggattaaatcccttattagagagccttcacaaagcatttggctagcttgctcttctgctttctgccatataaggtcttatcaagaaggccctcaacagaccaagtgctggcaacttgatcttgaatttcatagcttccagaactgtgagaaatgaacttgtgttctttataaattactcaatctcagtgttttgttatagccacactaacagactaaggccattatctatttttgttgttgtgtgccctgttaggagctgcctcctctcagctcctcaaactaaaaatgcttacatcggccaaaatctatttcttcatcccagttagttcagcaaagatagactatactattcaaggcttcagtctcaatgccaatacacaagggctctgcacagaccttgcagatacctcatctgtgcacgcagctttagaggtatgatacttgatattcaagaagggaatcaaagtggagtggtttctctttgaagagcaatttaaatatcctgtgttgatcttcagtcatgaacaggagtggtctttgtatgaattgagaagccaacaaaagtggctgtgtctctgctccccactcccaatttggaaaccctgtgagcatgactaggtggtctgtatgatgtaatttgatttgttagaatgtgagtggcttacaaccatcatttgcgagtaaattacttagccgtattcttctttacgactggctgaagaaacttacttgatggtataatataatttattcctgtgaataagtgagtgaccttcacatctcaatccatctcctgtgagttatgggccttttttcactcaggaaaatggcctgtgttttaccactgcctaccattttccacattccattccactaattgtgtacgtaaataagacagtctaagatgctgaagaaaattatattaacatgctaaataccaaaataattcttggtgtataccaaagcatcttttttctaaagatctgcaagcaacatttaaacattttgtttctgtattgacagtcctcttagctagagtaaatcaatagtattaatcccattttatagatgggaaaactaaggctcaaaaagaaattggcaacctggagcccagtggtacagaggcaagtcatagaacatgtagcaggaaaggaagtggctaagtggtgtatggaatacactgatatactggattttagattgtttgtatagtttgtattctactttgcttaatgaatgataactaatatttgttgaattttacacatgttgtaggcattgttctaagcatttgacataaactggattactcagtcctggtgatagtcctttgaggtggtcattataatgaatatcctcattttatggatgagacaagaaaaagtaacttgtccaggatcacaacgggacaggtgaaaagctatcaaatcagaatatgtgatggattttcttgacttcttactgatttgtttccaaagggagttgaagagacttcagaattcactcggtttaatatttttcaggatgttatgattgtaccattctgtatccctaatcctaatctaaaaatgataaatggcaaactcctaggctttttatttttttgagggagactgcatattaaattgcttgtttatttatttttgagacggaatctctctctgtcgcccaggctaaagtgcagtggcgcgatctcagctcactgtaatctctgcctctcaggtttaagcgattctcctgcctcagcttcccaagtagctgggattacaggtgtgtgccaccatactcagctaattttgtatttttggtagagatgaggtttcactatgttggccaggttggtctcaaactcctgacctcaggtgatccaccgcctcagcctcccaaagtactggaatcacgggtgtgaaccactgtgcctggcctaattcgctcttttagcaagttttgagatgattcctgcacacactaaattttgaaaatctctgatttgttttcacatggttctctatgcagcctaggaggtgctctgatggcactgagcagccataaggaggaatgaagtaagtgggatgggaaggtggtcagcacttaacaggtgaagctcacccctagttcaactttagttcctctgactttctcctttatattttgaggttttcaataagatttaatgtgaagggtcctacagattaaaaaaataaataaataaagttgaaaatccagcctagttcaatttcctctccacccactttatagagtcagagactaagactcagagataatggagtgttttttttcaagataatccagtttaatggaactgatgagactggaacccttggcttcccaaactttgggctgtttccctgtcaccatactacaggcaccaattgctaactttcagaacagcagctcttaaaaataaagacaaagaatgtgaacacgtatagtcggtaaatttccccaaaaggcccaacacaaatagaagataaaaggcagcaggcagtcagcgtgctatggtttgaatgtgtctcccagatgttcatgttttgaaaacttaatgctcaatgcagcagtgatgaaaggtgggacctttaagaggcaattaggccatgagggctctaccctaatgaatggattaatgctgttaccacaggaatggattagttatcttgggagtaggctcttgatagaaggataaattcagccccatttttgtctcaagtttgcttctttctgttttctgccatgggatggctctcaccagatggtcaagcagatgccagtgccatgcccttggacttcccagtctccagaacagtgagccaaataaacttattttaaaaattacccagtgtgtggtattgtgttatagcatctgaaaacagactaagacaacgtgtatatgacatgaaggggaatgaagtgcagtttgctagagaaactgcagaagttcttctggagccccaagggctgtgtacaccaagaatttttttctgtgatttttggctttttgagcaaaagaatggtatgaagacaagaaggaaaaaaaaaatcagtatgaaaagaattttggggatgtaaatgtggctcaaaattggagtttcaaagtttacaaatagaaatgtgacaaaggaaaagaaaatgtggacaccattttatgcatcaagttagagtatcttcctgggaagaaagtcagaccttcggaatacaaaaagcagtaaacaaaaactaactatagtcaggatggcagacagttactcccaaggtaagaaatctcctcactagtgctggaaccccattgtgttggttggcacctaatttcatactgtgggtgcttagcagggctcagtaggaagtgcattgttttcctagaatatgtactttgggaagaaaccacatcttacttctgatctttcacagggaagtaaataagaaagccacaattagcatggggtggggggataaatttttaaggactttgtgatcttttacattgttggacatgaaaagatttttggtcatttgttctatttggggggtcatggttttaaagagaagagcagacttgttatgggaatagctggctatctagatgatgttgaaaaaaggatagtgttttttggagtatagcttaaatttgcagatgaataggctcctgagaaagtagagcatttctcatgataatgtgtataattgaataaaaaggattaccaatgaagttctaggaaaaagtagaatattgtccagatggaactgcaaaaacaaaacacaaacggaattatacacatgaatggattttataaattgcaaactatcatatagatagtacaagtggtacccagccattcttaaatagaaaatgcagtaaacagaattagaaataatatttgtggagtacgatattgataagactatactagagaacaaacacaaagtgaacttagatttgtaatgcaaggaagaaaagataatgcaatagttgttattggaatctgcttcgataatggctggaatatagcaaggaaattttcttgctaggtatggaatctataaaaccagaagtggaaacatgacaaaaagcaagtgggtgaggttaaaagataaataaaaatcacacgatttttaaaagtctgtcgaaattgttttatttaacagatttgagaaaagatgcaaagaacttaaagagggttttaaactatatttgcagccaaagtatttggaaagcataggctataacttagggttgggctgggtttgttcctcagacaaaaatgaagtaaaactgctaacttaggttttacttttaacttctgaattataaagaaggatcttcaatgagaaaatgaagaacagagagattgaggcttatggaaagggaatgaatggtaaaagaacatgtaagtatttaaaattaatttaagccaggtttagatcactggttctcaaccctggctgcatattagaatcacaagagaagcttttaaaaatacttgcagagattctgatttaattggtctaaaggtgaggacccaggcaggggcattttttaaaatctcccagggggattctaatatgcagtcatttttgagaaccattgccctggataaattaattatacaccagaattcacaaagaactcacaggtgttacaggtggagaacagaagcgatgtcagagactggagatgttatttttttttaaatgcagaaatgtagaccctggaagctatagaacaacaagtctgacactctcccttaatataatctggaaaaaaatgtcctgtgagcatttataaaagaaagcaattattactttggatcagcatgggcttaccaaggacaaatcaagagaaactcactgtgtgtgtgtgtgtgtgtgtgtgtgtgtgtgtgtgtgtgtgtgtgtgtattttacagctaagtcaggggaaagtccatgccttgatttcagcagtgtatttgacaaagtgccttgtaagatttttgtgcaggggtattcttggtgcaatgtgaaaagctttggatgtccatgtagatacctcaggggtctctcaaaagccttgccttccttcattgccttctctttgctacagggaagacaaagaagtaaggcccctcaccacaccatctaccttgaaccagagcaactctgcttccatttatttttatttcactattttgaaacagattttattttaataaagttttatagtaaaaacaatttggaaacttctattttagacaacaagatgcagacaccaatgtcatatgttaaaaggtaatattcattcattaaacagatatgaccctgtgttgatgtgaaactaaaggagaatcttcatagtctgctatccttttattaaaaactctgatgaaaacattgaaggtgtgctgacaaaggtgtgcttacagtgaagctagaacagtggagagtcatctagatatcagaatcaagaataaaataaccacatcagatgagaatgatagatccaaccaagagatgatttttttaagggatgtattagtcttctcaggctgctataacaaaataccatattatgggtggagtaagcaatagacacttattcctcacagttctagagactgggaagtccgagatcaacaagctagcaaatggccacctccttgctacattttcacaaggcagagggagcagtctggtatatttttttcttcttacaagggcactaatttcatcatgggggcctcaccctcatgaccttattcaaacttaattatctccaaatggtcacacctttaaataccatcaagctgggtattaggacttcaacatattaatattgggggaatacaaacattcaatccataacaacagataagcataaaagttctgctgttatagaaaaaaatgatttgcacaagcacaggacttcatagctattcatatgtaaaagtgtcaaggcattagacaatcatagtcttaaatgaagtggacattagaaaaataaacacaatattaatgtggtttagttttttcaggtcacagcaggttcagggtaaaaataatcacaatgatagtaatcatcaatagcttatcttatgggttcacctaccccataattgtgagaatccaaaacttctatatccgtggactttcaaagtctttccactacctttgagagtttccctgggacaccttacaactggcaacactcatctgtcatctattaattagaggcaacaatattcacatttcgcagggttgttgtctgaattgaggggtaggttgtataaaagcattagtaaacagttaagttccgtacaaataaacaattagtgtggcttaaaatgggctgtttgaagagtagatgctagactggcctgccagaatctgtcctgcccacgcagcactaaatctctttttctcccagtggctgggaattctgctgactgaaatccttcagctgtcagccctctctgggaattgctctttggaaagcctcgcccaaggtcacaattcactttgtgtgggcagcctgcatccagtggctgagctatgtggggaggtagggaggaaggggggtagaaatgctccttgcccaacttggaacaattctaaggggtcatcccagttctaggtcttccccgtggcatgggctgagtcctctgttgtggccacacaacagcccatcttctttctccctctgccccatcccacttccttccttgaactcaatggtattaattccaagaacatgccctaatatactttattcacagtaatctctgtctcagaatctgcttccttggagtcccagtaccatttccaagtcagacaaagaaagactcagcttttcagatgtgattttttttcctctttttttttttcatctttcggaattgagtgcatctggaagcaataagctgtaataacccatttattcttccctcaagtgagtgtatttaatgtgtaatattacatccttgggacagacagaaaacctgacgctgagggctagcttctgatcaatttgtaacaaataacccagtaaaaacattcaaatggtggtaaaggcagcttcatggcaagttgccagttgctggtagtgtaagtgctttgaaagctcaagagaagacagcaatagtatggcctggaatatttgtgaaatttttaaatcagattcagagaattttggaattggacataatcttagaaatgttctagtcctaggtctctgttgaagatggaaatggaatcccagacagaccaagtgactccatcttttcaaatcacaaagctgaaataataactggaccttgaaggaggggataagacttagaagtctataaccgcgctgattttcactgtgccacaaggtgtcaactcttggggacaattcttcatccataaagaccctctggggtctgtatatgtttgaatgaagcacagtactcaaggaatgtgacctgtggccttgacactgcttttcacattgatctccacagtcacgatggctgatgtttctttgtgcataaccttgccccatctctcagttttcaattcctggggttctgctaaagccactctgaagccaaagccacatatcaccttgtcacatgatcctgatgtcatctgaaacattacattatagctcctctcttccatgctctttcattgctttggtgtagtgtgatttaaatatctccagcacctctgtgatatggttgacaacagtagtatttcaagctgacttttcatcagaagcttagaaggtgattcacaattacaggggctattctcttctggctgagatgcagagacattagacaaaggccatggaggaggatctgtgtgtctccttattgaccaagagccctggctggtcttattgaatgaaatgcagttggtaaaaatgccaggaaattcatcagggggcttgaaagacactcagctggacttccatgatgctaggttaggagcaatttgaacttttcattaatatagcagttggcaatttgccatttgatagtatactagcttcagggtactaaggctaactctcagtgtgggagctatgtaatttctctaattaaaaaatcataagtcatcattatttatccttcaccgtattttgaagtcacaatttagaaagtaaaacagcaattcctctaagatgaaactagagaaaaaatgatttctacaaccctgtcacaataacaaatacaatttttatatattcctttttaaacttttcattttttatgtggacattaatagaaatttgctattatttatttcttcagttgcttatatgccatgttgctgcaatcattcactcagaattaatgtacttattctcttgtttatttatttatttttgagacaggatcatactctgttgtcaaggctgtagtgcagtggtgcaatcacagctcactgtagccttgacttcccaggctcaagcgatcctctcacctcagcctcccaagtaagtgggactacaggcacgcaccaccacacccaactaatttttttttgttgttgttttttaaagacggggtcccactatgttgcccaggctggccttgaactcccaggctcaagtgatctctctccctgggccttccaaagtgctggggttataggtgtcagcctctgcacaaggcctcattctcctacttttaagtatttaattgtttttgttttcacgattatcaataatgctgggataaacatttccattacacaagcttttctacatattgcattatttttttaggaacttcccagaggtgaaattactagtttaaaagtatgaatgctgtgagtcttgaaagatatctaagctccaaaagaaattcatcgatttacaattttcttattattttgttaggaaacgaacatctcattttttaaatttgcatctcacattagtactacaaaaaattgatcactattaaaaattgttttcttacagaaacttctatgatctatacaggtcagggtagtgtaaatcaagtaatggtgtattgaaaaggttgcaaggagaagttcttgcaacttctgtgcagtggggtgctggtgctctgtgacccaaggcagtagccatgcttgctttggacatggtgataccagcactggtgagtggtgataggtctaacattatcatgagctgccatgggcaactgtgcccctagcactgagtgaggagaccctgaggtgatatccatgcctactgagagagacttccaagggcagatgcaggggatccagcagtagggggaagatgctcctcagtggatgtaaccaatgatcagggagacgttggtagtcatggaagccaaagcttacatcccacactcatagatgggatgaatatggaaacttttgataggggatgagctaaagcattacagggtggggtgaaccagaaacatgctgattactaaaaattggtctcatttgtatttatgcagtatcagttttgttttattatgccagatctataatatctattaaaaaatagttctagaaatttttcattgactatgatgataatttttacttcaaaatagatattttaaattatatggcagtcattccatctccaattttatatataaacaaaataaagaatgtatatttttatcttttaccctgtattaaaaagattatatgattttcttttagtttagcctgttagtatattatatacacagattttcttatcttgaattggaagagtagacatatcagttttaaaatatttattgagaatttattctgtgtaaggcattaggtggatcagggaagagtaaaaagtagtgcgtttgtattacctggtaattgaaaatgatcacgttgatgacatgattacaattagggagattgcttccttccattttaaagagatgttctcgccacacgatctctcatttctttttattgtatgtatttttcagttatttaaccgtaactcatttgaataaaattattaatcatccactttgcttatatagaaacggttatggtattcttaaagattctctgtgagttttgattctgttcaagttgcttgagttgtgcatcttaggaatactcatctgagaatttctaattttcatggtgtgtttctaaagctgggctggccattgatctcttcttattttaataaatgccatccttattaaaattgttaaatggagtctagtgattagaagactcagatagcaaagcaattacacaaacaaaaccacagcataattcagactcagttttaaccaatttacttaaccattttatttttctagtctccttttaacttgtgcacctaaaatcctaatgacaaatcaggggaagagtttctccaagaaagaaaggttcaaagtaccctaaagctggttggtggccaggatcaggaacaatctgagattgagttcagttattagatatcatttcaaggataagggcctccccaaaatgaagattacagagggccccttattcagttactgaaatgtatttacctgttgaaactcagaattttatcttacaggacatcaaaaacatccacatatccttttacctatattacctggtattaaaatcccccagagcaaattcaacttagtattttaatttagatcatgtaacatacttggcacatgaatattacttcttatgaattagtaattaaaattttcttctaaaatgtatattattgtgacttttaatattcttccttctgaagagagaaaaatgtaaatcaggagaggaacagttacaatgcaacattcagctagtggctgggagaggaatgaagagagaaatgaaaaatgtactaagacttctatcccttagatttaattaaaagctgctctttttgtttgcctttttggcatggctgcagattaatacttttttcatttttctataaaattaaaaatgccaattgttgatttttagtggataaaaaaatttcaaatcagtctctgaaataatactgcaaaccaataacagtcatgttgagaaaaacccaaaaaaccctaaagcaaccagaaataaaaatccctaaaaagcttttcatttgacttatcttagttgttgagaatatttctagtgacagttgactgattctttcattttacaagtatccaatcattcattagcaaaaaagacttggattaagtatttgggtgtagagttttcttattcaagccttcagtgaaaatgacagttttcataatcttattctcatgtctatctatttctacccaatatgaagctcactgtaatttgattcagtcagtcgttgtgtttcttgttgttgagcttctgctgttagaccataataggggtaagaaatagaagaattagtaaaacccagtaactgccatggagaaattcaagtgcattggcaatagagaaataacattcccactgtgctttagattgggtggagtcatctaacaaaggggattttgttaataaaaatacattagcagaaacactaagagattatatgctctatctagaaggacttagggagattatctagttcaaatccctcatttcaccaataagggcattacagctcagacctcatagtgtgtagctatcctggtaaaggattgaaattttcatacatcctaatattttattgcaataagaggtacttgaaaaaaagggtgaatttgacctccatctacagatgtgtacatcaccctcttattatttctaggcattttgaattgaaaacaaccttatgtgttcactaattggcatgaatttaaagtctttgttttaaactgtgttttgctattattcaggtatgctgacactaacagatcaggagacaattgtcattgaaaaaacagttgttattcacagttctcaagagaatggggcacagaactccatgcaggtcctcaaggggaagcaccagggcagtcaggaggcagacggagtgggaggaaagcatgggcaagaggcattattgtggtttctgcaagaaagaatgggtgaggcagggtaagcaggtttatgatgatgagtttgtttgaataatttcagtgggttttggggtaggaggctgtcctgagttgtttggtaactggccttgcagtgattaggataggggaatattggcctggagtttaagagccaaatagaagaggtgtgggggagttgtgggctttggattggtgaatttgcaagtgaaagctgtgctccaaggttagtcatttgctaatctctatgaattggctgtccttagggagagagggcagtctctgcccagttagagagaccccagatgccagagcatcaggaatacagaaaataagaaaatatagtcaacacagtcttctaacaagcaacatgcattttgtgttgactggggaggagggttgccccttaatagaatcagctccaattatcaatattataactgcctataatgaagtttttagtttagtttgtttttacttaagctagagtatcattatatagtattgtctcaagatattattgtaatctgatagacaagatactaaatatttctggagcttcatgtcttttgaactttggcaatagcttgagctttccaaatgaaaaatgctaatataaacttttcagatgcacaactctctgactagtaattatattcccacacttaggaggatggatttgttacttgagtttgggaaaaatgactctgagtggaaaaaaaacaagtagactacatattacaatagattatattggaaaagtgcacctacctataagttcatgttttgaaatttagaagatcttttgtcatagaaagaaatgctaggtgattttcagtttcaactttaaacatgtttatagcttcccagttttctataatgagtttgcatcattattatagttggggaaaaatggttttccaacaaaatatttattgaaactaagtcaaatcagggaaaagatataataacatgttttataatacttgaagtaaggtgtttatgtagccttttgggaaaaggttttgtttttgtttatatgccataaataaagatataatatttcaaaaaaatgaaaattagggtctcatttgccatctttagtatatttaacccaaatgtagctaaactttgaatttggggatcctataattcaattagctaaaattttgagagtcagaatgtttgttgtatgagaaaaagatggatatatttgtggaaaatatgcctatttatgaaataagcagagttaggttttatatttactctcctatcacttcccccacaaactccaacccaagttaatccaacccaagaaaaacaaagccacacacacagttcttacctccccatgcccccagtccctcctgctgctcctccacccacaaatgtacccatccaactgcacagtgctctaaaaccatcttctcccctttccttctaaaagaagactggtgtagttcagcataccagtgtaatttcacacaatgagaacttctccaagtaaaccacataaaggtataaaatatgaccaatcaatctccttaccctccccaagtatctggcttttaaaaagatgcttgtgtcctaaataaaactgcaatggagggcaggagtgaggtgtgtatcttcatcaatgtgacaatatcacgtgtatatgggctgatacaatttataagcagagaactatccagtaggcgcagtgacttataaacaattccttctctaataccccctcatgcaataactttgcacattaattgatcaaggctctaagaaattctgcagtaaagaaatcagcctaactatgcttcggtcaagtccccaatattatctctattttttataatgtcttctctttttctaattctaaatctacatattttctaagaaagccaagcttttatagttcccatggtaaggacaggggactctcaaggaggggcaaagagagagggtaacagctgccatttttatgggtgggtgctttgtaaatggaatagtgccatgaagttacaggaacaatcaacctaacatatatctaaggattgtgtcctatgaagattacattaaccagtgccagcatggatacagggggaaggatgggacatctcaatatctcaatcaaagtataaggagttggttattttagataacaacaaaatgcaaaatacatcttccaggtttgctagagaaaacctacagacagctgagtcaccctaaagttgtctttggctctgtgaagccattcctctaggattgagtggtgtcaaaaaattctgctaggaaaggggtcctctatgggtgctgtttctatccctcatcagggttgctggctacctgttgctggtagctgtgaactagatgactcttgaagtgacagctagaatctgtctttctcttgaagacagtaagcttgaaaaccagctctctgatcatttatgtgtgggcttcaatttgctatggtgataagaaaaccaccaaaaaaatcatgcctctttgtaattttcatttgcttaattcatatgacttcaaagtagctaaagggctatttttttaagtataaagaatacaaaagttcttggcttagacctgcttcttaaagtgaaaaatatatacacatacaggtttgtgaaatgatttattaagctgagaattattagatttcctctattctcaatacttatattttaccctttgctggtgtctttataaacttcctattatgaagaaacaaacaacaacaacaataaaaaaaaaacacccaacccacttttgcattctcaacataagatttctacctaatttaaaatttctgccaataatttcaccaggagaatgtgccaaataagtgaatatttttagttctatgagttaaacagcagatacagatctgtgattgaagataaacaatctgtcagctaaatatttaaaaataacgaatagagtttcctcctaatatacagtattaaattgattttgaagctcagattgattttattagtaagttcttttttttttttccttcctctggtggatagtttgcttaaaaggatattaaccttttcaactggcaactggatattgtggcagcaaatgccttccttttgaagcatcctcctgatacgtaatgtacaatagccaattttgatgccagtctctggctctcttcatatgtatcatagttcttgtcaaagaaatccattttattattttttttttattttttgagacagtcttgctctgtcacccaggctggagtgcggtggcactatcttagctcactgcaatctctgcctcccgggttcaagtgattctcctgcctcagcctcctgagtagctgggactacaggcaccagccaccatacctggctaatttttgtatttttagtagagacggggtttcaccatgttggcaaggctgttctcgaactcctgacctcaagtgatccacctgcctcagcctctcaaagtgctaggattacaggtgtgagccacctcgccccgtgagctctgtgaaacccatttttaaaagggagtcatttataactccaaactgtattaattcttcttcttcatcgtcattctctatacgaagaagaaagatctttgaaactattccttaatcagtgacatcattctaaaatcctaagtaatgttgtcatgaattgatattgtattccattgagttacttgacacttttaaatatttgtttgacaaaatgggtcattgattaaatactatgattcagttatctctaaaaaatattaagataaaacagcttttcttctccaggtttgtttaataagaatcatttaaattgcaaaagagctatcctcaagagattcttgccagttttattttaatgagaaacaaaacaatattaaagaaaactgggacaaattttgggaagtttcttgcagaatcataaaggtataaaaagttgtgtaaatcatattgtttttccatgttttttcttcaaagccagctacagctttttaattcacttaaaaataccttttaagctctctgtcatggagacttaaagcacattttactgggatctttggcctcaaaaaacttataacttggtattttgtttaaccatggttatattgtgtgtgtgtgtgtgtgtgtgtgtgtgtgtgtgtgtgtgcttagcttcacaaattcttactttgaaagtgagaaattcttaccttgaagttgatcccattatctattcgagatgacaacctggtaatttgacttgccctttgtgattttttttttttttttttttttttttttgagacggagtctcattctgtcacccaggctggatggaatgcagtggcacgatctcggctcactgcaacctccatctcctgagttcaagcgattctcctgcctcagcctcctgagtagctggtattacaggtgcacgccagcacgcccagctaatttttgcatttttagtagagacggggtttcaccatgttggtcaggctggtctcgaactcctgacctcataatctgcccaactcggcctgccaaagtgctgggattacaggcgacctttgtgatttatagtatagctctgtggtccttagctttggagatgatgctacaatatgggaattcccattcacattttgtatcatgtgttcgttttacactcagtttatgtaaagcatttgtgaatgctgctgtttgtgggctgacccttgtttgtagctctgccactcacattcaacatctgcttaaaactgctatgcccaaaagaggcaggtggtgagggttaagaattcagactatgcagttccatacctgcataggatacctgggctcgtgctccaaatctttagtactctaggtatgtagccttaggctacatttgtctaagactccttatctgcaaaatggaagtaataatatggtaaagctcctcattaaactataagttttgcctaaaaattcacgcctgtaatcccagtattttgggaggcccaggcaggtggatcacctgaggtcaggagttcaagaccagcctggataacatggtgaaaccctgtctctactaaaagtgtaaaaattagctgggcatgttggtgggcacctgtaatcccagctactcgggaggctgaggcgggagaatcacttgaacccaggaggcggaggttgcagtgagccaaaatcacaccattgcactccagcctggtcaataagagcaagactccgtctttaaaaaaaaaaaaaattagatttagtaaaatgctgtttttgtgagattaatgaaatgggaatgagggctggtacagaatgagtccctgggacagcagcaagggtcctatttttcctttgggcatgtcatcattctcagtccttgggtgtgtgtcctctcatttgcccatgtcaagaacataatcagaagtgtatagttatttgctgaggagttgggagctgttcacagcctgttgaattaactgcttctcagaggagcagaaatatattttaccaccagcttctgggtcacgttttgcattctcaagcatggctgcatgaaatagactgaataaggggtaaccaagagtggaaattttctttttatgcatcattgactatttccttctcattctgtcttttcagtgagaaattacaggctttggtgctttaattattatgtctattagaataatctagccttcaatgcatagcaatttaaagcttctttcttattcatcatatttagttttttatttcttaatttatttttctaaaaaaatcaggtctattgtagcaggaattctgtattgaaaacattccagagttaagctaaattcttaaaatgctagtaacaacaataatgatagtgatattagtaatcatgtttataatcacatgtaatcaataatataatgctaatattattagtaatattgtgattactaatagcagtctataaactaacaatgaatcataatggcaatcataataatgtgaaaactataatttaatacctataatattcctagcacttaacgtatttattattttgtttgctattcttccaaatacgctcatagacattagtatattttagtgaacaaactaactttcagaaagttgcatcagtatgtcaattcacacaagtatagttgacaccaagagtcaaattattcctattatacacacttgatgacttagctataaattttaactttcttatttcttcacatgaggctgatattaagatgtcctagcaaatatttctaaaaaaaaatgatcaattatttacttatctggtttcaagtcttctggatatgggtcaggcagtatcgtgtccagatacagtgtttttcctaatatgagttttagaaatacatttatagattactggagattttgttaatttgctttggttagatgcaagattgtaacttaatggctgtaatgttacagaacagtcacttcaagtcaaaggaagggcagcactttggcatgattctagaatatgtttttaccaaaccaggattttttttggttcttgcccagtaggaattgggtccaattttagaatcaatgttaatccaataaaaataatttttctttttcagtgaaaataaagcactttcttgggagatactttatacaatctttcccaatcaggctggagtcttcttcccccactcctatttcctgcctttgctgtgaaagctctgtgaaaaataagcacagatgagaggacacaatgacatctgccttcctgcttgtggttccataagtgatacttctgtgggatgcagttgtactgatattggtgggaaggggaatccatttttcattattgaaaatagctttctttcctttgaaaatgacaattgtgcgtcagaggaaagtgggagcttggaatgaagaaagtgtcgggataaatttagcttttgtctttcttctgatctcaatttggatattgtttgcaagatgagccctgttcaaccctcaggatcaagaagattgtgaaaggggtgggaaacagcacaggtgcactggacagtgaacaatcagatacaatccaatcaatgcctggttttgtctgtcctcgcaggagggccttttattccctctctcctctgtccctatttttctggtcgtgctgtgtgataaataataagatcaagaggctggacactaagattctagcctctgttcagcctgataaattattgttctaagtgtactatttcttgccttcttgctgttgtactatttcttgccttcttgctgtttaaaaaagtattttttcatttttggcagttatacaaagaaaaccaaaatgtaatctgtacagagtttaacacagtgtgtatatatgtacatgcaggtaaatatgtatatatatatatatgcatgtatatatgtacatgcaggtacatatatatatatgcatgtatatatgtacatgcaggtacatatatatatatgcatgtatatatgtagctgtaaaaacataagtacagacattcatgtgcatatgtacacacacaaacttgaattattatttgtgcagggaatttgtatatttagtgacaaattcttaggcctttgaagcatagaccaaatgtttaatcatctgtaaaccattgagtagggaaagtttagtgcaaagaaggtggtatatatatatatatatatacacacacacatatacaaatacaaatatacatacacacatacacacacacatatatatatatatatatatattttttttttttttttttttttttgaggcggggtcttactctgtcacccaggctggagtgcaatggtgcaatttggctcactgcaacctctgcctcctgggttccagctattctcccacctcagcctcccaaatagtcaatatatgtgttttaataccctgaatttcattttagttttccatagtcttattaagaagccagaaaataatggtaatgctgactttagaggttagagaataatgtgtgtttgtgtaaggaaaattgggggtgaggatgaacatgtggttgaatgatagattgatggctagtattaacaactgctaaccttttatacaacctagggtcacaaaattcatgggattgtcacaaacctggaaaaaatgggaactttatacttctagcctgttatcacttcagtggcaatcctagagataaggcttctattattttaacaattatatttttgtgtatattctctggaaatagttgtaatactgaggcctctgtcattctaaaaagagctgatctggttaataactattaacttagaggctttcagtagaatctcttttagtgaacagcaatcttgaattttaaaaaatatatctcgagcatggtgccagcaagatggctgacaagagatgcctaatgcttatcccctctcccaataaaaagggatcaacaaatagccaggcacatttcaactagggtatttgaaggagagtgctggagtaaaacagatgactggtagggatcctgtagagcatagtgactcataatggatgcacagaaaagggaatgaaacactccaactttgcctcctggtctctgcaacctggatcagttcagaaccagaaggaactctccctgtggggaaaaataagaaagaaacctccagtacccacttccctcctccccaattaaagtcatgaatacctacagtatttgctgctggagaaccctacagtccttccaagctctgagcccagtatagggagtttccaggagttcacatggctgcattactccaaagaaggaacccatattttgcttctctgcccaggctgctgctatatggtgccgttttgagactggagacactgcgagagtatgtcctgctctggaggcaagtagccgccacatctccctgcccctgaggatctgccaactatactgcgctcacaaatggtagtgtgccattccccagccaagcagttacagctccctacccacttggaaaaaaccacctataagacactccgtcttcatcccagtggctgaggtgcccaaacctggctactcagagcctaggcccagtggagcagctgtaaccttggtgtttaagccctcaaggcacactgcccccccatggaacaggtggtcttgtccagtgagaacaacatgcccaacctggtgaaggagcagccctggggcaccctcagctcacagaacagcttggtgcccctgtcctgagtgatgaggctgtgctcaagtagccacacaaactcctgaacattaggccacttaggctgtcactggcattgctgacattggctacagctataaaaactacagagactacactactgtgcccatgtggaaccaaagccaatgtaccctacctaaccaacaccctaggacacatctgtagttgaaaatcattccacacaaagtgactctgtaaaattagaagaagcaatcattccattggatgcacagttgtcaatgtaggaatacaagaaacataaaaaggcaaggaaacatgataccaccaaataaatacataactctttagtaactgacccccccatggaaatttacaaattgcctaaaaaggaattcaaaatatcttaaggaaacttagtgctataaaagtgaatacacatacattattcaatgaaattagggaagcaattaattatctgaatgagaaatttaacagagatagaagtgattaaaaacaaaacaaacagaaatgttgaagctgaagacttcagtgaataaaataagtacaagtgagagcttcaacagatagataaagcagaagaaagaatgtctgaacttaaagataagtagtttgaaataatccagagggggaaaaaaaggaaaaaagaatggaaaagagcaaagaaagcctgcaagacctatgggacactagtaagtgaacaaacattcatgttctggacatttcagacagagataaggttgagaacgtttatttaacaaaataatagctaaaaacatctcgaattttggaagagatataggtgctcagacccatgaagctctaagggcctcaattagatttaatccaaataaatcctcttcaaggcacattataattaaactatcaaaagtcaaagacagagaattttaaaagcagcaagagaaaagtgtccagtcacataattcccttatatgtgataagggactccccattagactatcaaaaatgttttttcagcagcaaccttgcaagccaggagaggatgggatgatatattcaaagtgttgaaaaataaaaaagaactgtcagtcaagataccatactcagcaagattatccttcagaaatgaagagaaataaagtcttttccagacaagcaaaagctgagagaattcatcaccactagaccagccttacaagaaatgcttaagaaaatgcttcaactggaagcaaaagaatactaattatgaccattaaatcatatgaaagtaaaattcactagtaaaggtgagttttacataatcaaattcagaatactgactggacgcagtggctcatgcctgtaattccagcactttggaaggctgaggcgtgtggatcatgagtcttgagtttcagaccagcctggtcaacatagtgaaaccctgtctctactaaaaatacaaaaaattacctgggcgtggtcgtgggtgcctgtaatcccagctactcaggaggctgaggcaggagaatcccttgaacctgggaggtggaggttgtagtgaaccaagactgcaccgctgcactctagcctcggagacagtgcgagactccatctcaaaaaaaaaaaaaaaaaattagaatattttattactgtaatggtggtatataatctttcagatctctagtatgaagattaaaagtcaaaatggccaataattatcatagctacaataagttgttaagaaatatactatgtaaaaagatgaaagtttaggcaaaaatacaaattgtgggaggcaagggtaaatgtctggaatatttgtatacaaccaaatttaacctgttaccggcttaaaatagtctccttataagtataaaattttaatgtaggcccaaggaactacaaaggaaaaattacagcagtcatacaaatgagaaaaagaaaacaatcaaagcttataactacagataaccaccaaaccacaaaggtaaacaagaaagagaggaacaaaagatccacaaaattactaggaggcaattagctgagtggcaagagtaagtctttatttgtcaataataaacttgaatgtaaatggaatacattcatcagttaaaagatatagagtggctgaatgtatgaaagaataacaccaaactatatgctgcctacaagtcttccttcacctgtaaagatatacgtagactgaaagtgaaaaaatggaaaatgctattccatgcaaacagaagccaaaaagaacaggagtagctagaaattagataaaatagactgtatatcaaaaactgtagaaagagaccaagattgtcattttataatgtcatcatataatgacaaaaagatcaattcagcaagagaatataacaattgtaaatatatatatatatatatttctaacactggagcactccaatatgtaaaacaaatattattagacttaaaggaagaaataaatatgataagagtaggagatttcaacaccccatttttggcaacagatggatcagacagaaaatcaataaagaaacattagatttaaattgcaagataaaatagacataacagacaatacagaatattccacccaacagctgtagaataagcattctttttctcagtacatggcacttttcctagaatagatcatatgtcaggctacaaaataagtctcaaaaactttttaaatatcaaaatcgtatcaggtatcttttctgaccacaatggcgtaaaactagaaattaataatgggagaaactttggaaactatataaatacaggaaaattaaacagcatactgttgatcaccaaattggtcaatgaagaaatttaaaagagaatttaaaaacccaaaacaaaggaaaatgtaaatacatcttaccaaaatctatgggatatagcaaaagctgttctaggagggaatttcatagcaataaatgcctacaacaaaaaaaattagaaatagcttatgaaaacaacctaatgataggcctcaaggtattagaaaaacaagaccaaactaaaacccaaattagtagaatgaaagaaatagtaaagatcagagaataaataagcaaaatagagactgaaaaattataaaagatcaataaaacaaagagttggtttttgatcatataaaatgaataaaccattagctagactaagaaaaacacagagaaaaatccaaataaataaaatctgagatgtaaagacattacaattgatactacaggaatacaaaggatcataagaaactattattaacagctatgaacaaacaaattggaaaacctgaaagaaatggataaattcctgggcacatacaacctaccaaaattgagtcatgaagaattagaaactgaacagaacaataatgagttgcaagatcgaatcaatagtaaaaagtttcctgtcaaagaaaagctcaggacctgatggcttcactcttgaattctaaacaacatttaaaaaagaaccaataccaatccttttaaaaatattccaaaaaattaaagaggaagaaattcttccaaaattattctctgaggacagcatcaccctgataccaaaaccagacaaagacacaacataaaaagaaaactacaaatcaatattcctgacaaacacagatgtaaaaaacctcaacaaaatactagcaaaccaaatccaacaggacattaaaaagatgatacaccatgatcagatgggttcatcccatggatacaaggatggttcaacatatggaaatcaatgaatgtgatacgtcccatcgatggggtcaagggcagaaactgtatgatcatctcaatagatgcagaaaaagcatttgataaaatttgacatcccttaatattaaactcttaataaattagttatgaaaggaatatccctcaacacaataaaagccatatatgacaattccatggctgaccatcaaactgaatggtgaaaagttgaaagttttttcttcaagacctgggataagacaaggatgaccactttcaccagttttattcaatatagttctgaaattctagccagagcaattaggcaagataagaaataaaggacatccaaactggagaggaggaagtcaaattatccttgtttgatgatgacatgatattatatagagaaaaccctaaagactccacaaaaacttcagaactaataagtgaattcagtaaatttgtaggacataaaaatctgttgtgtttctgtatgccaatagtgaactatctgaaaaagaaatcaggaaagaaattatttacaatagctacaaaaaatacctaggaataaacttaactatctagtgaaagatctgtagaatgaaaactggaaaacattaataaaagaaattgaagagggaacaaataaatggaaaggcgttctgtgttcatgaattggaagaattattagttacaatgtccatactacctgaaataatctacagggtcaatgcaaaccctaacgaaacaccaatgacattatttacagaaatattttaaaaaccctaaaattcatatggaactgagagacaggactagctggatttcctaggccgactaaaaatccctaagcctagctaggaaggtgaccgcttccaccttgaaacacggggcttgcaacttagctcacacatgaccaatcagatagtaaggagagctcactaaaatgctaattaggcaacaacaggaggtaaagaaatagccaatcatctgttgcctgagagcacagtgggagggacaatgatcaggatataaacccatgcatttgagcaggcaagggcaaccgcctttaggtcccctccctttgtgtaggagctctgttttcactctatttcgctctattaaatcttgcaacttcactcttctggtccatgtttgttacagcttgagctgagctttcactcaccatccaccactgctgtttgccaccatcgcagacccaccactgactcccatccctccggatctggcaggatgtcctctgtgctcctgatccagcgaggcaccttttgcggctccccatcaggctaaaggcttgccattgttcctgcacggctaagtgcccaggttcatcctaattgagctgaacactagtcactaggttccacggttctcttctgtgacccacagcttctaatagagctataacactcacttcatggcccaagattccattccttagaatccgtgaggccaagaaccccaggtcagagaacacgaggcttgccaccatcttagaagcagcccaccaccatcttggaagtggctccccaccatcttagaagctctgtgaacaaagacccccggtaacagaaccgtgaaagaccctgagtagcaaaaacaaacaaacaaaaaatcctgaacaaaaagaacaaagctggaaatattacactacacgaccacaaattatactacaaagctagagtaaccaaaacaagattttggcaaatgcacactctctcacgctctctctcacacacacacacgcacgcacacatagactaatggaacagaataggtaactcagaaataaatccacacacagccaactgattttcaacaaaagtattaagaacagatattggggaaaggatggtctcttcaataaatggtgctggaaaaaccacttatcccagtgcagaagaatgaaactaagccaccatctctcatcatatacaaaaatcaactaaaaatgggttaaagacttaaacataagccccgaaactataaaactactagaagaaaacaaaggagaaacacttcaggatattggtatgggcagggatttttttgataagaacttaaaagcacaggcaacacaagcaaaaacagacaaatgagattacattgaactaaaaagcttacatataacaaaggaaacaatccactgagtgaagagacaacttacagaatggaagaatatacttttaaattatgcatctgacaaggggttaatatcctgaatgtatatggaactcaaacaattcaacagcaaaattcaaacaaacaaaaacaaataatttgatttaaaaaatgagcaaaagacctaatagacttttcttaaagaaagacataaaaagagccaataggtatatgaaatatatgctcaatatcactaattgtcaggaaaatacaaatcaaaaccacactgagatatcacttcacccaaattaaagtgactgtaataaaaaaataacaaatgctgacgtggatgtggagacatgagaacccttatatactgttggtaaaaatgtaaattagcacagccattatgggaaacagtatggaagtttctcaaaaaattagaattaccatatgattagtaatcccatactggatatttacccaaaggaattgaaatcagtatgttcaagaaatgtctgcagttccgtttattgcagcattatttaccacagccatgatatggaatcagtctaagtgtccatcaatagatgaatggataaagtaattgtggtctatatacacaatggaatattattcagccataaaaagaacaaaatgctgtcatttacagcaagaaagatgaacctggaggtcatgttaagtaaaacaagccaagtgcagaaagacaaataccaggtgatctcattcatttgtggtattttgaaaagttgatcttgtagacatacagagtagaaagtggtcatggaggctgaggatgatagtggggaggaaggagtggaaagcaattgaccagtgggtactaaattacagataggtaggaataaggtctggtgttgtattgcagtagagtgactataggtaacaatattgtatcaaatatttcaaaataactagaagagaggattttgaatgtttgaatcacaaataaataataaatgtttgaggtgatggataagctaaacaccctgatttaatcattatacaaatatatgtgtatcaaaacatcacactgcaccccataaacatgtataattcttatgtgccaattaaaaataaaacaaaaaatatggctgaatcatgacatatgaatatgtcagtcatagtatagaaatcagatatttatactatgtactttgataaatccttactgtgaacattggtaaatttcatggtgcattcaaaatgcatctttatgtctaatttaaatactgcattctataactcacctttgtacattgaaaatggataaaaatggatcatttgagtgaaaatcattatggtttcttgaataggaatcttccagagagttattaataatcttcatttgacaagtagtttcaattaatgggtatacccaacaacctgctgaggcggataggatgtttacttttccatagcgaagcttgttgtttggggaagttaagtgactaaggtcacagggtgagtcagaatcaagacacaactccaatattccacaaattctctccagtctcagcatgtcccttgaaaaggaacaaatggaaattcaccattgaataatggctttataattaacttcacacacaacatttcaataaaaattcactgctactcaatgagagtagtagtatttctattttaatgataaagaaacacaggctcaaaaattaacctttcaggtttattggtttgggcttggaaagtggtgacaggcaaatgtgaaggatagttttctgatacttagcttttggaataatgtagcgtcatagaggattaccactttcaaagaagacaacggctttgtcctctttttctctcgtgacaggatacttaacaattcttgttttggtttaatacgtgtagaaatacaattcaaattctagtcaagccagtgagtttctccagtaaggagaccattaaaaagaaggtaaacttaaaattgctaaacagatcattaaatgaagctggagtttgatataggacctgcgtaggggaaagtggggaactgatattgtaacaatatcaaaatactattgagaaggtacaattgggtgaatgtagctagcattaatgatgcaataaaagtcacacatgacttgtgtctgaagacctacagggggaaggggtcttttatcctaggttacagtagttccttcttatccacagtttttgtttctgtgatttcaattatccatggtcaaccacaaactgaaaatattttgagagaaagagagaaagaccacattcacatattttcattacactatattgttataattattctattttattatttgatattgttagtctcttactgtgattaattttcaaattaaactttatcatatgtatgcaaaagaaaaacagtatatataggttttgataatatctgtggtttcaggcatccactggggcttttggaatgcagttcctgcagatagggggatctacagtgctgagttgaaatcttctgtatgcttctatataaagttgctggataaatttgtttctgtttcaattctatatatcttcagaggggttagttcctaatttccttgcatttggaaaataatgagcactctgctaaaattttagcttgttcattggatttatttattcccccctcattttttttgaaagaaaatgttttcccttcccttcccttcccttcccttcccctcccttccctcccctcccctcccctcccctcccactcctcctccccctccccctccccctcccctttcccttcctttctcttttcacttttccttttcctttccaaaaggttcccctctgttggccaggctgaagtgcagtggcacaatcttggctcaaggcagcctctgcctcttgggcttaagtgatcctcccacctcagcctcccaagtagttgagactacaggtgcatgccaccatgccctcctggctattttttatattatttgtaaagatgggtttccatcatattgctcaggctggtctcaaactcctgggctcaagcgatcctcccatttcagcctccctgggattacaggtgtaagccaccatgccttgccttccctccccttttttagatgggatttgagtagataaataagaccaagaaaaagagtagaacacaaatatgcaaagtcaaggaataatctagctttataacagagttcatcttttgttttgagcttccttccaatttgatcaaaagtgacaagttcactgaactttaatagatatttttttctggagcttgacaaaggaaactcccaatgatcaatgaaaatgatattcaaaagcatttttcagggattcaatcatttccctgactctcctagataactttaataaaaccaaaaggcttaatgtagtgcaactcagggcaagcaaatctatgaggcctaagctaagtgatctacatgatacaaaaacctgatggtctttttcagttcaaggacagaatttttgtaccaacctagtggagtgtggctaggatgcccctaagcaatcttcccttttgttaagaaagagctggagggcagatatgaaggttaggctttctaactgttgagagctgagaggcgccactaacatgcagtataaagaaagagccaggacacaaaaatcttggctcaatgacagcagctctgggcagagaggttatccagcagcattaagctagcttaccccatggcctgaagccacagctccagttattgcagcagcttccaaatctgcagtccttggctcttgcttggctatactctggcatccctactgcacagctctgctggctttttggcccttgctgtccttcacatcactgcttcttggatcatagactgaactgagagccaattccaaatctccagtaccaattcccacttcaacttggctgattccaaacttgccaatttttgtgaaggaccacagaggacaaaagccagcctggtggtgatctggtatatcatattggccattgattgaagttgtaagtgttagagacaaaatgagttatttagtactgaggtgctctcatgaaagagaaggccatcttttggggagaaagtctaggctttcctggggtgcagatggtggtggcagggctggctcactctgttcatacatggctgatccagatctcaaatccatgtccactatcccatagctcaaagttgttttttgttttaagtaaaccaaagcctattagctttttgccttttaaaattcacacggatacaaattcatataattttaggtatattagtaataatccagtttaaaggctagtaacgtgcagatagcctatgattcaaattggccccacagataacattccatgttcttaacacacacacacacacacacacacacacacacacacacaccccaaaataaaccaaaacttgaattcataatcaatttgtaaaatttagaagacttcatgtttaaatctagatgttcatatttctttaaaattagatgtgccgtatttggacttaccttcccatatgccataaacagctgaagctgagtggctttggcccatgttagaccaatcatacactctctaattccctatcaccaccccctcccagtctccctgacatggggtctgccacagtcagcttgggctgctataaccttagatttgttgcttaaacaacagaaatcggccagtcgcggtggctcatgcctgtaatcccagcactttgggaggccaaggctggtggatcatttgaggtcaggagttcgagaccagcctggccaacatggtgaaactatgtctctactaaaaatacaaaaattagctgaatgtggtggcacccacctgtaatcctagctactcgggaggctgaggcaggagaattgcttgagcctgggaggcggagcttgcggtgagccgagatcacaccatcgcactccagtctgggtgacagagtgagaccctgactcacaaaaaaaaaaaaaaaaggaaaagaaaaagaaatcaatcttaccacagttctggttgctagaattcagatgggtgtgtggacagcatggttgggttctggtgaggtctcccttcctggcttgaaaagggcagccttttcactgtgttctcacatggcagaaggtggggaggggtggaagctctcaagtatctctttttataaggacactaatcccattatggaggctccaccctcatgacctcatctagcctaattacctcccaaacaccccacctcaatactatcacattgggagtgaggcctccaacatgcgaattttggaggcacacattcaggccatgacaggctcaagggtcagttaccattgatcatattgccagtcactccacccttcatgcaccaatattacctgctcatgcacccttcatgcaccgatattacctgaaaccattgagcatgagatcacctgaggtcatccccagagcacattttaccactgaggaatctaaaatccacagaagttgtctcaaccccgttggtcaggattagatccaactggcctggctttaagtttaggaatattttttcctttcctgatatatcttactttccacatttctgtagattgatgttttataatcaatgagaataataataagcaccatatgttagatatttacctgttatatcaaatcaaatgcattaatatactttattttcttcatagataatcaaatgtaaatggttttgggaatctccatatgtatatcattttccttatgatatcattcttcaaaattttatcttttctttttttctatagacattataaatattctccaagattaattggagagttattttggagagttattttggcagggagatgtataatgattcactttatctcatcaaaacacattagttcaagatatgaagccttgtttacatgacttaaaacaaatcagacatttcattcaaaacatgtaatttcataaaaagtcaggaaactaattgcttaacataaatttacccaaaaatacaatgcattgcatttatggatcactttgctagcattgctctattgtctatttgtctatgccagatgtgagtaatagccttgaagatgtgttactcaaagatcatttgaaaaatgcccagagaagagtcataaaattcattctatagaattgatgctgggaactgaaatgacattttcaggagatacatgaaaatgggaacagaaacttgagtgtctaagtggagaaaggctaagcagacttggaatgatacatctctcctctcctctcctctcctctcctctcctctcctctcctctcctgtcctctcctctccctaatcccctacaaaataagaaatacagtgcagactgtatcaaatacataaagtaagaaaagactcattcataaaacatacatcagtacccacttccttattttctctctcatgtttttgttgttgagtaaagacagtcccaaactccttccaaaatggccccaagcaaaggagagaatgtattttaagctttatttcactatgcattaacttttatatactttttccttttttgaaacaatatttttaaatagaaaacttagaaaataagaaatagtataaaaaattattattggaaaaaaacccctgtaaaaaatatctaaattgtacatgttcttgctggtgaaatctgagtcctgcagcagacttcccaaagcatattggctctgggtttctgggggaaggtgctctggatctcttttaaaaagcacacatgctgctccatgtggtgcagcagctgctaaggtaatgatgcatttttagtgaaaaaataccataaataaacatacaaaaaatcatatgaaactctccaactaagcacaaaatttggcagcaagtttagaatctaaaaaaaaaattataactgataagataatgtaccagcccaaccatttccaaatcttatttctacctacatatttatgcacatatttatataacacatatcaccattatatttacctttccaacatgcctgagaacttaatccatgatttccaatgttaatatattccaaaggtatggaggactcacgattaaatgcctctgccactacataaaattagttagcaatgaattaactaattatataatcaacgactttcttttgtttcactaaattaaatgaagactttttttctgaatgatgactgtaagtcattattagaaaataaagatgtttttctattttcttctaattattagctatttctaaggtacactaaaaagacctgaagtggtttatatgtacagaagaatctaaatctctgtactaatttcactttatctgaaatgactcaactaaagtcatcaattcattcataggatagtttaaaaccacattaactgtaattagcagagaaaaaataattaactggcagaatagaagcactaaaaagatctcgcagctgaccagatttataaaaattaatatcatacaacatactaacatctggattgaaaggattcaatatactaagtttaacaggtagaactatcaaggtgaaaagactcttaaataataaaattaatacatccaataactgtctgtcaatcacttaaacaaaatttaagtgcagagagtggaacaactgcatagtctttacattaggtgatctatacaaggtctaagagcattattcagaactttgactagaaattatttatttatgattctagtttgctatacttgtgaaactggtttagtaaggacattggcaatccaccaactttaggagttgtgagggaagtttgttaaaaggaggaatgaagacataaatgaaagagaagaaggcaagaatgaatagtagaaatgctttggagattaggttaaaaaagaacaacaaattctatatggttccatctttatctttccttccctcctttctttcttaccttcaaaccactttgattttccttcctctttcttgccttccagttaggtatgaggtgagccagataggaggtctgcaaaaaatatacacccactacatctactaatattgtgtgtatgcacatgtcataaattatacagtgatggaatacccagatgggcctgacatgtattagggacactaatattttgagagaagtccaacttcaattaacttatccagaattttacaataaaaaatttagaacaagctattttaagcaaataaatatggatgatttttgtttaatgacttaatattgttttctttgagctatatttggaggtacaatcatttcaatgcttagggattgaggttttaatataatctgttttatgttttatgtttctgatacatcccaaaatattccatcctagataatgctggtctacaacagttaagtctttccagtgtttccaataacctattgttatcaggttagatgcctccctaaatcaaacttatttaaaagagagctatagtatagtaggtgtgtgaatttgcatgtactcacatctacacaaaacaaaacctttttgcaggtagatctaaaatagttctccataacattgtaggttttaactatcccaaatttggttgtgattataatgaattggttaaagtaaaatacaaatgtctttcatagaataagatgacacttttatttattaataaaataaatacatagaaactagtgcacaaaaattatctatgtagctctggattaactaatatgttatagaaacataatttttattgtgtttatgtaatatggaaaacccaaaccaaaaatctttattgtatcatgtttaaatatagatttcctgtttttctgtttttttttttttttgtaactccaatttcattttttaaatgtggatattatggcatttattctttgaaaacctcacagtgcccaggtctcaactccagagaatttaattagtctgagatgggacctaaacactggggttttaaaaagctccccaggtgatttttatgtgtggccaggactgaaaaccactgcattggaatttgagcatcaaccttgaggtcaattgcattatgagctaaattcaatgctgaacaatggcatgtatgattcaagtcttgaggttcatctttctcacatttctctgtccctcctctatttttcacttacaatctatttattatgattcaaactttaaactagaggagatcattaatcatggatataatttagtgacagcagggtcatgtcccactaagtaagtacaccttgtttgcctcaaaatgctaatcgtttttctgcaacattaatgaggaacaattgatatgaagcctaacaacctagttgctgttttattgaaataaagtactctattagattatggcaaaacacagcaaggtttaattatgcaaaattctgaatcatataacaccatacttatgaaattttggcaccaaggaagaggggaattttaatgactttcaagattttctggaaagaagattacaattatagaagttgttaccttgcatcttccctgcaataagatatatcattctcaggataactaatatttcagttgcctttgcttttagctgtgaggttgttaaaagaggagatccccatttttcttctctgaatatctgctgttgcttccatttattcatttagaactgtctattttaaaagaaaagacctcaaatttacaacagcaaatacagaagaccaaacttaggaacagttgggaggaactacagaatttgtcctctctgcttataatcttgcaaacctttgagattccttgtggtagtatgaatttcatggtagcattttacttcactgcttttgtagtcttagaaaagacctcaaagcaaagtaaccaagcatgtaatatagcttgtgtttaaagttactgtgtttaggccgggtgcggtggctctcgcctgtaatcctagcactttgggagtccaaggcaggtggatcacctgacgtcaggagttcgagaccagcctgaccaacatggcgaaaccctgtctctactaaaaatacaaaaattagttgggtgtggtggcacgtgcctgtactcccagctacttaggaggctgaggtgggaggatcgcttgaacttgggaggtggaggttgcagtgagccgagattgtgctgttacactccagcctgggtaacagagtaagattccgtctcaaaaataaataaataaataataaataaataaataaataaagttactgtgtttaaagatgttttctctgaatcacccttagaacaaattacaacttaaaaacatactattattagagtgtttttatgaacattataaaacgtgtttttggcaacgtgtattgttggactttacgggacaccattgcacttttaaatctccccgatttgatcccttgtctctattggcacctatttgaatcttgataaaaaatgataactaatttttatactatttacaaagattgtttaaggctagcaatgatgagtcctttagtatgtttcagttccaagaaatatgattgtctttaagacgacagcacagggccgggtgcggtggctcaaacctgtaatcccagcactttgggaagccaaggtggcggattacctgaggtcaggagttcaagaccagcctggccaacatggagaaaccccgtctctactaaaaatacaaaaaattagctgggcatggtggcaggcacgtgtaatcccagctacttgggaggcagaggcaggagaatcgcttgaacccgggaggcagcggttgtagtgagccaagattgtgccattgcactccagcctgggcaacaagagagaaactccatctcaaaacacaaaacaaaacaaaacaaaaaacaaaggaaaaaaaagaagaagacagcacaaaatacattgatttagttcagactctgagatcaagtgataaataataaatgataaaaatccatgtgagagtaggtgaaagggtcaggtcatgatttattgagaaattttccatttcccaactgagatgaacttggatagtcttaattatgaaaataacttgcaattggcatctgtgcattagttggtgtgtgtgtgtgtggttggaggtgggtgatgtgatatcggttgattaagtagatgaactttttgcaggcagggattacatactattaacctgtgcattcccagtgccaagtactgaacctggtacatgttaatagctattcaatagaagtttactaaattatttataatggaaagaggaaaaacatggataatggaagcactcttagaaaagcaaaatatgatatttgttct

SEQ ID NO: 524 - DNA, 20001 bp, Homo sapiens
aacaagtgcaactgtctcatcagcaacacaatttcaataactatatataacacttcattacctggatataacataagttacttcattggcctcaaattgttagctgattatactgtttcaaattactcactattggaaatattgctatagtgaccaaccatgtacataaatccattctaaggtcatagccagagcaacagtttcttagaaagttactaggtcaagaaatagaattaaaatttgtgaagcttagtccaaaagaaaactacactcatttttatctcataataacaagcccatcttagtacactcctatatgaattggcatactcttttttatataaaaaacttaatgatgttttcttatcttttttgtttgtttgttttttagagatagggccttgctgtgtggtccaggctggagtgcattggcgcaatcacagctcactgcagctttgacctcccaggctcaatctatctttccacctcacccttctgagtagctgggactccatgcttagataattttttatttttattttttgtagagaggggttttgccatgttgcccaggctgttctcaaacttttgggttcaagcagtcctcctgccttagcctccctaaagtgatttttttcttatcttaaaatgaatgcattctcattttagaaaaacaatggtaaagtataaatatgaacatgaaatattcggcaattctataatccagagtcaacacctattaacattgtggagttctactttttagttggcatttatatttttgtttttttaaaatataaaatataaaagtatttctgtattttagtttttccacatctcatccacatttcttgtcaggttggtttctaactaagtttattcctattttcttttcatcttctcttgcccttttgcgccagctcttttgttcttatctgatgatttgaacaaaatcatttgaaggtgtcaaaaaaaattttctaattcatagattagataatttgggaagtaattttttcttttgaatgatttttttgtctaatatttctcaaaggccccttgttggtgtatttatttctttatttatccttaaatgaggacagatgcacacaaatttgatttagtaacagtcagaatagatgagctacccttcattcctcttttctcatttctctctctttattcattcatttaacaaatactgaagttttcatgtgctgagctttattctagtaatagataagctgtaaataaaacagagttccagattgcatggcactactttctcctggtgctgaatgaatccccttcaagtacagtggagggctggctgatttgctcagttttgagctcaattcccaacacttaaaaacatgaagtttggttttgctgaagcggttttatgccactgcctcattctccaacatacttaatcaatgaaatttgcatacatacaatgatggtcctaaagttcagttcaatctgggatcttgagtgcctatgccaactttccagatttaaactatggagggcatccaatgtcccggaggtacttgcttcccttctccctttccatccctgtaggttttgggggttgcaactgaccatgagagtcaacagtggaagaactctaccctggtcatctcagaatccaaccttccaccaagagaggatcaaatgccaatttttaggcatttacaaatgaggacagtgtacaacaaatatctggttcaacgagtaatgaggagaagatacaatccagggataactctagagactgggctcctaacaacccgatgcacctgcctcatcagcaacatgactttgggagccatatagtgctccatcatgtggattcgttatagggtacttgatctggtctcagatgattggctgattataactatttccaattatatgccaatatatctcatgtctcatatcggaggcagagagcataatagaggaaaatgttttcctttggcctcttaagctagaaggaactacactgtgatgaaaagctttataagtacctggctttcctcagttcagcattgttgtcttcaggttaatgggaatcccttcaaagttattttaaaagcatatccaaaagtcttcatttttgttagtgatacaactttactttttctgtgtcttcagaagtatttaaataggatttggagaaaaatttattgaggggctgcttactgtcagaagacggggcactgatacaaatctacagttttgatagtccttgcaaattctttttcttttaattgaaatgtgcttattttattttactcctcttatgtcataattttctgttaaatattatattgcagaagtttccattactcaaattatttcaattgatgggaggaaaattgatttttcgtagggattatgatgttcaaacattatatccaattaggaaaaaaactgagaggaaaaggtaaaaaacaaaccatttatttaatacttcctttgggatgtgtactattattgattctcatcattaaccccattttacagtatataaaccaagggaataagtaattttttaagggtcacataactggtaaataatgtagccagaatttgaacccaggtcttatggattctgaaattcatacttttttcacacaccatgtggccccctcaagaatgtaagaaacaaaaagaatggcttgcattatcacataataaacaaaatatttaaaagaggagttttacagaatgagagatttatgttcagtctttagacttatgaaaaccaaatcaggatagaaaagttgagtcaacatgggtttttgctaaaaattacttaattgggcccctgcagttggtcagatttcctcagtgatgatgacctcattctatggtggaggccagatttttaggatagctattcatttttctcatgaaagcatacttggtccaagaaccaggtaagtaagctcttaaaacttgctaatgcatatttatcttctcattactgtcttactgtcaagggcatttatgcaaaggttgacaatataatgaaaggtcaaggaatgcataaccctggttctatactatgttcatttaagtgattactaaaggcttgtgtgtgtgcgtgtgtgtgtgcgtgtgtgttgttttgttttatacttctataaggtaagttctgctttctaggaggttctgggttttgtcatttgataatgtcatggtgggcagttgagacaacttacagaacttactgaaagtggagttttgtttgttttatttaaaaaaatactgaaagttcttcttaccaaatcaatggtaatgtcaaggataaaacaacagctgtgagtttaatgcataaaataaagacttgaaaactatacattcaaagacaggatcattatttaagtgccaataagattacacgccgggactgaaataaataagccatcatcagtgacttgagtagcaaagtttgttttctctgggaagaaagcttgcttgctgctgcagtcctccaaagagtttaaaagagaattttccaaaagaaaaaggtaacatgttaagcacctcctcataaagacatacaggaaaaaaataacttggggcttcacttagaaataaagtatatatattgtcttaagtcagtgcatgtgaaaatatgattttggttagattacttttgagtaccacaagagctgtatagacatgtaagcaattgcattgcctgcaaattggtgcagggaagtaggtttgtcctccaacatctgatgatataatttaacttgcaaagttttagaataatctgcaagccaaagcaaagagagatgggaaacaagtcgaatcttttaggaaagtttcttatgtatataacaagaagattttgtttttatactttttactaaattataatttttgtctaaatgctctggtatagtctcagtaaaaatattgttgtatatgttttgaaaagataaatttccctttgaggaatacctatatcgtggagtagttttgaagtgtgaggacctaaggattcctgctttgcattgttagcccaaaggaatgacaggataatgtatgaaaatgttgattcattgattttttcccctcactcctatagaataatcttaaaggggaaaatgttctcccattggatgagaactttcactaaacatgtcgttaggagaagcacaggctcaaagctcccctttgaggacagggctaaacatgattccccacctcttttagctcctcctcagaactttttgatttctaagagttaaaagaccattccactattgcgtgcaatttctttgtggtcactgacactaattctgcaatttttgatgctggtgcttctgttcattcatgagcaggcagtgacatccatatcaccatcgtccccaggtcaccagtgattatcagatgtcatcagttataaaatgtatattcctttcagaaacatttcaggtagaaaaaaaagtgcatcttggaatcaataagagtacattttaactgcttgttttttttattgcctctcccttctaccacaacacctacttcatgagagaaagatctttttctgctgtaacaaggacagtatttatatgacagatagtagcattccaataaatagctcttaaatcaatgaattaacaaaaaatgtcccagactgagaaaatgacaagggaaacaaagccattaaggaaacaatattttgccactcatagtacaggaaaataaatctgaagtcgtcaaatggattattgacggactcctcttactaattgtttatggtaatgtaataaagtcagagtcccacatgagaaaaacagaacattttgtttaatacagaaaaatgttttgctcaaattaaaacatatattccagagtatagacatatttaccacttcaagataatgtctagagttgataaatttttatcctttcaggatctattcactcttattcttttgacattatccaatgaatcaaaaagaccttgaaattcttaacatacgtcattaggaaaaacttgaacataccctaaagactaatttaaatacaggaggggggctactagttgagagatctaagtggttatatttgatttataaataggctgtcctagataaaaaggagccaggaatcaatgtgccagataaaagagaccagatgctaaggaaagtagccctattttctagaaaggcctcttcaatagagacactatggggaaaatatagttgggccttgtaagctgtatttgcaatcacttctctgtaaattgggaaaaatcaaatgcccaactcacatgttttggtattgatcaagtttttaataactgtaatttaaatctatctgtgaataaatgtgaaagcctctattttcaataacattctaaattcctgcatatatctggaatttagaagaaggaaaaagcagtttcataaaggtgtaggatcacacactatctaaaagaaaacatttgcaagaatatgtctctgtgaataatcttacagaaaattccctttaaatatctagttcaagttacacattacaaatcacattacaaaactttttgttctccgtatggatccagtctcttgattattaaggaccatgagccctagcttgaaagtagaaacttaaatcagcgactttatttttattgccaaacggagaactgaattcatataataagagagcagtggagatgagacatgacagaattcattaatgtgccaaggatgtggccaacttgtctacaactagttaaaaggcaaatacacagattgatcatttttctttccaggactgtacgtcacaatacacatggcctgtttcctaaaaccttctgtctaatgtttaatagattgatggaacttcaaaaacagcactccctacaatcctgctaggcaagaggggacctaaagatacactaggttagaagagagactgtttgaaatctgaactgggaagaattaggctttttcctgcaaattttcccctttaaactaaaactttccgttggatgtaaaaggggctgtggcttgaatctgagatttgaaaaaaatgactgattcaaaccattttgatttagtttttattttttaaaatattttatcttcagctttctttgcacaaaggagttactatgcttatcaatatggaccatgatgtcaaagatgtgaaggtcagctttatattctcttcttaaagaagcagcatggaatggtggttaggagtcaaaatccccaagatagaatgtctgctgcctcgacaatattaggcagaaagcacaacctctgtgagtcccagtgtcctggcattataatggtacaacctgccttaattgcttcccaggattgtcttgaagagaaaaatgagataaattcacatgtaaacctttgaaataagagtattctaaggcagcccaaagtgtaattttcaggggactgcataaaacattatcttcttagttctccaggttccttgaaggaaattttagtgtattattcattgaactgaaagttaataggttatatgttagtccttaattgttcatccttccctaaatggtagtctttaactgtcccacttgctgttcttggtcaaattacctaacttttcctgccctatatctgtgtcttccattgtcccctcttttcagaattttagaagattctatgtggtaaacccaaagaacgtagataaattgactgttctttgggagatctacattaaaaatcattagatgcactgctaagaagtttttacattctccttctgtttacacaaacgcacagaaactgacatgagcctggggaacccatattgccctcctcaaactagaattttaacctcatagtattagacaaaaagaagcactgtcaaacaagggctgatattttaacttctggagatgccctgagccacccagagagtgtcctttcattaccttctgtcgtctgctaaccaaatttgattggacttgtgcagaagttagccacagtttttcagtccagtgaagactaattggtgtgtcacatatcatttccctgaatgacttgcattgtaaagtttactgtctagtatgtgtgctttgaactgtatgtacttttaaatgcacatggattttaaatgatttacgttataaaattttctgcaatttgcaaagtaattttaacgtgtattacttcatttgatttttgcaacaaactctctagggcaggaaattcactatgactcccattatggaaatggagaaactgaatcagaaagagttaagcaacatgttcaaggccatatgggtcaaaaaagacagaacaagcctagagcccaatttcctaactgttggtttagggctctatcaattgtatgcctcccgtcattgtcctttgttcattaattcattcaattattcagtccttgaagtttgattcaagttatccaatggcagcaaagtagaaaatgctctcagagtcccagcccctgggtaagtcatactagtgctctatgccccagtttcatgtaaaaatgtgaaaggttcaaattagattatttttttccttttttttttttttttttttcctgagacagggtctcactctgtgccctaggctggaatgcagtggctcaatctcggctcactgcagccttaacctcccagactcaagtgatcctctcacctcagcctcctgagtagctgggactataggcacatgccactacgcccagctaatttttgtactttttatagagatggggtttcaccatgttgcccaggctggcctcgaactcctgggctctagggatccgcctgccttggcctcctagagtgctgagtttacaggccactgtacccggcccaaactagatgatttctaaaatcaaatctatccaggggtagtgtatgagccatgtattaaaacaatacaagatttgaatattggcccttctgcttcctggctgtgtgatttgggaaaaattatataacctctctgcttatcagttttctcataagtaaagacaggggtgttaacattaattttgaagaaatcttgtgaaaaataagtaaaataatctatgtaaaagaaattgccaaatggcaagcactcaataaatgtcaatgattccttttgacgttaacacttgtcatattctaaaagcatatacattatttttaatagcagtttaatcattatctataaaggcattgctagctttactaacttcagagggaaagcattaaatatattaaacatctatacgatcaaaaatgacttcactaaacataacatttttattaagagttcatctgtaagatcttagcattgtaagatcatttccctaagattcaactcagaagaccatggattcaataagaaatgtgaacatattttaatatccccatccttttctttttaataggaatatgaaaattaaatataagagctttacatatcagagcagatggaatcttattgcataggttaatcctttaaaccagtaaataaaaggagcaagtccatgtggaaaaaattattaatgatcttaaaaaaatggagcatagataatgggtataaataatcctgcttgcccaaatgtttctttaaaactggaaaataaaagtatataatttattttttaaatgatttaggcttactactaaacaacagcatccttggaaaaattaaaccacaatcatcatcagagacaggggtaagaagccacatagctacatcaccaaaaagagcaactcaccagttacaatgaatatgatggttttaattgctttctggcagggctgtcagactactaagaaaaatcctatagacagaaaaatcatacataaggatctttctctttctgtctcttttattacaaagtaaaaagcatttgggtagccttttttaattttaaatttttatttttaacatatattaattcgaagcatcgtttcaggtccaggtgccatgcggaaaatgactgatgttccagggataggaaagggatgaatactgggagacatccaaattataaacatctaaaaatcctgggaaaatacccatttcctctaagaatagattctcactaagaatctaattctatttttatttgtttattgcttcatacatccaaagtaatattgtaagcagttttcaaaaaaatatatttaatacttgaccctatgaaaataactaccgatttaatttatattttgtttgctaaaaaaatattaaacccatgtttacatttatgtggttcaatccttttatactctaaatatgtctttatgcaatacaaaaggagcattttaaattttattttttgttttactttataaaaagttaagtgaaatattttactttagaaaattagaaagtgagcttcagaagagagtcaaattaagtttttataaagtttgtcttttacttttagaagttagtgtttatatattggtataaggactttaatatagtctctgagctctgtagtatgcaacctaataaaataaaaacaacttaggtaatatatatgactgaaactatcaaagtaatcattgaacttcatattcagaaaatttttgtttaaaagccattattctgacaccaatttttgattgctcagatatgataaagtttctctaagaaaagccattctcaagatatttcatttctgttctccactctacatatattttttgtacataaagttagtattagaacaaagcagttaaccttatcaaaatctattataaattatcagttgtaagatgcggaaattcccaaaggtactatccatctaatttatggtaaagatgtgcctctttgaatagactccattttagatcaaggttgagctaaccctcacttttggtcctaaagtggctaaactctgcaataacaacaacaacaataataaaacctcacaaagcttctacaaagaaacagtaataataataataataataataatagcaccagaaatacccaactttgataagcagtcatgttttagtcctcagtttttcttctccttgcaatttctcaaaagataatgcccagaaatttaggcttcttgtcagggtcctgcccccagtgaaaaataataaaaacccaccaatctaaataagcccagtaaactttatttataataattaaaatgccagaaataaggggtaaaggtatgagtaaatggtgatgatgtaactccttaaaacttccagtaacagtcttgaccttcaattacttgtatcaagataagcatgattatgatgatttcaggatgtaaaagaggagaaagttatgcaagtcataaacttatagttcccatttttaaaataatccatgttttattggttcatatatggagcctaaagctgattagttcaattgattaaagattagcatcagtgaagccagaggatcattttggtctttggagataaaaattagctgtattctgtgttttggtatagcagagagtaaagttaattctattaaggtatctacaaggatatgtcattggttggtctcagagggcaacaggttaaagcaatataagttggtcatcaccattactagaaatacaattaccttgtcttcatgatagtgggtcaatggcataatctttggcaccattcaatacatattaggcaattggtcaacatttgagtaattgcaaatatgaattttgaatgtacctttatagtatgtttattttatttatttagctcttctatatcaatttgctataattatatttttatctagcccctttatatcagttgtgttttaataaatccttcccagaacatatatcactatatgcaaattactgcttgtcttacacagcatccaacatggacatactctattcccagtatgcaattcagcacacatgattcaataatactcaaagtgtataacattgaatgatacaaaagagcattagaaatgttttattatgaaattttgttaaaattattttcatttattgttcattctttattcattaactatttattgagtgcctactgtgtgccaagctataacagatcatacggtgataaaaagactaagttccaacacttcacagcaggctcataaacacatctactcctacccaccttcaacaaacacaatgttattacattataaaccacaaatggaggaaaacttttcttgagcctaattgtgtctctagcaagctttatcatgttattttgggaaaaggattgagccttacacattacatactggagtttacaacagctgttaaaaagaaaaagtctctagttacacagctctggcttctgttcattttgtgattattattataagtcaaaagtctatagcaataaaaatgacatcaacaggaacaacaataaccataatatacaccaaatattgtctacagctatattaacagtgcatattcattgcaggagagtgggtggaagacttggggactagctgactcaataaaaggaacaaatcatagtagcctttcaacttccaccgggtcatacggcacccggaggtgaaattaaaatcggtttacaacctgaaaaatgaacttcaagtcatggattagaagattagtcaatgctgtgttaaggaaagattaaaaaaagaaaaaaactgttcaggccataaagaggtcatgacactttattatcataaacaaaaatttaacaatcaatttttttttgctaaagtaagcagcatatcaggccaataaagaatggcaaatgatatctgtgtacctgagcagtgaatgttttactgtattttggggacgaaaataacataaaaaaagacaaataacaaagtgaattaatgggaaagtttgaatatctgaaagaactcttagatcagtcatccttaaacgtctatgtaaaatacttaaacagttaccctcaatgaacttcaacttacatatttataaattataaagatatggtaccatgcaaatatgtaatatttaacattaaaaccttatacaaagagagaaaaacttaaaggattagaaaaaactgtacataaagagcaattctaatattttccttctaaaaaggattatattatttacaccttgtattctgagcatcccactttgtagaccactttgtagaaataaaaacaggctgaaggcaagctacagtcagaaaaaacagcaacttagcaaatattactgatgagcaaattccatgaaagggtatgttttaaacttacaaatacaggataacattgaaaatctgtgaataggaaggtcctggtgtattgataaaaaccatactttagctaaattcctaagagtcactgacaatcagacaggcttatccttgaaaaacaccaagagaaaaacatgtatgttctcaagcaataatactaataatgtaaaaaattcaaaggtaaaattctcaatactcatgtgacactgagctattagaacagtaaaacctcattaatgttaactcttaaaactcttaggattggaactagggaccattcagcattggggttaacatttaccttccttattctttcttcttaggtaatataaagagagattatgtagagagttgttttaaagaacaagcaaacagattacctctcaacacttgagaagtactcgtttacatagtgaaaatatatttactatttaaacagtcttgtctattgatgacagcaaaaatcatgcaacttttttctagcctaattcagctactgtgtgcatctgaaagaaataaaattaaatttgtttaaagtattatttaattgatttttgtttactaattctgcccagtattttccattttatttgaattaatgagatttcccttattcaaagtgttataaatgtacacattgtgaggctacttgcatgtttcagtaattaataacttatttatttacaaaatatttggctatacaaaggatagtaaaagatacattttaaatattgactcattgtggccatcaagcattatctagagccacagtgtaaataactgcctttgttttatcaggattctataagtgcataaaacggaagtgaaaatgtcatatttctcaggatactgaggccccttgaagttttatgaaaccttaagtagaaagtatataggaaagaaattgtacattctacaattataagtacttgatcttaaaaaaaagtcatatggcctaagattaatgcaaaaatattatggactgagatttaaaccaaattggttgtgtatgcatttacttatcacccagtaggcatggcagaactccatcttattatgtttaaaagtataaatctcaaatttgtacgtcatatggatggaatgtatccagcaataaatatgcagtttagaggaacctttgcaatgctgtagaataatttggacagctggtgttattggttgatctacaaggtttttggtgttcttatcaatctgctcttttacacttaatttaaatttagtataaatattcactgtcaaaaaaattaaattgggggagaatgatctcacattttaactcaggatacaaaaccagaatattagcagatgaattacatggataggtgagtttttatggttctaactggtatggagacaaagaaaagtgataatttgtttttgtttatgcaggctagatgaagttccaaaatgcaaaataaaataaaaaataaaaaagaatcttctagttgccagttctgtggcatacatgctctttttattaggaaaacttgtttaattactaataacacctaacatttgttgagcactttctactttccaaagcatttacacatctattatctcataacagccttaggagattataagtaattaaatatagcaaaaggcagttatggtaggtaatttggagtattataaaccaggcttggattgatacaggtagagagaaaacaagtcttttatcctttgtcttttacattaggaatatggagtctttgcagcatattagtatttgtagtttaggagctgcttatacagtaaatactaagtggttgtatcccttgtacattccctggatatgtaccattattacttgcggtagagttaccctgatgtggcttctgcaggtctaatgaactgttttcttgaagccctaatcacagtgtttctgttttttcacccaacacaatgctcacctgcacgactatagtcatattagacttagccttacatgggactctaacttaattgcatttaattccttgttcaaacaagcagcattttgaaagtgcttgtaaagtggccacaagatctacacaggaaaagaacaaaataacaaggcctgagcatgttttacatggattctgtcaagctcaaagcaggatcatatttggccacttccaacatagagaaacataacacacaattgtatccagtgtgtgaaaaagcaagccaacagaaaactttcagaccttatctatcaaataataaatgaaaaacaagctatttacacatgtgagggcaggtggaaacatgggaggccccatcaggaacttagaaaaagcaggtagcaaacaaagccaagaggcatgcaaagctttaatttttattaaaaggcaaaggaaactgtttaacgaattacacagcttaagaaaggtaaaaatccttcaggcagggagagatgagcctatggaaatagaataccagttctactcatactctaacacaaaaatatctgtagttcttttctaaactttgctatatatatcacatcactcagctctaaattgagtttatatgtcacattaatgtaaatactgaatatttatctaatcaaaattatagtataactgtattgggagaatggtgtggggagacgaaagggagtatatgtgtggtgggtgcagaagagagagggtgctaattccttaacagtacacttctcccatagtgagagatcaagagagaaagtctacaatagaaaattgaagaacttaaatggtttagaggaaataatgaggacaataataatttaggataataataatttagctcttggattcttcaagtgcatggagtttatatttttaatttaatgtttttaagggtttggcattccaaaggttgttttaagcaagcaggagttatctttgttttaaattctcactagataaagtgatattggtccagacactaaataataaagattggaaaaggaatttagaaaaggctaatgtttatatggtagtagtttggcctatcagaccataaaacccacatgattgttgcagaagggtcgaggattctgggaaataaaatgatttaaatagtgattaaagatctatatccttactgaaaaacattatttatcacactataaatgaataaaacaacagaccttttaggactatccctccccaaaattggtataactactcggagtctatttttaaatttatatgtctcatttaatataatatttttattccttcatctaattcttctcctttcttgctttgtataatgtatcccttgcctgaccagatggcagtgaatcagccaataatcacggaaggcacatcgtaatatattaacatcctaatgacttattttgcagatctgtttccaaaaatcacaatcaataataaaaatacagagttgacctggaaacaagactgcatgatatgaaaatatcctggagtggcattcctattgtccatctgtaatgaacactgcactgtaccttacttaaccagtttccatgacccaggtctccctaataaaacttcaaatttgttcaggtaactactttatttgttcagacaaagtgcctcatgggaagctgccccaacctcccttccaaaggagggacgggctggtctaacagtaatcacctttccagtaattagtttagaaatggacagatgatgacccatttatgatcaatgacacacaaggagaggtttgctggaagcttcagagaaagttatttcttctgaaagagtaatggaatctctctctctctctcccccactttttttgttggttttggctgttttttcctctaaattattcaattttttaaaatttctattttagacattacctgttgaattcccaccatgtaagaagtttaggatttaacttctcttacttccttgaccctaccacatatgtatcccttatcacccccacccctcttcccaataaggttataactttgattagatcaacatttggtagttactacataaactcaactcagattttagtgccaggggtgtgctggtaaactggttctctggaaagaaaataattgtataagtcccgattggtacagtgtgctgagtcccatggcataaatactcctgctttgttcaatttcaggttaccaaggtcattaaatgtaaaatttgaaataaatgggcacattcggttctcatgagttcttttcctttgggttaataattgtcatgtttgtatttgtttgcttgctacattttctatatacttacaaatgattaaacaacaaattcccccaatcatataactctcttctaaagatgtacaggtatgtcagatatttcatcaattggatgtttttgaaaaaggcttttctgtcacattgtgctctcattgccttctatgcctggcatgccattatgcttggatttccttgcactctcatcttgagaattctcttccccagctctgatcctctatttcctgcatcccatgtctttcttgctttactaccccattttcgtggatcacttcctccagtggcttcctaggaaaatttctgaggctttgtatgtctgacaatgtctttattctactttcacccttgattgatagtagaagtggctttaaaactccagtttggaagtaatttccttcagaatgttgaaggctttgattcattttgatctagctctcaatgtaggtgttgagaagtgcaatgacattctgattgctaattctttgcatgtggcctgctttttctctgttgaatactttaagtatttagaccaaaacatttatattttgagaattagaatggattcaaggtttccagtggcattccagtatggttttctgagtagaagggaagagtatgcaatagtgtgtatcctagaggaaatatggcggcctattatcttaatgtggccacaagagtataacatatgcaaatatgtgtgttaaggtaggaaaaataaacttcttccaaaaggaattgataagagactttcatcaattctatattgagagggagattaaagagaaggagcacaatagtttggaatgaaagaggggaaaatgtcttttcctcttggccttgaagaattggtagtttaaaaactctattggctgggcgcggtggctcacacctgtaatcccagcactttgggaggctgaagcaggcagatcaccaggtcaggagatcgagaccatcctggctaacatggtgaaaccccatctctactaaatatacaaaaaattagccaggcgtggtggcaggcgcctgtagtcccagctacttgggaggctgaggcaggtgaatggcatgaacctggaaggcggagcttgcagtgagctgagatcatgccactacactccagcctgggtgacagagcgagactccatctccaaaaaaaaaaaaaaaaaaaaaaaaaactacacgcaaaaaatactattaacaggtttctattatagaaaatgataaagacaaaaactaaaaataatccatcatcttacctcacacatatattctcttaatgttttcaataatacttataacaaaaataatacatgacctggaaaattcaactggtcacacaggaatattacaaaagtaaaattttcctctccccaatgtacagtcctatcattcacaggattttatttagcttcctaaaagaaggttaacaatatgtttaaaaaaaaaaaacacttaaaagttattattaccaaagttacaatgtcataataatgttctcctccttgctttaatacataataatgtaattcatcttagttcacacaggtctacctcctcatctttcatggctgcatggtagtccattgtattgaccagaggtcagtgaagtagaacgtgtaggccaactatgacccactgcttgttcttataatggcctgtgagctaaaaatgatttttgcattttaaaatgattaaggaaaataaaaatactattttctgataagaaaattatgtgaaattcaaatttcagtgtccctatgtcaacttttattagaacagcagcagccacatccatttaggtactgtctgtggctgcttttacacttcgagtgggatggtagtgacatggagtatgtagcctaccaagcttaaaacatttactgtttggccctttggctgacctcttgcataagctatataatctatttaactcaacatgaaagtaagcattcaaagggttttcaatcctgcaagtaggtgtgtccggaattggttccttccagtgggttcctggtctcgctgacttcaagaatgaaaccgtggacccttgccatcagtgttacagttcttaaaagatggggtgtccagagtttgctccttccaatgttcagatgtgtctgaagtttcttccttccgatgggttcgtggtctcgcttgacttcaggagtgaagctgcagacctttgcagtgagtgtcacagctcttaaagctggcgcctccagagttgtttgttcctccctgtgggtctgtgatctcgtggacttcatgagtgaagctgcagaccttcgcagtgagtgttacagctcataaaggtaatgtggacccaaagagtgagcagcagcaagacttattgtgaagagcaaaagaacaaaccttccacagcatagaaggggacagcgctaccgctgctgacttgggtagccagcttttattcccttatttggccccgcccatgtcctgctgattggtccattttacagagtgctgattggtccattttacagagtgctgactggtgcatttgcaaacctttagctagacacagagcgctgattggtgcatttttacagagtgctgattggtgcatttacaaaccttcagctagacacatagcactgattggtgtgtttacaatcctttagctagacagaaaagatctccaagtccccacctgacccagaagcccagccagcttcacctctcataggtaaaggagcagcataagcataagtaaagaaaatgcaagtattggaactaatcagcaaattgatcagtgtggatttgggtaggaaagtgataagagacaaagcaagaaagataggttgtggccatgccatcattagaatcccaggttgagaaatctgcctttcatctggaaggaaatcaataactattgaggatattgagcaggagaaaagtgacatgaatggggatctattttaggagattaatctggttgtataatgtggaattaatgtagagagtattgctcacaggttaggaaaccatttataagactattttagtaacctataaaagaggccttctgttcctgtgaagatacaaattctaaagtgtaaatgtactattgaaatcatttctacaatcctgaaatcaaagaaagttgtctgtttctttgtatgtatacaaagttgtttcaatatcacttaaaggtatttatttttataaaataataccaagatatatcttatcactgaagttttggtccactgtctttcagtacacccagctatgactttaatatatgctttccatgtaacaaacaactgaagaaactaattgagtgacataatagttgctgaattaatctggagtatggtatctgattatttgattatttcttaagtattacttgtaagcttaaggctcaaaatatgtcagtggaaaacatacaggaccatctgttatttcaaagtcataatgtgaagtgcccatcataatctgattaaaagtcctaaataacaagaatgatggtctcctagacagagtaattctaattaaccttata

SEQ ID NO: 525 - DNA, 20001 bp, Homo sapiens
gggggctggaagaccatgtgcagcaggatggctagctggctggccaccaaggattcagactgccctccatagcgcttttcactgcctagagagcatctccctgacagagactacatttctcactccccccactagcttctagggaagttcatgtgactcttaactgaaattaaggctgttgagacagaaataatttgtgagggtccccccgggaagacaggccaacaaagttgtgtgtgtgccagaggctgctacaagctggaaggcttttatgggaaagtttagaagaagggaggaggactccttataccagagttgtcctgttcagtggaggctacaatacagaggttacaatcattggctgcaggtgacatcatacaggctaaaatgtgctacgtgcaagacaatcagtaaaacttcatgattcagaaacaaatcagcaaaacttcgtgattcagaaacacatcagcatccttttcactgtcagtaggatacgtattaatcagtgtgttaacagtttgaagaactcacaataagattcttcactcaggacaggatatactccatgaatcataagacctcccccggggtggggtggtaatttggaagcctgccaaatgtggcctgtaggttatcatgaccagttctcatctgtggaatgtgagttgctgtaatggggtcatattaatgttacagcagttaaaaaatgggtgtgccttttccattctctcttcctccatctgccagctggatgtagaaggctctgaggccatagcagacgacacgatcacaagaagaaaaaacctgggtccctgaatcaccatgtggaggaaaattgctcaaaaccagggacacgtgcaccaaactattacctgagccagggatatgttttcatgtgtgaaggaagcactgaacattagagttgtattcaccaccacagccagtatcaccttaactaacatgccacaataaggaacttggattttattctaagtgcaagcaaatgccactggaaggttttagggagaggaggaaagtgaagtggtttaggtgttgaaagaccactgtggttgctatgcagagcctaggggcaaaagaagctgagagaacactgaagcggtttctgccttaatccatggaaggactggcagattggtgaaacagaggaggtggagaggaatgaagtaatctgagatcaactttgaaagctgagccaaggattttctagctgattggatgtcaaaggtgagggaaagaaaagagtcataggagactcctggtttgtggcttggtgtcatttcatctggtaggaaagcctgaggagcagactcaagggagatattctgagtttagttttggtggtgttatgctcactgttcataagaaaccttaatctattatctagtggttgtgcaaatatatatatgtaaacacatacacatatatatagcctaagagaaacatctagtaacttcttttacaaccagtgaagacagaatactacaccatggaatactatgcagccataaaaaatgatgagttcatgtccttagtagggacatggatgaaactggaaatcatcattctcagtaaactatcgcaagaacaaaaaaccaaacaccacatattctcactcataggtgggaactgaacaatgagatcacatggacacaggaaggggaatattacactctggtgactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaacacgcacataattaaagtcactgatcattagcttttcattactaaaagtatagcaacattaaataacaaaattaaaggctgaatgaattgtatgatgaatctgtgaatgacgaagttctgtgtctaacaacactgttgtcagtgcaaatattgaatcagatatattttaaaaaccagttaccattctttaagcttccttttcaactcacaccgacatgaatgtatattatccaaatgtggcaaactattcgaggcttgaaggactttaaagattacccagtgaaatcttctcaatttaaaaattatacaaccaagtcccatataaaaatgctttgtctaaggttacaaacctgagcagttcacctgatatgaagctctgtgcgagttaatccaattctcagcattaagatatctcaaaaacatatgagaaatcagaatcgcttaagccaagaattgcacacaatatgattctctttatagcaggttttcttcactaaagaatatttcaatgtaaatattaactgttcaaccaaaagaggtgtcaacatgaagaatactgaactcaaatattattcaacaagtctacactctaatatttacctatctaattttgtaatcatatgttttgaatttggtggtaaaaggtatgatattagaataagaaaggaataaacatctgggctttggaaatgccttgcttcacctataaggatcacgcagaagaatctggaaaaaacattgaaggaatgtgtgtagttatactttatttttcactaagggaacatgagacatttagtgccacaaattgtttttgtatcatgacatggtgttaactgagacttcatctgacatctccaagactaaaaccagaagagttacatgtcccatatttcaaagaccctccttgcaggactagcgaggtaagaagtggcccgaactggtctgggaatcttagcccatcattcacagcctgctgcacacaagagagaagattcttcagagaaattcatgggagtgggttttccagtctccatttccatggaaaaggaaaggagggtggtctgcctcccccaattccccacaaaccctcccagtcaagtggaaggggcttcaacacaaccccttgcattggagagaccagcatcttagtccactaggaaatgatcttaggagatggagcaagaaagagtccttgagagaacctggactgccctccaagataataactgtccctggagaataaatgagctgaaaagacaatagagtgagtcaactgcacctctatcagcccaaggcaggatgaagattttctgggccatgtgatgccactaggggtacccattctaggggcctcttgacaggaatcaggatcagggaccccccagcaaaggaaagttcagtggagtatatgaatggagcaaagaactgagagggtgtcacaagaggtcagccagagaacacactcccctatgcaggacagagtcccctgtgtcgggggttctggtggggagggtccccaattacctacaaaatacaccaactaaagaaattcggcaatggggcatttgccacacagggaactctgacaccgttgtatgagtagcagccaaattagaaactcggtcaccgtctacccctcctccctttttgacagcccaactctgtaagagtctgagagcaacctgctgatgtggggctgagaatgaaagagccaagtggagaaccaaaaaagggaatcaggccatgcttcgttgcctgtctacagccctgaggagtcacatttcctctgagagaccctgggacaaagtggagaagggggtgtgttggggaaggagcttccattaaatggaagatttaagtttttacattagattgggttgtgctattttattttatacttgaaaatgagcctgtttgttaacacgttgaaattgactgaaagactgtgcggtttgtgcaagttgtcaccaaggaggcaaagaaaggaaatctgatcaagtataataattaaggccagacgtggaagaaggataaaagttgtttcttagttaaactccaccctcaataaaccagttagagttgtagtaatgaaaagccaccggtgagatgctgagttaagataggaatacagtcatgtcacagctcatacatccaaaattcctttccagtcaaaatccagctacagtgtatctgtaactaggtgaaatgagtttataagaggcctgagaatgttttctaaacaatttacatatgaatttaacaaataaatttgaggaattttttaagggaaagcaaattaatgcaaatgaaactaagaccagaaagctgatattactagggaagcatatttattaggcatcttcaatgtgctaagtggtatttagaggcataagaagaattagaagatatggctcctattcttggaaccagctggatgaaataaatccatgcttagaagaaaaaaaaaaacactagagaaaagaataataaagcaaagtacatacaatcaactgctataataagggtaagaggatatactgctgtacagaaatgcacacacatgaaggtggaagcatggtgaagaggatttgtataaatgacaaaaggggaaatagaccatccagaaagacagacgatattgaaaattctttcttgatgcagattacaaagttcggatagagatgatccatggtagtcaatggagatttccattatatgggcatctgtcggcagtctcattatagaagaaaaatgagtgcctaagaaatcaagtagctttgctgtgaattttactgctgggaaggataccatggggaaatggttaacaggattttttttttctagccagaagagtccgttgataatcttaaccagtcaggaggcttcagggaaactgatggtgatattttggacttctaaatatagaatgaattagaaataacctggactttaggaaaataagtgtacctaaagctatgttaatgaaataataaagactgaaatgcaacccaattagagaaactatggagaatttagttggcaaaaggatttctttgaattcaaatttgagcagaacagagaccctttgtttgaaacgtcagcaggccctttgttctccccagtgacatatggctttaaagtctagcttagctttaagtcaatcacttaatctgggtttctctgtgaactacctttaagactccagaaagacatttcgaggtgcatgggtgagttgagtggtataaatagtgccccatttgaggagagaagcctttctgccttattcctagatggttggtctttgcataataactctgctacctactttttgccacttgtgaatttcctgttcatagaggacattaggagaaattgtctcatgtttggggtgtaccaaaacatttgaacgagaggaaaagaactgtgaacattggggaaggctgctcaagttagatttttgtcatagtgcacattaagttgtgctgacccagatattccaatttcaactgtttcccacatccactagaaaatcttagtatcagcaagcatgtggcctggcgagctgggagtattaacttgtggtctgaccaggattcttcgtcattttagcacagccttggccatggttagcaaggcggttctaaccttgttattctaattattctctcactttgggtgtgattcctgttagtccttccacttaaaacagatggaagagtgacctgtacattgggaaaggtcatctgtgtcttgattttttttatctggaagttttcacttataaagatgttgtaattataattattatgattattttgtacttaaattgggcagtgctgagatctaaaacaaactctaggtctgattattttctgaagaaaataacattgtacctcatatataccatggaatactatgcagccataaaaaggaatgagatcatgtcctctgcagggacatggttggagctggaaggcattatcctcagcaagctaactcaggaacagaaaaccaaacaccacatgttctcacttataagtgagagctgcacaatgagaacacatggacacagggaaggaaatggcacacactggggcctgtcatggggtggggttgggggagggagagcattgggaaaaatagccaatatatgccaggcttaatacctagatgatgggttgataggtgcagcaaaccaccattgcacacgtttacctatgtaacaagccagcacatcctgcacgtgtaccccagaacttaaaattaaaattaaaattaattttaagaaaagaaagttaaaaaaaaaaaaagaaaataacattgtactgaagcaaaactagttactctgtccttttaccataagatgtgagctgtagattataatgaaccactgaacagttccaaccaaaattataacttttgattaagtagtatggcttggctgctgaatcaccagtgtgaaaacccatccctggagaacgtggagcccgagatgacatgggtagccactgttggtggaaaaagcagaaatttttgaagagtgaccaaagtcaggaacataacagacaaattctggggagcaacaggcagtatttattgattcatcccacaaatgtgtaggagcacatactatgtgccaggtgctggaaaaagagcagtgacatgctccaggctcaaagtgcactgacctaacttcagaaagatgtctgcatcgcctctataatctcagaacattaacccatgagtggtctcagatgttaagaaaactggtaaatgtatcactcaggatgattttggtggtaagtaatagaaaacccaactcaaactggcattaacaataaggttaatttattggctgatacaactgaaagcccagaaatcatgagacagtttgatgagggctctggctccaattttttatattctcttggatcttccttttttaagtgccacctttaactttaggctagcttccctcttgaggacaaaatggaagctatagtttagggttcacattcccataccagattattcagaaaaatcaagcttcccaagcaatggcctaaagtcataagccattgacatttacctctgcatcaatcaccatgacagaagggaaggaattttgctgattgatttaagccaatgagggtacatacctgaacctggcagtgggggtagtcccagtcaacctcatggctgctcttccaatggagaaataaatgctaagagaagcatgacagcaaacccaagcattcattcagatattcagtattagaaacagaagatttatcaaaggcttcctgtttaggcagaaaactgatgagctgcagaagacatacactcattgctgttggcaaaaatctcagaaagcacaggaaagtctacgaaaggcaaaagtttccatgtctgcttctgataacctcaaagcgttttcctacagcccccttttaatgagttcctcattcatgggcccaaatatttgaacacagtgaccttaaaaacttaaccacagatgactggtccaagaaagggacctgatccaaaggcagcaatctatggactggcctacaaaatggcctaacaaaagagcttagtgctaccgggattttctattctggatggtgactacctgattctgtcagatcctatagggtgttggactataagatatacaagtcaaaaatagtgaagaggtctaaccttccttgcaagctaacaatttagttggccatgctttaatggatgctggcaaaaaaaaaaagacatctgtgtaagagacaaaggacttattactcacagctcagcgagcataaacttcatatttgcctcaatttctcttgtcccccacccctctaacttccaaaggtgtgacacggaacagccatgcaatgtagtaggtgatatagtttggatgtcccctccaaatctcatgttgagatgtaatcccccttgtggagatggggcctgatgggaggtatttgggtcatgcagggcagatccctcatgacttggtgctgtcctcatgacagtgagagagttctcatgagatcttgctgtttaacagcatgtggcacctcccctgcactctctctctcttgctcccactctcaccatgtgatacatgggctccccctttgccttctgccatgattgtaagcttcttaaggcctcaccagaagccaagcagatgccggtgccatgcttcctatagtacctacagaactgtgagccaattaagcctcttttctttataaattacccagtctcaggcatttctttatagcaatgccagagtagcctaatagtagatttgcatcacactcaaggaaccttgaacctagaaaacctaaatcttttataatgaattgctagcaaacttgccctttctttgccccaaaggagatattatctttattatacgaaacaaaaagtaaagccatctttcactctggagagtccatttgccatgtaaacacccaggaaaagatagtccaaaacaaaagttgtcaatgcccctgatcacgagatgtgcagaaatgcaagagacccaaggagaattgtctcccaacagcagcagacaaaagaaagctacagacactgagataaacacaaagaataggctgtaagtactgacagcagaagccatgaggtagagagaaagaaaggaatgaaagctattgcattagcggcaggagaaataagcaagaaaggacataccatcatcatgccaatggaagtgtgttgatatctataaacatgagctgcaatcatattctctcattaaatagatagtgcagtacttctgaagaagttatcagtgaatgtgggatcattttgtttgacagtggaaatttctcacactatccactaacctaccctgtcaccatagtcaagcaagtcaagctagaatctctgactgtgtcagcctccggggttttgtagaaaatttgtattatggagatgtgggctaaatactggaggtgattcacttcagaaagctaagcattgggaaaccatctctatcacagtaaccatttatgttaaagaaactgattttgcactgtttttagcctcctgtattttatttctttccatcttaatctaacattcttttctagacaagagatgtttattgttatttgtcagtggcaatagccagatgttctagatatacctttgttaaaggcaacacaattatctcaaagggcaatatttattttagacactaacttggcctctgttgccaatttttctagttatggttagttcattgtactttgtctccaaaaaacaaatatcccaaattttttacatgaagtgtacactcaaagcaggcatcttaagttgttactacctcttatttatattgcattaagtattttattcactcccacaataacgacaactaaaaaaaaacttcctgttcattgataattagatgttttgcttcatttggacttcctccaacaatcttctgttcagattcagctcttataattaattatcctcttgctgaacaactaaaaactgaagtctgaccaaagtacatctcatcccacacagatgtcctagttactccacaaaaggttaattaatcataagaggtgctttagagcaggaggcgctggaagaaattcagacctagtttctggcaacacagaaaaactaccatcatgccccttgttattgagctcacactgagagaatcatttcaatggagcagaaatccaactgcatgaacgaaatagctggtggatataatatcatgcctcagataatggagcacaccacttcccagtcactgatgattcagaatcccagcctgcctgcaagagaaggtcagcactgtttgtcctcatttaacagaggtgcctgaaaatcccaaatcgcaacaatggcagaagcaatcttcattgttctcctctctttggctgggtgccattttgtaacaggaatgagccctcttctccagccaaaacagtctacacacagtcgtccaaatacaccttgcattttccaacctgtggcttcagtcatgctaatccctccagtccaggtataaacttgtcttcttccaccacctagccaaaccctataattcagtcaagaaccagttcaaataactcttcctcatacacctgcatgcggaacattccaacccaatggaagtgcgtcctcttttgattcaggagcagctgtggtgcgttagaaggagcactgtcctgaaacagaaaatagatgcaatattggctgtattaaatgtgtaactttgagcaagatatttaactcctgtgagcctcagctttctgttcaataaaacgagaagaagaatagctactttgtaggctttattgtggaaattaaataaaatcaggattatgaaaatgtttatcattttgttgctgctcagcacatatttctttgcttacttgataattgacatccctgtgttttagtttgctttctttagttgttttttcttccccttttaacaaaagatgtgagagaaagtcaccttaaaatagttctcaaaatagtaatcatcatcatccctttctgggaacagggatgtaataaattgtgtgctctaaagatctatgagatttccttttggaggagcagggacagaaaagaggtcaggactcagatcaagaatctgaacccatcatggccaagcactggaggactcatttctggtgctggagatggctgtgaattgaacaggagaagagtccactgcaataggtcatgctgttagaggtagcatccacaggagatgagcacaactgtggttcccttcacccagacgaggtgtctctctgttaccagcatgctttcctagacatgaagagagactacatatgagtttccaggtccccttgggaatcagaaaaaaaaagtgctccatattctggagatgaaagggaagtgatgctctggtgacagccataaatcatctcattgagtctcataaactgttagcatgccttttctccccaacagactctaaactcctggaggccaaaaactagtttgaagtgttttatctgtccctcaggccctgagctcagcgtgcacttaggttctggtttgtttccatgggctttacttgattagccactcttcttgttctctccaccatcttttccttgtttattgtttagccataatttagaccatattaaagtggattctaaatcaatatcgaagactctagatggtcaatgttttctccttgctgaatgattccttccatttctcttggaagctcccattgaaatggagaattaacaagcttgcgggaagaagagagcgggaagggagcaggaaagaggatatttggctatggaataggagcaaaaaatgcaatttgtctttcatgaataagattctgtgagaaaaaggtggcaattctagttcatggagatagcaaggtgttcatgccacttctgaagcactagatcttactggccttcttgtctaccatgtttatttggttctttggaagtcagtcttgagccaaaagtatatggaagattttcgtccggtccacagtgtcaacctataaaatacattgatataaataaacaacaacttgtgttcaacacatctttattcaagggttcaaattccttttccagcatgattgtgcccagtcttcagagataacagggtacttatcaaccttcttcattttaaagatgccaaaattgagtcagtaaagtcaagtatcaagttcagccaaatagaattggaacccaattccatcgtgtgtgtgtgtgtgtgtgtgtgtgtgtgtgtgtgtgtatatataattattgtaattattatcattcaacggcatttctgaagctgaatgtgaatcctgcccactgtgcaggattcagccagcacctgaaatgcagccaacagtgaagaagacaatgttttaataaaaaaatagtcctgagaccacagcactcccagttttgaaagccttaaaataaattccaaatttattcataatggaaagaaatcacagaatccaaggtacaaaattatttctacagctgctccaataaacatcagaaaaagcctcgccaactccttcctgttcagcctactggtgtacactagaggagtttttaaaagaataactcttatctgtcctcatgaaagctaaaaagctagtcttatcaggtctaaaaagaacgtgttcaatttcaaggcttctaaaaaaaccttctggttgtatttacccactttctcaattagcaagggtttgaaatcctgaaaagctttcttactgccttaattttatagtcaatgacatatatgcagatataggtatagatatgtaaagagatatagagatagacatatatctcatctatctccccaactagattgttaaactcatgaatcctaactatagctagagtcttcatcaatgtattcatgtgctcaggctgccattatagaacaccacagactgagtggcttaaacaataggaatttattttctcacagttttagaggctagaaggccaagactgaagtgtcagcatgtttggtttcttctggggcctctctccttgccttgtagatgaccaccttctctctgtgtcctcacatgatctttcctctctctgtgcacaactatctgtatcctgatattctcttttaataaggaccccagtcacgctggattagggtccactcatatgacttcattttaccttaattacttctttaaaggccctaactccagtacagtcacattctgaggtacaggggttaggacttcaacatatatagttgcaggcgacacaaatcagctcataagactgtatctcccaagtatttatggtttgcccatgaagaggcctccataaacgcatgttggttaatgacttgatgtaaataaatatacaagctaattctgaatggatggaaaagtatggtgagcttgaaaaatcatcccacatccttaccctttcaattgtaattaaaaaaaaaaaaaaaaaaaaaaacgaaaacaaatacagagctccttcctaattctgtataaaggcacgggtggtggtgccacacacacctctccaaaaggaagcaagacctgcagtatgcaaagaacattcccggaagctaccaagcagggatgaggcttttgaaagcaggccagacagcaagagaaaaagacactgctgtgataaggtttggaggagcaactccacgattcacagcaaaagtataggatgctaagcttttttccccaattatttaaaatgatgtaactggagtgttattagacatcagagaaatctaggttgaagtcctgtctcttatcatgtaggtgaacttgagcaaattattaattgtctctaatgttcctcttcctcatctgtaaaagagatagcagctttattgtgagaattaaatatgctaattcacttaacgtgtactgacattaactgagtgttcgattaatgttagtttctttccccttctgacttcctcctcaaccaagacacagtttttcctcctcaaccaagacagtttttcctcctcaaccaagcacaggctcgctagaacactgaaagaccccacttctctctaacacactgtttctcaactttaaaaatccacatggctcttgatcatacaaaactttacttttccacaccctttgttgagatttgtaactgtgacctctaagataggtcggaatattaaaaaggcaaataacgcacacagattccccaaatctctctctccaagccacagaaagcagggaagatgagcctgaatgtctgtctgtgtgtgagtgagtgcggggtgcatcagagcggattctcccatgctgctctccagttacttagcccctgtgtaagaattaaattattcccagaagtcacagacaagtcaagtcagctgttttacttaaaggagcaagacaaaaccgaaagcccaaaatggaaaactggagaagaaagcagttgtttgggtgacaaacaatcactgaagctctttccggcaactcaaagctggctctcaacacctgattattttcaagaagaaacgcaaatgatacgtgtttgttttgtggtttatcagtaagccaacttgcttggtgtttgctaaccctctgcatttgactatatggacccagcattggtaagggcagggaggaagtgaaagaggcatcttttagatttattttgcttcttagtctgtctgcatcctggcaggaatccaccaggcttgtttaaacatattacccatttgttagacaaagggagctaagctgtgccaggtgcctgtggcattatacagggttaagcaatggcaggagaacatttccacaattatctttcagtctgtgatagacctaaaggagccagcaaagtttgtttaccgacctttccaagaagtctcaatgggagatgtggggacactgaaaaaaataaaagaatatattacagaaaattattttaataaatggaaaaagactcaagatgtctacaccctacctgtaactgcatattctgggttacctttgtcatactctataatttcatgtatttgatataagctacattctcctaaattggtttgatccaatgccaatcacatacacacacacatacagccacattcaaaaagactaaaaaatcttttttagtcctaaaatctgggctacagtagtgatcaaacatctaagagtaaccttctaggatttgctacttttccctttctgaagcaaagcattttgacatacataggtcattctctggcaaaaaaaaaaaagagagagagaggaaaaggcagagctcagcaactgctttatcagaagaactcacaggcattaaatttctaacaaagctaacccatgtagtgtttggcagcacagtactcccagacacacacacacacacacacacacacacacacacacacacacacactcacatgtgccctgcaattctgctctatcagcctctagttcttcccacttggctctgggagaaacagactaaacatcttaacccacccttaacattttctgtactcagaacaacctgattagagccagatctcacttttaattctgttctttgagacatcttccagaaagaaaatatacctgtctagggaaagtttagaacaatggctagaaatagatactgaggccaaatgaacactttttgcctttgacctgaattaaaggcagcaaaaagcagaattggaaaatagaatggctctctctctcagcctctctggctgtcagctctccacgttaagtgctaaggatacaagatgagcaggacagatgtagtctatgctctcatcgaattcacagaacagtggcagaaatagacaagtcaagaggcaatttcaggacagtctgatcatggcctacaagtccttttgctatctgacccatacttagccatgataaagatttggggagtcagagaagtcctttaagcagaggcgtgacatgatccgatctgctgtttagaaaaagcactttggctgcagtagagagaatgaatttaggagaagtacagttagtggtggagtgaccagttttaaggcagttgaagtagcccaggggagagatggtggtggcctggcttacagacttggcatggcaatggcgagaagtgaacagattcaagcaataatgaggaaacagaatccctgccttccttcaaccgtgggaatagaaatgatgcacagcttggggggaggaggagtgagacatttcattttttgcctaatattcttcaaacacaaattatcattccacattttcccttagaaaatcaccatctcccattcatcttcactgcaattcttggtaattgaaagaaatatggaatccatcatttattttgaacccagaaaggtcacacagttctcctggccaatacaagtggtttgctttgaaaccatcccacgtgtattttccacaggccctgcacagctaccatttcactcctggcacttgttcatcattccattttctcaaagtgaatgacaagcaaatggtaatcaatgttcccaataaaagttttaggagataattacagtgacgggaagcatagtcattacaatagtcatgctgggtttgttgtgatgctactaatcacaccaagttttctgattcatgtaaattgcaggtaactttactcctctagaatttgctattaatagataatattattatgctaatagctgcctaaagtataatttaagaatttcaagtgatctaagccagatattttaaaacactataataacctaacagatatgagccaaaaaataaattttatcacatttaaggaaattattttgaaggagagacacctgcaatttacacattaaaaaatcagttatactacatggagctgagtgatttaatgtatgcatgttttttcaattgctcaacaaaatagaaattgcaaaatattatactatctaatctctggtttattgttaatccatgagtgcttatatatacatgctatatgcatatatatgctaccatttgttcattcactcaacaaatattagctaaacatacacactcctgagcaactagaaggggcaacataaactcaagtaagtataatactgaaatatgtgctaaatagagataaacacaagaaactacagtgctgtaaagaaagatgcctttaactccatcatagagggcttcctagagaaggtgatttttaagatgggtcttagcagaaaagtcaagagcgcggcagagaaacccaaacagttgggggataatccaggaaccgaagaaaaggctattcaaggatatggtaggatctggcagccgcaagaatgtagacaaggttcattaggatagggtcaggagaagactatgaagagcttagagtgccatagcaaggtcactggagcagggaagaagcacaggcacattatctttgacttgctcttcagaaaagaggattatgcttcgcagataattgttttatataaattgaaagtttgtggcaaccttacaatcgagcaagtctatcagcaccatttttccaatagcatgtgctcacctcttgtctctgtgtcacattttggtaattttcacaatattgcaaactttttcatgattattatatctgttatgagataggtgatcagtgatctttgttgttatctattgcaattgttttggggtgctacaaaccatgccttataagacagcaaacttaatcaataaatattgtgtgtgttctgactgctccaccgaccagcccctcccccgtctcttttcctctcctcaggcctccctattccctgagacacataaatcttgaaattagaccaaataataaccctacaatgacctctaagtgttcacatgagaggaagaatcccctgtctctcaatttaaatcaaaagctagaaatgattaagcttagtgaagaacgcatgcagaaagcccagacaggccaaggttaggaggctgggtctttgggaggtaattagatttagatgaagccatgaaggtggagcccccataatgggctgagtgcccttataggaagtggaaaaaatactagcactctctctctctgtctctaccacgtgaggccaccgtgagaaggcagccatttgcaagccaggaagagggccctccggaggaatccaatcagctgacactttgatcttggacttcttagaccccagaactgtaagccatcaatttctgttgtttaagtcacacagtctgtggtatattgctatagcaatcagagctgactaagatataccccttccctcccatcctcctgacctgctaactcgggctcatccttcagcttttgccttaaatattacttccttaagaagtcttcctcgaaccactatgattggtcaacgatcccatgtccatgccctcctctctttatacactcaaatacaaacacacacacaatgttgaaatgtctcaacactcactaagggtttggtcagtgttacttggagattcattaattatctggcaggtagtttaataggaaatagtttatctatccaattacctctagcttcacagtcctcacttgaaatcagggctccatttgattgggagtgatgggaggaggacagtgagggcttggggagcaaagggcagctggagaaagatagtgggggatcttagtggagggataatgagaggaagcaaagggacccccagaagtggggaactccaaagggctactgagaactgtgtatctgattgcacagaacatcaagttctggatgtagaaaattccagagaaagctagtgtaaaaataaatgctgttgcagaatttcctgtctgaatctggtcttttcagctccactgggaagtagtagcctgttttaatatcatcccatttctgccacctgtatcactcttctaatcttttaaagcagtattactcctattaaaagactgcagccttcccacagggcagttttcaaatacctgacgccccattcaatcagggcagcacccggccatacatatttagggattttaatctttccacataaatcactccctccagctccttaatcatgtgtgacaacttgcagtgactgcatctcatgctctgatttccctgaaaggtcttgcaaactaagcatggttaagccgagtcagtaacttcgatggaaagcacaataaccagacaggaaatgcacaaaatgagtccacacacagcacatgtctctctgaacctagcccccagtgggggtctagaaacctgctgttttctgaatggggggaccagctcacaagatgacggtgtgctctcctcacctgcagaaactgaggagttagactagggatccccaagggccctttaagctttagtatgctctgcgcttgtgctcccaatctcccttaagaggcagattgtcctaatcagagttataacagaaccaatcaaattggaatagcaggaggactttaaatcaaaccaggaagaatccttggacttcatcaagattcccgagccatagcggctgggaataaggcaatgctctagccctttattattctgaattttaaactatgataacctggtactttcttatctcttaaacagggtctcttgatgatgatctctgcttcctgtcactgtgactcctgaaaatcagatttctggttccagattcctgtgactctgatggtgatgatgtgatgtaattctgtgcatttgttttatctacagatacaagagagaagaacccaaatgctaattctcataatattaggttggtgcaaaagtcattgcggtttttgccatttaaagtaatggcaaaaccacaatgacttttacaccaaccaaaaaataagttgatggtttttttgttttgttttgttttgttttttctttttgagaccgagtcttgctctgtcacccagcctggagtgtagtggagccatcttagctcactgcaaactccacctcccaggttcaagcgattctcctgtctcagcctcttgagtagctgggattacaaatgtaagccaccacacctggctaatttttgtatttttggtagagacggggtttcaccatgttgattaggctgttttcaaactcctgacctcaagtgattgacctgcctcagcctcccagagcaatcggattactggcgtgagccaccgcacccggcccaaaaagtaagtattaataacacttacctgagtgcttaatcataacacgcattctccaagcacttcactcatagtaactcattttaaacatcatgaaaaccctacaaggtggatgagaaactaaggcagagagattaaaaaacttgcccaaggttacacagatagcaagaggaaatgctgagatttgaacccaggtagtttgacttcatagccactctgctgttctatcaagattctttagtattaccgagatttctgtctcaaataaaattgagaagctgggcatggtggcccacccgtgtaatcccagcactttgggaggtggagatggggggatcacttgaagccaggagttagagaccagcctgggcaacatagtgagacctcctctctacagaaaaattaagaaccagcaaggcatggtggcatacact

SEQ ID NO: 526 - DNA, 20001 bp, Homo sapiens
ttagctgttaatttgtcctctatttttccctgtgggttagtcttatttccctaatactagcctaagactatcttcctctccactgtggctcacaactggcagccaaagtttcttggttgactccagccccctaaagatggggcagagaatgccagtccctggtgtgccaggaactgagctaagcaccttccaaataaggtctcatttaatcttcacaaaactctattgtatgagtactagcatagctcctaatttagagatgagaaaattaaggctctcagagattaacagaagtcacaacagccaccaagtagcagaggtgatttgtagtgacctgaactggtctctcagtagacaagttaacaagtaagacaggttaatttttaacctgggttaaaaatctcaaggcactaagatgccagactgtagggcaagggccctttgtggttttccatgcatattggatgggtgggggccagggagaagatgcttcaggctcccatgcgtggagcaggttacattggcattcctagggttctatttcatgcatgaactttgtatcctcctgtggactcccacaggtttttttttttttgagacagggtctccctctgttgcccaggcaagacttaagacttcagtggcgggccgggcgcggtggctcacgcctgtaatcccagcactttgggaggccgaggcgggcggatcatgaggtcaggagatccagaccatcctggctaacatggtgaaatcctgtctctaccaaaaatacaaaaaaaaaattagccgggcttggtagcggcgccttgtagtcccagctactcgggaggctgaggcaggagaatggcgtgaacccgagtggaggagcttacagtgagccgagatcgtgccactgcactccagcctgggcgacagagcgagactccatctcaaaaaaaaaacaaaaaccaaaaaaaagacttcagtggcaccatcatggctcactgcagcctcagcctccccggttcaatcaatcttactacctcagcctctgaagtagctgggattacaggcacacgccaccatgcctggatgatttttgtattttttgtagagatggggtttcgccatgttgcccaggctggtctctaactcctgagttcaagctatcctcccacctcgacctcccaaaccgttgggattacaggcgtgaggcacagtgcgtggccgagagtctgttttctattctagccttctcctcggatttcacacaacaggtgctccataaatactcagtgaatccaggcaggtatgaagaaatgtaatttgtttctcctttatccatccccctgagcaaatgtccagacggcggagtccaagggaatgctacgacccacccgtttgtatcccgttaaccttcctgctgctgacccgggagcaactgcgtggagtgggcgtgtgctctcggttgctcaggttgtatcctgagatcctggcatggtcttccaggggaatattttttccactgcagatgaccagaggaagataccctacattcttccataatacggaggacagctgtgtgggttacaggggaggccagaaatgaagcagggatggtggaactcgagacaaagaagaaacaaaggactgcccttaacagatgccttcattgtttgaccggttcattatccagaacatatgaaggaaggaataaagaggggatctcagttctttttctcaaacggccaaagaaaaccttttgttgttgttgttttgagcaagaaccttgtactggtacatgaagaatagatgagaaaagtgtgcagtgagtttgaaaaatattattgagatcttgaacttccaccttagcctgggttccattggcttggggaaattttaggctttgttacagatgttaaattatgaaaaaaatctaggtacaattcagcttctataggaaaaaacaaacaacaacaaaaaaaacaaaaataaaaacaaacaaaacaggcttgcaggtcaggctattgccttgaaaacaaaagataattaaagattacttacggctgcgcacggtggttcacgcctgtaatctcagcactttgggaggccgaggccggtggatcacctgaggttggaagcctgagaccagcctgaccaacatggagaaaccccaactctactaaaaatacaaaattagccgggcatggtggcacatgcctgtaatccagaggcaggagaaacgtttgaacccgggaggcggaggttgcagtgagccgagatcgcgccattgcactccagcctgggcaacaagagtgaaacttcgtcacaaaaaataaaatgtaataaagattactttatccaaaccccctcccaagtaagtttttcaaaaaaatgtgctctccctctcctgtgggtaagggaggagaccacccctcatattgccttatgcccaatttctgcctccaaagaaagaaaaagtaaaaactaaaaggcagaaatgaaatccacaagcagtcagcccggcgccacaccctggtcctcgaagttaaagatcgacccctgacctaatcggttatgttatctatagattacagacattgtatagaaaagcactgtgaaaatccctgtcctgttttgttctgatctaattaccggtgcatgcagcccccagtcacgtaccccatgcttgctcaatcgatcacgagcctctcacgcccacccccttagagttgtgagcccttaaaaaggacaggaattgctcactcagggagctcggctcttgagacaggagtcttaccgatgcccccggccgaataaaccccttccctctttaactcagtgtctgaggagttttgtctgtgacttgtcctgctacacagggaaattagagaagagctggtccctccagccctgaaaatagtagccaagacagagaaagggggtaggggaaggaaagcaatgccaggtatgtcccagtcagagggaccaataggatataaacaaggtggagggtagcaggaaccccttctcctcctcaccccagcccaccctattccctactcaggcctctgggagaaggttgctgagaggctgcctgcacctgcttgggatgcagcctcatcagcgtgtcttggttaggcaggatgctgccaacagctgagctctgctaagccacccttagacctttggcagcatgagccagactttggaggagctgcaagtctaaatgagaagcttccagaggggtccattgtagcaggacagttagggtgtaagcaaattgctaaggttggaaccaagcacaagctccgggcagacctcagaggggtcttcagccccagtgggagctggggtgcagtgagccgtggtgcaaccctgccgaagcatcgccagggacacagaatggaccccgagggtacaacagccacagagttcaccttgctgtacccttgctctgcagagctggcccgggggaagaggtgccactttggcatagggaccaagaagcgtcccagaacaaagcaagccagaccatggccccaggccttttaacctttgacatcataagaacatctctgattcactgagactgttgcagttgaggactgacagcaggaagggcctcagagggaaagtccttgtgaggactcctccttgtgacaggactcagagccgaggcccaacactagggcttagaaggtggggcttagcctgtggatgggcccagggagtggccttcagacaccacagctgagcatgaaaatgtaaactgagcattcatgcctcaggaaactgagggaggggctcctctgccatctgtgctaaaagtagagcagccagggcctcatcccaacagaggacaagaatctcttcttccacacaggacccttcccaacaccaactcagtgtggcagggaaggagcagaggcagccaaaaccaggagttggattgagggttccatccgttccttgtccccctggcgtttggaatgctgtgccatctaagatacttgtcaccaagtcctgggcccagctgtccctctgctaaccaagatcctaggccaagtgccacctgagttctgtggtccagtgtgactggctgcagaggggcttggctgttcagttataagaagaggttcccacgtacatgccctcctcctgatcctatgctaagccccagcacagggatgggaacctgtgtgtcacccagccttaaccactcaaagaggggatgcctatagctcaggctctcctttcactccattagcatctatccacctgggtcccttttccccagttaatcatggctgcatccgtatcacgaagccttctgctctgaggacagccagccgggaccagacatatatgcagcaggctgtgccttccttctatgcctttgtttgtgcggccctctttcctctgcccacctgtattcacctggctgaggctcagagatgcagtttaggcacattggctgcagaaacctgtctctgaatcctccagcttctccagcaccctgcaaagaccttgctcctagtatttcattcattcattcaacaaatacttaagtacctactctgtacctgtcctgggcactagggatgccaccatgaataaaagagacgaaaggaaaaaaaaaactctgcccttataagacatagatcctacagtatgtgggacggagactgataatacatgaaataaacaagctacatggcatgtcaaattcaaaattctgtaacgacaaagaaagcagcaaagggggtgaggcacgtgggatggtgggatggtcacgtatgtgtgtgcctctctcacagctcggcgtgctccttcagaacaagcatgggattgtgtttctctctgggtccccacgcctagccaggcaccctgctgagtagtcttcttcactagtgctgccacatacttaaccacttgccctttacagcccagagatccctgggctgtctgcacctatttctccccagagtgcccaacaggtcaccaaggagggagggtccaagaagggcaaggcagggcttggataggctcccaggactaagcaagcaacacctaccagctcaggccttcttgaaattaattctgggggtcaagccaatatcatttgtagagccataagccctaaggaagaacccttcagacaacaaatcaacgaatgcagcattctaattttcaacaaacgtatgaattgcaacatagcattaatgacagaggcactggaaaagagtgctgccctgatggtttcataggaaccacagtttactcagggaggctggctctgggcatgaggaagagggctcagctttagtgctgctttatagaagtgtactgggtttttgtcttgtttttttttttttttctcgttctgtcgcctgggttgaagtgcagtggcaggatcttgcctcactgcaaccactgtctcccaggttcaagcaattcttctgcctcagcctcccaagtagctgggattacaggcatgtgccaccacacctggctaattcttgtatttttagtagagacggagttttaccatgttggccaggctggtctcaaactcctgacctcaggtgatccacctgcctcagcctcccaaagtgctgggattacaggcatgagctaccgctcccggcctattttttaatcagttatactggaggtgggtatgctctcctccttcctgactcagcttagataggcaaccctgtgtcccagaagatccctctactgtgcccacaccccatctgcccatggattagccctgacccaaagtgggccagtcactttcttcttgggatgtggaagtgagtgcagtttgagaggcgaagctgctgatgcttgaaatccagcttgtgggtggtgcagttaggaggtgatgtggagtgaagtcagcaccacatgtagggccaagctcccctgctgccaagaggaggctggggcaaatgcaggcagggagaggctgtgatgctgcaggccaagaggcagaaagagagagacagagagggaggcaagagagagagttggaagagagaaagagaggctgggactggccagaatgtgtcctgcctgtggctgtctcagaggtgcctcatcctcataacaacccttccttcttgtaacttgagctaattttatggatttcttttttttctttttctttttctttttttttttttcaaatggagtttttttctgttgctcaggctggaatgccgtggcgcaatcttggctcactgcaacctctgcctcgtgggttcaggtgattcttctgcctcagcctccaagtagctggcattacaaatgctcgccaccaccccaggctaatttttgtattttcagtagagatgggtttcaccatgttgcccaggctggtcttgaattcctgacctcaggtgatccaccagccttggcctcccagagtgctgagattacaagtgtgagccaccatgcctggccacattttaaaatcttacagtttctgtgggtcagaagaccacacatggcctaggtggtcctcagtttcagggcatctcagaagactggaatcaaagtgttggccaggtgcagtggctcatgcctataatcccagcactttgagaggctgagtggcacctggacaacagagtgagaccctgtttcaaaaacaacaacaaaaacaaaaacaaaaacaaaagacaacaacaacaacaaaaaacacaaggtgtcagttggggttgtggtctcatcggaaggttcagctggggaaggagctacttctagcctcactcacagggttgttggcagggctgttaggctgaggctgccctcaacttcttattacatgggcctctacagctctcttcatcagagcaaatgtgtgagaagagccagagagagtgcaacaagatagaagtcacaatcttttataacctactcttagaattgttatcctatcacctttgccgtattcaattaattaaagcaattagctaggtctagcccacaaacaaggggaagggatttcacaaaaacatgaataccaggagaggagaactagtgggggccatgtcagaagctgctggccacacccctgaactagaaaaaccacaagattacatgaaaaagacatttaaggaaggccctaccacagatggaaacctagccttgtccacaattccaagaagatcctttaagttctaaagtaatctggttttgtttttctttctgtttttgtttttagagagagtcttgctctgctacccagcctgcagtacagtggtgcaattgcagctcactgcagtctcaacctcctaggctcaaaggatcttccctcctcagcctcctgagtagctgggactacaggcatgcaccaccatgcctgtgacccataaagttcttaagccaatgtaacttactcaattatgttggtgtgtcactaaaagaataaaagagatgaaagaaaaaaaaaaaacctgcccttatgggacatagatcctacagtatgtgggacagagactgataaaacatgaaataaacaagctacatggcatgtctttccctgcaattccagcaataaaattcccaggagaggctggggagagagaaacacacaccaaagagtaggtagagacagtgagagagacaaagaataaagaagaaggtagggaaggtggtagggagggggaaacggggagaaaacaagaaggtctaaggaaacatattacttcttgacagcaaatacaccaaaagctaccgtttcttttttttttttttttttttttagacggagttttgctctgtcacccaggctggagtgcaatcgcacaatctcggctcactgcaacctccaccgcctggattcaagctattctcctgcctcagcctcccaagtagctgggactacaggtgcccgctaccacgcctggctaatttttgtagcttttagtagagacagggtttcaccatgttggccaggctggtctctaactcctgacctcaggtgatccgcccatctcagcctcccaaagtgctgggattacaggcatgagccactgtgcccggccaaaaggtaccatttctaatacagatataaccctaattgacttgggacttaaattgcaagagaaagagttcagcacttgatgtgttaggcaaagtatcagctttcagcccaaagtgttaaggggattataagcaggtgtgttggcctgaggagtatccattcaacaggtatttttaagcatctaccatgtgcctgaccttatgctgggaatacacagtgaaaaagtacttcattcacaaatatttattgagcatctgctatgtcatataaattgttctgggctcttagggagtacatctaagaaaaaaacagacctaactaagcagaacttaccttagagcaataccaacagatggcatgcaaagattagttggtactttgtaaagtgcccttatgctatcccactggaacctcaataggcagaaggttccagtattgtcatcatctggaatatgaataaacccagaacacagagatcagcacaggccccagagctcagagagagtcagaggctcatggacctcatctttactttcttctacaagtggttctcaaattcgagtgttcgctataatatcctaatgttcttgtaaaaatgcagagtactgggcctggctcccagagattctgacccattaattctgggataggcctgggaatctgtacttttaatatcacccagatgattcagcagtagaaggtccccagagctccctttgagaacacgctgtgagcccatctcccaaccaagagatttttgtcaaagctcccaaggaaggagtagggttgactgcacagtgaatgctcacttcctcatgtgaaatgtacaaattcaattcaacttgatcaatattcatttgttcagtcgaataaaaataaagagcttaggaggtggctggtggggtgtagatagggatgtctacatggaggaatataaactcagaatgccaggaagttgtcttcaaatatcttaagatggtgggtagctcagtttaactcaaacacctttattaaatgcatcaactaggatacttttggttgtgagcaacagaaaaccctatataactggctgagcaaccaggagctgcatcatgtcaccacaaggaggagtccagaggggtatagcccccgtgccccaggcactgtgctaggtaagggcttgaggtacccagacatggtctctatgctcaaggacagtctcagaggagagaaacacatgaacagatgccttggagttaatgtgctgtgatacgtgctgtgacacaggtgttgcccagaagaggggcacccggctctgcccgaggacaacaggcaggtaaagcttcctggcagaggtgatacctgtgctgggcactgaggatgagtaagaatgaggcaaagaagaaaggagtggaagggggtttcaggccatatggcttacaactcagagggatgaggcatcacggcgtggcgtgggaagtcccgtgcctctggagtgagtagattgggtgtcagactgaagaacgagcagaagccaggacccgagggcacataagtcatcctgaggaacttgaacttggtggtccgccacatggcagtgttcatggggcagctagagatgcaagccacagtttgcagagcaattttttgaaccttagaagccatataagggctgaagatatgtattagagtgttggcagcatagaggtgatagaaattctaacacagatgagaaatgacaggcacagtgtgagacagagaagaacactaagctgagcgtgggagcctaggagcaagactcaggtctcaagaccccgcgtctccaccaagcagtctcagaagaattgctcgacaggtgggaagagctccaggcgagaggctgtcttagaaatcaaggaagtggaaagtttccaggaggagaatgtggttgccatttcaaatgcaacaaagaggcccagaaagataaggactgaaatgtatcccgtgggtttgataatctggaagtctggagactttggtaaacagttacagtggcgtggtagggacagaaccagggtactgtggtggggaatgatagagcaacgaaggctaggattacccagtgaagatggctcttataataagctcagggcaaaaggaaaggaaagagggagaggcaagaggggagtataggatcaaaggaaagtgttttttgggtggggagaacttgagcatgtttgtacattgagggtcagagggagataggagtgactgcagcaagttgtgagcaaattggagcaagagggacaaaattgaggcagcgtgaggggctggacctgaccatgaggaggaacacttcgtcctcagagacaagggtgggtgggtgggtgggtgtgacacactggaaaaccaggatggtgggagccgtacagtgttcagtacaggatgatcaccagaaagaaatattaatgagagctttctgcagatcctgaccctttgtaaagggagtgcacactaactttccaattcgcaaagaatagcaccctcttataatcaccccagggataaggaaggatcagagtgtgagtcagaaaatgagctgcttggccggatgcagtggccaagtgcacctgcaatcccagcacttcaggaggctgaggcgggtggatcgcctgaggtcaggagttcgaaaccagcctggccaacatggtaaaaccctgtctctactaaaaatacaaaaattagctgggtgtggtggtaggcgcctgtaatcccagctacttgggaggctgagacaggagaatcgcttgaacctgggaggcagaggttggagtgagccgagatcacaccattgcactccagcagtgggtgacaagagtgaaactctgtcgaaagaaaagaaaagaaaagaaaattaaagaaaagaaagaaggaaggaaggaagggaaatgagctgcttgtatcagatatttcaggtgtggagtagctctaggtgatgacaagttccaggatttgaatgtggtacggagctgaaatggagcagaggtgagggttactgggattaagatcagagaaatcgtgcaagcctaggttcttggataggtgtatcagataggaacccaattttgctgcaagcaacagcaacatggctgcagtggcttaaataagtttgggatatacaggataagaagtctagagtcagacagatgatggtgatggctcaatagccttttgaggacaaggtggactctgctagccatttcctcatggttgaaagatggctgtccctgctccagccattgcatctacagtcaaggaaggaagaaggagaaaacgatgtaccagctgtgtatctcccctattaccaggaaagcaaatgcttgtctagaaaacactccttctctccagcatattcccactgggtcttcttgagagaaccgtgtcccttggccttcccttggctgcaagagagctgagagaactgggaacgggactgccatggtagatgaagtcagcaccttctgctgggcacaccgctgcatggaactaaatcagggtcctcgtacgaaggcgaaaatggggctggatattgattaggccaacatgagatctgctgtgatacatcctctgtgtggtgaacaaagtcttgtcctgctctagagcgttgatattcgggccagtgaaggatggaaatagctgttaggtccagctgagggcaggactgggaagaggagtgatgggaaggtagtcagaggccagagctgagtccctggacaccagcctgtgtttgtgctgagaggggagctctccgcacggtcttgagcagctgtgaaacaggcagagctgtcttcggggagatggaagaggcaggcctggccaaactaaggggcaggtgcagaccacagccacagtttgggaggcagcaagtgcctgcccagcctccagcaccccctttgggcctctgggcacctcagaaatgtgaactgggcaacccaggctccgcattcacaggcgtaaagtgtggcaccctttgagaaggggactcaggtcagactggccctccagaaacctcaagactaccacccccatgtctcttccttataccctgtggtcctcaccatggtcctctcatttgatcccggtcctcttgcccagctatcccctggctcctcccacagcattagggttccatccccagcaatgctgggtaagagcttcccaggactcctctcccctccccagggccctctatttgagcagaaccagacagggcaacacaggggcagatgatgagctacacagggcccgctgctggctggttgtgagtgggtaagaaaggaggagggcaaagctgactccccacgctaagcctaggtgacccatccagcagcctacagctgtgcagtgggacttgggcagcagtgatggttcaatagccttttggggacaaggtggcctctgttagccatttcctcatggtttaaagatggcatcccagtgtgtgacctggacaccaggttttgtctcagatgagccagagagtagagaagcccctcaggctgcactcccccatgtttctgcccttcgtccactccatcgagcatgccctgcaccctcagatcccagggcctttgctcatgccatcagtctgcctggaacactcctccccaccctgctctccaagttgactcccactcttcctttgcgccccagcttagacatcatttctctgaagacccctttcttggccttttgcctggttctttctttccccgttttccttcttaggagtatgtgattctgtattagttcagatcattaccaccaatcactgagtcaaacatgcaatcccagtgagcaagcacaacagaggctgatttcttctacttccacgtggcttgggaaggcctccttcatttgtagttacactggccacctggcaatatgccacacccaatgtcaccaatgcggagcatgagaaggaagcacaccagcttttaaagtgcatccttggaggtgacacaaatcacacccactcaaggtccttgccagaattgatcacatgccccagactaaactgtaaaaggtattgggaaatagtgggatgtacgtggaatagttagttagttagttagttagttagttagttagttagttatttttaagagatggggtctcagttgttgccctggttggtctcaaactcttgggttcaagcaatcctcctgcctgagcctcctgcgtagctgagatgacaggtgtttgccaccatgcccagctcatggaatatttaggaagctctacttgtctctgccacagctttttgtaaaagcctcttatcacagttgtcactttacatttatttatgagcttcttggatggtgtctgtctctgtcccgagggttgtgagctccagtgaggacaggaattgcatgtgttggctcacggttccccctcagggtctagccgactacctgtgtgtcatcggtgtccaggaaatattgagtgactcactaaataaataaactgcattaagtgggcagtgggcttagcaattgagagttcacttcaggccacaaagagcatcatttcagagggaaacaaaacttcaaagtctaaggagtgaaattgagttagggatcagaggggcagctaattttgacagagaaaagcaagaagatctgatgaggagaggcacgggggaattttcccagaggcccagctccctaaatcagcttttattaaaccactccttggtactgtggctgtccctgggtgccacagacacaaagagctgtgggggagaaggggaaggttttgcagccatcactagctcccactgcttcccctgtgaccttaccactgtgaaaaataatgcagcaacagcagaatgcacagtttccataattaggctccgtgaagaggggaagccgtctcaaaaagcctgctgttttagctctggtagaagtctgggtagtttaaagcggagaacgtgttttccagacagatggcttaacatcggttcctgacaaaaggcaggcaggaaagaagaaaccactcaggaaaagaaaagccttcaaacctctggagaggcagtgagtggtctaaaatctctgcttcttcttagctctctggttctggccacattacccagcttctctaagctccagcttcctcacctgtaaaattcctcttcatcagttctaagacacacctttttttcttaacattttaacatcgctgaaattaggatgtaattagcgatcaatggcaggccacaatatagttggtagggcttttctcttcatatggcataaagtaatggcaagtgttacaatcaatgtatcttagatttgatgaaatacagcattccctttggttttgggatcagaaataatataggtgaaccggtgccaggtaatatatggaattgtacatagtagattctcagaaaaatcacaattttaatcttattactttaagatataaaaaagaaaaatcttcaggctaggcgcggtggcttacaactgtaatcccagcactttgggaggctgaagcgggcagatcacctgaggtcaggagttcaagaccaacctggccaacatagcgaaaccccatctctactaaaaatacaaaaattagctgggcgtggtggcacacacctataatcccaggtattcgggaggctgaggcaggagaacctcttgaacctgggagacagaagttgcagtgagccaagatcatgccactgcactccagcctgggtgacagagcaagactctgtctcaaaaacaaaaacaaaaacaaaacttcagtctttgtgggatacgtagcatgaacaaggttagaaatgtaatgtgcaacatcagaactaaagttggctgggcgctgtggctcacgcctgtaatcccagcactttgagaggccgaggcgggtggatcacaaggtcaggagatcaagaccatcctggctaacacagtgaaaccccgtctctactaaaaatacaaaatattagccaggcgtggtggtgggcacctgtagtcccagctgctctggaggctgaggcgggagaatggcgtgaacctgggaggcagagcttgcagtgagccgagactgctctgggcaatagagcaagactctctctcaaaaaaaaaaaacaaaaaacaaacaaacaaaaaaacactaaagttaataaaactttattgtattagagatttctgttaagttagtagatttcagctgctcttgtcaccaaaaaggaaagtaactatgtgagatgatggctatgttaatatgcttcgctatggtaaccactttactatctatatgtatcccataacatttgttatgaacctcaaatacacacaatagaatttattttttaagaaaagtctttgtgacatcatccttagctaaccaacacaggaacagaaaaccaaatactgcacatcctcacttataagtgggggctaaatgatgagaacacatgaacacatagaggagagcaacacacactggggccttttggagggtggaggatgggaggagggagaggatcaagaaaaacaactaatgggtcctaggcttcatacctgggggatgaaataatctatacaacaaaccccatgacacaagtttacctatgaaataaagctgcacgtgcaaccctgaacttcaaataaaagtttaaaaaataaaaataggctggctatggtggctcatgcctgtgaacctagcactctgggagactgaggcaagtggatcacttgaagtcaggagttcgagaccagctccactagaataacaaaaattagccgggcttagtggtgtgtgcctataatcccagctactcaggggactgaggcaggagaattgcttaaaccagggtgggggcaaaggtttcagtgagccgagatggtgccactgcactccagcctggatgaaagagcgagactccatttcaaaaataaataaataaataaataaaaatctttgtgagttgtttggtttctaccctcagactctatacaactgtcattacaggattaggaggtgcccttgtaagacttgggcaaagtacactgactttgcaggtgggactggggtaaaggctagatgacggaagagagagagagaagacagagagagaaacagagagagagaaaacacagagagagaagagagagagacggagagaacacagaggttagcgggaggaaaaatcaaaggtgaaatatgaatccaccgcctctttggaactttacagtggtgactgaaatgtaagagacactggttccaagcctgggaaaagggcaaagtgatccagcctcacggatgactcagccaggagcaaagagggcattcagaagaagacataaatattccttagcctcagagaggcagagacctgaaagaactgataaatcaggaatcttgattattgtaaatttggaagttgtacatgtaaaatgttttctttttccattggaaagatagagactgtcatttggtgcaaatctctctactgatttttaaagaaagaaaggaatactgttaggtagatgggggatctggaaagaattcctggatttagcttggggcttagaatccagccccttcccctcttactgttcctcctccccgcctccaccacaagtgatttgttccattttaattgcacccatttgactttcacaaaacatgttaaaattttgttagtgcatgaatatctgggtatgtgtacttgagtttaatatttgaaggcttaatttgctttttgaaatgtttttataaaagtatttcattacttaatgaagtgaagtaatttttaaaagtaaaatcaaggtccaatctgtattgatctggagaagttctgcagtatatcaaatgtttatggttttgcacgtcccaattacaagaatcagaagggcattaaaaacaaaaagataaaaaagcttatgcagagatggtgttagtagtgactcagggcattcattattttatgggaagggaattattaataaattacttcaggggtagaattgccaattttacgtcacttttatgacaaaataaatcaaatgtgcaaatgctcagttttgtatataattcagcatatgattgtatatgtgtgaccaattctgctaagtataaagtcccatgacagttttattcagaaaatacaaataatacaaaaatgcagaactaattttctggtcccaagatagcttggcaaatagccacgtttataaatattttctgtgacataatttgtactatgacttaaccaagatgtctttagagataatatttgttaaagtagtcagtgatagaacttagcccatttatgactagtgttccattactggaacactaagtatgtgggagttatttgtatcctactgctcaaggtcattgccaagttctgattgcaaaaattcaaaaaattgcaacctcaggcataaatgggttaatctgaaatgccagttaaaaattgggctgtttccacccctgcctccaccctccgagctttgcatgttccactaacccgggcaggtggcaggtggaggtgtcaggctgctggcatctcttcgagggcagaacactaacctgaccatgggcatccaacccaataaaagcaattccaaccttaaaataaataaaaataaaattaaacaaattgggctgtggcgtttttttgtttgtttatttgttttgatggagtctccctctgttgcccaggctggagtgcagtggtgggatcttggctcactgcagcctccacctcccaggttcaagtgattctcctgcctcagcctcccaagtagctgggattacaggtgcccgccaccatgcctggctaatttttttagttttagtagagacagggtttctccatgttggccaggctggtctcgaactcctgacctcaagtgatccacccactttggcctcccaaagtgctgggattataagcgtgagccaccgcacccagcctaggctgtttcaatgcaatttttatttcttttcttttctttgtttttatttttttgttttttgtttgttttttgaaacagagtcttgctctgtcacccaggctggagtgcagtggtgcaatcttggctcactgcaacccccacctcccgggttcgagcaattctcttgcctcagcctcccaagaagatgggattacaggcttgtgccactatgcccgattaatttttgtatttttagtagagagggggtttcaccatgttggccaggttgatctcaaactcccggcctcaagtgatccacctgccttggcatcccaaggcgctggaatcacaggcatgagccaccgcacccggcctgtttcagtgtaattttaattagaaacatcccatggtgttagggttaatttgcttggtaattttaaccaggagcatgcaaatgattattgaattcattgggattttatgttattagaggtatctcatccacccataatgtagccttgtgctttgggttgtggggtggtttgtggtataatcactataaaataggcctgggccactgaacaccaatagtcaacacagatatgcagactacagacacatttaataaaatgttacattgttggtaattatacattgtgaaagtaatttttgtctcctttaatctgtcatttgtttgttgcatagtcagtctttatctttggactgggtccagaaatggccagaaatgtattttaatgatcctggaagtggctagtagcatgtgctgtggatgtggaattggtatgactggatgcaccagggtctgcagaagctgcaccaagattgtgactgtacacagagatcttcagcctgaaagaaatcaagtttcagtttgatgaatttgatctgggccatctccaacacactttatgtaccttatgtactgtgatgtactgttcctcagacaccgtggcaatcttctgcattggtcctaaaatagctggagatatcgcagctccttcttgggggccctgctgacaagtggaggccagttgctaagcccatcagctgcatcgtagctgcagcagtccaggcgcggtcacccagaccatgcgtggaccagaaagagcccatcttctgcatcactccaggagcagctgaacaattccttttggaagcagtgggacgaaaccaagtagctggcagcttccccgggctctcttccactgtagcagaatcttgagaaagctggcttccagccacggctgctgcttgagtgtatgggtctggtgcctccatcccatttcctgcatggccctgacccctggatccttcttattcgagaaggtgagccagtgcacacactggcagaggtcactggttgtcctctagtggggggtcaggcgtgtctgtattggtgcttgtcccacctggcagacccagcctactttttttttttaatccgtagatgaacagggcagaagatgccaggtaaatagggctctactgcttcttgacttcctgaccagcccagccagcaggcactgcctggggtggtcagtaggcttcctatacaagtattctgggccacctctcattgaacctcccccacatttacacatcatacccactcacacacacccacacattcacctatgtgcacctccccccagcacacatactcaccagtcaaatgggcaaatcatgcaagggaaccacggcacattcctctgcttaatagatgctcctttcctattcccctcccaaccaccaagaatgatgtcatccaccaggaatccaaactcaaccctctgccctaagacctaaggcagaaaggatctgactacctgtggaaccgcgagttactgtaatgcttgtcacattagattacaggatgtcagggagtcttctgaactcagggacacaccagtatggacagacagcacagatgagtccctgcttctagggtgccccattggtgccaagagcataaccacagaggtccttgactactccttgcaacccttg

SEQ ID NO: 527 - DNA, 40001 bp, Homo sapiens
ccaaagttgaaaggaagtaagaatccagggtgagagcaagccatttgttttctcctatttttatacttcagcagtgggcaccctccctgaagactatgggaatagaccttactttaaggaaggtccctggaagttgttcatttcctgcataatagtccgttgattcttgcatttgctgcacttacgttctagttcattaaaagaatctaggctgttccttgggggactcatcaaaaacccacatttttatgttatttcagttttaattcagtttttaaaaatttatgcagaaaccactgagcaaataaaatgctcagaaacattctgggttttaacctagattgaatgagtttgaatgagttgagccttgatcattcaaccttagtcacgcagctcacaccgataaactggtcagaatacacatctttaagagaaaaaaacattctcagagctgcttctataaaaaaaaaaatctctcaactttggtggtatatttggatctattcccagtatattcccagtatattttgaagcaaaccatatcctgcctgagaatggaagtgggaaatctattcttaacacagtgttctttctttgtttttacagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatctatttattattaaaaccatttataaggctttttcataaatgtatagcaaataggaattattaacttgagcataagatatgagatacatgaacctgaactattaaaataaaatattatatttaacccttagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaatattatggatggtgaagggaatggtatagaattggagagattatcttactgaacacctgtagtcccagctttctctggaagtggtcgtatttgagcaggatgtgcacaaggcaattgaaatgcccataattagtttctcagctttgaatacactataaactcactggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattgtcatgtgttgcttttgtcattttattgagagtgacaaaataaaattccttaattcggtcagattcacttctatagggatttggttcccagagttacatgaactgacttctctaagcagatgactagagcattctgattaaatgcaagcaaatgaattcccccctctggttctggttcttgtcaacatggccagatctgaattctgtggcccactttttggtttcccccaagtcaggcatccatctgtagccccggggactccagattcattgactcagagccaccccaatgtgtcatggggcttttttgaggcctcatgtgggctcacaaacaggtgctcctgctctatgttggggtcaacacgaatgttgattgtccacaaaccacttgacaatggagcttcgggcccagcaaaggacatgattcccttgttgtaggcattgtctccagagtgttcctgggccctcctgctccaaacacacattcattccaggaagaatctgggaaatgtctcttttcccatgctgctgctgcttggtccacctggggactgaagtgtgttgttgtcatggatacagttgctggcgcagcctcagtctcaaaataaaaggcttgaaagtcagggttgagctggtgctggatacggggagcacacatcccactgaccttcccaacccgaactcaggtatgagcaggtgagcctttattcccctgaagatagaaatctttatgggaaaagtgacagtagctggcctacctcatttgtttatcagacccaaacaggcatctctgaaccacaattaatttagtggaatcagttggggcttagggtactacacatacacatttatagcatcaaatttttaaaatcagtttgttccctacaaaaatcttatctgacaagaagaaatttcccttcttcttttatatgtgtaacatgtaacatgttgttactaaatgttgactttgggcacttctttggctataagaatggttcaaaataagtgaaagggattggtagcctgcgccttccatcattttacaatctgtttgaatagttgaggttaatttaagcaatgaaattaacactacaaggcagaattccaagtgcgtgtgtatctttattctgcagatccacatacagaataaggagattctcctgtgtggggtagaggatgagggaagtgcctggggacactcatctttgcttgtgaaataagacagagaacattggcttctcctgaattcctcccaaggagaccagtcttgtatttgtagagcagaactgccccaagaaactcctcaaggtagagggcaagacacaggtggctgcacgtggtcactaacggcggtgcattagtcaagtgggatgcatttgaagttgctgggaaaatattgaggaggattcagggagactaagaacagcaaaaaggggcaggctagaggaatgtgttagggggagtgtgttttgaggaccctttccctgggatggtacaaatcttcagaaaataaatacacaaattaaagcacttgtatcatcagaacacccgtgaccttctagaacatggagcatggcatgcctgcgagccccccacagccccccatcatgctagattgcagcaagatccttccatccaagttctcacctctcccattgattctcaacactgctctgggggtatctttctgaaatgcaagatggagccaaccattccctgctcacaagtcttcagagattccctatgtactaactcctgcctaacttctaatatggggctcatggacagcagcggcctggcccttacctctgcagatgcatcctagagtcctccctgcctagatcccaaacttcgaagacagccgtctgggcacagacttcatgccaactgccagtgtggccctcctgtcctgagctgagtggcatgttcccctttgacacttcccaccacctactgcccagcactctttgccaggggaaaaccaaaccacttgtgttggccactcttccccatggctttcccctatcctttgttttattcctctaggggtttcctaaaaggaggcagcatagtgctataactcagaactgcatcattgttcgaaagctctgcgactttgaaaaggttatatgagttttctgtgccttggtttatgcatctgtaaaatgacccttcttcctcagaggactgagaggattccatgagataagttgagaagtccctagatccagggctggccctttataactgctcagtgaatgttagctgtccccatcaccaccattttcagctgttctctctggctaatgtctcttccacctgtctctttggcaaactcttattttaccgtcagggcccaacttgagaatcacctcttcctgcaagcctgccttgatcctctgctcccagagcaacctctggtagctttgtcctatgagggcttcctggctcttccactcatggcacgtgtagaaaatagaacctgtaggtcacctggtgctggacaaggacttctcttagtcacaggccctggctggaccctacttagtggctaagtgccttgacacccctgtagtcaattcatggtcaggcagctgtgatgatcaactcccatcatgatctgtttatgtgtctcctcccttcactggactgggaagttcttgagggaagagacttttactggtttgtttaactcgttacacccagacagtgcctggtctgttgcaggagttggatgggatatttatgtggttgaactgagctcttcttcaccattctccaaagtgctgtataatttctttattcatgttccttcttctctcttgcctagttgaaatattatttgtaattaagcacctttgcaccctttccttgcaatcccaggcagaggtcacaagtcctgccccatgtgaggacagacccctatttacaaacttgacttcagcccttgctggtcattgtataggggactccagataaacagaaacaatacatttattatgaggaactggctcacatgatgatggaggctgtgaaatcccacagtctgtcatctgcaagctggagacccaggaaagctggtagtgtgtaattccagtctgagtccaaaggcctgagaaccacaagcattgatggcgcaagtcccagtccaaaggcagaagaacaatgtctcagctcaaagtcaggcagaaatagagaattcagccttcctcaacccttttgttccattcaggtcctccatggattgagtgatacccatccacactggggagggaaatctgctttattgagtccaccaatccaaatgctaatctcattctgaaacacctccacagacacacccagaaataaagcttaacgacatatctgggcaccccatgacccagtcaagttgacacatgaagttaaccatcacagctctgtctccccaactcccctgattaggagctcttgtgggacaaagccctggacatttgtaccagttcacacacgtatgcatttagacacataaactgtgtgccataatgtgcttagctataacctaaacctattctcatggaattacaatccacatggaaagccaggtccaagctagttgcaggcatgagccatgaactgtgatgggggcttgagtgcaaggactttaggggagcaggtaggagggggtcacaacctcgctatgggagaaaaggcaggaaggcatcccagtgtgtccagaattggtgggttcttggtctcactgacttcaagaatgaagccacaaaccctcgcagtgagtgttactgttcttaaaggcagcatgcccagagtttgttgcttctgatgtttagatgtgcttggagtttcttccctctggtgggttcatggtctcgctggctcagcggtgaagttacagacttttgcggtgagtgttatagctcttaaggtggcgagtctggagttgttcgtctctcccggtgggttcgtggtctcgctagcttcaggagtgaagctgcaaaccttcgcagtgagtgttaacagcacataaaggcagtgtggacccaaaaagtgagcagcagcaagatttactgcaaagagtgaaaaaacaaagcctctacagcatggaaggcaactaagcggatcgtccctgctgaccggggcagcctgcttttatttccttatctggccccacccacatcctgctgattggtccactttacagagagccgattggtctgtttcacagagagctgattggtccgttttgacagggtgctgattggtgcatttacaatccctgagctagacacaaaagttctccacctccccactagattagctagatacagagtgtccattggtgtatttacaaaccctggctagacacagagtgctgattggtgcatttacaaaccttgagctagatacagagtgccaattggtgcattcacaatcctttagctagacataaagattctccaagtccccaccagattaactagatagagtgctgattggtgcatccacaaaccctgagctagacacagggtgctgattggtgtgttgtttacaaaccttcagctagataaagagtgctgattggtgtgtttacaaaccttgagctagatatagagtgctgattggtgtatttacaatcccttagctaaacataaagattctccaagtcccactagactcaggatcccagctggctccacccagtggatctcacaccagggccacaggtggagctgcctgccagtcctgcgccgttcgcctgcactcctcagcccttgggcggtggatgggatttggcgccgtggagtgaagggggcggcactcatcggggagactcaggccgggcaggagcccacggcgggcgagggggcagactcaggcaaggcgggctgcaggtctcgagccctgcctggtgcggaggcagctaaggcccagcgacaaatcaagcgcgcgggctggtggaccagcactgctgggggacccagtgcaccctctgcagctgctggcctgggtgctaagctcctcactgcctgggccgcagggccggctggccgctccgagtgcagggcccaccaagcccacgcccacccggaactctagttggcccgcaagcgctgtgcgcagccccggttcctgcccgtgcctctccctccacacctccccgcaagccaagggagccggctccggcctcggccagcccagagaagggctcccacagtgcagcggcaggctgaagggctcctcaagcacggccagaatgggcgccgaggccgaggagacaccgagagcgagcgagtgagggctgtgagggctaccagcacgctgttacctctccccaggacccagctaagggataaatagcacttatcacggaggagtgtttgaagcaaatggaacacatatgggctagtggtggagagcacaggtttgaactggctcgcctgggctcaaatcccgcctctgaaatatgttgggacccttgcctggcatgcagtccgtactcataaaatgttagctcttgtagctacatgtcacttaccaacttttaaaatctgtgttttgggcaaaatgtttcacagttatcctgtgaaatttgccttcacatgtcaggaatgattttgcctgagaaaaatgaaaacaagccaattgccttcagggagctgcacctgtggggtaaagaccccagggaggcttcctacagggacacaggagacccctgcatagggtgtgggtattaaagtgcatctgccaccctcaaccccaaagtggattttccacccagtatagtgctttttttccacacacacacacacacacatgcccccccccccaaaaaaaacaaaacccaacaacaaagctgcaggtctccaaatgaagagctttagcagcactttttttttccttttaagttatgagatgggaaaatagcatttgcagtaattttgtgtggctataactgaaattccatgtgcgtgttttgccttatcgcttttaagtaagtacaaagggacagataatgcttccaaatgcatgctgtctctattatgactatggtaactcccaatcacttgactgtaaatagtgcggggtttctgtccctgtttcacatgcctttcaccctacctttgagcttcctccttcgcaccacccgccccccacccccccctccaccgcgtctcttgctttcatttctgcactggcaaatggctatgatgtttggttcctttttttcagagatgagtgaagaattcaagagaaactgccctctgggttgatggcgagagtttttgccttcagcttcacctctcacgtcctctggatagacctcccaatgggggcaaaaccaccgcaaaatgaaaatcccctcctccccattgaatctgctctgctgaagctgcaacactctcggattattccagaaatggatgtcctttcaagccccgctgtcagtttctttccgatgcataaggcgatttatggatgctttattctaagccatgtgccttcagtgacccagaactgacaagacttgagttcctggccccctgcaggtttctccacagtccattccctagcagccccctccccagggacagcctgaggacaccaacaccaagcaatagctctgtcccctgcagaacctcccatccttctccctccacagccccctcctactccccagctcccccaccctccagccccttcaaaacccatcaaagccccaggactttgagcactgctatccttcggagtgtcaggcaaccacaatactctcattccaagggagggtcatttccaggtcaggagaatcattttccttccactgctgagagctccagaatcctggatttaggttcctttgttatgaggtttcctcttctgatccttccacaattaagtgacacaatttctctccccattaaaaggcaggaggctttcattttcagacttgaagagcatttgacttgaatggaagcacttttgagttcagagagggaagataagttcattttcattgagcaccacggctcacctcttcatatgatttgctcagattaattctccagtatttcacattctcaaagaatgtgaaaaccccactgatgagacggatcatgaagcttccctgggcttcagttccctcattagaaaaaggaatgatttgaaccaaataattatgcaggctctccctgctttgaaatactgacattttgtcactgctagaataaatggaaggagagcacatggctttggtcaaaacaaacaacaacaaaccttcttgaccattttggttgcttttacgtgatttctgtaaatgtggcagggcagaaaggacaggtgttaaatgatgagtgttcacaccttccctctcctctcacagccttcggaagggtggagtttcctgcttggttcaccaggcagtctttggttgtgggaatgaacctggtggtagaaaaatgaggaaacaggaaggttccagggaggcaagtggaaaggaagaagggggcccgcccggctgcattcgagagaatttaccgagtgtggagaggaggagtagcaggattttgggccctgcctcgcttgtgtgcgtgtgtgtgcgtgtaagcgtgtgctctgtctgaagctctccttctacccactccctactctctgtcatggccatttcagacctccattatcctcaaaggctttggttcctcttgttccccaatctccttctgtagtcttggcaaatagtctgactttctacttttccattccaatagcaattctctcaatctctctcttccaagttacagaccttcatccacctggaccagaacgttagggttcttttctactgcagtggaggagtgttcttttgttttctctaaggtcagctgtctcctcctgtgctttggatgccatcccctccattcttgtcaggaaccttgtagcagtgattacccctcctctcgccttcccttaacctcttcctctctcaactggaaacttccatcagaagtatttcaatttgctcaagcctttcccattttcactatataaagcctatgccctccctcttcccattgccctttctgtctcctttctttcgtagtctgagttttcagaaatgtccctatactcattgtctccattgctttccctctctttctctgcttagccttctccagtccactacagccttcattcccccatgaagctcctccttctaagctggccagtgatctcaatgtctttatacccaatgacatttttcagttttcccattacctcattgcccagcagatttgacattgttgacaacttccttcttcctgaactctttcttctgttgattttctggaaaccacagtctgcaggttttcttcataccattgactgctacttcttagtcccctctgactgcaattcatcctactctgaccactgaatcttggccttccttccttctctgtcttaggctctctcctggaccacccggggtcagctcattcacacccattgcttcagttatggtctagattctgttgattcctagatttataattccagcccaggtttcctatctgagcccctctctgcttatccaactgacatcttgatatacactctttaatggtttttaattttttaattttttttttttgagatagggtctcactctgtcacccagaccagaatgcagtggtgcgatctaggctcactgcaacctcctcctcccaggctcaagcgattctcttgccttagcctccaaagtagctgagattacaggtgtgcaccactgcggccaagctaacttttgtatttttggtagattcagggtttcgccatgttggccaggctggttttgaactcctgggattacaggcgtgagccaccatgccctgccactctttaatgtttccaccaggcagaaatcttggagtcatttttggcaccctcttacttttcttttcatatcctgttgattgtatcctctaaacatctctgcaatctaaacacttctttccttccctaccgctgcatctttgtccagcttagacttggactgttatctttgcctgaagcacagtaatagacttcgacacttccttgtgcacctacttattcctgccctcctctaactcttctccaactctagaccaaagtgatctcttcaaaatgaaactctgatcatgcagtatttaaaacccttacatagcttccgcttgctcttggattaacgaacaagattgttactgggggctataaggctcaaaatgctctggtctggctgggcgcggtggctcacgcctgtaatcccagcattttgggaggctgaggcaggcggatcacgaggtcaggaaatcgagaccatcctagccaacacagtaaaaccccgtctctactaaaaatacaaaaaaaaaaaaaaattagccaggcatggtggcgggtgcctgtagtcccagctacttaggaggctgaggtaggagaatctctcgaactcgggaggcagagcttgcagtgagccgagatcatgccattgcactccagcctgggtgacagagtgagactctgtctcaaaaaaaaaaaaaaatctctagtcctacttacctttctagccttatctgatacatattctccctctctgatctctatctcaatttctcaaggacactatggagagggaaagagatgctgttaatagttagtcttggacaacaggcataaaatatgaccacactgagcaaactgtatgatgccctcactcaggaatgacattctccttcctactgcaggcccttttcttgctctattccatctgccttggaacctctggcctctcttcttcgcctcattaattctgatttgcctttcaggtctcaagatccactttttcaggaaagcctttcttgactccctacctcaaatactcctgtgatgtacttttgcaacacttcctacggagcccctcctgagtgccattgacctcttttgagattcctcatcactgttgccactttgtgtgcatttatgagattatttgattaatatttaatcttctccactgaagtgtaaactctctgaagccaggaatcatatcgaggttcgctcactattgtatcccccacattcagctcagtgcatgacacataatgactaagtattatttaataggtgaatcagcaaagaaatcagctcattattggggggtaactatccattggtttcttatgtttgtgcacatgttatgaatagagatactgactacttttgtttctgactatctgtctattcaagcattttgagtaatgaacagccttggaagatacagatgaagtcccccttcagaacagaggacagacatgctagcttcccaatataataaagataatgtcttcctctaaagaaaagggcaggtgtgcttcctgcccataataagtgattccatttctctcagatcagtgttctgctggaaatataattgactgcatatgcaggtataatatggctattttcgtgttgctttgtgggaattgtagctcaagtaaccaatgcaaaaaatattgaaaccctggcacctgctgtaagtaataaactgtctttcatctctaacaaataatcttgtgtcttcttttagcactcatgctagttgcgtgtttggtgaaatctcagacccttcacagtttttgacattaattaattatattttattcattctgtatatttcttagactttagtatcgagatgtgcagaaataaaacatgtgaatgtcttgagtataagtccctgtttttccttatgcattgacaaactacattcctgagatcacccctacatgataatccgaaataagcaaaggttttattgaccatctctcttacttattcactttttaatgttccctttttctcctaattttgtcatttttttcctcctatgttcttttttttattagtactggtttattgcagaaaatttagaaatattaatatgtcctcctatgttcttaatctatggtctatttcctttcaaatggttacattaatttctcccagggtgttagctgatctttataggggactcttaaagaggaaaaacatccagagtttagcgaagtatagtagaaaaagccctgaatcagaaattaggagacataacttttacatatgtacaggcataactagttatgtgaaattgggcaggtcacaaagctccagtttcctcttctgaacgcagtcattcctttatgcatttatttattcattcaacaatcatttattgaattatttgcaataaatgacttaactgctgccttcaaaaaacccacagtctagtgagagagaaagacaaactcaagatattaacacagtgtgaaaggcatgataatagaggaaatcccagggagctgctgtaggacccatgggattagagcggagacagagagcatgggattaaactgtgcaagggaggtggagtctgagctgagtctggttgggcaaaataacttggccatggagaaggtgaggtagggagttgtagtcaaaagcaagagaaagtcccttgcaatgcttgttgaagcttttccctcttctccctacttaggctttgccttggctcccaatccctccaaacctatagtggtgtccctaagggagagtcttatcacccctgtggccatggcaagtggcctagtagaaggtagtgtaacaacccagcagagagctcaggcacctgcctccaccactaaccctgcaatctgggcaccatattcctgtctgcaaaaagggagtcacatttggtttctcctgctgggttaccgtggggatgtgagtgctcagcatagtccttagcccatgaaaactatccaagtggttgcatcaaaattggggaatactttggaaattattcatctcatttcttttttgtctctttgagaacatgacatcacctctagttggcccaggacctccatctgcctgagggtgggagaatggagcagagattagaagtgtctcaaagtcacacagggaggccaacataattttcagtttctaacgtgcaaaataggattaggcagcaggaggttagctttgaaatacagaatattctcttgaggtgaaattacaagtttttttatttccctgtcttgagtattctcccaccaacaccttcgtgacagtcttcagaagaaagataaaggcaattgagtgcatctgatgagaagaagcaaggcagtcatcattatttacatctacgtgagacaaataaaaagagtttaatgatttcagtcactaagggctaggggcctcattcagaagacagtggtttttgaccccaagacctgcccttgtcactatatttttcaatagcacatgtttggaaaatgactgctttaaaaatgtatatatcctcccaggttgaaaataacttcatgcttcttagtaattttggagaggtacaaagcaatcccaataatttgaaagcatcacagactcttttagagaagtttttggagtgctttcaatggttgagcccataaacatgtccactgatttacattttaaaaatgaaagagtgttgtattaaaatatttggattctggtcacatagtaaggctattgtgcttccaggggttagcacaggatcagacttggttactggaagtatcaaaatttgcaaattatccttcaaatgaaaattattcagttcttcaggttttttgcttatgactggtgcatgtttgctggttgtgaaagtggaaacagatacaggatttgctcccagtctgagcatctggagttgagtggcagggaagctaataaggcatctcactgcattcttcccttttcttcctggatggatgacatgtgttaatgttcatgtaaatccttgccccacttcactctaagagctgaagcaaccacttaaaagtcttttgtctgtttgtttttcttttttcttttcctatttctaagtaatagactcatactgctagttttgattgtttagcatttgtgacttcctatggtgaaagaataaagacttagtcatttcatgccctgttcccaaccccaccttcatcctcccaagagagtcatattatagtttttgttattgttcagtgtttgtattatcatgaccagaagtatttttcacagcaataccgcatttccttttgtggttgtcattagtgctcactgacagatattttgttcttaacttttaaggtacatagcaggacttgctttcctgctccctttgaattaggtaaagtcatgtgactaggtctagccaatgagctccaggccagagcatgtaattactggtgtgaaacttaccagagctctctttctgtctggtattgctaactaccaatattcaagaaatttatgagtgatgctagcataatggtggattggaagatccagaccctccttttacccatgcacacactgatttaataataatacatggggcaacttcctttctgagaagcccagaaacaaataacaagaagttcctgcatctgagatgggcatgagaccagctgcataaaagtcagtaggaacattcagggcacttttcttggccttgttcttcccttcagtacagcacaaaacaaatgggtaaaaaaacccaaaactcctggcttcttccttaggaggtaaggaattgaagcgtgtgtctaaaggtccagctttctgagtggctgcctgagggactggtttctgtttgcctgaatgtaagcactggcaggaagaagcacgaggctggtagggacactgaaaataaaggcaacagtttggactagtatatactcatttacaatagcccctcctcctggctcagcagagaatgagtgggtgaaaactctcaaatggtaatttctccctggggaaagaaattgttggagcacggcattttgcagagctgcctgaagtactgatttctgtctcatccaattcagggtgctgatgggacctaacatactctagattcctggtgactactgaaaaaaaaaaaagctggagcacatgctgctgctacagaagacccagagtacagcaggtagacaccagaggaagtaagagattatgagcatatgaagatagaaacaagcaaattcttctaattagaaatttacacacactcgccaagagaaaatacatccatagaaaatttgagagacctccagattttctacctgtgctaattggcgaaggtctttccctgcatgaagccagtctgtgaataatgggaaaggtgcctgttcctttggatttgcagatatcaactccaagctacagaaacataaagaaactggaaaatatagcctaatcaaagaaacagaataaatctacagaaattggccctaaataagtgtaggtatacaaaacaccaaacaaagaattcaaaataaccatcataataatattcagtgagctcaagaaaacagtgtttgaacaaaatttggatctcaacaaataaataaaaaatatgagaaacaaacagaaattttggagctaaagaatgtaagtgaactaaaaaattcattagagaagttcaacagtagacgtcatcaagccgaagaataagctaactcaaagacagatcatttgaaattacccagtcagaggagcaagaagaaaaaaagaatacaaaagagtaaagaaagtctaagggacttatggaacaccatcaagtaaacaaggctatgcattatgtgagtctcagaagagaaggaaaaatgagcacaaggcttatttaaaaaaatagtggccagaactttttaaaaattgagaaggaaaaggcacatccagatttaagaagcccagtggtctccaaataggataaattaaaagaagtccatacagagtaatataataatcaaatgatcaaaagtcagagacaaagagggagttctgaaggcctcaagagaatgcataaaagaaaactccataagatatcaggggattgggatgtacattcaaagtgctgaaagtaaaaatttgccaactaaaaatactatatctggcttaatggttcttcaaaaatgaaggaaagataaaacttttccagataaacaaagccaagggaggccatcacaactagaccagccttacaagaaatgataaaggaggtccttcaaattaaaatgaaagattgaatggcagcacaaaagcatatgaaagtataaagtttgctgataaaattgaatatatagataaatacagaatactatgatactgcaatgatggtgcataaatcattttaaatgcaggtataggagttaaaacaaagtattcaaaataactatataaaatatgttaatggatacaaagtataaagaaatgtgacatcatcaacatagagtttgaggaggaccttcaagatagccaactggcagcatctgacacttgcctcctccatgaaaaatcaaaataacaagtagacagtcacactttgaatagagcatctgagagagaacactggaatttagcagagaagtgacagaaaacaccacaggcatggaaggagagagaagcaaggcagtcagttcactgggattggctgggagcctggagaggctccccagtctaaagaaagggtaaaagatccccagctgtgcacattcccaccatgaacttctgcaaccctagccatgggagaacccttcaatccttgtggggcctacgatagcatagggagctgcctgaagaccattccagaaaggagcctcacactgggttcctcatccagccccctttccccattcctaagtagctgtagcttggcaccattttgagagctcagtccttaccagactgcatcccgccctgggacccaacagcccctacatttacacatttctagggacacactaacattcccactgcattcacgaagaggactgcatcagcacaatgccagctggactcagtggagcagcagcgtccccagcattctagcacacacagtgtcttgcacctgagggaatggacagtggaggacactatggaggctgcccatgggacaaagagagccaaagcctgtgcttcctaaagcctgagaactgcctacatagggtggctaccacagacagcaactccagcctcctctagcattagggctgctgtacacacaccctgagaacagactcagccaccatccattacagccacttctgctgcccgtggaggctgaagtgcatgccactgacattaaccctgcttcctcagcagcagagctacagttctcaggaggcctgagacctgcttacctgcagctgcagccactgtcagcagccatgcttcctccagcaacagggccgtagtgcacttgcacatgccccaaggacaggctccctgcaaccactactctcactgctgtaggcagccaagcactctgctgaggagggcctggggatcagcccaccctgcctgccatagccagcacccaagcacaccaccaggagcccttaggccagacctacctggcctggcaatgcacatgtacccccaacatcccagtacccaagcacatccctgagggccctggaattaccctgccctgtccatcacatctagtttctgtgcacttctcctgggggcctgaggaaagacccatccagctaaccactgccaccagtggggcccaaagactggtccacttggtgtccttgttaccagcaaaacctcacaatagcctccactaataactgcagctcaagccactgaagaaatcagacaccactattgctggttatagccaaagaaatcatataagactatacttctgcacacacccagaataaaagctaaaatgtcctatccaacaaacaccatagattcatcttcaggagaaggtctttccctataaaagccaattttaaaagttcgaagaagtgaccattgtaacagatgcacagctatcaatttaaaaatgtaagaaacaggaacaaacatggaaatatgaaacctctgaaggaacacaataattctttagcaacatatttcaatgaaaagaaatttataaaatgccaggaaaagtattcaaaataatgacatttaaaaagcttagtgagataaaagagaacacagatgaacaatgcaaagagatcaggaaaaccattcaggatataaacaagaaattcaccaatatcataaacaaaataaaacaaaaaaacagaaattttggaactaaagaattaaatgagagaaaatatttgttcaagagcatcaataatagactagagcaagtagaagagtctcagaacttgaagacaggtctttaaagataacccagtcaggccaaaaagaaaaaaaaagaggaagaagaagaaaagaaaaaagaatgaataaagcagatgtgacatatggacaccacatagagacccaatatgtgaattttgggtgttctagaaggtgaagagatggccaaaggcatagaaaactttcttaacaaaacaatagctaaaaacttcccaagtctagcaagaggtttagatatccagatccaggaaactcagggatcctcaaatggatacaatccaaaaagtctccacagcatgttatatcaaactgtgaaaagtcaaagacagagaattgtagaaacagcaaaggagtctggccacatataagggaatccccattggactaaaagaggatttctcagtagaaacctttcagcccgggacagaatgggatgatatattcaaagtgctaaaagaaaaaaatcgccatccaagaatagtatacctaaaaaaataatccttcacaaatgagggagaaataaagtctttcccaataaagcaaaaactgaaggagctcatcaccaatagactggtcctacaagaaatgcttaagggagtcccaaacctggaatacaaaggataatatcgaccttcatgaaaacacatgaaagtataaaactcactggcagagcaaatacacatatgaggaagagaaaagactcaaatgttaccactgtagaagctgcaaaactgcaatgataaacaataagagagaaagaaaggatcaaaagatatacaaagcatccagaaaacaataaacacaatgacaggaataaatcctcacatatcaataataaacttgaatataaatgagttgcattttccacttaaaagatatagactggctgaatgaattttaaaaaatggcctaactgtatgctgcctgtaagaaatttgtttcatcagtaaagacacttacggactgaaaataaagagatagcaaaatatattccacaaaaacagaaatgaaaagcaagaaggattagttatagttaagtcatataaaatggactttaagtccaaaacagtaataagagacacagaaagtcatataatgataaagggatcaatcaattcagcaagaagatataacaattctaaatgtataagcatccaacacctgagtacccagattatatatctgggtatatagtaattataacaagtatatagtaataatatatatatatataaaacatatatatatataacaagtatatagtaataataacaagtaattattattagatctagaggaaaagatagactccagtataataatgttaaatagttaaggacttcaacaccccactcttagcattatacagatcatgtagacagcaaatcaacaaagaaacattgaatttaaactgcactttagaccaaattcttctaacagacatctacagaacatttatccaacagctgcaggatacacattcttctcgtcagcacatggaacattgtccaggatagatcatatgttagaccacaaaatgtctccacaaatttttttaaaaatgaaatcataccaagtatcttctcagaccacagtggaataaaactgaaaattaataacaaaaggaactttggaaactgttcaaatacatggaaattatacaatgtgctcttgaaagaccactggatcaatgaagaaatgtaggagaaaattaaaaaaaaaaatccttgaaacaaatgaagatagaaacacagcatgccaaaaacccatgggatacagcaaaaggagttctacaagggaagtttatagcaataagtgcttacatcgaaaaagagaaagatttcaaataaacaatctgatgatgcaacttaaggaattacaaaagcaagaacaaaccaaaccaaaaagtagtagaaggaaacaaattataaagatcagagcagaactatataaaatagagactataaaaacacaaaggacaaacaaaatgaaaatttggttatctgaaaagatagaattgataaatcactaactagactaagcaagaaaaaaagagagaagatccaaataaacctaatcagaaataaaaaaatgagacataacaactgataccacagaaattcaaaagatcatcagaaactgttatgaacaactatatattaacaaactggaaaacctatgggaaatgggtaagttcctggacacataatctctgccaatattgaaccataaataaatataaaacctgaacagactaataacaagtaaaacaattgaatcagcctcttaagaaggatcacttgagtagcgattcctcaaggatctagaactagaaatactatttgacccagccatcccattactgggtatatacacaaaggattataaatcatgctgctataaagacacatgcacacgcatgtttattgcagcactattcacaatagcaaagacttggaaccaacccaaatgtccaacaatgatagactggattaagaaaatgtggcacatatacaccatggagtactatgcagccataaaaaggatgagttcatgttctttgtagggacatggatgaagctggaaaccatcattctcagtaaactatcgcagggacaaaaaaccaaacaccgcgtgttctcactcataggtgggaattgaacaatgagaacatttggacataggaaggggaacatcacacaccggggcctgttgtggggtggggggaggggagagggatagcattaggagatatacctaatgtaaatgacgagttaatgggcgcagcacaccaacatggcacatgtagacatatgtaacaaacttgcacgttgtgcacatgtaccctagaacttaaagtataatgaaaagaaaaaaaaagaaggatcacttgagcccaggagtttgaggctgtagtgagctatccttttatttcagttagaatagctattatataaaagacaaaaaaaatagccaatgctggcaaggatgtggagaaaagagaactgttatccattgttggtgagaatgtaaattagtatagccattatggaaaacagcatgaaaatttatcaaaaaactaataatagtactaccataaaatccagcaatcccactactgggtatttattgaaaggaaagaaaatcagtacatccaagggaaacctggacccccgtgtttattatggcactattcacaatagcaaagatatgaaatcaacctaagtgtacaccgagatttgaatgaataaagaaaatgtggtgcgtataaccaaaggaatactacttggccattgaaacagaatgaaattctccatctgcagcaacatatgtggaactggaggtcattatgttaggtaaaataagccaagaatagaaggacaaacattatatgttctcactcatatgtgggagctaaaagaattgatctcatggaggtagataatagaatgacagttaccagagaatgggaagggtttgtgtgtgtgaggggtgaaatgaaatgaggttgtttaatgggtacaaacatacagttagatagaagaaataagttccgtcattagatagcagagtaaggtgactacagttaacaacaatatattgtgtatttcaaaatagctagaagagagggcttaaaaagtctctaacacttataaatgataagtccattcaggtggatcccctgaacaccctgacttgagcattagacattctatgcacgtatcaaaataccacatgtaccctcgcaaaaatgtacaaatattgtatatcaataaaaattaaaataaatctaagcatgcttctttaataaataataatataaagtatttcatggagaaatcaaagtgtagagcttttgtgtgcaattgaaattaagttgctatgagcttaaaatagattgttaaaagatgtcttatgaaagccttgtggtgactacaaagaaaatacctacagaagatataccaaaaaatttagaaatttaaaacatgtcactacaaaaaaatcaataaaacaaagaaagacaacaagaaaagagggatgaaatcactacaaaaaatacaaaaatcaattaaatattggctatagtaactcctttatcaataattactttaaatgtaaatggattaaacatctcaatcaaaagctatcgagtggggaatatacttagaaaaaacaagatccaactgtacactgtatacaaaatgctgcctttagaattaaggacacatgtaggctgaaagttaaaggatggaaacatattccatgaaaatggtaaccaaaagagagcatgggtggcaattcttatatcaatgaaaatagatatgaagtcaaaactgtcacaagagacaaagaaggacattatatcatgataaaaaagtcaattcactaggaagataaatataaatataaatatgaatataaatatatatgcacccaacatcagagcaccaaaatatgtaaagcaaatattgacagaatagaaagggggaaatagccagcaacataataatagtaagatatttcaatactctactttcaataatggatagaaaatccagataaaatatcaataaggaagcagaggacttgtacaacactatagaatgaatggtcctaatggacatatacagaacatcccacccaagagcagaagaatacatgtttttctcaaacacacagaatattctttaagacagaactcatgttaggtcacaaaacaagtcttaatagatttaaaacgattgaaatcacagcaagtatcttgttcaaccacagtggaataaaactagaaatcaatagcagatggaaaaccagtatttgcaaatatgtagaaattaaatgacatcttcctaaacacctaatgggacaaagaggaagcaaaagggaaattagaaaatactgatacaagtgagaacaaataatatgccaaaacttacttgatacaaaaaacacagtactaagagggaagtgataaatgcttgcactaaaaaaaagaaagatcccaaataaacagcctaaacgtacacctcaaggagctagaataaagaacaataaactaagcctacagttagcagaatgaataaaactatatagattctaacagaaataaaatggatagaaaaacaatagccaaagtaacagtttatttttgaaaaagatcaataaaattgacaaatttttaactagactgaaaagattcaaataaataaaataagaaataaaagaggaggcattacaactaatgccaaagaaataggaagaattctaagagacggctatgaacaattacacgccaatgcattggaaaacccaggtttttctggtaaataacacataatgagagatcttctctcttaaattttaagtatacacacaacctgtaaatacctataatgaagaaatagaaaatctgaacagatgtataagtaaggagattaaatagtaatcaaaaacttcccaacagagaaaagcccaggaccagatgacgtcgctgctgaattctaccaaacatttaaagaattgatgccaatctgtaaactcttcaaaaaaaattgaaaagaaggaacattttcaaactcattatatacgaccagagttacacagaaatagaaactataagaaaataaaattatgggctaatgtccctgatgaatataggtgcaaacatccttaacaaaacagtagccaaataaattcaacagcacattagcagaatcatacaccatgactaagtggattcatttctgggattcaagaatggttgaacatacagaaatccatcaatgtgatatagcacattaacagaacaaagtataagaatcacacaattatctcaatatacgcaggaaaagcatttaagaaaattaacaccttttcatgataaaaacactcagcaaagtaggaagagaaggaaattacctcaacataataaaggctgtatatataaagcccatagctaacatcatactgttagttgtacctcatacatcaatggtgaaaaactgaaaacttttcctctaagatcaagaagaaagcaaggatgtccacattcccacttctattcagcattgtactggaagttctagtcagagtaataggcaagaaaaagaaataacaggcatccaaattgaaaaagaagcagtaaaattatctctgttcacagatgatatgatgttatatgtagaaaatctgaaagatttcacaaaatcctgttagaactaataaatgaattcagcaaagttgcaggatacaaaatcaacacacaaaaatcagttgcatttctatacactaacaacaaacaatccaaaaaagaaattaagaaaacaatttatttataatagcatcaagatgaattaaatacctagaaataaatttaaccaaagatgcaaaagacttgtatattgaaaactacaaaacattgtggaaagaagtcaaagaagacacagataaataaaaaggcaacttatgttttatgaattgcaagaaatactattgttaaaatgttcatgctacccaaagaaatctaaagattcaatgcaatttctaccaaaattctaatggcattttaattgaaatagaaaagaaagaaattctataatttatatggaaccacagaagaccacaaatcaatcttcagaaagaacaaaactggaggtgttacactatttgatttcaaaatatagctatagtaatgaaaacactgtggttcttgcctaacgatagacatatagacaaatagaacagaatagagagcccagaaattaatctatacaaaaagtgatcaattgctctttgccaagggagcccagagtaaacagtggggaaacattagtgtcttcaatgaatggtattggaaaaactggatatccatgtgtaaaagagattggatcctaatcttgcgccatacacaaaaatcaactcaaaatggattaaaaagttaaacataagacttaaaactgtaaaactcctagaagaaaacatatgggaaaatcttcatgacattggtcttggcagtgatttcttggacatgacaccaaaagcacaggcaactaaaacaagaatagacaagtaggattaattaaactgaaagacttctgcacagtggagtaaacaaccaatagtgtgaaaaggaaacctacaaaatggcagaaaatatttgcaaattgtgcatctgataagggattaatgtctgaaatatataaggaacttctataacataatggccaaaagccacaaataacccaatgaaaaaattggcaaaagatttgaatagacatttccccaaagaagacatataaatggctaaccagtatatgaaaagatgctcaacatcactagtcatcagagaaatgcaaatcaaaatcacaatgatatgtcacctcacacttgttagaatggtcattatccaaaagccagaaaataacaagtgttggtgaacatgtgtagcagttggaagtcttgaacactgtttatgtgaatgtaaaatggtgcagctgctgtagaaaacagtaaggtgattcttcaaaaacttaaaaataactaccgtatgattcacaatcccacttctgggaatttatccaaaagaactgaagtcatgtttttgaagagatatttgcactcttatgtttattgtagcattgttcacaaaggccaagaggtggaaatagcctaaatgttcattgatggatgaatggataaggaaaatgtggtatgtacatagaatggaatattatttagctagaaaaataagcctatcatatgctatgacatggatgaacattgtgctaggacattacactaagttaaataagccagtcacaaaaggacaaatactgcatgattccatttatatgaggtttttaaagtaaccaaactcatagaaacagaaaatataacagtgattgctagagaataggggtttggggaaggaggaaagggagttgttcaatgggtgtagtgtttcagtcatgcaagatgtaaaggttcaagggatctgctttgtgacattgtactcatagttgtcaatactgcattgtatacctaacgtttgttaagagagcagatctcctgctatgtgttatttaccataataataataataaatggttgcttcattgccttgcatccatttgtgactattatgaagataacccccctttcaacctgtggtggatatgtagtataagcaaaaaatgaaaccttattgttaccagctactgcaactttggaaatgtttgttaccacactataactaagacattcccaactgataaacatttcttgaataaatgtttattttttcctgaaaataacaacacctcattgaaaaaatttgctttatcttctctgtacttatcagaaatgaaactctaaaactctccatcagaaatataaatctcttctgaatattgtttatcaaggactctattaatttcatcttttctttgggactttccaaccaaggattgctctctagcctcctgcacaactgtcttcctggagatacccttcatctctatactatgcagcataaattccctggtttctacaactcaagtttgcaaagtcttgcttactactccaccatctatcctctcagttagcagattacatttcctactgttcctcacagtagtttagctctgtaacgtatttctggccaatgagatgcaaatattaatgttgtgtgtgacctttgggaagtgtccttaaaggggtggggctcactcttctttgtcctttcctataccagggtttttcaactttggcactattcatattttgaaccagataattctttcttgtgggcatctgtcctgtgcattatattaatcatgttcagtagtatctctagctactacctactagatgtcagtagaaccctctcctgcagttgtggcaattggtagtgacttcaaacattgccaagtgcccccaaatgggcaaaaatcatcccttttgagaaccattgctctgtaccagtgaatctcagacttgactgtaagtcacaataatgcggaaactggtacacgtatagatggctggatcttcttcctagagttcctgatttagcaggtctgggatagggcttgggaatttgcaagttcctaggaggtgctgaagctgctggtctgggactgcactgtgagaactgctgatctgtactactttgcttagcagataaacctgtggttcctaccgaataaatataacaatagcattgaacatggaagggttgtgaaccataggccgtcaaggtaaatcttgatagtggagttcaggaatttagaaatcatgctattacatgaaattggaaggcagcaccaaaaactatggtttatgcattagataaagattttgtttacatttgctctaaatgcagtgatttttctcaaataacagagatgatcaagatgaaaagaaacaatctcaaaagaaataataaagatgatagcaatgaatcttattagtctataatgtgcatgcccacccatcttaattctataggtttccaattgctgttgtcaagctttctgtggtaaattttatataactttccagaggctatgttaaaaaaagctattatacacaactcttttcacttagtgccacataatttttaataccttatctaaataatttgtgttggagcagcacaaaactggggggcattaatgctgtacacatttatgcagatgggagaaagactaataaaagaaatcattatggcctgaaatttaatagatgtcttgtgtttaatctcctaggtttactagacatgacagaagtctgcagaggcatttttagatcatcattttttagcactaatctgtgcctgccctgcatgtctggtgccaacgtttaattgtagcctagagaatctgagaaatgaaagaatctctccccacaccaatgtgctggcaacattattttactgttgtctccttaatctcctctactcttttgcaattagttttattactactgctcatttaatgagaccatggagtttggtgccagatggtgccattagttaaatctggaagactctaatggaattgagctcaaagcaggttaaaagtaatagaattacaaattttaatggtcatcacctcatagcgcaccgctctgtgtacctgttacataccagaaattagtgccggtttcaaacagaaaggcttggagtaaagttcagagagaccaagtgtgctcattcactcactcattcattcagctaatatttaatcatattcctatctgggtgcttcgggataccataaataagacagtcatggtttctgcctcatggagcttagagtctactagaggagaaagacaacatcaagcaaaccagcaagatcattatgcatttgtggtaagtgctaggaatgggggaagcagggaactggcatggagggttagaggatagagtggtttaggtcagggcttgatcaagggaagctctctgaggaggtgctcttttagctgagacttgagtggtagagagaagctgattgggggcatgcaagaagaatgtcattattgtctgatgcagtgaatagcatatggaaaggccttgggatggaagtcatttggtgtccccaaggaactcaaggacacctagtggggaagggaggatggctcaagatgaggctggagagtggccagaaactgctggacccagtgttgtgcatgagtgagatgaatgagcatttagaacctgagattatccagggattttaaatatgcctgtgccaaagtgctgatgagtaagacttgcagcaagaacatcttttggtcaaggcagtaaatactcatgagagcatcatgacctggtcagtatgtaaagtcatcagaagcatacttttgtcccttggtgaagagggcaggcaaaactgaggcagtactttgattcataaagttgctttatataacagtagcagtaattgaaacttggcatccctgccttcctacagggtacatctattgtgtttaggtctcctcatcttcctggttggtaacagtgcctggcctgcctttaaagaatatccctgctccccaccacatcccttggcaaatgactgctgtctcattcccagtgttgccttttctggtcttttgtcctgggctgaggctccttctctcctgttgaatgagtttgcatccatcaaggccaaggtcaaagagacacatgatctcctgggcactgagcttgagagaagaacacaaactgctaatgtttccatcatctccaagaagtctttcttcagcttctctctgaattcctccagggatttgtattacctgtgttggcacccacatttgcattgtttatgaaggataggctggattattagttcatttcagatattctctggacctgttgccttacacgtagcagatactaaaagtatctattgaattgaattcttactagtggttaccaattgttgagcaattaattgccaagtactcttctgagagcttgttatttaatctgtatatgatgactaatataatgtgtcaacttggctaggccacggtactcagacattttgtcaaacactattttagacgtttctgggaaggtatgtttaaaaatgagattaacatttaaattaatagacttcgtgcaaagtaggttaccctccattatgtgggtgggcctcatccaatcagtcaaaggcctgaatagaaaaagactgatgtcccccgagcaggaagatattctgccagtcaattgcctttggctgaaacgcaactcttcactggggctcaagcctcccagcctacaccacacactttggacttgccagcttccacaattgtgtgagcaaacaccttaaaatctctttcttgtaaacttgtttaagctctttgtagattctaggtattggccctttgtcagatggatagatcgcaaaaattttctcccattctgtaggttgcttgttcactctgatgatagtttcttttgctctgcagaagttctttagtttaattagagcccatttgtctattttggcttttgttgccattgcttttggtattttagtcatgaagtctttgcccatgcctatgtcctgaatggtattgcttaggttttcttctagggtttttatggttttaggttttacgtttaagtctgtaatccatcttgagttaatttttgtataaggtgtaaggaagggatctagtttcatctttctgcatatggctagccacaaggaaaaaacaaccaaccccattaaaaagtgagcaaaggatatgaaccgacacttctcaaaagaaaacatttatgcagccaacactcacatgaaaaaatgctcatcatcattggtgattagagaaatgcaaatcaaaaccacaatgagatatcatctcacgccagttagaatggcgatccttaaaaagtcaggaaacaacagatgctggagaggatgtggagaaatagtaacacttttacactgttggtgggagtgtgaattagttcaaccattgtggaagacagtgtggcaattcctcaaggatctagaactagaaataccatttgacccagcaatcccattactgggtatgtacacaaaggattataaatcattctactataaagacacatgcacaggtatgtttattgtggcactgttcacaatagcaaagacttggaaccaacccaaatacctgtcaatgatagactggataaagaaaatgtggcacatatacaccatggaatactaagcagccataaaaagggatgagttcatgtcctttgtagggacgtggatgaagctggaaaccatcaatctcagcaaactaacacaagaacagaaaaccaaacaccacatgttctcactcataagtgggagttgaacaatgagaacaaatggacacagggagaggaacatcacacaccggggcctgttggggggtggggggctgggggagggatagtattaggagaaatacctaatgtagatgatgggttgatgggtgcagcaaacaaccatggcacatgtatacctatgtaacaaacctgaaggttctgcacatgtgccccagaacttaaagtatatatttaaaaaatctctctttttctttccctctatattttggttctcctttctggagaaccctgactaagaacacacctgacctctaaccatttatgcctattttatagatgagaaaattgaggttcagaggtgttgagtgccatgcccaaggggatactcctggtacatggtagagccaagatctcagtccaggtctttctgagacaaaacacagcttcttatgcgtgaaatccacaaataagaacacaatgacctacatacaacacaaactgtacttccaattaagtagttctcctttttaatcattcaaaaactaccttgggatcttacagtgcatgggaatcatcaatatgtaaataccttattatccaggtgatgtgcaaaagtgtccagtagcacagaagattggttaataggatggtgtgtcccagctttttactgcacttgtacttgcttcgaatatttaggacccctatataaaattatcttctccaaagtcataatttccaagaagatcttatacccacactattttcataagtagtcaactgcaagatctttagaaccatgaggggatctcaatacacaacaatttaagattaaccattttgttgaatgtaagattatatcccctccaaagaatgaaattaaaatagagaaaaataaacagcacacgtggaatcctgagcctcttgatgccttttgccttgggctaaagttctcttgtgagttgtaaacttcaaaagtgtcctcaaactggaacctttccataggaaaagtcagcagaaaatattgaccccaggatcaattgtttctgtttaagttacagattgctgcagtcaaaataagcagccagtgtttgataaagacagctcctcttaggaagaactgtcatccccaaacacatagagagacactctctgtctctcgattacaatcatgatttccagaatggagaagatgacgatgatgatgaagatattgattatgtttgctcttggaatgaactactggtcttgctcaggtaaggtattcaccaacctggccacctgctctggatcatgcagagccatgctggcgcctgtgtcttgtctcactgtgccccatgtgcttgcgtgtccaggtttcccagtgtacgactacgatccatcctccttaagggatgccctcagtgcctctgtggtaaaagtgaattcccagtcactgagtccgtatctgtttcgggcattcagaagctcattaaaaagagtaagtgcaaaatgaaatcttctctactcctccttccaatgctgtctgccttttgtcagttcattggatatacttttaagaaattttctccagtttaaaaatgatagtagctagtcatctctttcatactgtctcttttctttgacagagaaagatttaattacaattttttgtcatgaggctatccaaaccacttttgatgactgattcttctgctgtattctcctctctaaccttgtcttctggttccctgcagcctgcttttgtacttgaagtcctcgcgattctttctgaggtgttttattacgaacttctcatttattggaaatgagcctcctttcaaattcagcagttctgctcctaatacttactggaaataatctggcttttgagtcaaagaaattcacctttccttgtcaatttggtaatagtctgtttcctcttagctttgggagctaaagaaagagtaatcacttgggcttccaatgactaagtctgtgatatgcaaggaaagaaatgtaaaaatatccttcaaaggaaatgagaaacataagcagcaagtcatctcccttcttcctgttccccaggtaatttcactgccttattatcatctgcatggggctcatttggaggtagggatgaacatattttcaagcaaatttaggttaaggtgggaggtagagaggttctataaagttgcacatcttaggaatgaaggctctgtatagccaggcagcatgggaatgagaatgaagacacggctgaaggtccaggcagcagaggccagatggacattgctttctctctgtctgcctgctgccttctcccatccctcctggactgactcttagcttgttccctctgctactctgtagagcacatggctcatgatttcctagttctagtctccaaatacaacatattcagcttgatcttcctcagaacctggctcctagtttctcttttccaaatttcaagggaaatgaatcaaaaggacccagttttattttctagtttgattatagttcatgaagactatgggctatgcttttttttaggtgccattccagaatcatggccagagtggagtcacttgctctggatgttgtggtgtggaggcactggtcagctgccacaccaaaggttgagctgctcctggatcagaatacagaaccccctttccttgcttgtattgtatttcaaatgccagtttccattggcatttaatgaaatccacttgtggtggtgtggaatcggggtctttttgccaaccttgcagatgaacagtttaaatttacttttgatttagctattgctcaccacagaagaaagttagcagtttattagatgaataagagcatgaggatagatcccaagagaaccaattactgacaccgtggaaatctgccctgtggagatgagctattgtgaggcacagccaccagagcgtgttctggctcatgtgccatcttggtatagtcacccagacttgagcccagacgcacatgcacctaaaaatagatacaattatatgcgatgtgtgtgactcttgatgagcacatgaaaaatgttgcctctccacctcaagtacactgctcctttacctggaggtctgcctattcttgcctctccctgccttttctgattattcaaattcattggtcaagctacagtcaccgtgccctcttgttgagaactctatttcttctcccactggaagggagattctcttcctttgatctctcctggtgatatttttttctattgggagtgtttcatattttgatttatgttgtgtgtattaaccatgtcttctataaacaccctatagatggctccaaatataccaattctctctaccctagcagacatgagggatacactaaaaggcaaagccctcaggagagagttgagtgaatagatcactagcactggggttacaaacaattcacgaaagaggaaatacaaaagactaagaaagatttggaaagctattcaacctccctaatagaagaaaagtgcagaattaaaatagcaatgtgaaaaagaagaataacaaggtaaaagaataacggtgaaaaaaacatcacaactgccgctcgagagtttggaattttgtaaaattgtatttgaaaagcaagttggaaatatgtgttaaacatatttactagcatgttaaacgttaaattagtaaatatttaaaactttcaattgcatagtttcacttctaagaatatgttcaaagcaaataagtggtttagtcatgagtatttgggggtacagttcaatggttgtagggagaagggtcgggcccttctgttttgccctcaggtttgcttaccaagtgcagtgattctctactcagactacacatcatcattgcacgggagctttaaatatttctgatgtccaggagggatgatcgactccttaaatcccagtctctgagggcgggactcatattcttaaatgttctcctgctcattctaatgtgcggtctcggtgaagaaccactgggtattaccaacagacctagatcaaatattcttttaattgatttcaagttactcacctcctgggctccaaatttgagaaaggaggagaaaggaaaaatccacacgactttagcactgatggttttcttgctccaaccttgacattaggctcacttggactattccctcagtggacacaagcagagaaaggaaaggtgggcattggccctatgctgggccctatgctggggagggggaagcaaagaggacaagtagggctgtggtttcatagggagcagtttctaccagggaaagagagggaaaggagatggggagggaggggaaggggaagaaaggggaagaggaagaggacacagttaaataaaccaaattcatttccaatagtggagagtaccgtagaggagggtaagcaggttgacatgataggccttgcctggggcagcagtcagatggggcaacagtgtcctctgatgctgcatctttgagctaagactcactccagtgacaagaagttcccactgtggaaagacgttctgaggaatattgggtgagctggcagagtcagtgggagggtcctgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaagggcaatgggtatcccctagggacatgtgcatttgcaaaacatctctgcttagcttgggccaccgtaacaaagtaccacgaacacataacaaaccatggtctaggtggtgcataaaaaacaccaatttatttctcagaattcaggaggctgagatctgggatgagggtgccagcatggtctggttctggtgagggccctcttctgggctgcagactgctgatttcctgctgtatcctcacatggcagaaagagagctagctgactctccagcctcttcttataaggatgctaatcccacttataagtgctctaccttgaagacctaataacctcccaaaggcccaacctccaaatatcacatcagggattagagtttcactatacggattggggcagggggacaaacagtccattgcaatctttccagctgctgtgtggagtggggtgtgaggggagaaactgatcatggtgagatgctggtgtggggtctcaagtcagggcagggaggatgcggggagcagatagatttgaggtacatttggaggcaaagccatggagttttgggatccttgaggtctccatgccttttttgtgtgtccattttacctttcaacctctttgcattttttggtttttggctttctaaattattctcagctagccatttctgatctttactttttgtccattaataagggattcatttgaaaaacctaagtgaccattgatgccctattagtgagggttctccagagaaacagaaccaatatgacatgcatacatatataaatggatgcatatgaatatatgagagagagacattgagagagacagagatttattataaggaattgcctcatgcaatttcaaaggctggcaagtccaaaaggaaaaaagaaaatctgatgaggtaggccagcaggctggagattcagggataacttacagtttaaatccaaaggcagtctgctggcagaattcctttctgatgggaagatttctgtctttattctattaaggcctttaactgattcgatgaagcccacccacataatggagggtcatctgctttacttaaagtccactgatttaaatattaatcccattcaaagaatagcttcacagaaacattcagaaaaatgttgaccaaatatctgggcaccatggttcagtcaagttgacactataaaattaaccattacaattgtcaaatggaattgctatgggtcttttatttttatatatttgtatttcttttaaaaataaaaaccaaaatgtaatcattacaaaaagtcaaaaaatacaagaaagggaaaatgaaaaataacattcattatccatttatctgagaaacactcactataaacccatgagaggatatccttttggagtgtttttattcatatgaaggtatacaatgtatttttaaagaaaaataggacaatactgtaatactgattgtaaattctcataatttgtttcagcaataatgctgggtttttaattttctccagttgacttcttttttttttttggaaatgaattattttattttatgagtatcttggtaagtttttttattatactttaagttttagggtacatgtgcacaacgtgcaggtttgttacatatatatacatgtgctatgttggtgtgctgcacccattaactcatcatttaacattaagtatatctcctaatgctatccctccccgcttcccagttgacaaatgggatctaattaaactaaagagcttctgcacggcaaaataaactaccatcagagtgaacaggcaacctacagaatgggagaaaatttttgcaatctactcatctgacaaagggctaatatccagaatctacaatgaactcaaacaaatttacaagaaaaaaaacaaacaaccccatcaacaagtgggcgaaggatatgaacagacacttctcaaaagaagacatttatgaagccaaaagacacatgaaaaaatgctcatcatcactggccatcagagaaatgcaaatcaaaaccacaatgagttgacttcttattgttcagcatttaggctgtcccacatttcttgaattacacagaatagaaatttactggcagaaagtgagttcaaatgaaacagcaaaaatgttagatgtttctccctattcttgaaagtccccttcaagatgcaaaagaggttgcaaagttatctcatagctcaataaaatgatctgtacccccaaaaaactcacattttcatcttttcagctaagcttttgtgttgccagttgcttccatcaaattgcttttaggtgaattgctgaagctcaccctgcagtggagggccccaaacaatggacttcagttgat

SEQ ID NO: 528 - DNA, 40001 bp, Homo sapiens
actgtcgaaactaactcactcttcataattttcacaaagtagtctaggtgaaataaaacagactttggagccagaagaatcgaaataaaattctcatttcccaattacttgctgtgctacctggtacaaatgacttggcctgtctgagcctgtctgcatttttaaaaggaagtaacgacacctgcctcatgatacagctgaaaggactaagttagatgaaatgtctctggtcctgagcagggcaccagtggtgcccacggtgccggttactggggtgagtgtcacttgtgttgaactgagcagggggccaagcgccagtcctgggctgtatctgtatctccacggaagatcaaaacgtgggggccgaggagtcctctatggattgtttcttctgaacagaaacagtgtgtgaagtcaagcgggggagccctccctttccagaagcgagtcattgaagaaatgcccctgtgcggactccccacacgttagcactggcggccaggccggcctcccatggagagcccctcttcagagccaccttgcccccatttccccctcaactgctcagctcactggggaggaaggcagcgaagttgtaaaaacttactttttggaaaaataagaattatggggaaggacattaatttaaaagcttttaaggagccaattcacctgtgaaagtgctccccaggtgagggccttcctgtgtggagaacagcccggtctttaaaagcattttaattaatgttgctgagaaacacgctgatggtatttaagtctgaagagcaaaggtaccagccaagagttttatgacgtggtgctagttctcttaaaggctgttgaaataatgttcccgtgcactcagcctccccacttagtgcgggtggcggccaagaggaagtgctggaatcctcggtggcctaaccccggccctcaggacagaacagaaggcaggcggccccggccaggacatgcccagtggaatttcagaggcactttcgggaacacagcgccttcgcaccttctgctcggtacacacctcgaggggtggcagccagctcttggcggcccacccagcaccctgaagcctgaactgcctggactgtcgctgagcaaatgccagggcccgaagaggacctggaagagggcgggtgaggggctgcaggcgtgtggggcctggatgatcccatcttgacgacgagctgggaaccgcagaccggtgtcatcctggctggagatggaggtctctacatggctccctgtgtggccagaccactgtggctggaccagagtttcccgatagcctctgggaatggcagggacagtgggggaggaggtcccaggggattttattaacagaaggggggagagagggtagagaaaggtaatgggaacaagtagctgaaaatatgccctggagagcaggggaggaggctgagcaggcaacttcaaaagggatggaagaaaatgggggctgcggagagttgaagagtgaccccaaaagatatgtccatccagaacctcagaatgtgaccttgtttggaataagggcttttgaggatataattcaggtaagaatctcgggaggagatggtcctggattagggtggggcctaaatccgaagacagttgaccttataagggatagaaggggacacagcagcacaggggaggaggccacgtgaagatggagacagctcagagtgattcggccaccagccaagggatgcagggggctgcgggaagctgcaggaggcgggagggatgccccttagagcctctggagggagcaagactctgtctgcccctggatttcagactttggagctccacaactgtgagagaataaatctttgttgctctgtgttacagcagcccgggggcacaggcacgcagaagagactttcccacagcggttcccagagccctggatgaggcgtcctccaaaggattatgtcaccaagtttctgcaggtgatgagtttgggagctgttgggtcaactgaaggtcatatatgtgagtgtgttgcaaatctccagggggctttagaatgtggggttttctcaaactgtttaacaaggcggctttgtttccacggtatgtctccttgtccttgtgtttctcgcaatgtcccttgggaaatgctggtctagaccaccggggtcaggggctcggggagggagggcactgcagcggaacgagcctggactgggagtcaggaggctggcccgcccagctctgccggtgacacggaagtgactctgggcagcccctgatttttcttgactccactgtcttagcctaggtcctccagaaaacagagccgtaaaccagacttcccacatcactgctttagtgggatggtgaacccagggaaggagtgagggaacagccgggcgcggtggctcacgcctataatcccagcactttgggagccgaggtgggcggatcgcctgagctcaggagtttgagaccagcctgggcaacatggcaaaatcctgtctctacaaaaatacaaaaattagccaggtgtggtggtgtgttcctgtagtcccagctactcgagacgttaaggtgtggggattgcttgagcccaaggaggtcaaggctacagtgagctgagattgcaccactgcactccagcctgggtgacagagcaagaccctgtctcagaagaagaagaaaaaaaaaaagagtgaggaagcagaagtgagccatgatgggagaggccagagctgccccatccagctggcccagctccacaacaacctcagctggttgcttggtccttgggggacgcctgcatcgtggcaggaccaagcacctgcagctgcggcagcaacagcgggcagtgtatctgctgggggccggccactgccctttgcctccttctgccctccatattttatcagccatggtctggcccatgggatatcgactgccccctgctcctgggctgtgttgcgggctgctccagagcctccggggggcccatccaaccctggcacaggcttagtagtggatcctcttccatagctgtcataagaggggccctcaattggggggtggaggccgctctgacagcagcaggtgagcccagtgactatggattgctgtgagctgttgctacggttgtctcgcctgggatgagcagccgaggtgggagggactgagtaggcccagagaatgcagtgactggcccaggacagtgtccttatccctgaattatcaaggtgtgagaggagtctctgggctccctcctggctgtagcattctgggagttggttggatctgtgtctgttattgctgccctgggttctggcaatcttccaggacagaaatcaagagagatcaccagacaaagcagcaaagaggacgagaaaactttattttagcttgtgcacaagaggtcagtactacgaaagggaagtgcaggcgggccactccctgagagtagtctgtgggttaatttcacagggaagggtctcaccaggccacgcataggaggggtttctccagcagctctacatgcttcttcatacatcacatgtaacatttgcattttaaatctccacccctagacatgatttttagcattaaaatgaaggaggggtcactgcatatgttggatcccgggaaagtccctagcttcctaatgcaggagcttctggggtcttttgttgctgattggttggaagctaacgtaagccacagcttgagtaaggggcttttgtcctttttctctaaaccacatcgaaacaggaaacccactagcctgcctgcctcaagtccaccaggaaagtaccttggtgaaggccagaagccctcctgtcttttcttaggaggcgggaggcctccagggactagcacgggcctgcaaaggcacctcatttattcagtggacagataagcactttttaatgtttcatgaagaacaaaatgcaattacctttccctgaaattcttaccaccagctctcacttcccaagagacagcagatctcagtggttaagctgaaccactattaagtacggagccagagggcccaggttgaaatcctggctatgccacctaatagctgggtgaccttgggaaaattacttctctgtgtgcctgagcctgttcccacttttaaatagggatgagaatagtactccctttataggattgtggtgggaattaagggagtcaatgataagtaaatcctttcaaacaggacctggcatgtcctttgcaaatgctattgtaagtatttgctaaagaaatcttgctgatggcactgttttgaagaaaaataaaggttgactgttccagcagtgccctctttccttttgaaggcagaggcagatatccctgtggaggagtgacagaggggatgtatcagtcaggaatgggctagtttgtgtgtggtaacaaacacacctcaagtcttggtggctcgaactccagagatctctctgccattcactcttcacatgttggtgaggggctcaggctgacccagggttattaatccagtgtgtcatgggttgtagttgcagctggaggggtggacacggagtcactctcgggcccttaggaagggacgtgcacacacctcattggtcaaggtgagtctggctgctcctggcttccaggtgcagggaggtgcaatcctcctgcatggccagtaggggcagcagcagacacgcctgtgagcatcgtgaggctaatgtcccctgccccaggtgcccttgccccagctgacctggcctgaggtctgcactgagggccaatggcttgcaccatgacggccctatgccaagggcaggcgagtggtggggctggctcagcagctgtgctgggggctctggatcccagctcccaagcttctcctcatcccaaggcccttctcccactgtctgttacttggttcaggtagctgcgcctatcactggccccgctgacatctccctgctggcggacctcccttgcattccctgtgcacactgcctgtctgataacacaaagcttatccgagcgctttttttttcttaaaactcccaattggctgcgtgatgtgctttgtccaacagggccccccgctgagcctctttgggtctcccagagttggccctgccttccctgagccggaagtatcccgccagcctccctgtgccccatgcacactcactccctgccctgcccactcatagccgccagctccctctggctacgtcaccctcatctttccagtcccaccttctgagcttattggatctcattcccgggcagtcaaacctgggtccagccctcactgcttccatcctgccccggcacggtgtcagacctaccccctggctggctacacactgtgctggagatcacaagaggacaggagactgcagctcacatgctgtcccgaggcccgcatgggccaggtaggcggttggcacgccaccaatgccagctgctggctgagcagttggtctgtcgggttctgctactgcttttctcatcctacctgatgcctgagaaagacaacttttctgctccctgcaataggtaccccacacatttttgaagtgctagatttttctctcttgaaatgtccttcgcccctcccaccaagaacccaagtcttacacagtctgagcgctggggtcattgtgtctgatttccgcaagggctgtaatcagtcccctctgtggtgcctcttctgtcactagggttgctgttcagggctcgtggtctagtgtccaacaggcacaccggcccacccagaggtgaggtgcctcccgggctccactcccaggaggcctctcgccttgttgaggcagcactttccactccctctgcactaagctgggtcaggttcacccccatggatgctcccagagaccttggtccccagtgctgtcaagcccacaccccgccatctccaagcctgatcctcccgggcctatgagggtcagctctgggcaacgggacccagagccacagtcggtcccttttcttacctgaagatttgtgcctgcaggggtcgggcagaatttccttttctcttccccccaacttttcaaacctgcagaaaggttgaaaaaatgaaacagtgaaggctgagattgcccaatggtgagcactttggccagattttctttctcaatctgagagcatagagtttctgatcatgcctttttcctgggcaatggcgcccccttctcaccctcttctaggtcagtgccccatactggtctgaggggatccgcattcccgggacgccagctgtccaggaccacctccctccacgtgcttgtctctgtctccatgccgtgttgttctctccttcctgagttttctttcccgggtgctcagtccttttctctcctcctccccttcttagggacatcttttgagtgttctgtaccaggcagtgtctcccctcactcacttcttcagtcacttccctgtctccaaagggcttaccacctttcctcacttcttttcttctttttataagagcgtccgctgtgtcgcccaggctggagtgcagtggtgtgatctcagctcactgcagcctctgccttctgggttcaagtgattctccctcagcctccccagtagttgggactacaggtgcgaaccaccatgcccagctaatttttgtatttttagtagagacagggtttcaccatgttggccaggctggtcccaaactcctggccttaagtgacccacccacctcgacctgccaaagtactgggattacaggcgtgagctaccatgcccagccccttatttcttttaaaactccttattctctttctattcttcaatctcaatcgatgtcctcacttctaatttggaagacttcgttatcaataaaacgccctcatctcccagtttgcaaacccactggcatctatacccacgcatgcttcctgcctgttgaggatgagctacccctgccaaggacgagcccccttttcacacgtgcctcacctcaagaactttcctcctcagtcacctacatcatcacgttttctttggtcttggatcttgcacattaccttaaagacatgcataacagttaaacacaccttctcttaatacccctcctccttcagccactgcgctattcccctgcgtcccttcagccgctgccccattcccctgcgtcccttcagctgctgcaccattcccctctgtccctttagctgctgccccttcccctgcgtccctttaaccgctgccccattcccctgcgtccctttagcaacatttcttgcaagtgttcctgatcttcctcacctctctccacttcttcacttcccacccattcctcaagccagtctaattggcttccacagcctcagggccactaaaactgctgtcaaggtcagtagtgatcttcccgccagcttcaagggtgaattctcacccttatcccactcaccctctcagcatctttggtcacagccttttcttgaaacctttcctttgcttcaaggacaccccccaccgcagtttctcctctctgccctctcccctccgagtccatgcaggtggctcctcctcctcctccagcctctccaagttagtgtgtcccgagctcagcccttggctcttctctgctccagctatgtccattctctgggagacttcacccagcccgtggtgtaatacagcatcagcacagtgatgactcctgaatttacatgaactttcctcctgaactccaaactcagatgctaaatcgtctactctccatcaccaactcaatgtccaactgacatctcaaacttaaaatactccactttgaatgcttgatttccacccctgaataaaaccccactctctcctccgtggtccaaccacagcaccagtcagctagtgctcagggccacgatcttggagtcagtcttgactcctctttcctctcccacctatagtttccactacccgttgctatgcaacaaactatccccaaatttagtggcttacagcctagcatccattcattatctcttgaatcctgtgggttgattgggctcagctgggtggttctttagtttcttgtggttttggctggagctgcagtcacctggaggatcacctgggctggaatctccaggatggttcacctcatggctggcagttggtgctggctttcagctgggggctcagctggagctgagttcctggtggtcttccatatggcctttccacatggcttggcttctttatgggaagagtgtcagagaatgtagagccatcttaaatccagcacagtcttctctatgaccacaaattatttatatctctcctaagcaaagtcctttcattctatcccattacagcatcagactcaggcttgaggtccaggatctcatctctaaatcaggtccagatatgggtggggctccttggttgaagctacttggatgctgctcctctacattaggaaactacaaagacaatacttgccatagttaaataacagccagtatgtattttctctcatgactctttgggttgattaggcttagccagctgattcttctgttccacttagtattgggagggctgtaattgtctgaaggctgggacattcattcacattgctggaagttggtgttggctgttggctgggagctcagcaagggctatcaatcagagttccctggttctgctccaggtggcctctccatcttggtggctgcattccaagaacaaaggtgaaaactacagatcttagggcccaaccttggaatgtatgcagtgtcacttctgtcacagtttattggtcaaagcatggagccaacccagattcaaggagaagggaagaagactccatcactgtattagtcggttttgcattgctgtgaagggatactggagactgggtaatttataaaggaaaaagttttatttggctcacagttctgcagactgtacaagaagtgtggtgctgacacctgcttctggtaaggcctcaggaagcttccaatcgtgtaaggtgaaggagaagcaggtgcatcacatggcaagagagggaacaagagaatgaggggtgggggagatgccacattttaaaacaaccagctcttgcctagaggaaaagagtgagaacttacccatcaccaaggggaaggtgcgaagccattcatgagggatctgccgccatgacccagacacctcccaccggcccccttccaacacgggggatcacacttcattgcaagacttggaggggacaaacatccaaaccatatcagtcacttggatggaagaaatggcaaagaatttgtagtcatttttaacctaccacatgaactgtcagtaaatcttttcagtttcacattcaaaatatagatgtaattataactctcgtctttttcactacatccacctgtcaccctaacccaaattatcaacaattctagcttggagcatggcaacggcctcctagtgttcaccccacctcttccttgccaccgtacccccatccctacacagcacatgtacctggagattggctgggactctgatggtctcacttgaggtcagagtgtctccaggtgcgctctgtgcacctcctcatcctgggactgctggctgcccagggcgtgttcctctcccggcagaagtgcaagaaccacttacatcctctgctaccctcatgcctgcttgcaccccggtggccaaagccagtcacacaacccagtccagcacgaacaggatggggaagatgtactcctccacggatgagtggagtcatggcagggcaggggaggaagagaagaacgtggacaagcagtacagcccagcacagactgcatttagatttgcttattccagcagtcagtgctatgtcaactatctgatatgtccacacatctctctatatatttccctctttttcatgtctctgtctctgtctaatgccaatgtcacccagtatccatagagttagggactagatacacagttctactgactgacagttttctaggcagcaacaagtatataaactcttgagaatgtttgtgccatttgactcagtaattccacttctacttatttttttttattttttttatttttttgagatggagtctcactctgttgcccaggctagagtgcagtggtgcaatctcggctcattgcaacctctgcctcccaggttcaagcaattctctgcctcagcctcttgagtagctggtattacaggcgcccttaaccttccctgctaatttttgtatttttagtagagatgggttttcaccatcttggccaggctggtgttgaactcctgacctcatgatctacccgcctcggcgtcccaaagtgctgggattacaggcgtgagccaccgcgccaggcctctacttacttatttttaaaaaacaatcagagacacacagacattaacatgccagtaggttcctggcctcgttgttaacaataggaaaaatctggaaacaacttcttcattctcactgcactgcttggcattttccttctgtgtgtctgggttttcttgcaatgtgcaattaattgagtacaggaagaactcctgagatgcagattttcttgatttgttcatttcttccttcacttacttttgcttagtgagggcattttcctgagcacttactatgtactacatgccagatattaaaaagtgttatggagtctcaggaacttatgtttagagtgagggagacttttaataagtaggtaagcagccagtaacatgcatacttgtaatttgtgataaatgctataaaggaaagacaatgcacagtaaaaacgatgggacctcacctaggtcgtgtgctcagggctggccaccctgaggaggtagcattgaggttaactcataaaaacttttcccaaccatagtaagaccagaggaaagcatgaccggcagaggaggcagggcgtgccaaggtcctggggcagcacagacctgggtgtgggggagaagccgaaagggctgggggcagttctgcagagtgatgtccattcctggcaattatcttttatctgaggacacttgcctggagaccctgcagccatgagcatggtccaagatccctgcctcaaggaagggagccctcctaggacaatggaaaacaaaggagcctattttcagcatttggacttcaaaatcaacttttgaaacttcccacatgagatagtatattgataacaggtttttgccgtcttagaaggttaaatttttctgtccccaatgttatgaacatattcacacaataaacaacagttttggaagaatgcaggatgaatgtgaggcagtttctccaccttacaacttgatacacactccacaggctggggagagagagaagattcagagcaaaagcaaatgaaccaggacatgaaaacagggcgtgggtcctgcccaaggcaccgtcttccagagggagctgaagactgtcatggaggccctgcagaggtggaagaaaaccattttataacctcagtggaccacccatttccagcctacaaaagaggtggagaggctgaggagagatggttggagactggaaggaggagagatggttggagactggaaggaggagagatggttggagactggaaggcgattcctttgaagagtgccgtgcagggattggggagcccttccctggaggagggtttcattctgactctggttccagggcggcactggagatgactcccctgcacttgggagaccctgagacaggctggagctgcagagtggggccttcatctgggaaacactgcatccccagagtgctttggggcaggtggagtgcccacgtgcaggccccctaccatgagagagctggcttggagtcaactgacgtcctatccaccaggggccacccagaggctggaaagacctgggcagacaggaactacagatggggccaccagcctagggctaagggagggatgagccacactggccttggccaagagactgagatgagagatccagtaaaggaatgggagggagatatcggtgaactcaccaaaggtgaagccttggattcaagctccaagcactctgaccctatgtccacaggacaggccagccaggaaggactgttcctgggcccctctgtctcctccctcccccgaccccttagacctggcaggagccttctctgcttccatcatcttcctcctcgtacacatcctcaccctgccctgaggaattcatactcattctttgggactgagcttggccatcagttctagagaccttttccaatttctcagagtcaggcttctgctctaaggcttcctaagtctgccatgtttgcctgaatacatcacgttatcctacagatgcctgcggacctgtgcatgtccctcactggattatagactcagcggacagacaagattgcctgtggctggaacatgggaggcagtgacatttactttttaaaagactgagtggtcgaagggggtgtgatgaaataccttcataccattagtaacatgtggcccattaaaatcatgccttagaaaaatatgtagcaacactagaaaagtttccttctatatacaatgctgaatgtggtgatttctacagcagtctgcatttacaagaaggactaaaatgaaagactgacaacacccaatgccagcaaggctggggatgcaggatgcaaacacccttgttgtgggcgagtacctggtgcagtcactttgggaaagttctggtggcttcttattatttgacccaatgatcctctgctaggtattgatccaaagaaagaaaaacatgcattcacaaaaaaacatgtacaaaaatgaccacagccattttgttcatcagtgccccaaactggaaacagctcaggcatacatcactaattacctgggtgcgcaggttggggcatagccctgcaacgggatactcctttgtggaacaaggtgtgacctgttgatacgtacaacatagatggatctcaaactattatgcagattggaagaagccttacatacaagttacatacttatggtccaattatatagtcttctagaatagccaaaactattttatggtaaaataaatcagaccagtgattgtctttgtggaatgcaagagaggattggccgggaagggtgaagtgctattctatggctcgacagaagttggctcacacatttgtcaaaactcagcaaatacacatgtaagatttgtacattgtatataaattttacatcaaaagaaaattattgaattataattaatgctaagcatgcggaggtgtttagaagtgcacgaatatctgtaatttactttgagttgcataacaaagaagatggattagtgcatggctagaggggtggatggatggataactggtaaagccagtgtagttaagatgtgagtggtaactgagggagagtatctgggtagtcactgtgcatgaatttgctgtggttgttgtaatacattagagcaacagatggttgtggtggcttaaaacaacagaaattgattctcattctgtggaccagaagtctgcaaggccacattccttccagaggctttaggggagcatgtttcctgcgtcttccagcttttgctggctgctggcattccttgacttgtgctcacatcaccttttcctctgtatcaaatctctctctgcccctttcttacaaggatactttgtgattgcatgtaaagcccacttgtataatccaggttaagtcccaagccccatcccaagatccttaacttaatcacgactgcatgaaccctttttccaaataaggtaagatttatagggatccacaaattaggaccttagtgataagttttcagctcatctggataaataccaaggagcacagttgctgaatcatatggtaaaagtgtgtttaattttgtaaaaagctgtcaaactatcttctaaagcagctgtattagtccattttcacactgctgtaaagaactgtcagagactgggtaatttatacaggaaagaggtttaattgactcacagttcagcatggctggggaggcctcaggaaacttacaatcatggtggaaagcaaaggggaagcaaagcactttcttcacaggtggcaggaaggagaatgaacacaggaggaactaccaaacacttataaaaccatcagatcttgtgagaactcactatcatgagaacagcatggaggaaaccaccccaatggtccaattatctccacctggtctctcccttgacatgtgggaattatggggattataattcaagatgagatttgagtggggacacaaagcctaaccacattagtagctataccattttttcattcccaccagcaatgaatgggaattcctgttgctccacatccttgccagcatttggtgttgtcagtgttttggattttggccatgctattaggtgtgtactggtatctcattcttttgatttgcaattccctaatgacatatgatgtggaacatctttctatacgcttatttgccatctgtatatcttctttggtgaggtatttgctcaagacttttgcctgctttttaattgagttgcacattttcttgttgagttttaagagttgttctttgtatattttagataatagtcctttatcagatgtatattttgcaaatattttctcccagtctgtggctattcttttcattcttaagcattaatcgattttcaaatgttgaaccaaccttgccaacctgggataaatctcactgggtcatggtgtacaattctttttatacattcttggactcaatttgctaatatttgttgagagtttttacgtctatatgcataagaaatattggtctgtagtttctttccttgcaacgtctttggttttggtattagagtaatgctggcctaatgctgaaatgagttaggaagaatgagttaggaagtattaagtagtattagaatgagttaggaagtattccttctgattctgtcttctggaagatattatagagtattggcataatttctttcttaaatgtttggtagaattcaccaggaaatccatttaagtctagtgctttctgttttggaaggttattaattattgcttcaatttctttaacagataaaagccaatttatattgtctgtttcttcttgtgtgagttttggcagattgtgtctttcaaaaaacgggcccatttcatctgggttatcaaatttgtgggcatagagttgttcatagtattcctttattacccttttaatatccatgggctctgtagtgatgtatcctcctttatgtctgctattagtaattcatgtctcctttcttttttttccttagcatattaatcacagttattttaaattcctggtctgagaattccaacattcctgccctatctgagtctagttctgacgctttgtctatctctccaaactatgttttttgcctttcggtatgccttgtaattattttcttggtagcctaacatgacatcctgggtaaaaggaactctggaagacaggccttcagtgatgtggtgtaaggcatggggagagaagtgaagggagcgtccgtcctatagttctatgagtaggtcttggtcctttggtaagactatgtctctggactgtgaacttcacaagtgtttctcagtttttctctcccctcctagctaggacataatgtgtagagggggttggagctgggtatttcccttcctaggtagttaggctctgctaaaatcccagcaggttaggctctggtaatgtagtttcttctgagggcaggcctcagaatgccccagtgtagtttaaactggttcctttttctctccccctgccagaagcatgaggagattctcccctgatttcattgtgagaacctggtggagctcctggaggtaaaattcacaaaagaggccagggccccctgtgattgggcctgcctggagtttttaactctcaaacttgcgcaccctgagcctctggcaatttgtcatttacagcccagggtttcgacgcaggcctgattcctgcagatgtgtctgctctggtgggctgggattctctgtgtccacctgttttttattttttctttctttctcatagttcaatttttttttattatactttaagttctgggatacatgtgcagaacgtgcaggtttgttacataggtatagatgtgccatggtggtttgctgcacccatcaacccatcatctacattaggtatttctcctaatgctatccctcccctagcccccaaccccccaacctttttttatcttcagtttggaaagcagcagtttgcccggagacctcatttctctggtagacccaagaatagttgttaatttttcagttcattaagcttttcacttgttaggataaagggatgacttctaagctccttacgtgaggaaaaggaaacctgaattctgacactattttaaaatttaaaatagtgaatagaaaccagtaaccatggaaaccactttcccccaaatagatggacttgaccaaaaaatcatcatacaaaatttatttttctatgatgagaatgtgttatttctataaaaaacttgttatttaaatattaaattttgagggaggatcctacctttgacccactacttacacttttatgtatgatgctaagcccagagcagggccgggacctggctctcccctcacccttgagaccatgctcctttctgagagggagaataaaattcatgtaaagggagataaacttcatgagcaaagatgtccacagtggtcagtcttcaagaatagtctggaaacaccgtacgtgctctgatgttagaacagaatgagggcagccgacgtgaaacctaggtttaaaaagagtctgagagcaacatggaaaggcaagacctgagcttgtaaattcagtgtttcaaagtttcatagattccaaattttccataatataaatatttgttacatttatatttagaaaacctgttataaaatgtcactgagtgaaggccctctaatctttttgccctgctcacccctctagtggtagccaggcccctgccctagagctgaacctcggtgaggctgaactttcctgcattgtgttggctcccagctgagccacatgtagttggtagctgatttttcggtcaggttggtctatttgggggaaagcggtttccgtagttgctgggtctaccctccaggttcccttgttcagctcagcaaagttcctcatttcctgccactgcactgtcagcccggctgtcctctgccccatggcatttacattcttccaaccagaaactacaaacagcaacagcaagaagctgctttgcacaatgactgaaaagccacgagggtctccccgccaagacgagcaggctggtggggccagccctggagtggtcaggcggcagggccagcgcggggtgtccaggtggaagtgcggcagcctctgggagatgggagctgctgggggtgcgctggggcggatgaccacaccacgaggctctgtgcactggcaggcccagtccccgtcacatgcgggtccaagacactccacggcagcattcctgctttgacaacacgtttcccacttggagtgaaatcagtccgtgaaaatctctgcctgggactgcctgctctctgcccaagtgcagcagccgcagaacaagcccgattctccgagccccgtcagccgtccatgtgaatcctttcgaacatgaaaaggaggcgcgctggcctctggcttgtgtcttgagcctttgaatgagcaattcccctgccaagaacgtgttctgaatggctgttttgtgtggtgggggatagttctttgcagattcagaatctagatgactactaacgagcgtgaagcgcctggtggttttggaagtaagccttcccagacttcagaacccacgtgagtcccccgactacaaagagcatattttagctgctgagtgagggagcagccagtggaatcccatggccgtgtgttagtctgggcttccctgaaaacagggaagggagacttggatgcaagtggtttagttgggaggagacgccaggtgaggcttgtgacctgggagagagagcagggaggagagctgagtgggaggtcagtgagcagagtcctggtgtggtcattgggactcagccccaggatcctctgaggaactgttgttcccccaagggactctaaagcaggctgcatgcttcattggctctggcgttaagtccctggtacttctgggctgccctacggagggctaagcagttcctttggccagagaaagcccccaggcagggagcagagaatgcaatacgtagcattccaactggttcctggatgcaaactcgatcccccattgcatcaagctggtgtgccacagagcacctgccacgtgtcgggcagggtcccagggaccaggaatgtcagggagcaggagaccgagcaagcatgtttcttggcgcttccatccagaatatagtaaatatgaaaatctcatagtatacaacatggtaatgagagctacagaaaaaaggaagagcgagggtgggtgaggcaggggtactgtgggggaggggggaccaaggggacactgagaagtggacatttgagccaagacttgaaggttccatttgagggccatttgggcagtggctgttggccacgagaaccatcaccaatgtggcatctcctgggctgtgcagggtcacctggtgccatcgcaggacctgctggtcacatcagagcttcctgctgcaagtggggccgggagcctgggcctctgatgcccacatggacccatccaggacttggcccacccactgagcaaacccaggcatctcttcctggtttcaacgagtcatgcacccacctcgaagactcctccctcttttgtcctctcgcggagcccagtcacaagagagttcaaagaaatcggcaggtcagtcagtgggtgggcaggtagagactctcaagattaatcagagaaatcgcccactgaatgggtgctcttaggtctgtgccaagggcttctgtaacaaactgccctgacctggggtcttaaacaacagaaatgcatttcctcacagtcctggagaccagccagtccaaagccaaggtgtccacagggccacgctcttcccacagcctctaggagagaactggttccttgcttctcatccagtttctggagatgctgccacccttgtggtcctaggcttggcgacatgtccaccctcgtggtcctaggcttggtgacgtgtccaccctcatggtcctaggcttaggtatgtgttgctccaccctgcgcctctgtcttcacgtcaccttcccttctctgcatctgtctccttctctttatgaagcctcctgtcattggatttagagcccaccctaatccaggaagatctcatctcaagattcttaattgcatctgcaaagaccctttttccgaacaagatcccgttcacaggctctgggcgggcatatcttttagaggccaccattcaacccactacagcctgcatgggagactgagaaatgacaggcttttggggacaatttacacttttaagccacatattatagtaccagctttcctgccgcaggtggggctgggagtctgggtctctcatgcccacatggggcccagccagaacttggcctactgaacaaactacaaaaatctctcttcttgtttcaatggataatgcacctcccttgaagatccatcctttatttgtccttcagtggcaccccatggcaattgttctgaagtatttactgacaaaatatccctgcctgttggttcatcttccagcttgtctccataagtgacaatgatttgggtgagccagggtggatttctgcaggctcctggactcaagccttcctgaactcatcccctcactctctctcccaatctcagcctgtgcatttaggtcctgccctggaatatggtaagatggaagactttcataatttccgatgcactgcactgaatctgggatttgtagcctatactagcatcctttctttaatttaaacgattagcgtttcaaatgtaaccaggaactgggcaccacgagataacccctgactatgactactcagccccttggagtttcccttaaggggggaatggggtgtagcagcagagccctgggattggaggcctctcctggtcaagtgtagtgagggtcagaggtcatgtgccaggtgtgcactatggagggacagaggcatcaagaggcattcatgtccccatcctttggtcgtgggggcggggggtgggtggtgtcctgccccagggtccttttgtgtagggacaaggcatgtagctgtcacacaacggtaacagaagagtggatgactggccaggctacccccaggcagccactgtctgaagttttctatcctagagctttgaaaacccaaattcctcatgccaagctcagcttcagtgatttaggaggcagaaggcagactgtaccccagtctgcatatgtgctgtttagggctcatttaggacccccaggaagtgcttcttcagtgagaggattctaaatagctcttacgttggtaaaacttttacagtaaatactgtcattagcatcctaagaatagtctactgtctggagtaaaagtccccaaaccaacagcccacatgccagtactgacttttggccaggggccatgtaggttttagttctgcagacccttctcagggccaccacagggagggcaggctggcttcccacacctggcagcttcacctggaggatagggtgccaagtccccacccataggcctatgctgtccagcagggacgcctcttcctaacccgttcacaggccgttttgcctggcagtgggcgctgccaagctctacctctatactccccccttactggaagcacagggcaatcggggaagccctctaagatccagcaggtgaccctgggccctgttttggggtctgggctgggctggactacagggtcaccaaggaaaccaggagcagcccttgcctcagctcagctttgtcctgaagaagggcctgccctagcacctgggggaggtggcagctgcatcatcccagaggggagggcaggagtgggtgaccctgagctccctggggggctgggagaggactggaataagcagttctggatggagacccgccaggcccgctcactgtgtcagctgaatttgcaggtagatggacacctctgtgtggccagaggccctgaccgctgagcctggcccaggtcctcacagatgctccgtttgagcacgggggtatagagcggggaggcttgttttgcagactggaccaggcaaggaggcaaaggttggcttctgcaggtctcagtggctggctcagaccccgaggaatctgctggtttgtcactgggccctgcactacactacccaacccccggggtgtcagaggcaggctgggggtctgtgtgctgatccacttctagtggtctacaccagtgttccaactgcttcttcttctcctgcttgtgagatgggcagttgatatcgtgaggtcaagaagcaggaccgctagccccagtggcggcattggtgatggcaggggcagggatttttaacttctgtgcacctgggttttctcatctgtaaaaaatagagatgacaatttctgctttacccactgtatctatgtcaaacatgcaataaaactgtgtgttaatgtgttatagaaatgaggaggtgctatgaaagcgcactctagttagagaccaagcctggatggaactcaggcttttcaacggtgaaatgggaaaagtctttttgttatttaattctttgatgatggaataggataatttgtgtgatggcagctaatatattgaaggtgcttctgcaatatcaatataataataattttaaaaagtgttgcatctccaagataatgttttggcttgtaaaattttgactattatatacgtataagaaaaaacacaaaatagagatttaagcaaaaatgaaatattgtattattcacagataatctataatgttttgttgtagatcttttcagattttttcatatatgtgactataattattttttacaaaaattggatcaacacatattttcatatcatttttatttttttgcttttatttttattttctttgagacggagttttgctcttgttgcccaggctggagtgcaatggtgcgccaggctggagtgcaatggtgcgatcttggctcaccgcaacctccctctcccgggtaccagcgattctcctgcctcagcctcccgagtagctgggattatgggcatgcgccactatcctggctaatttttgtatttttagtagagacggggtttcttcatgttggtcaggctggtcttgaactcctgacctcaggcgatccacccgcctcagcctcccaaagtgctgggattacaggcgtgagccactgcgcctggcctcatatcatttttaatgcttgcccagaattctaattctttcttattgcatatttaggttgttaaaaattttttttaaataataatatggataagaacctgcttgtagctaggactctgtaattgaaaatcaatcaggtaaaataataaactagaagtagagcagcccagacacgatggcgaaaccccatttctccaaaaaatacaaaaaggttagctgagcgtggtggtgtgtgcccgtggtcttagctgctcgggaggctgaggtgggaggattgctggagttcaggaggttaaggttgaagtgagctgatatggtgccactacactcccgcctgggcaacaaagccagaccttgtctcaaaaaaaaaaaaaagaagtagaaacgttaggtcaaatgatgtgcattttttccggttgtgataaaatacacataacaaaaatttaccatcttaaccattttcaagtgcacaggtcagtggcattaactatgaatacagtcacattgttgcactacccttatcgcactccaccattcctccacagaggagagctggcttgcttctagaatgctcatcaaatgcctggcactttgccagggtttcacatctctttgcattttggacagcagagattctgtccccattaaacactaacttcccattccctctcccccacagcctctggcaaccaccatcctaatttttgtctctatagatttgactcttctagatatctcatataagtggaatcatatagtatttatttttctgtgacttacttcacttggcataatttcttcaagtttaatcatgttgtagcatgggtcagaattcttctcctttttaaggctgcatactattccacttgggtggcgtctaccttttggctgttgtgaatagtgctactatgaccatggatgtacaaatatctcctcgagaccctgctttctattgttttcgtacatatccagaagtgaaattgctgcatcatctggtaactgtacgtttaattttttgagggactgccatactgttttccacagcagcaggaccatttcgcattcccaccaacagtgcacgagggctccagtttctccccatcattgccaccacttgttattttctgttgggtttttttttttttttttgatagtagtcatcttaatgactgtgaagtgggatgtacatatttttaaggctttgaaatcaattgctgaactgtacagtagaaaggtaatacttggcacttttaccaacaatggatagagcactatttccaccgtccctatgaacgcagagtacccctgccagttttttgatgagtatttgaaagaggaagcgtgcacgtggtgtggtaaacccagaggactgtgcctacctgcccaagaggaagacctgggttttctctggctgagaccaccagctgactggccctctcaagttttaaaatcctgcgtttagatcaactctgaagctcagcttcacgcattacctgatgtggccgatataaaaagagaagaatatcagatataaagaaaccgtatatttacatacaattagaagcaaatatttaatgcaagcaaatgttttataggaggtgagagaaactcctgtaaggaccagaaaaataagctgagcactcccaggaaacaaacctgtgtctcaaaatttggtgttagcctttgatgggaaagaaaatgaatcagtttctgcttttcctttgtttcatttctattttttttttttttttttttgagatggagtctcactctgtcacccaggctggagtgcagtggtgtgatcttggctcactgcaatttctgcttcccaggttcaagtgattctccaacctcagcctcctgagtagctgggattacaggcatgcaccaccatgcctagctaatttttgtatttttaataaagatgaggtttcgccgtgttggccaggctggtctcaaactcctgacctcaggtaatccatccgcctcatcctcccagtgctgggattacaggcgtgagccaccacgcccggccctttgtttcattttcgaatttgaattatgattgtagggctctgattccccaaaccttcacaacttaaaaccaagtgcccatctcacgtacccctcctcccccagcagccggggcctccctccctcctggccacactctgtggcacgaccctctgagcgtggtcttccctgttagtggggcaagccctggaggcagggtctgtgtcttgctctccaggaatggcctgaatctcctcaagtcctagcccaaaacgtgattcacaatcttggcttaaggtaatcctaatgcttctagaatgttcttcaaatgcctggcactttcccacctaaattatcccattccatcctttcagccagcttatcaggtgagcactactattcctcctattttatagatgaggacgctgaagcgcagagaggataagaaacttgctcagtgacacacagctggtgagggggatctgggtttgaattcacaccttcgggctctagtgtcagtgttctgaacgtacacccagcagtgcctctgacatgatgaacggatgagacgttcagtgaggagggagagcaggcaccaaaagcctgtatcggctataaccaagtaagagcagccttgctaagtagcagtcggtctagaaatcagttctattcgaagactcctaattgggcttttctgggtgatgataaccttcttggtaaaactgaaccccaagttctttggcctggttgccattccctggctagcaccacgtatttacgcctttgtgccttttcacatgcctcggcttctccttggaaatcctgttcatatcacccttttcttctgcaactgaaacttgctatttgtcattctgggcttagctctgatttcaccagttctgtggctccattcttagccatcgcatcccttctcctctccttggtctctcagtcacgtctcctacctcagttgaaattcttcccactagtcttgagcgtaaattagttcaaccattgtgaaagacagtggggcaattcctcaaggatctagaaccagaaataccatttgacccagccatcccattactgggtatatacccaaaggatttccgataaatcattctactataaagacacatgcacacctatgtttattgcagcactatttacaatagcaaagacttggaaccaacccaagtgcccatcagtgatagactggataaagtctacccctcttccagaaagtttgtgaataacccaccccttatttagcatataattaagagtgggtataaatagagccagccagcaacccacaagtgctactctgggcccctctgcctgtgggatagccctgctctgccaatgaagcagccatcttgctgttcactacgctatataaacttgctttctttcactgttggcttgctcttgaattcttccctgaatgaagccaagaaccaactcaggctgagcccccgtttttgggtttgcctgcatcacctgcagtggagatggttggttgtttaccaaaatcatttctcccttctctctggacatactgctggactacatttcccatccaacatgacaggtgggcacggcctgacgactggattgtccaacaaaacacagaaagtgtagacaagagaacagcagaaagtgacgcctgcagccacagagatgtgctcccagtctccctcttttctgactgctgggggtgcacaccacagcgaggcccaagggctgtgatggaggcctaggatggaaggtggctggtccctgaattacttctaggagaggcaccatctgctgagcaggaacccctgcctgggacagttgcaagaacaagaaatcagctccttttgtgccagaaccagtatgcatgttgaggtccaatcctacagttagtgatgtggtaacagaaatgagctttgtgcttccatgccctgggcaactgcaggcagctgaggcccccatctgcaggtggtctctgcaggcagagggtttctggtgaagggccctatggggtttctgatgagggccccacagaaaccagaatctcttccctgctgcttatttcaaattctgctcggttgtcccttccaggccaggcgggtaatcttgcttgtggccacactcctcttcctgggacctgagcctgccctcctgctcctgagtagttcattgtgatgctgtctgctgtggctgtggagtgctacgcgctggccagcctgagggcgacctgtaccgccttggccaaaccctttaccccactgagagatacctccctcatctgcagcgagagtccctaccttgtagggcagtgtgaaggatgtcctgagatggtcaggacttagcaccctgtaagcacaagagctgttcttggtggcgttatgatcacacccacagatagggcctcaggcaggcctcagtgtcctcctggctggccacgtgctacggatgtccccatgcacttgatgtgtcagcagcagaaggaccttcaggaggaggcaacgatgggatgagacgaggctcaaaggaggatgttgccgcgcagagacgtttcgggaatatgaggcaggtcaccacctatgattcttgtggtagtggaggaatggtggcggctgtcattgtgacacccactttagagacaggaaactgagcttcagagagggggagtccaggccccacagcacacagccaggaaagggccgggcagaaggggctttgggttttaacctaactcaccccgactgcctgcttcttcacccagccatcatggaacgtctctgtgcctcttccctgctctcgtggaggcctgggtcaggcagctgcccagaggcagacgtgcactgtgaccctagaagactgttccagacaggccagcccaggcagagacaaaacagggacctgctcctcattggtgtcacgaccaaatgcaggggatttgctaagggaggcgcagccatgaattgggagccagcttcgtgctctgccactccttcttgctaatccctcgaaaatccaatcagagctgtttccctccatgaaaccaactggacacagcacatactggccggacctctgccagcatggagtggatcttttttctgtttaaagaaccaggtttcaaatgttcttaataaaacgtttatatatatcatgcagggtgcaaataaatattttaatataattggaagaatgtagagaattgtaaaaagttatggaagttttacttctgattggccaagactcaataaactctggtttgatgtactctaatttataggcgtgcaaagccaactctttggcatcagagaggccgttaacgttgtaatgatgtttaaacgctgacaaatgagctgcttgggcggcaccttcagccctgagaatggaactgttggagctggaggacttgcctgtccccagctttctcccttcctcccgtgctggtggagcaggttaagggcaggaggactgttcattggggcgactgctccccatcggttgaggggagggcacaaaggggacccatggcttctttttcactgttgtccctaattatggtctttctcattaaaataacaaggaccatttctgctagaaacgctgacacatgtttttacttttctgggccgatggaaaccacatgtagaatccattccttccttttttccctccaaaatgcaaatggaagagctggtccagggggtccccggttgcccagccctgaacagaggcttggggaagccccctactcccacgccaagacgtgacttgcgcttctctgggcactttgtgccagccctaccagggagtgctgccccgctccccaggtctccctctgcttgctggcactgggcactcccagcaggcataacccgagcagagctgagtggttatttataaactctcttgaatgccaaagcgccaggaacaatccattccccccgtttgcaggaacatactttcagcataactcatcactttgaagatgggtccaaacttttgttcacatttattgacaggaagttgtttttcaaagctcaagtcagcaggcaggccccgggccaagaggctccgccacctcaagctggcgcggctctgagggcccataaattgtgttagcctcccacccacccctctctctccctttttccgctagaatttgcccagaggttgaacattacgttttccctttgtaaagtttcttcttaaactttttctttctttcttttttttttttttaagagaaaatcacctattggaagtgttaagaggttcttttcctctctgaaattctaaccctttatggtgctcttgaacttcctctttcccgcataagccactctgagccctccttactgcatgaaatttctcggccaagggtcctccttctcatccccctacttgagccttgaagcaagaatgtcctcccgggctctaagagctctgcctctccccaggcctctctcccctcaactgggaatcaggaatcctagggcaggttgtcccaaggcctggaggggccatcaggcaggaggactcagtgatgtggggtctcctgtggcttcttagctctctactcaccccacacatttaccctttggggctgacctgggtgtccatgacttatagatctaatcctcccccaacatcccactaatgttcccaaattgtcccgcccccagtgggacccctccattcccctttaaatagactcttctccctacagccctgagctcttccagttaccccaaccagggacctgggggtcatcccagacctctcccagattcctgcccctggttgggcactgagtcctaagtgtttctgtaccaaatttgtcttcctaccccttcaccactgcctggtttcaggccctgctccattttcggggtcactcccagacctcggcaggccaacttctctgtgtcccagatgccttttctgtaaatcggggcaatgtcagtgcccaccccactgcgtggtggcaagcatttcatgggctcatgtttgcaaagcacgcaggatggctctgggcatcttaagtgccacaggttgttctcctgctgccgcttttcttgggtctctgggtcaccctgtcactctgagtcagtccattccttatgcagccaccgagaggaccttgaaacaatgcacagcacattctgccatgcctgtgcttgaaccctgtgcccgctctcagttccccgtgggatcccccatccctggctctgcctgtctgcctcctgtgccccgctgtgtccaggggctctggcctttggagttggccttgttcctttctgtttctcccctggtcattccctccctctccttccctgtgagcccctctggaaggtgttcctgaccctccactgtcccttctaccctgtcctggctcagaggcccttgcctacccccacacaggcgtgccgtgtactctgccacgaaagctgcaattctttctcacgatctctgtgttttcctgcgtttggagacagggtctgtgcctcagggatctctgggcccacggtgcccagcacagattatgggcatagtaaataaatgctcatctaaaacgtgtgaatgacaaagaccaggagacagaccatggcgcatgcgtgagttaggaatttcccccatgacgtcacctctttgactattctgattttgtctagtgatgggtcaatccattttttggtttttaaccttgacaagagcccaaataccaaaatgaactgtctctgtgtactgatatcatgtgaaacttttcaaacccaggaagcattggaagctcacacttttagtgggaccagggaggagaagggagagagggacatgagggaaaaaggtgaatgggtccattttgtcttggaagaaataggaaacgcagcagtccgtggaggagcctcaggggcccaggtgtggaagagagtgcatgaggcttggatctgcaggggtgctgccccgcgtgggtctgcccgggagtcctgaagtccttgctgctggagaagaggggttgttctggagctaatggcattggagcagtgaggtcagattgcagggactaggcacagccagtgctgggagggctttgcccttcccgcggctttgtgcatttgttttcaaatacaagtaataagactctgggctgtttggagccctcactggagcccctcagaccaggaaaggaagagctgccggaggcaacggatactaacccaagctagttgatgcctaactaaacacctgcatcttggtttgtttgtgtgggaagtgatggttggaccaggtggtctctggcaccttgtgggggtgcctcaccagctgcagggcagggctccaggctggcagagcctgcagatgtccccaccaatgctgtagcgatgggctgccacggatgctggggcagcagccacgatgagagcctgggggttggcctccttggggtagcctggtagctgccagccctgagtggcaagaaggtgcagtgggctggccctgcaccccactgctctcctgtcccccacatgcctcctgctgggggtctcgaggctcagcagcggcactgacggcctccgcaggaccccctcctgccttctcacactgggggcttctccactcctcttttcctggtgcgtagcgtcctgctctctggtccctttcatcgccttggggggtgttccctccacattctcaggtggaagtgtttaaggccagtcccacagccacccctctggatctcctccaccccagcgcggtgccccctgcaaatggggcccacatgtacagcaaagcaggatgaggcaggccccgcctgccaagaatgtggcgcagcctcctgggcatgggacattgaagggagcgatgcatgcaggacagcgtcctcctctgcctggagtccatggaggagacctcctcggagtgggaggctccgcaggccgccagatgctggggagggcgctgggaagctgggaggaggtggcgggacgtgggtggggaggggctccctgttggggcgtcccgtcctgtcccaggggctgcgggagtggtcccaccatagtggtctcaccttggcccaaatagaggtggtgtcacccaggccttgctggggaacatggagcttggggtccctgggacaccgcggagggtccacgtttccccgagtccatcggcaggtgtggacaccgccttttccttcctctcgccttctgcttggctgtctcttgagatgactttagaaatgtaacaccttgagaacactgtatgttcacttccctttgagcctcatgacgacctcagagaatgaacgctccccccacgctggaggctcgggtggctaaagccgtccccgggtggcgatactgggtgggcctggcgcccgcctggtcccctgtgtggttcctggcttacttcccctcctcagtgccacgtccatctcacagactttttttttttttttttttttttaaactggtagttccagatttgggggcaggaggcagtgatttgggtgtgaaaatccgctgagctgggattgaacatgatggggctggagactctcaaatgggacagtggctcgtcctaactcagagcccagcccacacctgtccccagcacccagcacccagcaccgtgcccccagcgcttaccccatggagggtgggaagacaggtgaattagtgtaggaaggaataaggaggagtcccgttcagtggagagcaggctgtgcgctaccccactgtggagaagggttgcacaggcacctccaggggtatgttctggccactccgtgctgcaatcttggggctgcctgcccatccctaacatgttagactcagactcactgctcttgcatcgtgccccagcctccaaggaaaaccagccagcaaccacagcgccggttctagggaccctcctggatcaggcccacgtggttactgcccctcgggcctcagatcagtggttctatccccagctcacctgtccctacccgcccgtggtctgacttctgcttctgggttctgctcctcctttgggcctctgatcctcctttgggccttgccctgcaagctgctttgctctggttggtctctgagaggagcccctgcccctggtccagtgcggaaggaggaggctagcagccagcgctttcccgcagctcacttgctgtctgtgggccgacaggaagttcttcatggggaaagccaagaagccaagactcacatagcaaagcctccgtttggaagccggtgttagtcctttctccttgaggagcagtttcagtcagtgcatcactccaaatgggtttggtaacactgagcttatggtacaatgaaaatcactcttgccaagagagcaaatgcagatgaaaggcagggtgagtcacacgggctctccatgtccctcttgctgcacccccagcagcctttgacacaggagccagccacagacagtgctggaccccagcacgttgccccagactatgcaatgtccaatttctccaggcctcaccttctaggacccacttcccgatgcctggacatctcattgttcttttctggtttacttccaagctctggggaatccacccttggctagcatcactcagaaattgcacaactaccattttaagacaagattttaagagctgtttaatttaacttttaatgttggttaagctcctataggtagtgtctgggacagtgtagcagcaggagagcaaattctggcacctacccttataagaatttatgaacagtgttttctgctaaaaatagtaaagttctagttctgctgactacataacaatgaccagggcaagcaacttgcttaatcgcctcagtctcatatatttttttttcactcgtcagaggtggacactcaactttcataagataagtggcatgaaaatgctctttgagctgtaaaaatattggctgatttacaaatgactgttttgacgaaggtattggaaagaacttttattagaagacagtgagtgcttccacaggcactaacctctctggtgttttgaaaatgctccaaagggcaaattctagcactgtgaaagatttgagagacggctacctcgttagctgttctatttcctcattattatttttggcatctcagatggccactgacaggcataaagagattatttctcccatatacccatctctttttcaggaattaaaactatagaaaatctcagtggcaagactggggcacaggagccagggaatgggatgagaaatgttccttgcaatgccggaagccctttcccgaagtcacacattttcatgaataaactagggatgagttaagctggatgttagagttggatttataatgtatgaaatagtttattgtaaatgtttattttaaacctcagttttcagcagtctgatgaaccagatagcctgagaaacatcttgatataaaatgtctagggatgttggctaaaatacagcagtataataaacattgctcttgaaaagataagggaaatcccttgtggaggcccaaaccaaagaggaaacagaaaccagaaatataagataaccgatgctagggctatgctgggggaaggcatgggatggcaaaggtgggagttgaggttactttgtatgtctttttaactaatgaatttttggattttaatggccatgcagaaataggaaatgaatctttgagcccataagaggctggaaattagaactgagtttcctatacaagagttgtcttctgcctttgaagaattacacttccaatgaaaaggtggaccagaagaacaatccagccattggcacagggaaataacagaaagcctgtcaaccttggcctgattctgagtaggagaaaatggttgtccttgagaatttgtatgtagtggctatcctcaggtgtatttggggtgtgaatttatactatctgagtgacatggagcccccaatctgagcaatttagataaaattaaccctggagcacctggcaggagaaaacacaaaatctctgtggatgtacacaaagcattcctacagaaaaactgcaatgaagatgagctcacaatccaaaagtgccaatccaagggagaaaaataaactctgagcaagttcaaagatataacaaacagtgggattaaattcctaagagcttcaggcaacaatattatcaaaataaagattatgagatagaattaaagacacaatggaaaattaaaaaaaaaagagaaaacagcaagctgccaccaagggaagacaaaagacagggaagatttgaaaagaacagaaggaaatatataggaataaaaatatagtgattgaaatttaactaagtctttaatggttaggttaaaaagcaaattagacataactaaaaggagaattagttaagtggaaaatcactgtgagcacatggaaataaagagacaatttggaagcaagattaatagatatggagaataggacaagaaggtctaatagaagcacaataggagttatagatggagagaaaggagagaatgagagtgagtcaatattgaaagagatggtgactgagaattttcaaaatggagaacagttctgagctctcagattcaaggaaaatgtagtcctaaatattagggtagacataaggaaatgcatccctggatagattagagtaagctatgtaagaatgccaagtacaaagataataccttaacagtagccagaaatgtaagatgtcctatgaaggaatgacaattaatttggctgccacttctcaatgatgaccaaaggatagtggaattatatcttcaaagtgttgagagaaaatagaattttctacctaactaaactgtcatacaagaattagggagaaaggatgaaaaacaaagcattagggaatttataactaacagagtcccagctaaagaacttccaggaatgcactttatctggagaaaactgaatccagaatgaagaagtgaaccgaaagcagaatggtgagcaaataaattagtaaacatatggataaattggaacaggattgacaatggatgacaacaataatagcaatgacatttcacatgtataaaaacacgtaggacctgaaatactggattaagtatcatgtaagttgggaggagagtgacccaatcccctagtaatatgtaacgtgggaggataataatctagaattccaaaatcattgaatgatcccatgaacaattgagttaacttgagatcttggaatgctgagtacacatgttaaaattttaatcatgactgctgggagttggggagcgtgataaaagtagaatttgtaattttcaaaacagtaaaggaaaaatgagaaaagaaactctttaatcctattgaacaaggcggcaaatgttttctgtaaatggccagatagtacatacttttggctttgtgtgccatatggtctctattgtatctattcaactctgctattgtagtgcaagagaaaccatagagaagatttaaacaaatgagcatggtggtgcactccaattcaacttagtttataaaaatagcaaatgaactggatttggcctgaagggtgtaatttgccaatccctgctatagaagataggaaaagaagtaaaaagctagaaagatagaaagcacaaattaagatggcagaaacaattccaaataggttagttaactacaaaaaatgtaaacaaattgagttttctgaataaaaccagagactgatagattaaataaagaaaaaaatgactttatgcttttagcaagaccaattcttaaacaatatggaaaacagaaaggtgtaaagtaaaagtggagaaatagatgtgccagacaaagattgatgaaaagaaaggttattaactatattaaaacacaaaaaaggccttaaagtaaaaaaagcattagtcaggtctaaaaggattattttaaaatggtaaaagaactagaattcactaggaaaaatttataaacttagatacccctaaaaatatggcctcaaaatacataaaacaaaatttgacggaattacaaggagaggtttataagtctacccttacagtgtaacaaagtaagtgtatggatttttaaaatacaaattaagaatttatatctaatgacatatagaatgttatacctaaaaattaataatgcatattcttttcaagtacaaatgcaacagttataataatcacatattaggtcataaaatacaattcaacaaatattaacaaaatgggatcatgcaggccatgttctctctccactatatattgttcaagtaaaaaaattgaatgaagttatacatttggatgttttaaagcatatttgcaaataagtcatgatccaaagaagaaatcataataaaaaagactatattataggctgaatgataataaaaatgccatacatccacacttgtggaatgctgttacagtaatacgtagaacaaaatttatagccctaaatgcattcattagaaaagaaaaaagactggatactattaatctaatagaaattaaaagaacacaggataggaggcagaactagcttgcagttccagctccgatggacagagcagggtgtggagacttggatcatcaacttttgctccaaaacgactactgcaggaatataccaggaaagccaagagagcccacagaccctctgaaggaatcggattgctcctgcgggatctgggagacagcccacgtattgtgagtgtctaagctgtgacagtggaaaagtgggattatctgtccctgaacacacaccctcactggggaagctgaaggtctagatcaggggagaaggatttaaccttacttggagctgagtcaacttagagagccaagtgaaatacaggggtagaggaagcagtgggaaaagccctgtgggctctctggggtccccagggaagccatttcttacttttctcacaggtgtccttggggaggctgccagaggaactgggaaaagaccacagggagaaggaaacctccagctgaactttgtaacaattccaaccaaatgtgaagtctcctggccagaactcaggggagggcataaatcagatgtgcagatgcgacaggtggggaggtgtgaaaattctacttgctttctcatatgggaggctggtaccctggggcaagttctcagccctgctgctcatcgcctggaaacaaactcagtgctgttggggctgaggcacggtgggagtgggataggccttttgggttgtgtgggagctgggtgaggcctgtaactgccacctatcccccacttccctgacaaccttgatgacacagcagaggcagccataatcctcctgggaacataagtccgttgacctgggaacaacacccccaaccccgcagcagcagcagcaagccctgcccaaggagagtctgaacttagacacacctaaccttgcccccacctgatggtccttctctatccaccctggtagatgaagacagagggcatattattctcttgggatttctagggccccacccacagcctaatcctccctatactaccacagctgatgctctcttgaaagtgctacctcctggtaagaggccaaccagcacaagaatagtgcattaaataactaaaactaaggaccctcagagagcccatttcactcccttgccacctccatcggagcaggtgctggtgctcatggttgagaaaattgaagatggttcacattgtctgagcagaccactcccattaccagcccagagcctggtagccctgctgggtggctcagatccagaagagaaatagcaatcactacggtttggctctcaggaagccacatccctaggaaaaaggggagagtattacatcatgggaacaccctgtgggacaaaagaatctgaacagcagctttgagctccagatcttccctatgacatagcctacccaaatgagaaggaaccagaaaaaacatttctggtaatacaacaaaataagagtctttaacaccccccaaaaaatcacactagctcaccagcgatagatccaaaccaagaagaaattcctgatttacctgaaagagaattctgaaggttgattattaagctaatcaaggaggcaccagagaaaggtgaaatccaatttaaagaaataaaaaaaaatgatacaagatatgaggggagaaatctccagtgaaatagataacataaattttaaaaaaatcacaacttcaggaaataaaggacacacttagagaaaagcaaagtgtactggaaagtctcagcaatagaatcaaagaagcagaagaacttcagagcgtaaagacaaggttttcgaattaacccaatccaacaaagacaaagaaaaaagaattggaaaaaatcagcaaagcctccaagaagtttgggaatatggtaaacaataaaacctaagaataattggtgtgttcctgaggaagaagagaaagctaaaagtgtggaaaacatattgggggaataatcgagaaaaacatccttgcccttgctagagacctagacatccaaacacaagaagctcaaagaacaccagggaaatttattgcaaaaagatcattgcctaggcacattgtcattaggttatctaaagtcaagatgaaggagagaatcttaagagctgtgaggcaaaaagcaccagataacttatttaaaaactatgagatgaatagcagatttctcagcagaaaccctacaagctagaagggattggggccctatcttcagcctctttaaacaaaacaattatcagccaagaattttgtatccagtgaaactaagcttcataaatgaaggaaagatacagtatttttcagacaaacaaatgctgagagaatttgccacgaccaagccagcactacaagaactactaaaagaagctctaaatcttgaaacaaatcctggaaacacatcaaaacaggacctttttaaagtataaatctcacatgacctataaaacaaaagtataataaaataaccccaaggtatataggcgagaaataacacaatgaatggcatagtacctcgcatctcagtactaacattgaaggtaaatggcctaaatgctccacttaaaagatagagaattgcagattaaataagaaatcaccaaccaagtatctgctgctttcaagagactcacctaacacataaggactcacataaacttaaggtaaactggtggaaaaagacattccatacaaatgcacaccaaaagtgagcaagaatagctactcctgtatcagacaaaacaaacgttaaaggaacagtagttaaaaaagacaaaaagggacattagataatgataaaagtccttgtccaacaggaaaatattacaatcctaaatatatatgcacctaacactggagctcccaaatttataaaataattactactagacccaagaaatcagatagacggcaacataataatagtgggggacttcaatactccactgacagcactagac

SEQ ID NO: 529 - DNA, 78553 bp, Homo sapiens
ggttttaagtaggaaagaaaatactattctggccacaagatgaaaaatagaatgtaattgagaaagggagactggtaggtggaagaaaggcaaggctattgtcattttaagatgtttacttgcaaattgtcttaatggtctttttcttagacaaccagatgtcaatctggcatcttagtgtttgaagtctggaatgggcacaggagagtagagtaagaagaatggagtcttcccatgatggtgggtgaagaggggtgggatagagtagcctcctcaagggattgatgcttggtccagaatcagaggtgaccataagaatttaggatttatctgaaaccttataagccatttcaacaaatatttagcaataaactttgtccaattctgtaatctcaagaaagtcatctgagcttaaaaacaattggctgagatggatgtgcattgcagctatttaggaatgtggtaattagaatattgaaggtgttatctgcccatcagttgggcagtcatggcctgtcctaatgccaatctcactctctagtcagaactaatgctatttctgagcctcttctcaatataatcaaagagatatggggctgaaggggtaatggaggttaccttgtcttccttcgtcatctcaggaagaaataagggcagtgtacacatctccctaagtgtggaaaactatgacgacaccgggtctttctgacgtttgtgtggattcacaaactcccaaagcaccatattatttttaaattagaaatttctgaacagacagaggattcagagctctcacagctaaatgctaaggaaatatttattgatgtcaggatactttaaattatggccttctctctcctaaaatatttcccagccgtcaaattcgccaccaaaggaaatcctttggcatttctaatgccctctctactcctagaagaattttgagctgcttttggggacaaagatgttctactttttttttttttttaacaattggaaagataggtgcatgtgttgttttattgatttatttagactatacatacttggtttatacgttaccttatttaggattcacagcaatgccgtggggtaggttttcatcatttaaattttacaaaagagaaaataacatttgtaaaagtctggcgttcaagatggcacaggcggtatgtcaaaacaccagggccaggtctgtctgacatgaaaccttatcagtaagtttaaagaatttaaggtaagaaggtcactcttcttggagaaaacgaaaactaaattcagcagttatctcaggctcttcaattgagagaaaagtgaaacttggactatggtgaggagctgcaacttgccgcaagttcagatctgttaaggcagtacttctctgtgctttggatctcacttgtgatctttattttagtcacatggaatggtgccttaaaaggctacacccaaatcgaattcccctcaaagtggcctggagtacctcctgaggttaaaaagtcacccgaaagagaactgagcacagaggaaataatcactattcctcttttagccttgctgaaagtatggaggctatcttcccttgtcaatcttctcaccttagagacacacacctttgttttttgccgggattcctcattctcactgggcccatggggtttaaagtgactgtgttgttcacaacctgagcagtaggtgtttgaataaccacacactgggcagtttcttatgtatttcttcccactgcattcaacccaatgtcatttggcaagtatatatgatgcattgttggataacgttggaagcttaaactcaaatgggtaaaaaggcaactaccttgtcttctgtcagattcccagtgctttttagctccttcctactcaaaatgtggctcatgggcatgacattggcatcagctgggagcttattagaagcacagaaatgcagagtctcaggatccaccgctacttgtatacactacgtgtattttaacaaggtctccccaccccataattcaggcagaaagtttgagaagtcttgaaaactgttgttaggaggcagatctctcatcctctctagggtgcacaggctacaagaaggagccttggcaacaacctccaaagacacaattcctttcagagcttgtttcctgtttgataactcaccaaatctctaaaactggaatgtgaagcgagggttcagccaaggaactgggtgagagttaatggatcaatctgctctcccccgtcagtgcttttaccgctgacttctggaatgtgtttgatgaaaagaaagcaacttcttcagacagaagatactgatgcagcctgctgaggttaggacctacaggaacaatacaccaatgttatcagagcttcgtttgcctccaacttcagtccaaaactgacaacgggagggaaagcattttttaaagccgttgctgtcagctgccattattataaatagcaattgctctgcttctccctgggggaatgtaggcatcattgtttggtttttgtttagattaagaggttttttccaatagctttttacaactagatctgaaaaatgaaactagtagcacagtgatgctgcttccatttatcattccagaagcttggatatgttgaaagtcaaaaccagagaaggaggttcctgcttctttcctatcatcaggtttgagtgccctttctcaatgaacaattaacaaagaagtcagctctatttaatgttctgtgttcactccagaatttcaggaaagtaagaagcaaggagagtcaaaagaatcctaagtcactgatgtcttcatcaacccaatcatcagtgacctctaacattagctgattttctcaataaacattgtttatctttctcactatggttaaatgagattatgaatacaaaccaaatcctctgagtctagattttgaaatgtggccataagggccaagactgactgatggtttgtaggtatatgagggtaaaattagatctgctggctccatctgaaagaggcaattttgagagaaaattatagtggcaggtacaggacaaggctttaagcttaataatgccgcctttccattataaagatgtactcaggacccattcacgggtactgtctaccttttgagttgtatttctgggagtagtcaatttctgggaattggatcgattgacctgctttttaccagattctctcctttgatagggttggcaagcattacaaggtggctgaagtcagttagttagcaaacccacctggggtttacaaagatactttttacttcgttagcactaggaaacggagccaaccaacagccaaggtcacggagtttgtacacctggcttggaaaaacgagccaatcagaattaatcaaaactgaagtgcaaatgactatcctgaagaaatggaacatctagtgaaattggcatgctggggcctaaagaaaaaccacctgaaagactttagctcaccaagggaccctgttggctctcagaaggaatttcagactttcccactagctaagcccattaatatcaagagctttattagattaactggactctggtagcattttcaaggctcagattccacagcctttgtcaataacagtttccgctgtgaaaatagtttatttttgtgtttcttcaactccatagataaagttgatcctcagaagggtggggtgcttgtgaaggagtagacacacaactccctgggggactcttccatcgtgggactcttcctggccatgcttgggaacacagacatgcctttatgcaaagaaagggttccactagaagcacacctgattatactcaacctggatccaaagagccctgtgccatgtcaaaggaaaatgttctatcataaatctccagaaacagaaaaggtcaaaaccactcttggtaattagcctgctgaaatacagtggccctgctttttgtttaaccttttaagaaaagggctgcactctcacgagtctcaacaagcaggctttaattaggcacatcctcaacactcctaccctctgcttagccccttcccccacctgcagtcctaacagaacatgcgtttggtttgttgcttgaatcccctaactttggatggattcatgttttcttctcagtgcactttttgtagtcctattttaagtccatggaaccgtatcactttgcagaataaaaataagctatatatagactgacctccaaaaaagggtgtcatgttaaacaactggaaaaaatcagcaggcatgccatgcaccagcagttttgtttgtttgtttgtttgtttgttctaaattctggccaagttagcaataagcgtgcaaatgttcttgttaatgttactaggtaaaatgctttactgcaatagccactagctatgtgagcacttgaggtctagtttgaactgaggtaagatatatgtacaaaatattcattggagtttgaagacttattataagggaaaggatgtggaaagatccattagtaatttggatatattgggttaaataaaaggtattagtaaacttgattttccctgtgccttttgctttttatacggtggctataagagatttcaaaattacaaatgtggcttgtattgtgtatctattggacagtgctggtgtagcagatcaattattccatgtatagatagagaaaaataaatgtcatatgtttgatttggttactgcatgatttatcacataattttgtcctatcttgtattattatatatctttcttgtttcttgatcatcttccagccatattggaaactttcagaagataaatataaaatcttaaacttattctgcagcccatattgtacctaggacagtgctaggcacatgataagtgtttaatcaatgtttgttaatggagtaaaactcgatggtaggacattttcaaaagatttctttgggggctagtctgagagttagaacacaggttagccactgaatctgatggaatatgtctcactatccttgataattgttctggccaatgagctgtgagtaaaagtaacacatcacttttgagctgaaaattaacttcagagtgtgatcttttgttctctgccatagtgtttaattatctttttttttttttttttttttttttttttttttttttttgaggcagagtctcactctgttgccaggctggagtgcagtggtatgatttcggctcactgcaacctctgcctcccgggttcaagtgattctcctgcctcagcctcccgagtagctgggactaaaggcccgcaccaaaagacccagctcatgtctgtaatcccagcactttgggaggccgaggcgggcggatcacgaggtcaagagatcaagaccatcctggccaacatggtgaaaccctgactctactaagaatacaaaaatataattatcttttatatagagactactcctgttagctgttgtctccaagtgacctgcaatagacatgcagccaagcaagagacactcctttgttgttttcagccactgaagctcagaaattctttgtcgtggctacacaacctcgcttctgccaactgatgtagcatggctatttgactacagattggcttcccagctgtggctcttcctttgcaaagctcatattttactaacatttagtctcaataaccaaaaacaaagaggatcagtattatactcacctcttgaatcaacggtgatctttaattacaatgtctggagtcagagtgtctgccattaaaacatttaatttttagcagtagtaacgagttaagaatgctgatcaaactgcttcaggtagcttcccctttgaggagaggagggtaactgtaaatgaagcagcacattttaaagggcattgctgaaatcttccttgagcagcaccaactggtatttgttgatcactggactccctttagctgctgtttctgagaacaacctgcctcctgccttaccccattgagctgattttactaggacacaggaccatcatgaggggtccttggtaaaggagcatggttgagggattactgaggaggggagaagtagaggagaaaagggaaaatcccagtgaggtggccccaggcaaagatcgaaaaaaactgaagtgaatctaatcatttggcagggcaatccaagtcctgagctttaagacgacacttctcacggagagagaaactccagcttgcagttctcagacatggccttgttattgttttacttctaaataaaacacttgttgtctctaagtatttcaattcctgtgccttatctcaatttgtaggagagttccattcagagcacccatgaaacagaagatgaatgaatcattttactgcagactggaatagggcagtgtggctaatgagctgtacgtttagtcttagaaggccctgggatgcctcacactggaggcatcatctaagtcctactgtccctggagactaagtgagtggtcactctgttaccagacaaaagtgcagacccttctttggacttaaacacagagctagtatgactgtatattaagggataaatttcagactttgtatgtcttttcctggatgaaacattggaaacattgaaacattggagagtaacagagagaatggggaaatctttggttattctgggactacagtctccttcaggctaagtgttaagtaggccaagaattgagttgcttcctcccctagtcagtatcctgcttgcgtgaagttcgcttctctagaaacacagtctaagacagaaattcagatacacatgatttactctcaagaggaggagagaaaagcagaagggggtagggataggagataagccaggatgtggtccagctgtgacccagctttggcctgacctcatggggaggagagaaacatgcattatactacagatgtggttccaccaggaagcaaagatgctgttcttttataatcctgtctcagtcaatcattagctgtgggctgccctaggtagggggcatcatctcttaggcaaggtggctcccggtggttcatgacaattctctggagaagtggggataagaagtagtgggtaagccattagcagccaacactcactgcagccaggggatgggtgcctctgacctgtacagggatgtgggcagagaacccacaacacccactgccttgctgcagttattcctgtatccatgctcatcgtttttcaggtcccggtatcctatgcttccttatcccctactttctaattttacagttcactaatctaaaaatcaagctccagctgtctgacctctaaaatgagagagtggtctcactattctctcaagcccctttcaacttcatgagtctactgtgtcatcctattgtaacgaaagtcgaccctttttaaaaaataatcaatggctttctgtagagagaatgtcaaccccagtgactgatatcaaggtggaagtttcagagcatctgatcagcagttaggtctagaaagagctgggtctagaaagactctggctagtgctgctccatcacaccttgagaattgttgccgatattgatgtttgagagggcttacctgcttaggcacctgcgcaccatgtgatctcttctcttctcgtgctatggtgagcctagaatttgaggaaacctggaaagttgcatccagggaagactgaagtcaggggatacagccaattatactctacttcccttagcatgtcctgtagtagcaggagcaaaccgtgcttccatccatctgcatcagctttctctgattatctgtttcctttttaatctgctacctttgtctttccatctcctccgtccacctcctttctcttcctcagaagcatgcagtgccacaatggttgaaacccactctgttatcctttcactggacagtgacttccaaatggtgggggactgtctaaatagtctagaacttgccaaatgcagatatccctggagtaagccagctgactgactggcttagagaggagatgccaatacacttcctcattaggatagactgtactgcatgaagcaggctggattctggaatcaggcagttgggtttaaatccagaccttgccatttattagctgtgtgatcttgaaaaagttacttagcctctcttctgccttcagtttcctgaaagtttctcataagtcttgaatcttcagattcagtgggtacatgttgtccaagacaaaaatgacataacaaacaccaagataaatcctagtgaagctgttaaaacacaagtattaaggaaatactttaatgggcttctagacagaagaagtggtcactaattgggaggatatttgattactctacatagaaaacaatgccagaagacagcagaacaatgtccatggggttctgaggaaaagtgtgacctgagaattttacatacacacacacacgcacagagacacacgcacatgggcacgcgtgcgtgcacacagccacacacgcacacctacagagaaaccaagtcgtcccttaagcatgaagtcgacattttaaaatatgcaataattgaaaaactagaacacccaagagctcttgaaagaaaaccattgacatatttaattcagccaatgaatcaaagaatcaatatatatttttaaagcctcagaaatggagcatccatgagaaaatgctggtgatggtgagcgttgaggttatttaaatacagaaataaaactgaacgactcttgaaattactgtgacagaacagaatgtaagtgtcataaaaaccaaatataaaaaaagaatacacataatttaaaaaggatgctagtttccacatttttcacaaagaagagtcaatagatactatctaacacttaatgtttttcacattttttcctttagaggataatttaagaattcattttatgaagaaatattctttttctgaagttgaatagttccttagctttctttttgtcccctttatattcaagaaaatctatttaaaccttttatttcaaaatgcagtcatagcatgttctcatttttctatgcatttattaactgatttatcaatctgtcctccatccttccttcctgccatccattcatccacttatccattcatccttctgcctgtatgtaaatatagaaaattgtctgtgatgaagatcttcaaatattggtaaccattgttcctgggtgaaaatgtttttaggtaacttttaattgtatctgtccttttaactgtcttgaatgatttactatgaatgtacatcattctattataataaaaactgtaaaacatcactttcaaaagtgaataatgaagaactatatgggctaacactgttaactgaaaaatgagcatagtaaaacctcatctttgtaaaagagcggatataaatacgtgtagatacctagacattttctgggagattcacaagtaacagatcactgtggttatttaagaataggggacagtgagactgtattaacagggagacttccttctttctttttattttccaaaatatatgcaacttaatcatattgtaataatgatgggaaataaatactaaaagaaaaaaagaaatggctaaagaccatctttggatgggtacaagaagactactacaaaccttttggtttatttccttgtgtggtccccaaggcttcaccttcagagccagtagattctgccaacccctactccagaggatgagaagaagcctgtggccaagcagcagcactgtttccggagctctcctttcttttttctttttttgccttacatgatctttttagccttgaaatcaatttcttgtttatattaatccttcatgcaggatatggttttacctttcatttcttacaacatttcaggccagtagtatgtaggaaagacataagactaaagtaagcctagaagcagagacataactagcaaacgcaatgatagataacaatggatgttttgatgctagggaggagtggggactgcgatgtctagaggggcagtcacactctgctgtgacatttgctgctatgtcagaacttggcacagtgtggcatgagactctggagaagttaggaatttagatttataagcgggttttctccattttaaaatcctatgaaattaattcaaatggaaaaacaaaaaaggcattgagaagaccactgaaaacatctggccaggctggatttggactgcaggctgctatttttttacttctactgtagcttacaaagggtgtgcatttgagcttcagcaggaattgttgcatggcatacctgctcatcatagataggtatgaccagttgctgtgtgggctttaaattatgtggccctagagaagggtgtttctgcatcttactgccttctagtgcactggaaaccttttcttaagaaatagaaggcggaatagaaatagagagtgtccacagaggaggtgacatgcagcatcacctgtgggtcaggatcataacatttttcaggctccttggatgagagcagggctgaattttggttgcaggaaacaaaccccagcaaagtctacctgtgggagcccagcaaaagaaactcagtccattcttctttcctggggatttgacatagtccgagggaaagtgtggcagtatgagctgaatttggctttgaaatctgggtgttttgactcaaaacagaaaagaaatgatgagtcagggtaacaagagttgatggaaaaaggatgacctttttgagctacacaaaataaaaaggcccttgactgcttgagaagaggcaagtaaatcaggtgctaggattctaagtccaacctcaagtttccataacatcagagtgaatctaaactcaaaggcagccttcagagagtgcatagggcgagtaaaacgaataacaaacccatctcctaaaatccttgattttgcagcttcaagattccgttctctccctgatgtgtatgccactatcgtgaattgacaggaacatgggctgtttaatttctttcttttcaaaatgcccccctttgcttcctgtcaggctagtcctacactacggaatccattcttctgcctctcttttttttaaattcctttcaagagataagaacccagcattaaaatgtaggtggcatagctttgaatagtagttgccattttaacctctactggcctacttgtaccacctaaaatgtggcttctgcaactactctaatttattgcattctttttcataaaaaaacttggacatagcaagcaaggtgtcagcatacaaggcaacaatgcattgagccaagatcttacaatcttattacaagataaagagtagagtgcctcttgcttaaggatgttctgtagatggccccaaatgctaagagcaatttgattaataatcccatctgttttactccttgaatttgtttccagggaaaatgtgcctttgatcactaggcgctgacgagggtataacctggcccgaggtgtttccctggagtgaaatatgcagcacttctcaactcccaattccatttaatttattgtttgtttttgctcaagaagagcctgtttttacagctgaacagatttggaagctggcttggggtgtttcatttccttacatgaagagttataatgtaggggatggtaaccagctgtttccaccttcactaaagacagagcaaacaagaattacccttcactgtagcaaaagaaacttaggttagttataagaaggaacttcctgagagttagcaagggaggctaagagtctcctcccttgagggctcttagatgggattttcttatctctttttgggatggcttatgtgagaccaagattaatgacactagaatcagccaaataacctgtttctgtgccttccagtactgtatttctgtgtatgataaccattacctgggtctgtgccttgtggatagttggatgattgggggtaagatttatttatttatttattatttatttatttatttattttagaagaaggcttgttttccatttgatttgcaagtaaatgccatagcagtgatgggctgaagccagctggagagttcactgttaaatgtttaggtttaattttttttggcaagtcggttgttatacacagctgctattaaaaagtaaatcatataaacttaaaattaataaattatattaaaaacaaggaaaaatacatagaactcactaccccttaataatttcactgcattttacttttatatatatgctcctaagattatttacttctattgtgtctgtcttactctcttttgtgctgctattacagaaaacctgagactggatccatccatccttcctccctccttccctctctttctacctctttctcgctctctctttcttccttccttcctccctccctccctccctccttccctccctcccttcctcccgccctccttcccttttcccttcccccttcctctttctttctctttctttctttctttctctttctttctttctttctttctttctttctttctttctttctttctttctttttctttctttctttctctctctttctctttccttccttccttctttccttcttttcttcctttcttcctttctttctctctctctctctgtctctttctttctctctccctccctccctccctctctttcttcttcggagtctcactctgttgcccaggctggattgcagtggcaggatcttggctcactgcaatctctgcctcccgggttcaggtgattctccttgagcagaatctccttcagcctcccaagcaactgggattacaggtgtgtgccattatgcctggctaatttttttgtatttttagtagagatggggtttcgccacgttggccaggctggtctcgaacgcctgacctcaggtgatccgctgacctcaggtgatccgctcacctcagccttccaaagtgctgggattacaggtgtgagccaccacacccagcctgagactggattgtttataaggaaaagaaatgtagtctcacagtctggatgctgggaaatttaaggtcaagttgccagcatctagcgtcctgcttcttgctgaatcttccttcattcatatggtggcaggcagaagaagaaaagaggaagtctgtgtcctcacatgacagaaaaacagaagagtgagaacccactcccactcctgcaagcctttttaatagcggcattgacctattcgtgagggcagagccttcatgacctaaaaacctcccattaggccccacctcccagcactgttgcattggggattaagtttccaatacatgaatttcaggggacatatttagaccacagcagcatgtgtatggtggaaataatatatactaatgtggcgctgcacatctcattccaattccacattcagtggcatcatgttggtggtttgaaatctgttgtgtgaggaacatttacactataaaaattggaagactctataaaccaggttttccccagagccaggagttagacatttatgagactacctacatggaagagagttgtgagagagaaggaagtaagggagggagggagggagagagagagggagagagagagagaaagaaaagagaaaagaaaagaaagaaagatgagaggggaggggagggggagagagagagggaaagaagaaagaagggaaagaaaaagaaagagagaaagagaaaaaggaaagaaagaagagagggaaggagagcgggtgagagagagggaaagaaagaggaaagaaggaaggagggaaggagagagagaaggagaaagagagggaaggaaggaaggaaggaaggaagggagggaaagaaaagaaaagagaaaagaaaagaaaaatattgccctagtggcttttttaaataccttctcaatattttttcaaaatctttttggggagtaagtattataataaaggcctttttgaaaaagaaaatgttcaggatttcttaagtccagaaactcttttatcttgaactaaattagctcaagtaaaatctgaattggtggtaacaattacgtatcagtccctcttttactttactacccattgttaagccaatgctgtccaatagagatataatatagtccacatatgtacttttaaatctcctagtagctaaattaaaaacaaagtaacaacaaacaggataagttaattttagtaatgtatcttatttaacccaaattttccaaaattattatttcactatataatcaatattaaaatgttactaaagtgtgttttttttgttttttgttttttttggtaatgtgtcttttctaatttggcatgtattttacattcacctcacatctcaatcagactagacacacttcaagtgctcaataggccatgtggctagtggctgccctactggacagtatatgtctatattcccagtgaagaagaggctgggccacagccatggtcattgcccatggagacttgcccactctcagtgcgcacagacagaatacattgaggttatctcacattagtgctagatgggccatggagttcagattatcccattcttaatttgtagatgtggggatgattacatttccgggaggtggttgtcttgtcctaagtcatacattggtatgctcaatggtttcaactgcatccaaactttggtttctgaactgtgtagtgcttaaggacctgatgcatgaatcaaactttcagctatcgtatctccaaggcttcctcatctattggctgaataactgggctaattgttaaatttcttggtgcctcaatttcctcatatataaaatgagaaagagtatagtatctacctaactgaggtgtccatatgatgatgttcatttcaaatacattacaaaatgcttagaataaagcacagagtaagtgttcaataaatgtttgtttgcttttgcacagcaaaggaaacaatcaacaaagtgaagggacaacacacagaatgggacaaaatatttgcaaactccctatctgacaagggattaacaaccagaataaggagctcaaacaactctataggaaaaactctaatctgattaaaagtgaacaaaagatttaatacatatttctcaaaagaagacatacaaatggcaaacagcatatgaaaagatgcttagcatcattgatcatcagagaaatgcaaatcagaactataatgagatattgtctcatttcagttaaaatggcttttatccaaaggataggcaataacaaatgctggtgaggatgtggagaaaagggaattctcatacactgttggtagtaatataaattagtacagccactacggagaagagtttggaattcctcaaaaaacttaacatagaagtacaatatggcccagcaatcctgttgctgggtatataccacccaaaaaggaaatcaatatatcaaacagatatctgcatgcccatgtttgttgcagcactattcacaatagttaagatttcaaagcaaactaaatgtccatcaatagatgaataaataaaaaaaaatgtggtacatatacacacgggagtactaatcaaccatgaacaaagtaagatcccgtcacttgcaacaacggggaagaaactggaggtcattatgttaagtgaaataaatcaggcacagaaaggcaaacttcacatgatctcacttacttgtgggagctaaaataaaaacaataaactcatggagatagagactagaaggatggtcaccggaggctgggaaaggtagaaggagaggggtgaaagtgataatggttaatgggtataaaaaaatagaaagaatgaataagacctagcattcgataacacagcaggttggctataatcaataatcatttaattgtgcattttataataactaagtataactggattgtttgtaacacaaaagataaatgcttgaggaggagacaggtaccccatatttcatgatgtgattattatgcattgcatgcttgtatcaaagtatctcatgtatcccacaaatatatacacctataatgtactgataaaaattaaaaataaaaacatttaaaagttcacttgtattgctataatataaagcaaacatttaatggtttgaatgaagagaatactagtgacaggagtaaaggggatactattgaacagttctcaacctgaaagtccaaattgctttataattacttgtataaacattcgtataagaatgtaaaagttatgtgtcagattgctatttcttgagtatttagataagagttttgctttctgtttaaaagagttatctcctgctgtcattattcttactgaagtggtaactttgtttatatttctaatgagacttaatgctgattcataatgatgtcaatttatttaaacttatttgaatttctaaaatttggaattctaaaagattttggaagtaggctgccactactccctccatcccaccttccaagtacccgtgagatgcatgcattaaaactcaatttccactctacattgacaagagaatttgaaaagaaaattgttagacaaatatatgtatacatatatacatatatacacacacacacagatttataacattcgttcatgtttactgaaggtttttaggatttagtaactaacttatgcttctcaaggcaattttcatgctgctttgtagtgtccatgtggaccattctttatttgatcaacacaagctttggcatgctttaaaggagcagtagttaaggcagttatgctggaatttctttagaagtggagatggcgttttcattacccagacgggtgttataattaatgagaacaaataccactggggtaaaattatgatgagactaaaattttaaattctgttggcattttaatattaatataatttttctcctaatgtgtatttcacacatggccagggaattattgaaaacattatttaatttaatcaaaaatatttaattcctaaagtacattcaggagtgctcatggtgcacttagagaatactttttgaaatttctataatgcagtctttacattacatacctttaaatgtctgggtgatactagccatgagaaagtaggttaacaatataaaataatgaggccgggcgcagtggctcatgcctggaatcccaacactttgggaggctgaggcgggtggatcacctgaggtcgggagttcaagacctgcctgaccaacatggagaaaccccgtctctactaaaaatacaaaattagctgggcatggtggcgcatgcctgtaatcccagctacttgggaggctggggcaggagaagtgcttgaacccgggaggcagaggttgaggtgagccgagaccacgccagtgcactctagcctgggcaacaagagcaagactccatttcaaaaaaaaaaaaaaaaaaaggaaaagaaaagagtggtgaaaagagtggttatgtcttcaaatgaatgtgtagcttttctggatagtttctttctctctctttctttcatccattctctctctctcctttctttctttctttctcttatgtatttagagacgggcttgtccaggctggggtgcaatggcacgatctcagctcaccgcaaccactgcctcacgggttcaagcaattatcctgcctcagcctcccaagtagctgggattacaggtgtgcaccaccatgcccagctaatttttttgtattttagtagagacaaggtttgttcgtgttggtcaggctggtcttgaactcccgacctcaggagatccgcctgcctcggcctcccaaagttggtgttttttgtttgtttgtttgttttagtggagtcttgctctgtcacccaggccagagtgcagtggcacgatctctgctcactgcaacctccacctcctggatttaagccattctcctgcctcagcttccccagtagctgggattacaggcacacaccaacaggcccagctaatttttgtatttttagtagagatggggtttcaccattttggccaagctggtcttgaattcctgacctcgtgagccaccatgcctggccgttcttttcttttctcttttattttgttttcctttcttttctttcctcttttattttgttttcctttcttttctgttctctctctctctccttccccccctccctccctcctttccttccttccttccttccttccttccttccttccttccttccttttgttctttctttcactcttccttttcagttaaatcttactgggtaacaaaccaacctaaaacttactggccaaaaatggcaaccattttatttactcacatgtctgtggatcatcactgtaattcttctggtctgaaccagctttgcttatcgctgcaaagttctctcatggcctatagtcagttggcaagtctgctctcaacaggttgattaaggataacttcattcagatcactggtggttggaaggctggttagtctttatgagcttctgttgtggcagtttgtgtttcttccatgtggtttctcaatctttagcaggctcacttgggtttcttcatacaatggtctaagaactccagagaacatgtgcttatccacttctcaagaatccacttgaatcccatttcctaatgtctcattgatcaaaacaatttttatatgaccaagcccagagccattgtgtgagaggattacctcagggtatggatacagggaggagaattatcacagatgacaaattattatgttttcgcaaatggactattccatataacatgaagcttccttgtttgaagtcactgatattttgagttctttgctagtgcatcatgacctaatctgttgtgactgttgcaacacctgaatcaataactaggctgctaagccaacaaaaatgagctcagtcatttttgtttgatatagctactgattttccagaagcaagaacactatttccttttcttttatgcacacatctcctttacatatgtcttcatagactgaaactctcagaagatagcatttaataacacaggaagtttgtgagaggtgcctggtacggaagagagtgagaagttgtgatagaagaagccaagctgctgtgatgacagctgagactctgactgcagaaaatgagagaagtcttggattttcatgtatgtcactcatttgatattgtagaaaaacaggcatcagagtgactaaaaaatctctcctcagttcagcagtcacagaattttctgggaatctggacaagcaacgtcccacaaagcactaagaagaaattttagctacaaaccaagtgaacagcaaatagctaagataatgtgatagccaacatactcagattcttagaagatattgagttaggctgagtagtagtccatcgtatgtatataccacaatttctttatccactcattgactaaaggacatttgggctggttccacatttttcaattgtgaattgtgctcctataaacatgcatgtgcaatgtagtacacgttgctttcaaatgtgtgacatggatcatgagaaaccttcagataaatagaacattgtctcaaattcctagtcaaagagcaaaactgatttgctacagaaaactggaaaattttagaaagcattgtttcttcttaaaaaggactaaaaatatgacttctaagaatgaagagttaaaaataatgaatggaagacaaatgaagagataacaagggaggcttggagaggagggacgagggagctggatgtgtggaggttgatggacaggctgcagctgttagcaagatgatgagtaaaagtgagctggtagatctttccccctgaaacgctacttggagtaagaagtgcctcgatctggcactaagacaaacactcccagaaacagatgcatctcagagtgggtaggaaacagacccgagagaaagcaatcagaatgagagagggaattctatggtacactttcctcttaccccattacctgaatgagtcatttcctgccatgtcactctacaaggaggtggcatcatcggtgaaggcccaggctggatgtcaggcatcagtatcggacttagacagggctaaagggagagatggcgataccaagctcaatcagatctacagctcccgagaattctctcctcccaccccctgtccctcacacctgggtgacaggtgtttaccaggagcatggaaatgagatccatgctctgggaagaggtataggaaggttatctggtggtgaggtggcaaatagagagttgtccctctcagagtttcaggattattttttttttttagatgcagccacctaatctattctctaaaatcccccagaggggtacaggctgggacctgctcttatctcttcacacaggcacactttgtggatactccccgggaaaacactacagaagaggagaacatatgtgtatatgtacattgatatttatatttcagtataagtatacacttaaatatatgtgcacttatacacacatatgtatatgtaaaaatactgtatatataaaaacagaaaagcaaaactcctggatagattatattgtacaaaattgaattaatatttcagaatcgaattttaaatgttaaatgaatatattcaaagtgatatggcaaggcttagtaaaatggaacagaactaagcagtaataaagacaattcaactgtaaatatgagttacgaaaaacagaagagttgtgctaaagcagcagttcctaaaatgtaatcccaggagctacaacattggcatcacctgcaaacttgttagaaatccacactcttgcacccaccccagatctactgaatctgaaactcctggactggaatccaggcatctgtattttagggtatattccaaggggattctgaggcactcaagtttgaaaaccactgctgtagaaaaccaaactgattgattgggttgaactaaaaaatggttagagataaagagtgattcactgagctggaagatagtactgaaaaacctatccaaaggcattaggaatagacaaggagatgaaagtatttatgtcaatgttaacaggcatgatggataaagtagaagggtcaacatccatataataggacatcaaaaaagaggaagaaaataatgaagggagggaaatagccaaagatctgttgaccaaggactttccagaatttagaaaagatcagggtatttcacataaatgtctatatttctgtctttctcttgataaattagaagatctggcaacactggcccacattgtcatatagtagtttacccaagctgactagcagctactgccttgaaattaggcattgaaaggatgagcatgtgggctgtggtcacagactggctgggattctacccaagctgcaccacttactaactgtgtaacttgaggcgaccttttgaccctcaattttctcatctaggcagaggggataaaaagatgcttgtcttatagttgtttcaaagattaaatgaattaacatatactcaacatagtgtttacaatgccaatgattacttttacttgtcataggccccacaactcactatacgattcctgctcttttcctatataaccttggttggttatgactttggtttctttgttaacagctctgagcctcagtttactcttcagaaaaatgagataataaactaccccaacctcccatatatagagaagtgaaataatgtttgtggacatgatttacataaaatgggaactcagtaaatgcttgaatttttaaaatttagtcacccatcttcacattctgtacaataattagcacagaatgatgtgttgcagccagcctacagtggtgcaagagaggcaattgctaaaatttaagaaattttgaggattgattgttaaacgcagctatccttaaaaattgaatcatctaatcttacaattaaataaattataaaaacaaagagtaaattctcaaaaattcatctcttcttagttttgtactatattttaccagaatctatactgttgagattaggtctattgtatctatataatagaaatactatgtgatggtgtcctattaagcatctcttcccaacttctggtcgagtcacattgtcttggtgggttgaaattggccatggtagaagaatttatcctgtggaatttgaagtggcaaacacttcaaatcagagttttatttcctcttgaacaagttgaaaatatttaccagaatagcattgttaatatccataaaaattgtttggaaaataaagacacataaaattatgtttattaccagaggacctcaaaacactgtgaagtactcacagtgaccataaaaaagatgactccattatagtattaattttccctgaaatttacaggctaggtataacattaaacatttaatatatttatccttaaaatggcaaagttatatatgtcctagaactctatgaaatacgctacacaaacatgtttttcttcacctataattgacccactgcaagaggcattccatttaccatgcttgaacaaagatttgtctttatagtaacagctatgatcctaaagttggactaagttctttatgcacattgacacaattctcacaacatccttataaggaaagcactattatttcccctaaagatattaaaaagtgatagcacaggtaagtcactctgaacatagaaatacaaggggaatttaaaggtttgcttattgttatgtaaaacccacccaaaacttggtgggttaaaaatcaacatttgtttctcatacttctggtcattggctgggcttatctcttgtagttcttctgctccatatggcatcacctagagtcactcatgcaaataaattcagctatgggttttgcttggactagaacatccaagatggcttcacttacatttccacgtggcttcattcagctggggtggccagaacaactagggctgagtgcacctttctcattccacatggtttctccaggcttatttacatggctgctgtaaagtaaagccaccagaaaggtgaaaaggggtgaaacagaaagctgtcaggattcttaagtaccagaccattcatgtagcacattcaattggtcaaagcatactacaaggccagcccagattcagtaggaaaggaaatggcagctgttccatcctgccctggaaagatcatgtctcacttcacccacgttttatttatgtaaacccaattatgcagccccttcttggtgagagaagcaatgatcatatatagagccccaaagacctatagggatcatctgtaactgataactttataattgtggagttccttaatgtttaaagttggattttctgttacatgcaactgaagcattcccaatgatgaagattatgtggaaaaacaagactatagaaaagcaaataaaaactgctcatatcagatatgtgtggtgtatactttatgtaagacatgggggaaaaggctgtctgctaaacaatcctttgggtagcttttgcttttttggtgaaagcaccacagtctagagtgtagaactcaactttgcaaactaagaaactgaagttgctaattcattgagggcaattccatctttcagcgctaaagattgttattccaactcataaaatggcataaaaataaaatgccaattacaatttataatgaatactataaatattgaggagacaggaactttgaggtaatcatgacctgtacattctggaatcagaacaagaggaactggatgaattaaatatttaacgacagctaaaatagcctgattcatctacattacagtgagaatggttttgtcaaaaggacgggaccaccaaaagtccattggctagccacttcccgcatccacttttatgtaaaggatattcttgcttgtgggaggggatatacccaaagatgactgatcatgtccttctcttccctggaaggtgctgagcagagatgatggtctctgtttctcttttctttctcttttccatgactgattaaacccttctgtaaaaaccattcagttggcatgagattgtttccaaatacttctctaaacagaaattcaccccgatgaagtttttaatcatctatgggaaaatgagaaaaataaagacacacatatacaaaccccgacacacgtgtttcactttgtttgtgtaggcatatcatacatcaccttctccccttcaacagtcatctttcctgagtgtctttatatatccacccgtcagttgttccttactgtcttgtccagcccctatatccacatgaactatgatgcaagtagattgtgattagagccccttagttggctgcctctccttttgcacagattataattgtttccaagtagattgtgattagagccccttagttggctgcctctccttttgcatagattttaattgtttccttcttgatctgttcttttattctccattccacaaacatacaaagttgtagctgtatatccatgtattagggaagatgagctgccaaacattccatctcaaatctcagcagcttaacataataaaaatttatttctcactcatgtaaacttctgggcagctctgttagttggatctcttccatgagctacctcggatactcaggctttttccatcttgtagctctgccatcttcaacacatggcctctgaaaccactacagaaggggaaaatgagggagaatcataaatggcagctgtattattagcttgtcctggaaaggtcatacttcagttcactctaatagcgaactctaatagtctgacccaaatgagttttcctgaggatttgagatctctaaaaataataatagatgaagaaagacacaaaatttcacattaaatatgatgtctatggggctcaagagaaaagctactggtgaattaaattccttatgtgatctctccttaaggatgtctgttttacttaaccttactttcctgattttaaattgaggcctttcttcaaaatactgctttttctaaattctatttttatgcattcttcttcatgatgaccttgtgagtggaaaaacaactccaactattttttctctgctctcacaccaatcaacacagaagacatctgtgaccaaatgtgtatgggtttttctccacacaccaagcaagcagtcaattctgtagcagacgccaacggggtatcctccaatttaattttgacactgtctacttgaagatagcgtcagaatccacaggttgagggctcggtctcacaaggctgcccctccttcagatgatagtctcaagtctaggcctctgaatgtctggcccaccagcttcaagttggggttccacaatacctcccttgggtttaattaaattgctggagcagctcatagaactcagtgaaacatctacttacatttaccagtttattataaaggtattacaaaggacatagagatgcatagagtggggtatgggaaaaggggcatagagcttcatggcaccctctaggaatctctatgtgttcagctatctggaagctccccaaaccctgtccttttgtgcttttatggaggcttcattacataggcatattttatttaaccattgaccattggtcaatgatgatcaacttaactttcagccactcttcccacctctccccagagtttaggggtggggctgaaagtcccaatcctctaaccctgccttgttattccttgttaccagcccccatcctgaagcaacctagagcctgccagtcatcagtcaacacactagcaaaaaacatcaccttggagattccaaggattttaggagttgtatgccaagaaattggatcaaagatcaaatatgtattttacaatatcacagacctctatcaattacattgcattttcctaaatctgatttattcagcttagaataacaccctggcgtaaagggttatagtaagttgttcaaggcagccatggacacacacaggtccagttgaaaaatccaatcagatgagttagagatacatcccatttatccttctgattaaccaatcagactggcatacatattcacatatatcttctaatatcacaaaacattttctaaaattgaacagtatcaaaaaagtctttcatctacaccaaggattagcaaactgtggaccttggggccaaacttgaatcattccctacttttgtaaatgaaattttattggaacacaaccacacccactaatttacctattgctatggctgcttttgtgctacaatggcaaagatgagtagtcgtaatagaggttgtatagttcacaaagtctaatatattcattatctggccctttacagacatagttgatcaatgcctgctctaaactatgtggagaagagtcatatacttaagggcctgaacagcaatatcgatgagtgaagtggaacaactagaatataaaaagcaatataattttggttgagccaagaagtattctcatactggtctaaaaatattcaattttaaaaacatgtaggccaaaacaattcacagcagattaggcccctagtcaaccagtttacaacttatgaactgagttcataagcacaaagaaaggcactcctccaccaccccataatgagcaaggctgcctctctacaaacaagcttggccacaagatcttctctttattatgtgaaataaggttacttcctttacatcctcaacacctcagccttctatccacacccattttaaaattgtgactgcttggatttttcttaaataggaaacttgtcatgctcagctatatatcccattgttgctcttccaaaccacaaagactaacagagacttgacatcacagcttataagggtttgattaaatgcttaccatggagccaccttatttgctggtccatggggggagggatgtcatccttgataataatttattatttgtagttctcatgtccttacttggcaaatttataactggcaaccctggattttattttatttttaaactgatttatgaaatcccaaagtatggaaaccactggcctaagaggcacataatgcagcagtgcaaggatggctttgctgatctttgctttggtccttccttagtgattttacatcatgtaagctctcaattgtccaaacttattcttcttatatctaaattcttagggaacttctcactgaaatcagaatttataactaaaagcacataccaaggagataacagctattgccggcccagtcttaaacaagggaaagctgaatcctagaatgttttatgtcttgaaggaagccctaaatccaagagaaaggccttgagaactatgtgtgtagaaggcagacatcagaaacatgctgcttgcgggacaggagagtaggaacttgcatatagtgaatgtctgccatatctatttcctttagcaaaccatgtaaagtagagctatctccaatttatgagttaaaaacttgaacaaccttaccatgattaggcaaacttgctcaaggttaacaagtcattgataaactcagtatgactgaggtaaaagcttttatttcaggttggagcaatagctaacctttctattcttttgttttattttgtttttaagatggagtttcattctgtcacccagtggcatgatcacaactcactgctacctccaccctccaggctcaagtgatcctcccacctcagcctcccaagtagctgggaccgtagatacatgtcaccatgcccagctaaatttttgtatttttgttagagatggggtttcaccatgtagcccgggctggtctcaaactcctgagctcaagtgatccgcctgccttggcctcccaaagtgctgggattgcaagcataagctatcgtgcccagcctacctttctattcttctttctttttcttgaaaaaaaaaaataataatctctaaagtttaaaaggtttagaaaattatcctaagtcagttgaagcaaagttagagaagaacccagtaagatatcataacatttctttaacggactcaaatcttcaagtgaaatccatccaggagtatgagagtgctgcatgtggcatacagaatctctgtcaccagtctttgggaaattttataaataattaaagaggttcctacataccaggaaagataaaaagtctccacattttcaaggagaaaaaaatatgggttagagcaaccagtgaattaaagaaattcctggaacaattttagatttggttattaaacagaaggtttatgaattcttagaaaaacaagtagtagtattttatctatcagttagtttacaggaatcagaaagttagaaggcccatcttgcagaaagaaaacgctggtgtgtgctccataattaaaaagaacagacaaccatatccttgatcctaatgttgactattcaaaattcagtctcaggagagaagctctgattggccaagcctatacccaagctgtgcttttgttctatcagggcagataaagagtggttctggattcttgggccatcatggtctgaggaaggaagctgggtttgcctgtctgccaagcctacagaagtagagggttacagttcattctctaaaaggaaatcagtgtgcattttggaaagaaaacaggattctagaccacaaaaatattggcaattgtcctcaacaattgaaaaataggttggattcatgacatacttgcctctttcatttttaaaaagtgtttttggacaagtagatgccatgtatgtgattcattcatcaaggtccttagaagagtttctcatgatacccttgcaaaaagatagaaaaatggaagctggcaggtggtatatgttcatggctggtagaatattaaaaccattattgaatctcagtgaggattgctctctggaccaagagtgctataatcttttccagttcaacattataataatcacttgagtgagaaaaataaaagagttaagactcttgtagttgcaagtgacagaaattcaaccagaaaatttctgaagtgaggctgcaagcacagcttggattatgaaacttgaccaatgtgataaaaatgttgtccttttctcactgtctcttggctctgcttcctctctgttgcctttatgctataaaaccatctccatatggtgttaaggatggctccatgactctattcttacattccatcaggttggcaacttcagacaaggaaagttttcccagcagaagccctgagatgactcttattgtctgaattggtatatgtgttcaatcttgaatcaattaccagagtccaagttgatgaagtgttccgattagtcaagccaaaatcacatacccacccatggagccagggggctaagtaagctcccctcaaaccacctggataaagagaagagaagacatagtactaaaaaaaattgaggttttcttacaaaaaaaggggattttgaatagacaaaaataatgaacatcttttaaaacatgattattcagtttagaggtggcacaaaactgagagatgtagctattaataatattgacaggaagaaggttcaaaagatttcaataagctactggagtgggcttaaactaacacaattaaatttaatcagaatagaaggaaagtttaacattgacatcaaaatctcagttacataagtaatgttggggctattacttcaatgccaaagcatgaaagttttagttgtctacaaattcaattatttattaaccacctaaaaagctaatgtaattctctgctgttttacaagagctatactgcctcagtgatcattgtcccactgtattatgcactgcttgaatatttctgggtgtctattttcaatgctagtcattgacaataaccatataaccagaggaagatgcccacaagaacagacaatttattgccaagcaagttatataatatatctaaagtcaaatagaaacaatattttttccataattcacatcctgtttattatagataaaagttgactatatcatatccagagtgtatatacagcatccagaggtcaacctagtttcttcttagacacttggtataagcaaaaagtaagtaagccttggctaagcctttattgcccaggggcaaagtaatctttaaatatatgctctaggaaacacacatatcaaatagggaatcctttgtgcttgatgtaaaagaaacaacattaaaatgtctttttaacatagacacacataatatgtatatatatggataagtatggctatggatatatacaaatacatacaaactcaaacacaaatacaaacaaatccatacatcagtgtatttgtttcacatgactgttaggaaagtatttctgcataagaacaactagcacaaagtcctgaaactgttctaaaccatggggaaggactgcgctatcttaaatgttgtctttttgaaactttctttagtgacacattaacctctgtgttgttgaccacagcacagaccagttttcctcacttcctgttatcttgttctcatttgatagtgaggctcagagggtgtctgaggggagggaacattttggtacaaaggcagttggcaaacaggaaaagcagcccccttgctggttacaggttaataacgacagcagggagaggagttccttagaattcccttgagccggtcagcttcccttgaggtcaaaaagtcctagggcagctttaatctgctgtataaaggcaaggaaaagtcacttctggtttaccgtaaaacaaaaagagctccttattggatcagaagctgcagaaatgcttatagtcaagtgggttctgttggttgtggagagctgatgaggttagtttgttagaacacactttgtgaaccataaaatctacagaagtaatttatagttgtttgccaaagggatttttctaggcagcttctatatactacatactcttttaagtacttaagttaaattttaattttaacaacattagttgaaatcacggtggttaagtctaaaacatattgctttctttcttatctttttaaataaaatatatttgaccaaacagtctttcttatacaacctaatgggatcatttatgaacatcaggttttgaaatatggtccaatatatactaattgccatttattgaaaacctgttgtgtgccaggtattgtgctaagccctatgcaaaaaacttagatgatttaatctgcaaaacaacctgccaagtcagtgttatgcccatttacttattttacatataattaaaccatggtctagaaagcttaactcacatgaagttaaacaaccagtaaatagtgcccatagaagtagaatctagttgtgccaaaatgcaaaatccaagcttaaaatcaccagtgtgtaccttacagtagtgctctcagaagagtgttgtgttggcaaatgtttagtaaacagctctccagaaaaagtgtatgtatacacacacactacacacacatatatgtgtgggtgtggtatatatactttgtaataaagtatatatatgttttattataaattttactgatataaaaggaattaacaagttagaataactaaaatacataatttggtattataattattataaattccatatcatcagttgaatatcacagaatacacttgataatttttgcctaattcttttattgcagacagctacaatagaaacttttagaaggaaacataggagaaaatctttttaatttggagcaaaatggacatttccgcaaagcattcttagacgtgagaccaaaagcatgactcataaaagaaaaaataaattggactttattaaaattgaatttttctttttgcttcaagagacaccattaagaaattgaaaagataagccatggattgtgaaaattatgtgcaaatcatatattggacagaggacttgcacccagaatatacatagaactctcaaagctcaatattaagaaaacaaacacacacttaataaaaactgaacagatttgaacttatatctcctttgagccaaaagggataatagagatggtaaatgtgcacatgaaaagttgtttgacaccattaaccattaaaaatacaaattaaagctgtgataaaataccactacacacctattagatggctaaaataaacagtactgacaatatcaagtgtgacaaggatgtagaaaagctggaactctcacacattgctaatggaaatgcgaagtgacacagcagctctggaaaatagtgtggcactttcttatatcattaaacatacacttatcaatgactcagccgtctcactcctaggtatttaccctagagaaatgaagacttttatgttcatgccaaactctgcatgtgaatacttaaagcagctttatttataattgccaaaagctgtaaacagcccagagatacttcagcaggtgataaagaaactgtggtacatccatacaatggaatactactcagggatgaaaagaaatgaactattgtacctgaaacaacttgaatgtatcttaaaggcattctgttgaatgaaaaaaagtcagtctcaaatattacacattatataatactatttatataaaattctcataaagagaagactataattctcatgaagagaagactataaggatagagaacagattagaggctgccagagattaggtgtagttggaaagtatgactacaaagaggtagcatgagaaactttttcgaggtgatggaacttttctgaatcttgattgtggtgttggttatattaatctatatatgtattaaaactcatattactatataccaaaagaaaaaaagtaaaagtcaattttactgcatgataatttttaaaattgaattgaatttaaaaagttaaaatttataaaaatttttaaaaagtcaatacataataattctgtgaggttttttttttttttttttggtctcaattacctctaattaggttactttggtagtctgtgatttctaatgaacttatcaagaataagtatccactttgcttatgtcctttaccatttcgggcaaaatcacaacttaattcgctccactgtacatgaccttctcaagtatgggagagtgtgttttggttcagtaccaagcacttcaacaatttgcagggctccttagtaccctataccattcatgaaattcttaccgtttgcaattctattcttacaacctctgaaactggtcttaccatctgaccatctcttttcctctgctgttgactatatatagctccaaattatctcactaagtcctatatagcccctttggaccatctgagatagcaagagaaggcttaaagcctacagagggcgctccaggctatgtggtctccagaagtagaagcccctctgaaacatctgttagatgtggtgtcagtggccaggtgatgggacttaccggacagaatgtctgtgtctctactgtttcactccgattagtaagaggttcagagatgataattcattacgctgcttcataatgttcttcttaacattagtgaggatatacaggagagattgttatccatacatattttgcaaggtgaattataaatacttaaatacaacagcttactttaaggcaagaaattcccaatagaatatccactagcataaattctggtttcttggctgtcctgcatttctcttcaaatggttttgaggacacctctatttctgaggctactcctagtggtttccctgtagaaaaaagcaacctggagaattctgtattttaaaacacaaattgtaggcagtttagccataagagtgtaatcactgataagatactttataatacttcagtgaacatcagtgtggtgccaccagagttgggggaagaaatttctcctagacccagctacatctggtgtcccacaatcctcgctgggatgaagcacacctgataccttcccaggggtagttttagccatgcttgctgaagggcacactggaaagacctaacattgactcaaaacagtatctttatcttattcagcaagggtcgcctgtaatatccagtacttacagctgatgctgggaacttctgtctcctctgtcaggcattcttatatattttaaacctgaagctggtgtaatcaccaatcatttttagtgtttctgtgttccacacacattctaatcttgaaattctcaacaccaccataattagtaccacattcagactatgagactgggataaactggcgttatttcagatatctcttaaattgctctctaaccaacaagactcttagaacgtttcccaaaaggtagaaaagccctttgtgcttagcccacaacccagatatgggaaggaaactacttactcctagctaatagctctatcctccacctctcatcccattctacgggcagttggggaatctgcaaagtccatgctttgaacactgaattaccagctctatccctcctcctatttccaccctcactgctcccaattggttgggttggatccagcctggaacttcaaaccttttccccaaaagctcatgatccatcttttctcaagccagagaaggatcgtttgcatgggtgaagttctccaatggccttaattcttagtgctcacaatagtgaaaggaacttgggtgctcttgttaagggaagattctgagcttatcttggagtttcccctagtcttcttgcagatgaagctgataggtttctgttacctaccatcttttattgggctcacaccacaagatgcctagtttttttattatttctgcatttgatcatgcagcctggtcatttgagactccctacaacacttgcttgcttttctcccaactttctatcttccatttttctctccatccctccattcccagagctttacacaaaaaagtgtttcatatcattgtagactggaagtttcttcatcttctctctgctaggtggtcaagactttatgatgagtttacatgaggtttttttcatcggctagggatttgttctgctattggaagtcagtcaagcagaaatctgtgctaagcaagacagagtggacatgagagatattctctttttgaacaggtaagatttgaaaccttaaaaatctaacctgctgagcagtatagagccacagctacctaagtgctctaaaccttgaacttctaccatgcacttactaatgaaatagagaagtagtaataaaaattgattttaatccttttaattctcagatataggaagagaaaaccctcatattataaaattttctgataacttcttgttttgatgctttctggcttggaggactgaaggaagaaaattagccatatagtcaacttcagggaaaatgtataaacctagctttttggatctgaggtcaagaactgtagttgcctgttactactttacttggcttaattctctctggcctttgtaacatctaaatagtgttactgtatcagtcaaagtcaaactagggataagaaaccacttgagtatttgaaacagaaaaaatacaatacaagaaattagttactcagatgatggaagctctggaagccacacaaggtacaagaggcaacccgggaattagcaaaggttagaatcctctaccacctcctggctggaaggacagaggaaagaggtggttttactggtgcttaaggacggggatcacatggtgaaagatagaaccactgcgagaaagagctgaaaccaacaagaaaatgcagccatggcaggggtgctgcccaaaatggagaaggggtaaaagtgggggagaaatactattatttttttccttcctctcactctctggtctcttagtagtggctcccatgggccaaacccatccagaagcaagataatgtgagatgctggaaaattcatcctgatgggatcaacctccttcttccacaataaagagcagatgatggaaaggataaatggagaatctgtgggaaagatggcctaggactagcctggctagtggagacacatcacaaatgaagagatggttggacctgattttaggacttctccttcctgtaatggacaatttgtaatcaggttgggaagcgctctgccacctgcaggagctaaagtagcagccatgggaaggacataagcagtttgggagagcttcgtaacagtgacttcaaattctcagccttctctcatgaaccacctcaaggcaatgactctctaagctgatgtagttctgttgtgttcctgtgtttgagacagtctattctcacatttccctagtgtgttctgagtcacagttcattttattccctgcctgcatcacttgcttttacactccttacaaaatcatatacttctggtacccaatggtgtctagcataggttgcctattgtaaggtgtctttccctcttcccagtgtaggagccagaatcttttgttcctctcacaagcccatctgccactttacccagtgatctttgatgcctttcctagtactgtctaactctctttaaaaatacagaaacagttactgtggaattctatgcgatcctccatggcctccttcttccaataactccgaatggaaattcctgtgggggaatagcccaataaacacaattatccagcagaagaagggctttctggttggatcagtcaaagttcactcaggagcacagaggtcattccaggtactcaggtagaaggaatttaatatggggaactagatacagtggtgttgaaggtagtaaaaaaccaaaggccaataaggcaacagcttgaattcactactactgctagtaggacaagagggataaagggaataattggagtaattagaacccaagaatcagagccatccataggagctcattaatagcagaggtttcctgttgggatcaggaaccaagctggagacacagcccctgccagagcccatgcctgaaacacagaggaaaaggaataaaaacctggcttcttccttctgtctgtcctccaatctctccagtggttttcgttgactaaaccaagccagaagccacttggcaagagagtccaggaaatggagcttgcaaaggaagggcaggggaaggatttaagagcaaaccaacaaataacccagcacactggttgcaatatttgttctcaagtcttacacttttcggtagttctgagatttctgctgtctgctgccaaaactttttggctcctgaggggtccactcttgacaccccagcatcttcctgctagtggtttaaaagacatgcagatgcagaatgtcatgggcctgggtctagcctattggtctgggttttttttaattcaacgttaagccacaatttagtaatccactgtgacctctaccctccatcccctactcctaattgccactcctcacccaactatgaagatctattcacagccataatgtgggagggcatattggtggaacgctcatttgctaacagagcatgtgtgcaattgtttatgaagatttgtacattattgatatatctttcacttttagtcactgggtccaccaaggtacttctatagctggtagcttactctttcttctaccactctccttcatcataccaatattttttcctttgtttaccttcatggggtcttttatgcttccttgccagttctaaagcatgtgtgaagagcagatacatctatgtaaatggtttatatttactgtgaaaacttatgaaatatttatgaattattaatgtcgtttctagggccacaataaatctctctttttctctctctctctgtgtgtgtagtgtgtgtgtctttctctctctctgaagtgtaacccttcaatatggtataactttctcagactgattctgctactcactcaggagggaatgttaaattctacttattttgcttcagtttgtaaactttctagtgttctcttttttcaaactggattgttagattatctgagggtacccactccctttgttcagagcacagcatttggtgggctgtaaaacagaagagctccttcagacttgtttgacaaatgagaggaaaggggcaatggtggcaggagcttgtacagataaaaaggctcttcaccttgggccaaaaggtgctacttggcaccacctccacttcctgcttttgctcaggaaagaaatctgacaaagcaggagacagtccttgccttgccttcctcactcacaacccccttttttgagaactgccatcttgttctcaagatgggccatatactagtctctatttctatttctccagctcttgtccatgccacccagacaactatgatggcctctccttagttattaccctgtagattagttttgcattattggataaatggaatcctatagttttcgtttggaataatttagtcttcggaatctcttacttaacatgatgcttgtggaattcaccatgtagttgcatacagcaatattttatttattcttttgctgaatattattccattacttttgccagtttgaatggatttctttcttacagtcaagtaggccatgactaagggagataatgaagcatggaattgtcttttccagagaaaccacaggcatggaataagaattccctgaggaggccttttctgtcctttcttcatcaagctgcgacattattttcatattcagagaacttcagagcaacaccgagtttcgctgagtgggttcagagttccatatggcagctgtctcagttcctggcacgaggccaaaggatgacagttcttatcttctttcatgttcttttgcccaaccttagggaatatttctttaccctgtgattgctcatatctgaaaatcttactcacactctacaatcttccatcagcccaatgccatgtggtgttaaccctttgcatgctgcagtgttgagctgcaaacctgcccttttcttgcagtaatccaaagtgcccgtaaagtcttgaggcagacaatgttattttgtcatgtatgttcatataatatcagcaaatcattcattgtgtctttgtctatcttccagacatggtggttgctttgtagaatcaaaatttctgttatcttttttcataattagttaataaattcaagttgagctaaggagccaggtgaagccactgtgatttgggcaaggttcccatcgatagacatgtgctttcagacacaagatgtgctttcagacatacaattctgtttggccagagtagaatagaatgggtggtgcacactttcattatgtaagtacaccctgtttttcccattggtaataatatcttaaggagcgcaaggaaattcaggaaggaacatttcataatgtcaagaatacctactaagtaaattattctttagaataaatctgagagatggattgtcataccaaagccaatagaaactgaagcatgataatgtcaatgcatattttccctgatatactgtagatccgtagttttaaaagcctgcttttttattttgctagctgaatctcttttatcttgctgccactcttctcatgggatgcctcaaaatcctacagactcttgcctggcaatggggaaaaatgagggtgtttaccactaagaaagccaattaaagaagtaactgatggattatccagcccatagaccaaacaaaatggacgttacttcatgtcttcaaatatctaggcactggaatcagaaaatgaactcccaatcagacttccctgcttttcctgcagggaaaatgagatgcaaagcagagtcagagaaaaatagcaaatggccatttgtctgctgggagataaaaatcttactcagaggtcaagtcacattcaaactggttgatcccatggagactgactctgtcctgtgggacatttcttctctcctcctgtctctacctttcttttctctgtctctcccacccttcctctttttatttgcccccactcagggtgcagatacaggttttgtaaggctgaagtttaaatgacagtcaggggccagaggaagaggaagatattattataagtagcaatgaagtaaacatttatctaaaattaaaaaaaaataaatcaccagaaattgcaaatgtttaaatgttgaaagtccttcaacattattcaataccaaaaaagttacaccatgttttttaatgagctgctttatactttttcctacacgtttggctgtattccctttgattgccttttgatatgacaatggattttatatataatctttaatagaaaacagaaagataatttagtttttgggctagcatggttgatcaaaatctattttttattggctgaaatgcgtaaaatgcaaaaacccacctcatacacaagcgcacccatttttcttttagtttttagtactgcaacaagaacatgccctacaaacacagaaattgtgatatgttttgtttcacttgtttcccataaaaactgtacggtgcatttatgattgtatatgttgggaaattctgtgtattctgatagcagagaacttgcattttgacaagaactgaatgctccacttataacttcacaaactgtagactagcttcagagtcctaccttcgagccttgtttcttgtccaccacttgtacagctgccatgtcaagtaccacaggccttattcatgccctgatacaaggtggacattgcaccttcttgtcaagacactggatgagtttacacagcaggcaacaggagtatttctggaagccattactacactacagtggaaaacgataacattacacattatacatgtgactatgaaccgcttaactgtttccactaaataataagtaaatgcatctctaattcaactttcccttctatatatcatcccccaaacactcacccccattcaacaacacctaacacaaagggaattgtggtggagcagaagttaaagtggaaacagacagctgtcttaattgattatgatgcaattttttttttctgaaaatgtttcaaaatcaaaagatgataggaattatttttgaagtctgtcccagggtgtgggagggtctgtaggaactaggtccctgacatttgaacttcctggcaaagcttccttccttaatgctggcaatggccaacttagtgtctggtcttctgctttcccaacccagaaatgtgaagcttctggttgctgaggaggtcctagccctcaggtggaacggtgccatgtgtcctggagcccagatactgcctgggcagagaggtctgatcacacacagagatgggtgttggcctaggctttccagatgaaaacagtgtgactgatggctactgaggtggggctttggaaactgggtcctttcagcccatggatgaagcctgagatgtcatgcccagtgtttgaagcttacagacccagctcaattgactaataagaagcctgctttgtgcatttaactcttcggtgtttcctccctccctccctcactcccttcctctctccctccctcccttcctctctccctccctcccttcctctctccctccctccattcctctctccctccctcccttccttcctctctccctccctcccttcctctctccctccctcccttccttcctctatccctcccttgccccttctttctttcctttacttccttccttccttccttccttccttccttccttccttctttccttccttctttctttcatttaatcatcctgataggacactgaactaaaagcttgaaccctgggtttctgttctgatctaccactcatagctgtgtgtccttgaacaatcccttcatgcttctgaacctcactttcattatctataaagaaagcaagtgaacttgacagtctcttggtttcctgccctcagtaacatctgatttttctaggtctgattagtatgccaaatcacatgtgatgttgaaatgtgtgaggttatgttctcaccactaagtcattcccactgaatctttataaatgtaagctaaatattaagtaagtagtgtgaacccaggattacacagttgcttcacatggatatctcaggtaattccccaacaactaatgttttcagaaaaaatgtatctgtcacttgagatgtcccgggtactgtgaagagctcttgcaacaaagcccacatcatgtaagtaagtcctcatgaccaccttaatagttgtgtgatattattgtattccttattttagagaagaggaaactgaggcacaggaagtttgagtactagagtgtcaaagtcatacagctagtaagtgtcacggtcatcacctccaattatctctaagccacagatgacagcaattaaatgatttacccaggattattcaccctagatggcagagatagaaatagaatttcattgcctctagataatgggacagtataagaaaactccactcacttgaagttctttccaattgacaaatgtagttggcaatttattaccccagagaaatactttttccccttgcttttagatgtatctgttgttaaaaggggggaacaaaagtatcaattttgtataaagagttcggaaataatttgagttttacagggtgtcacttaatctttgaatctggttttattcggtaatattttgaaaactactcaggccaaaaaatccggataaaactactgtcctggcaccaaaaatggaagaaatggtaactgctgttccctgcatcctaggcatttccctgggcttacatagaatttattccaatgttccaccaggtggtgctctggtgaagacatggttctcaggctctccaaccccttgacgttatgcttggaaatattttgagtagattaagtcatttctcctaagaaagaggctgcccagtaaaaggaatatgattgcccattttgccaataagacacaacgtgcacacagagaaaagtccaacgggaatcctcagataaaggacaatcgtccctgaaaaagtcagtcccaaaacatctaagaaggtattagaacagtggtcttggctgagtcttatgggactagaatcaggaatttggagcttgcgtttctgctactaatctatgagtcatttggagaacctcattcttctctggactgcagtgtcctcacctataaaatgtgtataagtgtactggggtggtggggagggggttagactgtatcagccttcttctacagggggctcataagcccaatcaatggtatttgtagtccaacctcctgaagctgtgaaaaaaactttgtgtgtacacatatttttctgggaagaaggtccattgctttggacagatctaatcagaagccaggagtcctaaaatgttaacatctggatcagatcatttctaaggtcctctccaagcttcagtattctatgatgttataatctttctgggaaggaacttgtggctgtcaaattaattggatatccctagctatgttctagccgcatcctttcttatgtactctctaatgattttgttaaggcagtcacacctaagttaacagagtcctgcaacaccctctctactagattaggtggcacatcatgtgactgatgtggttcattagggagccaagagagaccagaggagctgtgagagcaactggccagatcccacaggagctcagtggtggaagcaggtgctaattaccatcctttggaggaacaggatatgcattttttgggagtgggtaagaatttctggttagacaagctccaaattctttggcctactttgaaggcactgcctgttccattggctaggatgagattttgtttcctgatgagcaccagctcagccaggaaggaaggctcagaaaaggaggtgtggatattctttgtggaggaattgtcatgcaaataaaggctccttcccaacccaaggtgtaactgtgagggagtgtcagggtcccacctttctggctcaggaaaaacatatctcttacttttttacaggagtaggtttggtagctgagtaatgtaattatatagattatagattaccaacaaacactgagatttcaacctgttctggatatatattatttgtgaggggaggggcttggagaaaaagagcaggaatattggttgggatgtagccaatgggagaaccccattattaaacagagagtgcagtccaagcattgcacccacaagaggaattcaatgtagggagatattgggagtagagatcagtgcttgggagagaggagctgggaaagaaagcaattcctccaaaggctctaagtcagcgtgttgtccagaacggaaattgagtataggaagagagattctttcttggactttggaatatctagtctggttccttttcagaatgatcagaccaccttccttacctattgcctgggccaatggttctcagccctggctctgcattaaaaccaccttttaaaaatttggcaatctctgggccaggtgcggtggctcaaacctgtaatcccagcactttggaaggccaaggcaggtggatcacttgaggtcaggagttcgagaccaccctggccaacatggcaaaaccctgtctctactaaaaatacaaaaattagccgggtgtggtggcatgtgcctgtaattccagttattgaggaggctgaggcaggagaattgcttgaacctgggaggcagaggttgcagtgagccgagatcatgccactgcactccggcctgggtaacagagcaagactctgtctcaaaaacaaaaaacaaaaacaaaaaacttaatgatgtcttggtttcatgctaaatcagtaagtcagaatatctgaggttagagcctagcattgctactaaaaaagttatttccttgtgactttaatatgctgccaaggttgagaaccactggcctacaccaatgatggaaaacatggaacatgcatgctgataaccccctcccaagttcatggaatgtgtttgtttagtaattacaacattctttgtgcactacagaacttgtgcacaatgcctggaacatagcagttgctcaataaacatttattaaatctagtgatctttggggcaagatggggtggtgatatctttcacttcagcacccattttaatttattccttttcattaaaaggacagtgaaaaatcatctttttttttttttttttagacagattttcacttttgtcactcaggctagagtgcaatggcacgatcttggctcactgcaacctccgcctcctggttcaagtgattatcctgctcagcctcccgagtagctgggattacaggcacctgccaccatgcctggctaatttttatattttcagtagagacggggtttcaccatattggccaggctggtctcgaactcctgacctcaggtgatacacccactttggcctcccaaagtgctggaattacaggtgtgagccaccacgccccaccatcctttctatttacaattctccttctatttgaagtatgcttcctcttttgttgttgttgttgttcttttctctcattactttcttcctctcctttcttggaaagatacatactaattccaagaagttagggtggaagtaaacaacatggaaggaagaagaagaacagcactatcgtagtttccttgattattggtctcaggtgatgccttggggagcacaaatcccaccccaaccccaaagagaaggagctctgtcatggatctcaagaaaaccaggccaacccaatgaggcccccttggcccaaggaggtggcaacactttcagagggatgaataaaggagatggaaataaaactgggacatgaaaaagcctttttcaaaaagaagctctcttttgttcccgcaccatgttgtcatcagtaagcaggcttgcttatggaatgccacgatggatccagataaagaaaacagcctgtgaagcaggacaggtttaccccagatttcaggggagaggggtattcctcatcccatgaggatggtcagtctagagggttaagaacagtgtgtggaggaaaaagaaagaataaattccttagggtatttttatcataagccttcagttaaaggaaaaggaaatattaaaacttatgcaagggccagttccactctccagggtctcagagctgttcctagaaatagtgtgcatttttccttggctacataggtgcttcaagacattttcttttcatacaattatcacagtttattagcatgtatttgtgtattgcctactttattattccattctcacactgctaatgaagacatacccaagactgggtaatttataaagaaagaggtttaatgggctcacagttccacatggctggggaggccttacaattgtggcaggaggtgaaggaggagcaaaggcacatcttacatggcagcaggcaagagggcatgtgcaggctaactgccctttataaaaccatcagatctcatgagacttattgactatcatgagaacagcatggaaaagacctgcccccatgatgtagttacctcccatcaggtcctccccaccccacaacacatggggattatagggctacaattcaagatgagatttgggtgaggatacagccaaaccatatcacctaccttactcattagtctcttggttcaatactgaatccccagtaccttgaatattagcacgtacaggtcactcaaaactgtgtgttcggtgaatgaataaattgcacaaaaattcccacagcatttattgtccaaagaggcagagaatgattggcagtaatttattattatcctatttatttatatttttatttgttaaatcagtcctttgttaaggcgatttttctaatttgattaaaaaatttatagcctatgtgtgatgtgaggagagacataaaagactgggtgtgtcctatgaagcctctcagagctcatagtctagaaggagagataatcaatgaggcaatattgaaagcatcacttaggtctcagggtactctggggccacacagaaacatgccttcccagacaggcacagcttccaagaggatatttgggaagaaaactatggcaaacaatgaaaaccaagggaagggtcagctgtagggaggagaatgcttccttcctgtttgggaatgggtacagaatggatcagaggggtgagcaaaagttggggggattagttaggcaactggtgcaataaatcaggagaaatggatgaagacctaagatcaggcagtatgtggaaattgtaagaagggatggataaaatgtgaaggaaatagggttgagggcatttgtggggtgatggaaactaggagcagaggagagactaaaaaggagcatttgcagtagtgagaaaaccaggcaaagaggagttgaggagttaggaaactaaaccagcgtactaaacagaaggagtggtccgaagtgtcaaacgctgttgattgtggcagaataaacagcagtggtgaaatgaagacaggaggtaggttataggtgagagaggagtgaagtgctaatgtctctttctgtaatagatgctctacctagaaaaaaaaaaagagagagagagagaggtgggatggtagctagagggagatgtaggaccaagctaaaacttctaaaatggaaggaaattttcagttgtgtaggcgagaggaaggatccagtgaaaagggagaaaaaagaggaattgggatatgtgttttacccttttgctatggattccacctttaaacacttttgttatcatcttcaatgacttccttctgacgcattgttagactctcctgctgaagcaagtgctcaatcatactgcaagcctcagacagcatctaatcaaacctgatcattcccacttagctggcttctgatagttgggttactttatctcttggctcagagattcctaatttgctgttcacagatcctcatggggtccacatataaaattgtaccttaccataattcatttcataatctatgtattgtttcatgcttttgaaaggatatattggcttccccagtctgccaaagaagtccatgacacaaagatacccccaaacccttcatcgatatactctaagttacagctatgacaagctctgtatttagaaactaacaactttctcctgtttcctgtggatcacccacttaccttctctgttccagatcaatgaatcagggaaattaatagactggaaatgtcttctaccaattattcccaaagatacgtaataatcacctcgagaaatagacaaaagaatagattccaaaatcccatattacaaaatcccattctgaaaaaccctgaatttagtacatttaaaaaggaaaccaagaatctgcctttttaaaacaagctccttggctaattttaatgcagatagcctttggacaacacaaagaaacatatcacttatctttccctggctttttttaaaatgtgtcctaaatatgattaattctattgaacatgttcagttactttgagaaatatcaaatcctcaaacttaaatcttttccaagtttccccaaagaaatgccgccatctctaatctttactcacgtgaacaaaccaatctctgttggtatttgtttaaacattttgagaggctcatcacatcacagagaatgacatacaaatcacagcacatagggaaatggctgtgtgtatggaacttttcagaatggagggaaaagggaacaatattcttagagaggtacagttttaaatttttggaaatcgcaaagcttataaatataagaaatgagtttaagggaagataaaatgtaataggtggtgatgcggccaggaaaaacaaaaagcctaaataatacaattaacatttttttttttcctgtgaagcagccacaaagtaaaccaggaatttcctctaataccaaaccatcagatgggttttcctgggagttacttcccacacctgaacaaaatttcagctgatcccaagtgacacagtgtgtaacgatatcccgctatgaggagggcccatgattgcaggactcttggcagtactagtgtgagttgaaacaatgaatgaatttgccagatctgatcaacagtttcaaggaagagtggactcactaatctttgagatctgggaaaaccttgagtggggccttcgtgttcctatctttctgagttgaagaaggaactcatccttcatctccaagtcaatggtaccagtggcttctattcccaggtatgtcaaattcctgccaacaaagctaaacagaacatttcagcaccttgacccttactgaggaatttttaaaccagggttagaagtggagctaatctggacagaggagaaggtaaaagacataaaatctgtctccagtgtctgcacttcaattaaaacccatatttgaatcatgaagtaagttgggtctacgacttctcaataataatgggtttcaataaacttgcagagacattccagaggctctgtcaatatatcaatcaatctataactcttttggcccccaaacaatgtttatctatttaactgtgattaccagatgttttggttgatctactaggtgcttgacagcagcttttttatttatagaaaaaaaatcaacaagagtgtggaatattattctccacattcaacaaaaccattttgctgtaatgacagccactaatggacagcagccatcagttaaataacatcagccaatgatggcaagataatatggggtacagttttcatgtgagtctccaatttaataggggttaaaaataatcttcaaggtcatcatattggtagcacttttttcttatcagacactgggagtaataatttatgaagcatttttgagttcacttgcacatctgctcctttggaccagggaaagctctatgagaaacacattctccccatgttcttatagcacaacagggttcatattttattgatgggtttcttaaaataatggtaataaaaatataattttaggcttttccagaagacacctgattactatccagtagccacttgctcatccttttctcttgcctgcagagtcctccccttattatagatatggaaaatgccagataattttttctcaagtcatccttgcaaataagttcaggtcatgtgaccataacccagccaatgagtactgagggagaagtcttcacagaaaatccctatagaaagattttattttctagtaagaacctgatgtttgagaagtgattccttacctctctgtctgctggctgtacagccagttgtgtgagaatatgtgctcataattgtggcagccaccttgtgactatgagaggcaaaccaagagatggacagtgaagtgtcccaacgtggttgatctgctcaagtaaccaactctgaaaacacctgtgtctgggcagcttattaaatgcagttggatatctgttctttgcagtcaaagtcttcctaacaatgctttactaattcattttaagaatgtttactgagtattcactaaaggctagccactgtgacaggcaccgggctatcatggtgagcacaacagacattatttctgtactctagggattctcacctaggggacagacagaagttgattagaggctatctaatgtcatatttagcttcattgcgttgggagtttgtggttagagaaggcttccctgaggaagtgatgcttgagctgctgtctgaagaatacatggaaactaatcagatgaagagggatgttctcactgtgcctttgtgaattaatcaatcaaactatctcctgaaatcaatcaaattatctcctgaaagccaatgaagtcaacaaatagaatcacaggagaaagaaaagtcacccccagttgtcaactattcagccaactgtctcccaagttagtgatacatcaagtgttgatgaggaaggatttttgcagactgacagcccaatccttcttcccgtgggcccatgtggacaccttattgtgatcgttcttatacatacaaaacgtcgtagtttttatggtagctgaggtcatggagatcagttttcatttgcttattgtacttgttataaatggtctaataaattatctctttttgctaagaatttccataattggtttcagcctgagggcacgttttttgtttttaaacattcagccattttgatttatgtgaatgtgaaaaatctacattttttttctgtgtttaatccaatctacagaatattatttagcgcaaggaaatctccaaaatagctgaagcttttcacttatttagatttcaccaaagagtccccagggtagaacgaaaacatctccaagctagggtaattttacaaaaactgcttagagttcaacagctatttctgtactttcagaattctgtaaacatatgggggaaaatctgtccacagttatgccggagcagtgcccgagccctgaattcccctatcgtttcattgttgggaagggctagagccctgattcaatgtctgtgttgcaaaggccctggagctttttcacctttctatttttgccctgttagacaaggtcttccgtcttttcttccttgaaaaatctgcttatttcctcttccttcctgcgtccttccctcatttctttcctttcttccttcctcccacttccctccctccctctctctctcccttccttccttccttccttccttccttctttcctttatttctttcttccttcctctttttttcctaccttatctcgtttccagatatctgcctaatttctcctagttctggtgctacatcctcctctaacttagaatcacgcttaagtgctataggccaagtatgttgtgtgttagggaggaacagagtactttctatttgcatcaaaagggattttcatgtttaatggcaggaaggattttggtttgtgggtgaggagagggggtgctgagagggaagtctgtcttgattctaaaaacggagaatatttctaaagtaaaatatcccttctcatgtatgccagggtcctgggcaatgacagctccaaaatatcagccactttcccctttttgactggggcatgtcctgggacacttcagtgtgacctcacatttagacactcagtgtccaaaggagttaataaataaggctttgacattttctctaaatgtgattgtgcgtacatgcatactgttatagaggttaatgatgaatccaaagatgtctattttacaacttaaaacttgtgtccttttaactgaaccattcaatttccaataaaccatgaaataatactatttataaatacatgtactaatcttataaatatcacaattttctattgcattgtattattaaaagtgttagcaagtttaagataaatatttaaaacaattagtaattttttaaataaaatgataacctttatttttcaatattataggaacttaaaagaatgatgtattttaggcttttcttgacttctgggacaacgcaatcttgtctgtttcactcagggaagtattctttcggtattgtgatgataggattcctaatctgaaatctaaacaatttctcctagaaggtaatgaggttttacacaaaccttattaagtcagtcctttgctaattgaatgtttaaaatctggggcctactgggtataacatttattgagacaaagtaattaacattttctttcttgatgcatttctttcaatattatgcttaaaacctcaacacatagtagaatgcttagcatataataggagttcataatagctattaaaaacaaagtattaagtaagagaaatgtgttctagaactggcagtcttcttgaaccaagaaaggctcaagggaaacaaaaggaatctcaactatgtacctcagatttctgagtccagaagttcattttcagtggcagtacaaatgtgggacatttttggttaaaatacgtattttactgtataggtccactgtgattttaaatgcccttatgttgcttaacagacattacttatatctactttacaatgtgcactgggcttcacagcattaaaggtggaattgttttaaaaagtagccttttagtaagtcagatacattatcgatatgcttccaaatacttggtctaggaggaaaataaggggaaaacatagtgaggatatattgaaaaatattttttttctcagaagaaaggagatacagtttacataaatttgagaattcggcattgcttaattctccctaatgtctacgagaacttctgctttaaaaccagccccaagaacacattggtcagccagctcttgtgctgaatcccagaatattaagaaccaatttaaatgcttattaaaattattattcttgtcttacttttatatgtctatttttctctattcatagatagtcatctctatctcagttacctatctaaataaacatatacatgaaaccaagcataataatgccatacatagaaatctaaaacaaagagaaattttaaaacgattatttatatgagaaagagttcactcggatattgttgcattctttcgtggttgctaagtgcgtttattccagaagggtctcctatgcagcaggccctgaggtaggagtaataagaataataaatacagttgaggcagagatgtcggggtgatgctcagaggaagccgatgttgaaccaggtacattatagaaataaaatatctaaaaaggaggagagaaaaacatttttagtttcagcaaaattgatgtaattgtgaaagaacacattttccaagaacactgaggactgtgggtgacttgaatagaggatggttttaatggagaatgtgaaagaagatgctttcaaattaaattcacaccagattttgaaggacctgtgacctgtggtaaggaattttgtagtttaacttttattttttattttattttattttttgcttatttttgagatggagtctcccaggctggagtgcagtgatgtgatctcaactcacttccacctccacctccgaggtttaagcaattctcatgcctcagcctcctgagtagctgggattacagatgtgtgccactgcacccagctaattttttttttttctagttttagtagagatggggttctaccatgttggccaggctggtctcgaactcctggcctgaagtgatccgcctgcctcggcctcccaaagtgctaggattacagacatgagccactgtgcccagcctaaatttaacttttagactatttccatcataagcttcattagtggctaccttttcactgttgagtccacagtgattattccagggcattgcatgttatagatgcttaataaatggttgttgattgtattgacagataggtatttttagaaagaggagcaacaggatcatatctgtgtatttagttagtcaagaagagaaaaattcagacagcatatatgtaatgggaaggagcagtcctcaagcaataaaggtgggaggcgggagataaatacctcagcttccccacccttgtcagcaggagtgagccccagatgcccatggtggtaacatacagtagtccccttatccacagttttgctttctgtggtttcacttacccagtcaaccaagagctgaaagtaggtgagtacagtacaataaaattctttgagggattacagtctcatgacttttgtggtatattgttataattgttctattttattattggttattgttgttaatctcttactgtgcctaattcataaaccaaactttatcataggtataacgtgtatagaaggaaacggtgtatatagggttcagtaccatccacggtttcaggcgtccataggggagacttgaaatgtatccatcagggataaggaggaagtactgtatttaccaacatgtcctgtattggtttcctttcttttctgtttaatttccttacttccccaggaatgcttcctgggtttaccttacaaatagacttcccaaacttgcaatattatatctcaagttctgcttctgggagaaccccattcaagacagagtcacatggtccttataacggtctacacagagattattagggcctcatctaaaacagtgaccatgaaaaaagtggaaggcaaaattctaagatattgccccaaatccacatcccctgatgtccacacatcttctccaagctattcaatcaagcattaatctcagtgcttctgtgaagggatattgcagaaataattgaggtcacgaatcaattgactttaagcaagggaattatcacgaatgtgtctgaactaatcccatgaatcctcaaaagtgataggcatcttcctgatgagacagattcaaggcataagagggatttgatgggagggagattctccattgtagctttgaagatggaggtgccatgtggcatggatggtgggtctctaggagttcagtgtagcccacagctgattccagcaaggaaatgggatctcagttacacagcagcactggatccttcaatggcctgaaagagcacacaagcagaaactccttcagagccttcaatgagtatgactctgagcagaggactcagccaaaccatgcccaggcttcttaccaagggaaatggtgagctaacaaattatcttaagctgctatttttttttggttatttgctatgcaaccatggaaacttaatacccccaaaaatggtgttaggtttaggatagaggtagaagtcaagccttacaattgctagaatttggtggctgattgtgtcaaatgattgaaaagaaaagaggaataatcttaaggttctagtctgagttcataattatgccattaatgaaatagaaaatgtgtaaagagatttttttttcaggtaagaagtgttttgttgttgctgttttagtttgttacttttgagatgaagctgtctagtaagcaactaaaaatacaatccaaagctcaggaacaattctgggtctgaagaacaaacatttggaagtcattggcatatgtttaatgttgaaatcatggaggatcgccatacaatgtggcacatatacaccatggaatactatacagccataaaaaaggatgagttcatgtcttttgcagggacatggatgaagctggaaaccattattctcagcaaactaacacaagaacagaagccaaatatcgtgcgttctcactcataagtgggagttgaacaatgagaacacatggacacagggaggggaacatcacacactggggcctgttggggggtggggggctagaggaaggatagcattaggagaaataacgtagatgatgggttgatgggtgcagcaaaccaccatggcacgtgtatacctatgtaacaaacctccatattctgcacatgtaccccagaacttaaagtataataataataataataataataaaccatgggggagggtatctgagtattttgtgtagatgtgttcttcactgcttagtccttctaaattttggtaatagggctttcttgactgaggagaaatacagagtacttataaaaatgggaatttattagataatgtgttatcttaagattgtattccatctaatttacaataaagtaatttttaatgttctggcttgtgaagtagggtatggatagcaaatacatggcactaaagccaccattccccaattctgagcctatggcattactaatcaattcagtaattttcccttcagaaccagtattctttccaaccatgctctgggcagcaacgaattgattatagttcacactcatttgcaatcatgggttagtttcaaaaccatatccatttaataacagatacgttgagttgctacttgagggtggagggtgagaggaggatgaggatcaaaaatgattgcttattgtctgtgtaatggaataaactgtacaccaaacccctgcaacgtgcaatttacctatgtaacacacctgaaactaaaagttaaaaaaaatctaaaatacattttattttgatttttctttaaaaatgatgttttcttatcttttacatattgttgaatgatattagatagcctcctgaggaatttgttaagatggcaagaagtggttcctacaggtggtttggatatgaaacattgcaaagctaagttgaaatagcatgaaaaaagtataaataggaatttcctttgatccttctaataaggctgaatggtgttgtgtccacagttattaagttcaaatattataatttttgattcctatactggaagataggggcagttcttgcagttccaagaatgacgtttttataactcagctttatgctgagagccaacgtaatgcacagggattgatctctttccaaccaaaaatgggtaagatttgcacaaagtcatgcatatcaatcatccaattgttgtctcatcctgccatcatcttgagagacactgaaaactctagaaccactgcctgagacacaatttgtatgacccaacctaagaaaaaaaaagcttaggcagctccatttctggatcacagggtgttaacatattagtcaacccataaaagctcccactgatttatatggagttgtagcgttgcgtcacaggtggaggggcctaaattgtttttggagaaatatagggctctgtcttcaggatcatgacccgtgagtcacacccagggctcccaaagccgaggccagtggggacgtggaagaacttggcttagccacagggatgtgactcactaaaaaagatgaactggttttgaaaagtaacaagaaccaccttctattctctacatacctgctttcattccataacttaaaaaaaaaagcaaactaggagttttataagtttttatcagatatgtaaacatattattatttacttttagaatcttggtcaattttgctgttatagaagtggtggccatagctatcttttgaataacaggttgacaaaatgataattgcattacttgaagataatcacttgccaaatttatacaataagttgacaaagttgtgacaaattcataggatgcgatatccagattcaactttctagtcatttaagggactctaattagtaatttatgaaggctcattagcaggaagttcaaggtaattgttaacttactgctgtccatgcagtgacaggtgatctgaaagcggagtgacatgacaaatgtggacagtgtcacatcatatccttatgtggcagggaaagctttcatttcccgaataggtgaggcatatgtgttttgggctaaaactatgattccaggccaccagaattcttatttcatcattttcaaaaattaagttgggtcaggtgtgatggctcatgcctgtaatcccaacactttgtgaggccaagatgggaggatcacttaagactaggagtttgagaccagcctggacaacatagcaagacctcatctctactaaaaataaaaaatctgagctgggcatggtggtgtgcgcctgtagtcccagcagtttcagaggctgaggcaggagagtcacttgagtccaggagtttgactctgtggtgagctacagtcctgccactgctctccagcccaggcaacagagtgagacactatctcaaaaaaattaagttgaaaacaattttaacattttaatatgtgagcatccctttctatgactgctgaattttattctaagaatagataaaaagttaatttcaagtatcgaaaacttgccactttcttttttcatgtttggattacaggcctagaaacttcaaaatgtggaaaacataagaaaaaaaaaaaactagactactgggaaaatgagaatgaatggagatgtatctgacgttttgggagcaggctagattcagatcttctctccctgtagctaaattgggtgggcagctggcctcaagaacagtccacccacaacctccaactcctggcacgaacctgcttgagcttggaagacattgtcggccctagatcccaccctgactcctgcatgttctggacacctccatcaccactgagcagggaagcatgttcttcctttctcattcatttgcttccaaaagaggagctctgattttcttctctcttgcagtgctttttcctctatatagctcttaacctcctctcattctcttcattcccacctgaaaggtgctagttcatgtgtcaccaccatcttgcctgaatgcctgttccggtgatcttcttgcttctaccatttgccactataagtcgttctactcccagaagccagtagcatagtttcagaaggctaacataatagtgtcttttccttgtgggaaaccatcagtggtttttcactcccttaagcacagccaacaacgccttcaatgacctgctccttcagccacactggccttcagacatgtccccaaaagcactcagttagttctcaccctggggcctttgcacatgccactttctgtccaagcttgcagaccaatatatgctttggcaccagctctcacagagcctgcagcacttatggcaaggtgcatatgttgtttcctgtctgccttcccagttagacttgaggagtgctgtgaggatgggtatagaagaaacatctgttttcccagggcccagtccagagcccaccccatagtggatgctcaataagtacttgccaagtgcttcctagaaatatgttaactgtttctttctgattattagattttcttatttgatcttttctggcaaagtggttgcttctgtattttcttagaattccatttgtgtcataagtgatctcttccctacttcatagcctttatacgtgctggatctctcaggaccaacaatgctgtagctcttcaggctaagcagtgaagatgagtttcagggattgtgagtgttttcccagaccttctacagacatttgcatatgcataggcaagtgccttttgggccctcaataaatatttgttgagggaaggacaggtggattgataaatggatgggtggacggatgaatggttgggtggatgaatggttggatggatggatggatggatggatggatggatggatggaagacaaatatactgatggatggtgtgctgaagatgttgacaacttctttagtctgtttatctctaaactcctttcccctctgtgaataacttgtcagatcccttttttgctagagacactgtcaaggaaagcatttcctaatgcttgtaacactgctaaagcaagaagaatattggcagaaacttctattttcaatgcagtttttaggaaggttaattactttgtgtttctgaagatgtaaatgttcctcaaggaagaaatctctgaataaaactcaatgacaagatctttataatggacttctggttattgctatgtgcaatgccctacctataactcgcattttaattgatgtatcctgagcaagatttgaaacagatctctttccctctcttctaattttaatgagtcttctctagcaagcacctatatcaccagagagatgcagagaacctcagcatactctggatgggcctccctctgcaatttatgatgaagtctgacttcagagtgagttcgcagcctccttcctgcctctcctctggtttccagggtagcagactcttgtctcccttcagacctgggctctcccagctcagtcccacttggcatttctaactgaggttatggatacacattgagcccagaactcattgcttttttggaaaaggcaaaataagagaggggattttccatattcacatttttccacagaaatgtattcataagctttaaacttgcccaagctctgttaatgtatgtggttggctcctgtgccaattttcattgtgaataagatgctaaataaaagggttcttgtctttcccctttctcctcccctcccataatttcaacttcataaacctattttgtaagtgaattaggtcttaggagagaatcagaaacgatgttgttcttttagccgcttacagtgtttgctttaaacccttgataggaacgtgggcttgtgacagcagcggcagaggtaaacagatgactttatatataatgctttttacaaggtggttcagttcgtttctaaccttggtctcggcgtcatggaatgagccagggaaattcctccccttaaccctaccctgcacgtcctcccttcaagggcaagaaaatgtccattttgcctttggtttcacagctctttctccacagtagagcttgcataatgctataccccccaatcccagggaaccccggtagtgtcaccaggtatttttattattatcattattattttcatcaggtgactgtgaatgttcacaataaaagttgcaatttttatgagccatgagctggcgtgtcctggcatgtcctggttgtcaagtttctgtgcattttggttcaaatgttccctgcctgtgtttattcctggtcagaccacacctcctgggactgtctttgtggcttttgctcagctgctgactcaagttgcagaagacatggggaatagtagagcaaggtctgcaagattctggcctgaaggaaaaggctccatagctctgcttttgagccatggaagctgcctgcccctcccttttcctggaaggtcccatgactagtttcctaataccaactagtcaagaatatgtagggctaaagggacattaatattaacataagtgatacagtgaggaccagaagccttggatgtaagggagaacacgtgagctttccgtcagagaagactaggttcaaataccagtcctccaaggaaagccagctccttgctggggaccttgggctagtgcttagtatctgatttcttcatctggaaaatagctataataatggaacccatcttagagggttggttaacattatatgaaaaaatgaaagttcaatgcacagtctgtgatctgatataggtcaggatgcaatattgttaatactattagctactataaatattattggtaagtaataatttcctataattaatataataaacaatattgtatcaaaattatctaaatcattaatactgataagcaataattatttactggtaattatagatattaatattacacattgattgatcttgcagaacctctttttcttcatctagaaagcagagattaacatggacattgaaaaaaacctctgactctctagggattttgtgaagatgaataaatgactttgaacagtgcctggccctttgcacagtgcctagcccttcagcctgtaacaagtgttgctgtttttaacgagaggttagttgtccttctcaggccctctgtaaaagaatgtattactttgcttttcagccagtgtgactgtctcattccagcacttctattgctgtctataaaagatgactgtggccaggcacggtggctcatgcctgtaatcccagcactttgggagtccaaggcaggaggatcactgaggtcagaagttcaaaaccagactggccaacatggtgaaaccccatctgtactaaaaatacagaaaaattagccaggtgtggtggtaggcaccagtaatcccagctactggggaggctgagacaggagaatcactgaaaccccagaggcggaggttgcagcgaactgagattttgccactgtactccagcctgggtggcattgtgagactccatctcaaaagaaagaaagaaagaaagagagagagagggagggagggagggagggagggagggaggaaggaaggaaggaaggaaggaaggaaggaaggaaggaagtaaagaaaaaaagatgactgcaaagtgactttagaggcaggtcatgggcctggtgacacccagccatgaggctggatggggggcccagtctcctggagaagatgatccctcggccttgtatatctcaatccaggcccaaggtcatggattcttcctggcaggctaggctgatggacttggtttatgagctgcagtctgtgcctaaagacacctaggaggaagagcttagctgctgaatgtacctgggggaccttccccacctatgttgtctgcctcagttgcctcttccttgggaagaggtgcagacagaaggtggcagactctgggatagatccagtagagctgtaaaaaacaggctggcttgtgtcacagcttgcctgtccctttaagccagggcttctggcagacggacctttgacagtctggtgaagcctatggattccttcctgaggatagttttaaatccataagataaaatatgtggggtttcaagggaaaccaactacataccaatttttttttttttttggaattatactacagtaatggatgtatttctctaatagtcaattagaatgatatgaggtaggtgctaaaaatataataattttgaagtagtaatgagtgaaaatggtaccatagggcatccctaggatatacaaatatttgatttcttttaggggcaaagtcatgcagcctgctaatgcttctgtgatttgtggtctgtgtacatattgaaaagaagtgaaacatttcagttgaaggttagaacaaataaggtggaattttctctcctgtccaggttcacagaccacataataaggagtccccactttgctcagctggtctcctaagtctctgtgccatgagaggtcgtggccccaacttctctttgtcttgtcatctcatttgcgtcacagcctcttgcgtgctctttgacctttatgcagtacccctgcacccatgatccaggtcgcatcaggcctgtttgtgcactctcagagtttaacggaagaacccatctttcatacttcattatttaaagaaggctagactgattttaaaagcacaatgtacatgaaaatcacctgaagtatttgataaaatccatatttctataccaacaccctcaatttgagttgatgggtctgaggagaggccctggtttctatattttaaagaactccctaaatgcttctgaggaaggtgctgcttgaacaagaaggtgcccttctgctaagagacaagccttttccagcttgaaaactattattttaccattctatattctgagcaggaaatgaatggacagactgtatgtagcgatgtgatatacaaacagggatggcagctacaagaatgtggaagtgtggaaggaagaaagaaaggaaaaaaggaaggagggggagagaagcagaaaggaagagaaaaataagggaggaagaaagaaaaggaaggaaagaaaggaagaaaaaagaagggaggaaggaagaagaagagaagcatggagatagggaagaaagaaggaagaaaggcaaaaagaaagggaaaagatgttctaagggctattaaacctatgggaaaggaaatttttatcagcagaatccagagataatataaatcagcaagaagaaggatagattgattttgaaattcaacaaatatttatcatgtgcttgctacattctagggcaggggttgaaatctcaaacacacagaggagccaggcaagatggtgctgatataaaagattcagggttctctcggtcctctatttttgcaatttgaggtaaacagtttggctgcataagaaaaacaacaggctgaatgtaagagttcatgctgtcaaactttggttcacagcatccggcatggctacctagggccttgctttgtgtacacatgaaatctatcttccatattctccaatttttcaagacaatttgacattttatagaaatctctttatgaatagatattggaagctattttagtactatttctgcaaaacaaatttacttaaaatgtatccactttaaaacaatcattttatttttcccatggattatgttggttggaattcaggcaaagtggagctgtttttttttttttttttttttttttacttcaccacgtctgaagcctcagatggtcagactcaaaggctgggggaagtgagggtagcaactaaacatctaagggctaggatcacctagaggctcacttacatgtctagtgcttaggctgggaagactcaatgatcaggactattaactggagcaacttaatgtggctttcccatgtggcttgacatcatggcgggctcaaggtagtgggactcattccactgtggctcagagcatcaagcacaagtgttcctgcaaagaaggagggagctgcatggccttttatgatccagtcttagaagtcatacaacatcacttcagtcatactatattggtcaaaaccgttccaagcccaaccagattcaaagacaggaaagatagtctctacttcttgatggggaagtgacaagtttacattctagaagagcgtgagagcgagagatattattgcaggcatctttgaaaaatagaatttgctgtcataactaattcaaaactttgttttatcctgtaatcccagaacttcaggaggctgaggcgggtgtatcacttgatgtcaggagttcatgacaagcctggccaacatgatgaaaccctgtctgtactaaaaatacaaaggttagccaggcgtgatggtgcgcgcctgtaatcccagctactaggaaggctgaggcaggagaatcgcttgaacccaggaggtggaggttgcagtgagcccagattgtgccactgcactccagcctgggcgacagagcagcaagacttcatctcaaaaaacaagcaaacagcaacaaaaaaaacccttattttaaaaataagttaaacacagtgtgtacagcataatgcatgtttgtaggctagcataacagagggttgcactagttttttacctctgttacagggtataaaaattcggagatgattaagatttggctcctcttcagagaacgcagtcttatattttggaattttggaatctctatgaattacatatttatactttttgtacccttgctggagttgaggagagttggatgaaagtagggagggtactgagactaggaggcagctatttattagaataacctggaaaatggaccaatcccccccattcccagccccaagaagtttacctctatccagaagaggagcatttgcatttttaatattttgagaaggttcagaaacccgagcttcctactgcttcctattgagaagcactgttctaaacagacttctacattgcaattggtactcacatatttagacatcagtcttaccgcttaaattcttcatttgcttgtaaaagccatgtagctctaaactcagaataatccattgtctactgcccttcatccctcatgatcaagtttttctaaatatgtttggaaattgacatgtgatttaaaaataacttaaagtatgtctgatagcccagataaggacatgtactttgtagtgccattcatggaaatagtgaccttgaaaaaaaattctggagggccttcctctcatcttcctttctccagttcctatggatatggaaggatagggctaagaattgctgtctgccttctgacttaataaggagacttttgctcaaataaacactgagttcttttttttttttttttccaagccattcaccaactcatataatgtatctttgtgaggtctgttccttccataggataattcagaaagttatacctaggctgggcacagaggctcacactgatgatcccagcaccttcagtggctgaggtggttaggattgcttgaggccaggagttcaagaccagcgtgggctacacaacgagcctccatctctatgaaaaaatttgaaaacataattttttaaaaggaaagttatacctgggccagggattctgtaccgttcatgatcttgtattccagggtgtgtaatattaggaaggtttaggtttattgtctaaatgttaattgtgtaaataaggtggtaaccatggcaacccaatcccacccccctcagcattggcaggtggccagggaggtgtgatcacaacttctatctgagctcacctttgcaggtaatggggcaggtatgtggcattaaagagcaggaaggccagcaagggttggtaattgtttaactcttccagtggcactcctctgagtacatggaccacacctgcaaacctggcaggacgtgccgtgcatgactggacggaggcactgatacactcggagccaaggaatgggtttaggcaggagctcagggctgaaatagggagcccagcctgccgggctgcttgaaatctcaggactcataatgcttgtgctttagggagacaactgctcattagctggatgaaattaaccagtcatgtcaccttttgacacctcaatttcctcattactgaatagtgagggatttgaacatattatccctaagctaccttttagctctaacatagactgagtatagtctatgtcaagactctgactagagtgtaggtgttttcagattggaagaattatcagaatcacttggagaactcaacaaaacacaaaccactgagctccacccccacccagattactgattctaaagatctgaggtggggcctgagaatctgcatttctaacaagtacccaaatgttgctaagctgctgatttggggcccatagtttgagaaccactgttctggtctgttattgcttggttatgttctggggattttcctgggccacctcatgtagctgcaacattctataaagagggctcctttgctcaaggagtgaggttttatttcctgaattttcccagccctttgttgttaatttttccaccagactgggcatctttggaacatcagagtttgaaaagagaaaacaaaatgaggcatagctcattcgattaggccaaggggccatatttttaccagctttatgtcttatgacttgcctagtactgtttcttaggaggaggagggagagtaattaaacattttctggacttaatattcaacttgcattgccttagttaatactatttataatctgatttgaaatatattcagcacagacagtgtgatatatacttgggattcatttttatctatactctaggagctcattgtatgctgcttctaaaatagctcttaatgatttccacctcctagtattcacacccttgtgtaatccactccctctccatgtgggttaaccctggtgacttgtttccaaactaatagaatgtgacaaaggtgatgggatgtcacttttgagattagaatataaaacactgtgacttccatctttcactctttctgctgctggccatttcctctctggcttttcctgaatgcttgctgtgatgatgaattcagagaggcctgcatggcaaggaagggtgagtgacttcctgctaacttccaacaggaactgcagtccacacccttaagactgggcttggaagtcgatccctccccagtcaagctttccaatgagaccacagaaaagaccaaccccttgatcacagtcttcaaggagaccctgaggcagaggacctagttaagtcctgtcaagatttctgaagcacaaacactgagtcaatgaatgtgtgttgttacaagctgccaggttaaagataatttttaatgcaacgtgagataattaacacaaatctattgacaaaggatgtttcttagggactaggtagtcaacatttggaaaactcaaatcataagaccacacttaatggtaatgcagagccagattgaactggtttgtgaggggtgcttgtacacaactctttctaactccgtatacagagatggcatgttaatatagtagcttgaagtaagcatgatgggaatacttatgcaatgaaaaccagcaagcaatacaattttgagatgccttttactagcatagcactgtactttaaaaaccctactctaagccctagctctcactgtatctttggtgaataacagaatcctggtatatttgcataatggtgtgcagagagtggtgttgcattcatgaagccagggttgttaaaatcatgtggattgtgggataatattacacagggctgctcccttgtgtgaacagggtgggtgaccccaagagtctgcaaacttctgaatagcatctttagcctaggaatatgaaataatcccaactctgtttatagcaggtcatcaatacctgaattgggtgaaattttggcatggaaatatatatatttttaatctgtctcaagtgtaccttctgggaaaggctctgtggaagcatctagctagacagagaattaagtaaggaattcctggcacttggtacctccttgcaaataaatatttgtatttggggaaatttatctctgacaattacttttattgctacatattacctgatgggaaggttggggagaagagacttagcttacctctatttgttgagagctaccaatatcaatagaaaaggaactagtaattgcaaatgatcaaatccactgaggtcagtttgtgggataaatcattacagtaaccataaaatacagatatgctacaagtcttcattttacacttgaagaatttggagtacaggcatggtggtcatctaactgagtttaagaagcttgtacatgacaaacaaagttaaagggctccaaatcagctctgaccccaaaatcatgtttctaatctctctgctagaggtcactcctcccccttttcactgttatagcctgaaaaccttagaggggaaattccagggaaggaaacttcacaggctcaagtttcacagtcttccctgacaggaaatcctagctaaccttgaacttcagggtcatctgttgtggtttaacaccattttttcatttctagttaaaagggcagctctgctcactgtcccttgcatgtcatgccctgaaaacatctcaactccctcttgttactgcctgaaaaatggattccccgaaataataagtcctccaaattcagacatcagctttcctcagttaatttctgcatcgtcatttataatattggaaggttcttacttttaagaaaatttggaccaatgccccaaatggtcttcccatctcagagcaaccaaaaaatgtgactgtggctgctgccaggacccctacatgcaaatgaccagactgtagagagttaagtcttgggacccacacatttctcccaggggaagtcattatttcagggcttttcactgtgttcatgaatttcttctgtgatctaggccttggggagaaagaacattcacctaatttcctataaaaggcactgtagcatagaagtaaagacaatcagtgttcacatcatagttttgtcttttatggcccgtataatcttgggaaaattacttaacgtctccgtgctaatgttttcttatctgtgaaatggaggtgtgagtactgcccatctcatgagtcatgaaaaggattaaatacattaagctctatgaagcgcctggagcagtgcccagcatgccaaaatactcagttaatgttacttcttacacatggtgggcctgtttatcactgctacttcctggaagtccccgtgcgtaatggaaaggatagctttgtgctgtcctgcttgtagccaaccagtttcttagttcattcagcttgctttttgtactccaggagtgtatcagttagctcttgctatgtaacaaatttctccaaatttagcagcttacaacaacaaacatttattatctccagtttttgcaggtcagaaatttctgagtagcttagctgggaggttctggctatgggtctttcatgaggttgcagtcaagtggttggcttggttcagtcaatttcaggctcaactggaggatgatccatttccaagctcacccacaaggatgctgtcaggcctcagttcctcaccatgtgggcctctacacagactgtctaaatgtcctcatgacataacagatggcttgctccagggactagagagaaagagagagatagagagagaaaaaaaatgtaagcaaaagacaaaatcttttatactctaatctataacttatgccatattctatttgttagaagcatgtcactaagtccaacccatactgaaggggtagggaattaggctccacctcttgtgggaacaaatatcaaaaacaaatgtgacatatttttaaaaccacaagtgtcttttacaacccatatatcttagaaattttaaagtttaagtgcactttggagatcaactagcacagctgcctcagttaagagatgagaagaataactcaagagacttgcacaaggtcacacaactaactggccccagggactggattcagctctcttactgttgttatgtgcagctgtacctcattttcaagtcatgtcgatggagtcacttcactgatatgctgtggcacatcctgaagccctaggctactgagagattgaaacttgtatatgatatctttagacttgcactgtctagtatggtagtcaatagctacatgtgttgtgagttacatgtggtgtcaaatatacatcagatttccaagagttagtattgaaaatgtaaattatcttattatttcatattgattacatgttgaagtagtattattttggatatattgagttaaataaaatatattgttaaaattcattttctctattttttttttttttttgcttatttgtatttctgctgttgctctagattaaccaaactgatctccacattctccatgtctttggtctatcagagtcttgcttttacttccatttctgtttccagccacggtgactgagtcacagcaacacaggctgctccaaggcctctgttctctgctgactctgcagagtgggtgcctgtgattttacaggtctgctccttcagacctttctgaacaacactaataactaagggtgtcctgtacaactgcaacaatggtttccaatggtgtgtgctctggtgagctcaaaacattccctgaggactgaacttccactcaaaagctgggtcccaacactctacttcctctttttaaagaccctaccagactaagtaaccctaactagatccattacatactgtttatttccttccttccttccttccttccttccttccttccttccttccttccttctttcctcctccctccctccgtccctccatctcttcttcccttcctgcctctcttcctcccttcctcccttcattttttcctctctctctctctctgtctgtctctctttctttctaaattctgagtcaacacagaaaaattcaagcccagatttggtcttgaagactattgtaaataaagtgatcaattgaatctccctggactgaacatttggactgaacatttggaagagtgattagtgagaggagttaaaagacaatcaattcagggtcttgccatttattgaacagattttcagccccttcactgtagggtattgttttcagaagatctgcctgcccgggattcttggttataattcctctcatgactggggaagataaatatctttcacagtaatttaaagtggttagtctgcactctctctaaacagcttccttccattgatcaacgggtgggccatgaagcctcttgcaggcctctgcccctaatcacccttcttgttgacattccaaactgctaagctcacaaatgtactgggaggacagtagctagaggacacttattccctaagagagaatccttgactttcacggtatgtgactttgttattttcccatccttgtaagggcttgacattgtttcagaaaatagtgttgaattggggaatgtcgttttcagtttctttctcactgacccatgccattcaatgtcttcatcctcctcaaaaccttttttggaataaggcaggaaataaataaataaataaatgaaactgtctctaatgtaaaatgagttgggtagtttgaagatgtttcctctgaaacacttgaaggaagataaagactgaaaagagagaaactgctatattttagatgtaaacaagaacaagggccattggataaatatggtaaattatacagggctagcattttgataacttgtgatctggagaaagtataagttggcacttccactttttttttttttttggttttgtttttgataattgtatgcagcatagaaatcccatagctcccaaatcttctactccaactgccatttgaaattctaccacagtcctatgtatcatcaatgacctccccaatttggccacaaaggatactgagattctaagtagagctagaatcaaacaggaaaccatgtgagtatgagcaaaagggtaagagaagtaagaaagctggtttagatcagaaaagacatctcctccccccagaattttctggaagatgacattttgtaacaataagtttatatccagtttgtaaatcttttggttacataaaacaggaccatgtctatgtcaagtaatggaggttactgttgagttactatgacgatggcacaggcagaagctagtgcctcccttagactagggcagtagttctcaacagtgggtgggagcaggtagagattttgcctctggaggacatttgacaatgtctggggacatttttgattgtcatagttacagaggagaatgctggcatctaatgggtagagcccagggacactactaaacatcctccaaatgcacaggacagctcttgacaacaaagaattatccagctcaaaatgtcgatagtgctgaggatgaaaaaccctgaacaaggacaagaggtgaccccctactccctgtgtggccctgtgacctggaggactttgtaaactaaacatcaaaaaacaaggacaataaatattgtttttggttttcacattcataataaaattctttacttgattgagtataaagttttaagacaagagaagctgacaagcaatagacaaccacgttgcccatcataaaacctttatttatattcagagaacagacattgagtttcagttaagtttcccttggaaataatcatgcaaaggctgtatcattaagcattgtaacaggtagatgaggataagtcttcctcatccctaaaattcttctgaagtagaatagacacccacctgcctggagtggttaaggtaagaaggaaggacaggtaatcctggagagaggtactgcccctccacttcgctagtatttgcaggtctagattctatctttctaaatattacagaatgactcaatagcacattctactaaaaaatggtaatgtatcatttaaaaactcttcaaaaaatggttatgaaactgcacttactgttgcttattatactatcttgatcataattttgtaatgtttgagagaggtactctctcctcacctccccctcacctctcagatccatcagccatccttctctgccttgttctgtgtccctggggatggacccttactgattacagcatgtgaattctcttgttctttagcttctacctggctgagctaatgcgaggtgctggcaggggaacagagagaaagagtagaaaggactcagaatacttattctcctgcccttacccagccttggcacctcttgcctggtagtggctaccggtgtccatgattacagcttctgcttggtggaaacttctttgcggttccagttttttctggctctgtcaaccctatttttatttttttgtctttcaggtcaattggaaaaggcctctagctgttgctggactcagagttcctcaacatcttttatcagttccattaaaactatggggagggataacattaggagaaatacctaatgtaggtgactggttgatgggtgcagcaaaccaccagggcacgtgtatatcttgtcacaaaactgcacgttctgcacacataacccagaagttaaggtttaataaataaaatacaataaataaaaaaactatcaatatctcataaagcaacaggaaccctcattcattgctggtggagatgcaaaatggtacagccactttggaagtcagtgtggcaatttcttacaaagctaaacttcattttactatacaatctagcaattgtgctccttggtattaactcaaatgagataaaatcttatatctgcacaaaaactccacccagatatttatagcagctttattcataattaccccaaactggaagcaaccaagatgtccttcagtagatgaatggataaacaagctgtggtcattcaacaatgggatattagtcagagataaaaataaatgagctgtcaagccatgagaagacatggaaggaccttaaatgcatagtgataagtgaaagaagccagtccagaaaggctgaatactctatgattccaactatatgacatagttgaaaggcaaaactacagagacaggaaaaagatgagtggttgccagagatgtgaggagagaggaaaggcagaataggtggagcacagaagaaccttatagagcagtaaactattctgtatgatactgcaatggtggatacaaggcactctgcatccttccaaacccatagaatgtacaacacaaaggctgaaccctaatggaaaccctggacattcattaataataatgtattgatactagttcatcaatcgtaagaaaggtaccacaccaaagcaagatattaataataggggcaactgtgaaaggcatgggaggcatatgggaactctatactttcagcttaacatctctatagacctagaactactttaaaaatgaagttcattaattaaatatatcagtgaaccatgtatatatatgaggaaaagtcctaccctcttctctctgcatagcctcattattatttatcttcttttattatttatcttcttcttctattatttatcttctctttccagggaaattctatttcctgcccagggcctgactattatatgttgtatcaaaaagacattgtgaaaataaagaaaaccgcaaaaatgaaaatattatcaaaacctttttattcatgaaatgcatgttagacaccaaaatattggtggcttttcatatcaccaatgctaaaaaattaattaaggggtatatatcttttttattccttggcattacctaagatttagagaataaagaatgtccaaacaccctggttttcctggggcaatcctgatttagggctgttttcctgaatgcagtcgttaacggaaccccgttttcctctcaaacttgtcctagtttggataataagttatattattattgtgcctctaatactttctttgcaaaaggagttacaaagcaccatgggcagagtctagtcatactcaccccagcttgtctgtttgggcactgtctggaacagatagactaggctgggaacgaaggtgtgtctgccaggaccaaacgttccaaaaacaaattttttatcagatgaaactataacctagatcttataatgattaaatgcaatttctgtagtgaaaatcaccttaagtagtataaggatttgctgaagatgaacatcaggccccatgagttcctcaacagctcgaaccatggagagttcgtgcaggcagggtcatttgtctaccacctacactgtggatcaggtacagagtacagagggcttgctctatacatatatagctactaaccagctccagaagccaatattttacctaccaggaccaggaccttgaggtttccctttattattatccattcattcaataaatacccattcaattcaggcaccgcattgaaaatacagtggtgcataacacaagtaaaaaatatccattctagtgggaagaggcaaccaataagcaagtaatcaagtcagtgaaacaattcatataatggtgaatactaggaagggtatagatgcaaaatcattgcacaggagagagggagggcttctttctagagatgatagttgaactaattctgaagaggaaagggagccagccaagggaaatcttggatgttcatcccacagtccctctggaattaatgaaactaatgaataaactgtgtgccaagaagaaatattataaatgttaagtggtttttcttgataagcaaaaagaaaactagtattctaggtattacatgtgggcactgtaaattttaaaaagaattgttctcttgttagcagtcatttgttattgattggtaattgccatcatcaaaatgccaaatcatgttgacccatctcttctgcttcaagactttcccagcctgttccagttactatggctgcataacaaattacccagaaccttagtggcttaaaacaatgacaacacttgttttgtttatgattttataattgggaagactccatggaaatggcttatctatgttccactcagcattaactagcaaagtgcagcgagggggtccttgaaccatctaaagtcttcctcattacctgtctggcagttggtactagccattagcagatcccagctaatgcttttggccagaaaattacacgtaacctttccaggtggcctgggcttcctcacaacatggaggctgtgagcatcctgacagagagagcaagggccaactgagtgctgtgttgcttcctatgacctagcttcagaaaacacgtaacattacttcagtgatagtcaattagtcacagtggcaaaaaaggctgtccagattccaggaagggaacatagatccatctctcattgcaggtcacagtggaagaagaacatgtgggatggcatctattggtgcagccatctttgaaacacatagtgttccatgaagctcaatcctttgagtttcttgtaagacacttctatttttccagtccatatgcctaaaagaacacataaggcaactgcaaagataggagaagtgaaataaactgagtgggaaactcaaaaatcctcatgggcaagcagacagacaaggaaagcctagagactcactcattattcatctctgtcctgtgtatttatgataggtatcaagcttgaacgagtcattaaaaatatgtttagaaaactttggtttgaacaaagtaaaatgtttttctatatttcttatcttcttagaaaatttagtaactatgtgtatgtcctccaagagggacacatagtatgaaatttatctccatcttctttgacgtggaatcctttttgcatacaatcgtgaaatagctcacgggaccacttaggaaattctattaagccaatttgttctaagaggggttataatagacccacagagtgggatgtttcatgggttttgtgaggggatggaaaaattctcttccagcttgaagctgtgaaaggaatgcaatgtctgcttttcaactctggttagcagaatgttgtgccctatggtacctgaatgaaatagctaacctgagtgtgctcaaggaatatgttgtttctggtatgccagaattcaaaaccagagcccattagcatgagtacttcaaggactgccgctgatgtaacctttcaggggaaaggctggtccatctacaaatgactcaagatgtgatgaacagtaggaagccaagccagtgagtaagggacaacatatgctgctgatggagctcaacttcaccctgcctcattggaccaagttcattacctgagagtgatgaaatgaggcgaaagagaatgtacaacacgaagactgcagaaacttacaaaaggagtgtaggctagaaatctagaccagcctcaagatgccaagattccactt

SEQ ID NO: 530 - DNA, 75421 bp, Homo sapiens
cagtttagagagcaacataaaccagctgacagagctgaaaaacacagcacgagaactttgtgaagcatacacaagtatcaatagctgaatcgaccaagaggaagaaaggatatcagagtttgaagaccactttgctgaaataaggcatgcagacaaaactagagaaaaaaaagaatgaaaaggaatgaacaaagcctccaagaaatacaggactccataaaaagactgaacctacaactgattggagtaccagaggagacagggagaatggaaacaagctggaaaacacagttcaggatattatccaagagaacatccccaaactagcaagaaaggccaagatgccaattcaggaaatacagagaacaccattaagatattccatgagaagatcagaccggaatgcataatcatcagattctccaaggtcaaaatgaagaacaaacagttaaagccagccagagagtaaggccaggtcacctactaagggaagcccatcagactaacagcagatatctcaggagaaactgtacaagccagaagagattgggggccaatattaacattcttaaaaaaaaaattttcaacctagaattttatatacagccaaactaagcttcataagtgaaggagaaataaaatcctttcagacaagcaaatgctgagtgattttgttaccatcaggcctgccttacaagagctcctgaaaaaaacactaaatatggaaaggaaaagttggtaccagtcactgcaaaacacaccaaaatataaagaccaatgacactatgaagaaactgcatcaactagtgtgcagaatgatgagatagcatcatgatgacaggatcaaattcacacataataataataaccttaaatgtaaatgggctaaatgcccaaagtaaaagacatagactggcaaattggataaagattcaagacccatcagtgtgctatatccaggagaaccatctcatgtgcaaagacacacacattggctcaaaataaagggttggaggaaaatttaccaagaaaatggaaagcaaaaaaaaaaaaaaaaaaaagcaggggttgcaatcctaatctcaaataaaacagactttaaaccaacaaagatcaaaatagacgaaaaagggtattacataatggtaaagggaaaaattcaacaacaagagctcactatcctaagtatatatgcacccaatacaggagcacccagattcataaaacaagttcttaaaactaagaagagacttagactctcatacaataatggtgggagactttaacaccccactgtcaatattagacagatgaaggagacagaaaattaacaaggatattcagggcttgaactcagctctggatcaagtggatccagtagacgcctacagaactctctacccaaaatcaacagaatatacatttttctcaatgccacatggcacttattctaaagtggaacacataattggaagtaaaacactcctcagcaaatgcaaaagaatggaaatcataacagtctgtcagaccacagtgcaatcaaattagaactcaggattaagaaactcactcaaaaccacacaattacatggaaattgaacaacctgctcctgaatgaatctggggtaaataatgaaattaaggcagaaatcaagagttcttagaaaccagttagaacaaacagacaatgtaccagaatctctgggaaacaactaaagcagtgttaagaggaaaatttatagcactacttgctcacacctgaaagctagattgatctcaaattgacaccctagcatcacaaaacagctagagaagcaagagtaaactaatccaaaagctagcaaaagacaagaagtaattaagattaaagcaaaattgaaggagatagagacatgaaaaacccaccaaaaaatcaatgaatccaggagctgattttttgaaaaattaacaaaataggtaggccactatctagactaataaggaataagagagagaagaatcaaatagacacaataaaaaatgataaaggggatattactactgaccacatagaaataaaaactacctttagagaatcctataaacacctctacgcaaataaactagaaaatatagaatctatggataaattcctggacacatacaccctcccaggactaaaccaggaagaagtcaaatccctgaaaagacaaaatacaaattctgaaattaaagcagtaattaataacctaccaaccaataaaagcccaggaccagacagattcacagctgaattccaccagttacaaaaaggagctggtaccattccttctaaaactattccaaacaattggaaaaaagggactcctccctaactcattttatgtagccaccatcatcctgatatcaaagcctggcagaaacacaacaaaaaaagaaaacttcaggtcaatatccctgatgaacatcgaagtaaaaatcagaaaatactggcaaaccaaatctagcagcacatcaaaaaatttatccaccacaatcaagtaggcttcatccctgggatgaaggctggttcaacatacacaaatcagtaaacataatccatcacatgaacagaaccaaagacagaaaccacatgattatcccaatagatgcagaaaaaggcctttgatataattcaacatcccttcatgttaaaaactctcaataaactagatattgatggaacatatctcaaaataataagagctatttgtaacaaacccacagccactatcatattgaatgggcaaaagctggaagcattccctttgaaaaccggtataagacaaggatgccctctgtcaccactcctatccaacatagtattggaagttctggccagggctcagctgggactgtctgctgaagtatccacacatggcttcttcacttggcatggcttcttatagcatgcaagatggatccatgagagagtattctaagaagcatccaaagagaaagcattccaagaaaactggaaggaagctgcagggccttttaccatctatcctcagaaatcatattagcataactcccattgcttgattggttgaggcagtaataaacccatccagatttagaaagagggggcatagataagccgtcttgtggggagaaatgtcaaggaagttgggggccacatttgataagcactacttctactgatgccacaatcatgacgaggtgttttcctgcctcccttgctcgacactctcttcctctttcctttttctagttcctgatgtccttgtagtgtcctttaattatataattctctgtaaaaaatttcccccatgatccaatatccatgcaccctatcttctacctcttcccacggaaattctgttctctccacttggattatccctgctagggtctagtgtcaattactttactgaaatatcgcctaaattttgaatggctgagcaatttaatgcatccatgagggtctcttcatattagatggagaatgtgctaatccaaatgaacaataattagtagtaggtgtagaaatctttgttaagctcagaagccttcctttacattgtcctgttttccatgtatttctcatctcttccctagaccctacactaccccaaactaaaggatgggctaagagcactgtgtcattccatttcagagagagatgctacccctcactgtggctttccctgcaccaccctagtccagttgttataactgcgtttccatacttcatagtatgtaagatgagtttaactataaagctgtctgtttatgtaccacttaggaaaaactgctgctaattaacgtataatgcaagattttttataaaggggcacaggaaacttttgagtatgatgggcctggcctaaattttgagtgtgatggtggttacaagggtgtattcatttgtcaaaacatatgacctagtgccatttgactatgtggtttattgtatgtcattatagctgaactaacttgaaaaaaaagtaccatggaatactgtaatattgatacacttaaataatgttttcttaactgcaaggagcatgcttggaaaggaatcatgttcaatatattgtgtgagatgaaactaagctttcatcctcagatgaaaagcatctcttaaaatgctttaattttaaagccatctgtcactctaaagacacccttggctaacaggctcgctgacaaccattctcttccactttggaggaacactgaagtgggccaataaaacctgggttttccaaggtgatagttgtggatgaacgtgagctaactacctcctgttatctcctctagcagttctgactgaggtttgttcatattctactgatgcttatttcccctccttgccccatctgagcagtttctctgttgacaactgctcagtggatcaggcggagtgagggtataactacttgtcaaggtgtcagacacttccatcaagattcaaactcctgaccataagtaacaaaggggcttacaatttcaaaaaacaacaatattaaataaaacacgaaatagatacagctaccactcccgaccaactatatatgatgcttagcatccccaaactaatgctcacttataaatacagcaagtgtcccaaacacttaaagaccagccacactcttttataaaaaagacttttatgttttaaatatttgtttacagtttatttttgagttaaaatatacatacagtaaagattcaaaaacataagtgtacaatttattcagttatgacaaatgataacatccatattaaccatactccagtagatatatggccattttctatggtataatttttaaattatattttaaatgattgttgctggtatataaaagtgcagttggcttttgatattgatttggtaaccaacaataatgccaaactctcttatttattctaaaactggcccttaaacttttaaattttctaggtaggcatttataatatactatctttagataatgacactttaaaaaaattccaagtcctcattttttaatctacttctctgatataattacaacatcaaagacatataatacagtgagaaacagatgtagtgataatgagcctctttttttcagaaattgatctttaaaattttcaccattaagcataatgtttgccataatttttaaagatattgtttatctggttaagtaaatcattgtttttcctattattgctaaagatatctgtatatgtatatttacatatatatatttagccacaagtgaatgctaattttatccaaacactctttttcatatctatttagataatcatataggttttttcttttaatatgttaataaagtagataatataatcttactttctaatgttaaactaattgtattcctgggataaaaccaacttaaccaaaaattatttacttttttttttttttttgagacagagtctcactctgttgcccaggctagagtgcaatggcataaccttggctcactgcaatatccgcctcccagggttaagcaattctcctcccaaggagctgtgattacagacatgcgccaccacacccggctagtttttgtatttttagtagagatggggtttcaccatgttggccaggctggtctcaaactcctgacctcaagtgatctgcctacctcaatctcccaaagtgttgagattacaggcgtaagccaccacgcttagcctaaaaaaagtttacttttaatgtattatagaatttgatttgacagatactatttaatatttttatatctgtgtttataagtgacactagacagtaagtttaatactctccttgtctgattttgatattgacatttccctaatctcaaaaaatcagctgtgagatgtttcctctttttctgtattctgagagtttttgtaagattggagttagccatttataaaatttttggtaaaacttgttatttagtatttgataaaataaggatagattactttttaaataacagttttagattaacagaaaacttgaaaagatagtcagaattgcaatgggctttgcatcatttcccttattattaacaggttatattaatatggcatatttgtcacaactaatgaacctatattgacccatattattaatttaggttgttaatttattcagatttcctcagatcttacctaatgtctgttttctgttccagcatctgatctgggaaaccacactgcatttagttatcatgacttatttggctgtgacaaattcccagactgtccttccttgacagttttggagagtacagttcaggtaattttgtagactatctcctattggcatttgtgtggtgttttcctcatgattagactggggttattagttttttaggagaaagagcttaaggagaaaatgttgcatcatatgaaggttacacagtatcaacatgatttattcattgttgatgttgaccttgctaacctggctgaggcagtctttgtcaggcatattcttttcttcttttaaaagtagaagagtcttttgcaaagtgtggaccatgagtcagaacattcacgtcatctgggagtttgttaggaatgcaaaatctcaaacttcatcacagataactgaaacagaatatgcaggtttaccagatcctatgtgattcatatttttttttttagacggagtcccactttgtcattcaggctggagtgcagtggcacaatgttgactcactgcaacctctgactcctggtttcaagtgattctcctacctcaacctcccaagtagctggaattacaggcatgtgtcactacccccagctaatttttgtatatttagtagagacagggtttcaccatgttggccaggctggtctcaaattcctgacctcaagccattcacctgccttggcctcccaaagtggtgggattacaggagtgagccactgtgctcagtctcatattctttttaacatttgaaagaactgctttaagataatctagagcagattttatcaaactttttttatagagagcccaataacaaacattttcagctttgtgagctataggttctttgtcacaacttttcgattcagcccttttaggagaaagtatccaaagacaatgcataaatggcatagagtttaagtccttacttaacttcgtcaataaattcttggaaactatgtgtattagcctgttctcatgctgttaataaagacatacctgagagtgggtaatttataaagggaagaggtttaattgactcacagttccacacgtctggggagacaacgaatcatggcagaaggcgaacgaggtgcaaaggcatgtcttacatggtggcaggcaagagaacatgtgcagggtaactgccctttataaaaccatcagatctcacgagacttattcactatcatgagaacaggatgggggaaacagccccatggttcaattctctctacctggtccctcccatgacaggtggggattatgggaaccacaattcaagatgagatttgggtggggacacaaagtctaaccatatcactatgactttaagtgaaacaacatacggcaggtcctcaaataacatttcttttttcaaagcctaatgataaggaaaaaacatgttttttttataagtggttttgcttaaagttacattttcaaagaacctattggtgacttactgtattttttttggaaaaacttatagacactaaaatttgaatttgaaattggaaataaaatgaaaacttgaaatgtgttgtgaaatattcttattacctcttaaaaatttaaaaaacatttcaaataaaaattttaaaacctttaaaaattattttaaagcatttatttcaaacatttaaaaaattaaaaacaatttctgttttgcagaggctttgggctctgccaaaataggcatccagttggagttggcccatgggcttagctaggccatcactgatacagtggcttttctttggatcctgccagctgctagctctacctgattagtagcttttaaagatgattttcatgaaaaggtaacactgtgactctcattcagaaatataaagtgaacatgtatcagatattttatttaatccattaattaaatgagaaaactgaaaaagatgttaaaactggctcaaagaaaaaaaaatccaaaaacagatatatttctaaatcaggaatattgaaaacttaaaatggacacaaagtcacctttttcagaggaagatttgcctctctaccctgcctcagacagaattatttgcatgcttatggtcaagagtaatttgcattgcttgttctctacatgctaactttgatctctactgagttgtacaatggcctagtcaaagatatggagggtattccatgggactagataatcccaggaggctgtagcattttattaaaagaatatccagtaatctcttttgcttatttcaaagtgttaagtttttctttgtagttgattgggatattttcctctccccactcccttaagaaaaaaatagatgaggaaattgatggctcaccttactaaatgactcacctaacttcatgccagagctactcataggcaacctcaatgcaaagaaggctctcctttgggtctttctaattgggaggattcatctgacagattagactctttaaatagagacaatgatgggccatttcaaagacaccaaaatgttttctacagcttcaagcactcatttatcacttatttacttactaataggaacaaattacattgttgtgtttttttttttttcctttggcacaacatggggaccaggaaccttgttctcagtgtggctgtgccatggaaccctctgcaaggaactttttgaatggcaatttcctcctgccagacatgaggaattgaagcaatttttgaaataaagcaatctatgggccttctaaaattatatctccccactatgatccataaaactggacccttatgttttggaaggagtcttagaaatcaactagttgactatgtttgcaccatgtcttcattatgcttagttgtgactactcttatccttcctctagttcttcctatgcagttccacttgaagtgcttatgaggtgataggttaaaaagtctggatgtctttgacttctccagtctctggagtaagagtccacccatccaaatactaacttacagttgaaaataaactttggtctactctagctgatcacatttaaatgattaattttgttaaattttcatattgataatctctacttttcacaataatagaagtgcattgatgatgtaattagtatattattttatttcaatctatcaatatctctatcaattcagctgctttaacaaaggaacctctttctttgagtaataacatcaattaccgacctaaaaacagaatttggagctaataatgggaagtataggaagaattccaagtttactcttgttctctttctctccttgactccacatacacattactttttcaggcatcaatattacctcaaaccaaggcttttcaaaccttagcatgtaaaaaattagctggaagacttgttaaaacacaaattgcgggaccctcaaatggcatttctgattgagtagatattcactacagttgagattctgcatttccaccaagctcccaggtgaccgaaatgtttctggctgaggaccatactttcagtagcaaaaaacaacttagtgggaaagagaaagtcaaacatatgctaaggcataaagattaaaataataaatgacaagacccgaaagggtttacaatctgttgggaaaggtaaatatgaaataaatgaaaacaacaaattgacagagatgatgcagtatttttgttttctgttgttgctgtaacaaattacctataaaagtgggcttaaaacaacatcctttattatcccacagttctctagatcaggggtccaagtgggctgggcagggtgatctgcagaaggcctcacaaggctgccatccagatgtcaacttagctgtgttctcatctggagcttaaacttttttcccaagcttattcaggttgttgggagaattcatttccttgggattataagactaaggtgcttatcatcttcctggatagtagctggggtaatctcagctcctacaatccactctcagattcttcttatgtggctcctccatcttcagaatttcctgtgtgtttagttcttctcatgctacccatctctgacttcctctgtttctgatcctagacccagacttaaaaaactcatgacatacatcaggcccacctgggtaatctctctttcttaaagttaactgtgctattacctaatcactggagtaaaacccattatatttacagtcttggaaaaagttgtgcatgatgagtacaccaggaggctgggatcttggaagtcatcttagaattctgcccatcacatagaggtttgggcaaagtgctattggaacaatgagggtgatgtatcaagtctatcccagggagttacggaagactggctgaaggggatagtgcttgctggggtcttagaaaatgtaggtttttggcagcttaagcatggctctctgaaaaaatagtaaaagggaattccaaggagaggaaactgtgtccagatgtatggatcttttaaggcatgttcaataacatggagaagttttcagagacaagagcatagaatgtaaaggagagatatcagcatgaaatatgtgccttatgatccaaagagcaagcagagtaaagaacaatcagattcaaagctagctggttactagagcaagtccctaacctctcttatactcagcttcttcctctattaaatgcatatcttggcctaggccagtgtttggtaaacagtgacctaagaagccctagagttttggaagagagggggttgatatacacacgagagggtggtgcaagggtctgggaagctgtgtgtcagtctttgaggccctcactctcagtttcaccaaagtcccactcagcttctatctgccttatatggtttggctccagataagattttacttagagtttatatgtttaaatgttctaaaaccacagataaactctttgcataacatgattttttttctattacactcagctcttgtatttcattaattaattcattcgttcagcttttttttttttttttaaattgcgcctactatgtgctgggcagtgttctaggcaggagatttattgggaagatttatggttctttttgtcctggagcttgtcatcttatggaggatataaacattagtcaaataatcataactaaatgtcaaattgcaactgcactaagtgtgacaagctggtgattcttgatgctattataactgaaatagtttatcttataatgtagaagcaagaaggccttcctgagaaactgacgatgagtttgagaattagaggatgagtagaagttaactgaatgactacaaggaggaattgtgtttgatgtaaggtggatgtatatgcagtgtcctttggcagatgagagcacagcgatgtgaaggacagagggaaggtccatgtggctgaaataaagaaaatgtaggggaggccagagctgatgctggagaggaggaaggccaagatcatggaaggctttgtttttaatgttaaggcatttgcatttgtcttttatttttagagacagggtttctctctgtcacccaggctggagtgctcttacacgatcatagctcactaacccaaactcttgggctcaaatgattctcctgcctcagtctcctgagtatctagagacaagaggcaggatccaccatgcctagctatttaaaaaagaaaaatgtttttgtggaaacagagtctcactatgttgccgaggctggtcttgaactcctggcctcaaggaattctcctaccttggccacccaaagcactgtgaccacaggtgtgagccatcacactcagccatatttgtttttattataacagaaatagacttgtctttatcctaagagacttggggtttcaaaagaatatggtctgaaaagagaaaatgggtaggaaagaggtaaggggtattgattcaagtagactgatgaggaggattgaatgcaggaaagatgattacacaggaactcaagtaggtggtggtagagaatatgaagaaaatcagtacatttagcaggtgtcaagaggtaaaatcaaacgggtttggtgaaggactggatgtgagagatgatggagaggagacagaggtttcaaaggtaactctaagatttctggattgcaaaaccagagcaaaagccctgacattaatggagacaaggtgctggaagaggtccaggttgacggagaagattttgatttatttagtcatgttgcattttaagttcctttaacatccttagttttaactaagtcaattcaatctgtaggactagagcttgaaagagagatcaattaaactccctgggttttcacatcttcatcttcttgtagcaataataaaatatcacttaaagaccattgtaaaaatagataacaagtacaaatggaaagcatgatgcaatggaattcatgccagtagttactataacacaaaaataacatcaagcttttcactagtggctgttgggcagttcgagggactcaacattgccagtattttaatgggtgtaaaattgtccatatgatacaattttgggcaagagagtttttgacagaaaacttttggaagcaatacattgacctcaaatgactacaagtaaaggattttagccagagttacaaaatgatggggtaagattttcttcatgcaggactctttcagaccacatcttccggtactcaacttttactgctcattactgggaggaacttctaagaattccagcacctaggccagttaaatcagaatgccaatacctaggccagttaaatcagaatctctagggattagggaccagcattgatttttttatttctttgtttgtttgtttgtttgtttttgagacgtagtctcgctctgtcaaccaggctggagtgcagtggcgcgatcttggctcactgcaacctctgcctctggggttcaagcgagtctcctactcagcctcctgagtaggcacctgtcaccacacccggctaatttttgtattttattagagagggtgtttcaccatgttggccaggctgatcttgaactcctgacctcaagtgatccacccacctcggcctcccaaaatgctgagattacaagcatgagccactgtacccagccagcattgatagtttttaagcctccagatagttctggtgtgcactcatgattgaaaaccaccaagctagagtgagagtctttgtgtgaggtgaacttgggtaataagccacccagagaaacatttagaattttctcccacggtccaggaggattgaagtagaactagtggctttggatttttcctctatttccccatattgcctactcatcaggcatagctcctttgttcatactgcctgaggctgtccctgatgtcttccatcagacactgtctgattctcctcactacctagatgtctcacttgaagactgtgagtcaaaaagttgaggttggagacctcacctgaaaatctgtgttttgagcaagttctatctgtattcttaagacaaagaaggtgggtttgagaagcagtgtcctaaccattgttactcaaatggtaagtgcttggactggtatcacctagaagattgtaagaaacacagcatctcacacattccagacccatgaaacaaaatgcactttaaccacatgtcctggtgatacatatgttcgttaaagtttgagaagcactgccctaaaactaagtttcccaagagagatgccagaccacctacatcataacaacttgagatgctaataatctactctgaaccttatgaatcagaatatcttgggtgaggcctggaaatcttcacatttaacaaaatcagctattggctcttacgcacaattattgtttaaaagtactcggtcttgtattggtttagtgaacacatgctcaggcagctctggggatctggtccaacatcacagggtaaaacaatgtgagttgggttattggtctcacgtactcaaacatgggctacagttgccaccccacccaccacacattggtcttcatgtatcagtccttcaagccttactcatgggtcaacatgttaattgtgtgtaactcatagagtgtgatcacaaagggagatttatttttctctctcactgtccctttaaaccagtttggtgggaagccaaagtggctacctcctctgctttcagacaaaaatctaggcagtcatcatggttttatagttacctttaaattaatagaaagtcatatatgagccagatgtagtgggtgcatggctgtcatcctagccatgtgggagaatcacttgagcccaggattcatgaccaacctgggcagcatagtgagaccccgtctcttaaaaacaatgataacaggaaagtcatatatcatttcaagccatttagtcacaattaaacacttaaaatatctacctctagataataatcaactctgaaccagatttaacattagcatgcgttttctccctagctggggctggctacaggctggctccctgcttttggagagaagctatgattacgtttctctttttcccttttctctccaccactcaatagctatattaataacatctccttgaataagtgaaggaggcaggagggaaggaaaggagagcagaaaatccttatcagacactaccatgaaatagtttcacattctctggttttggtggaggttgaaatcacacttttatggacgctttcaaaggtttattttggttctcatgctgggctgtgctaacccacctcctgtgatgtggatgatgtgttctgttcctctaactctgactctgccctcagccactagttttctggttactcattcaacacacacaactggattaccaacagcctactcaatggtcattttggacaagaatcaaggtggctttaggttcctacttttccatttgacctacatacggatcataggacaccaatgcatcttttgtcccactgttgttggaactgtggttacttcctaaatttgatcctcaactctcacttcttcttgtcctgccctctagagctgaaagttgtaggctttttaccttaggatactcaggtggagatcagacccgagtcactgtgatcttcttgccatgaggacaacactttccaagttcttcaagtggtcccagtaaagccactctcagtaaacttgaggggcagagaaaatgtttcctcacctttctagaataggacctggatctcatagcacaactcatcataaagaaatcttctctctagtattcaatcactgaccctttatccttttgtgacaaattcaaaagttatcaaaatggttcccaatcatttccttttgctcatggttcagcatctgattggaatctgatgtctatcatgtcttggtgcttcagttgaaagctccaatttaacatcttgataactctgaagcacgcacatgctcctttacgtcaaatcaagtttaaagcaatgagttttaagattggtggtaaattcagccaatcaatcaacaaatatatatatggaaatattgtgccattttatatcaggaacttgagtgttcatggatttttgcgtccaagaagtgttctagaaccagtctcctacacataccgagggacaattttataaagcaaaatagttaaaattataaacaaaactgattacattggaacacagttaccccaaaacatgaaaaataacaagtttgagataaagccatttggatggttagttttatgtatccaattgactgggctatgggatgcacagatagctggtgaaacattatttaggggtatttttatgaggaagtttccagaagaaattagcattttgatgggtagacagagtcaaaaagattcgttctctctaatgtgggcttcattcaatcctttgagggcccccctccccccccacaaaaaaaaggaatggaaaggtgaatttgccctctctgttcgagctgggacattcatcttctcctgcccttagacatcagcactcctggttcttgggcctttggacttggatcaggacttacactgttagcctcttgcttctcaggcttttaggattggacaaaaacaccaccactgactttcctgggcctccaggttgtaggaggaagatcacgggacttctcagcctccattatccatgagccaatccctcataataaatatatttctatatatctgattttatctagtatataattgtatctaataatatataaataacatacaataggccaggcatgatagctcacacctgtaatcccagcattttgggaggctgatcaggagtttaagaccagcctgaccaacatggtaaaaccctgcctctattaaaaataaaaaaatacgccgggtgcagtggctcacatctgtaatcccagcactttgggaggccgaggtgggcagatcacgaggtcaggagatcgagaccatcctggctaacatggtgaaaccccatctctactaaaaatacaaaaaattagccgggtgtggtggcgggccctgtagtcccagctactcgggaggctgaggtgggagaaaggcatgaagccgggaggtggagcttgcagtgagctgagatcgtgccactgcactccagccagggtgacagagcgagactccgtctcaaaaaaaaaaaccaatacaaaaaatacaaaaaatagctgagcatagtggtgcctgcctgtagtcttaactactcaggaggctgacacaagagaatcacttgaacccagaaggtggaggttacagtgagccaagatcctgccactgcattccagcctgggtgacacagcacgactttgtcacacacacacacacacacacacacacacacacacaaaatatatatatataaatatatatatatataaaatatgaggttaataataaatatatatattttatctaatgattttatatgtcaattatatattaggtgtgtttaattttatatatttaaacagaactaatttatatagtattagtatagtatattagtattcaatatatactattctatattactaatatatagaatatatactaatattctatattagtatactatattagtatattagtatatatagtattagtatagtatattagtatttaatatatactatattagtatattatatactattactatagtacagtatattagtatttggatttctatatataaatacaaataaatactaatttataaattaaaattttaaatatgtatacataaaccctggccaatagagtcatacatgtgcttttttatcaatacctacaataatagaatcaaggctagatctaattcattcataatttcaaagtagtgatgagtataaagaatacttggagagatttggaacaggaaatacgacaataaaatacctgtgatttctatttctaatacctgtgattctattttgcagttatgtatagtacaaaccctgctgtctttttttttttttttgtagccccatctcaaaccaaaagaaatggtgagttttagttagaaactggtgaaagtaaaaatgtagtttttttcttacctacacacagggtgaatcattttttgaatcattttctatttatgttctgtgatttgtttattgctgaactctactcctgttcgagaacattcttcaaattatatgctttggaattgttgagatttgtttcatgccttagcatattgtaaatttgtgtaaatattccatttatgctagaaaataagtattctacagtaattgagtacagcattctgcatttatgaggacaagtttgttaattcttttgggtcaatctttcagattattactgatatctttgctgcttctttgatgaattactgaaaaagaaatatcttattattggtttggaattgttttatcttcttgatgaattgaatatttttgctatttggatagattctcttgatttctaaaaatgctgtgtgttcttaaagtacattttacaaaacatgaatagagctacaccaacaaatattttcttaatgattatatgcatggtatactctttacatctttggttttcatttgtgtgtgtgcatgtgggtgcgttctcatatattagaaatctctcccaaaaacagtagattattgttttctaattattctttaaaaatccagactgcccattctttttgaagcagagaacatatctacattgtgcctggattcttgacacattaaatatgagataaaataatatatatcatttcaggcaactaactttgtggaaatatagttatactatgatgaataactgatgcacactgtttcttttcttaattttttcagtagttaccctaaaaattaaggcatgtatatttaactaaacaaatttaatttttattaacacctttaccctcattcagaaaatataagggaattagagcactttggatactcttaaaacttacatgttattattactgttaactttacttacatataaatatatattaactcctctatcattattgttttcaagagtcaatattcatttagatttattggcatatttaacatttcctttactttcattttcttctctctgggatcactttcattcttcctacaaggtgttatgtattgaaatgtcttaaaaagatctgctcaaaagaaactctcttaggttgtctaaaatgttttcatatttctttatttcttgatgggtactttggttaaatactgaattctaggttgccagccattttcttgtcttctggctacatagacgtattgaagaatcattggaaagcctgttttacctttaaagtaatctactccctccctccctctattttattccattattttacttttgtttctgggttgctgttgtttgtttgttttgttttatgaaatatataagaggggatgattcttattatcttgcctgtaatttgttaaatttcttgaatggattgatattttaaattttcaaccactatctctttaaaaaatctctataacccattctctcattcctttagttctaaaatttcaattaaatattatttagattttcttacatacattctttatctcttaatcttttttatttataaaacttttttcactccctatttcatttttgaattgtgtgtgtgtgtgtgttgatgtaactttcgttttgctaattctctgttgatctatgttttagcatctgttaaactcattcactgtgttcttaaatttggtcattatacttttcttttttagaatttttatttcttaaaaagtcaaatgtaattttttaaagtttatcgttttcaattcattcaaattaggttgaagaattttagagttaactttgaaatacacaaaaattactgagttttcaacatttttaaggattatataagcaaaaatattttaaaattaaagatattttaagattatttgtatgtaagataaaatggatattatatttggctgtttagttaattttgcacttactaggtaactggatgactccctacttttcttgttcttttaatcaatcaaaaataacatatcactaataaataatttttaaaatccagtttgcatttaatttacccattaaattttttcaagattaacatctttttagagaaggaaattaattggtttatgaatcataatgacagaataattgtttattttgtgctgagtatgtaagagttagagaccttgaggtgaagaaaatatgaaagagaacaaggaaattaagatggttggatcaccagattacttcctccatggatgggaatgacattggagagctggaatttgtttcagtcacggaactgataacataattgctaggttttagatactggaatgacacacaattatattatagcccaaacacatccttgataattttaatgtttaaaagactcagctttatctgtgaaatattttaattaaatactttgcttttaacctctatctaaatttctttgttgaaaaactgaacaattatctgtactaccttacttacatcacaacgttgttttctatttaaattacctctatttattaaaaatatgtacctaagagtacataggtgatggagttcagaatacactaccccaaacaatggtatgttggtatctgagaaaatggcagaagcaggaaagtcactctcacagtcccttcatcagttcccctaaaccaagtcataaaaccctcatttgagaggggccctccctatgcccagaggaaaaaagcattcttagctctgaagacacagggaagagaagagtaagaacaaacaagccttgctaagttttccctcgtttattaccattattattctctttccctccaatcatatttctccataactatccactcttcatcaaacctaggcataaaaatacacatatttgtctatttctttgtgtcttcatttcctcacaaagacctcagtgttatgtaaaccttatattaaatacatcgatttgcttttctcttcttaattaatgtcttttgttaatgaagcctcagccatgaacctcaggaagaaaatatgtttattttcgtttccacttcatagacttttaacacttgacatttttctcaggtccaaaaagaatcccaatctaacatactttcaaaattattatgacagatttaagggtctttcttcaattttataaattatttaagtacacattttatcattcttctatagaatgttatattttaacttagttataacttaattatattttaactatttttgttatatcaaactactttcatataactaacctgcaaatatttttacctcttccttctctgtgttagttagctattcacagactgacaaatcactttaacccaatgactgctatagtttgaatgcatctttcaaggttcatgtgttggaaagttaatccccaatgcaatagtattaagaagtgagacttttaagaggtgattagagggctccagcctcataaaagcattaatgtcattactgtggaagtgagttcattattgtgggagtggttatcaaaggacaagttcaggccctcctctcaccctctttcactttctctttgcccttccaagaatgtcctcaccaggtgctggcccctcaatcttgtatttcccatcattcagaattgtaagccaaaaaattctgttcattataaagtacatagtctgtgatattctgctatagcagcacaaaatgaactaagatcgtgacttaaaacaataagcatggtaagcaggggaatgctaacttacgtaactttcaaaatgagtgaggactgtaacaccaaatgcaaaaggagctgtgcacaaacgctgtacctcagtggataaagttgtttcccacagagtataggctaacaattctgaagccactatgaatgtacactgtaactgatcaattaagtaaatggatgaccgatggtgagagccaagtttctcattgttggagtgagagagaaaacagaagaaagtggaatgggctacatgtgttaatggattggaattagagactgcagcatgaattcatcttcaaacgaatgtggatatagatcattagatggaaaatattaatacacatgcatatagacacacaggttagtatgcatacatatattttctgactctgtcagctgggaaggctgagaagcattcgcaccccattggcaatgaacacatctaacatccagatcttggttttcaataccattctccaaaacaaaaaacaaataaaaaacagacaaacaaaaccttgggaaaatggctgattcttggactaaagcagaaaatatataagtctgaagcatcttgaaatgccaaaaaagtgaggaagtacttaaagtgcacacacacacacacacaataatggggtaagtaaatgggatatggaagccaagtgaaagagccccaagtggccaagttagaatgatctgggcaacacaatacataatgtagcattgaattgtaacccaaagtataaaataaatacctatgattccatagtaacataaataaataggattgaacatactaaactgttgtgcagaataattgcaaataatttatgtaaatatcttcaaggagttggaacataactcttccactccttaagtgtgggctgtccatagtgacttctttccaaaagtacaatacggaaagcaggtgaagagtaagtttaccatagagaaacttgacaaaaactacctcaggcagatcattgagattaatatcaatactgatgttatgttgataacatgacatcacttttggtattatgatgaatatgacactttacatttgtggtcttcctccccgaaacctagaactcaagtcaaattataagaaacaggagacaaattccaataagaaacttttcatgaaatacttcagcagtactcttcactgctgtcaaggtcatcaaaaccaagaggagtccaagaaactgtcacagacaaaagaagtctaaagaatatgaagactaaatgcaatgtgttatcctgaatgggatcctagaccagaaataagacattaggtaaaaattaagaatatctgaataaagtatgaacttcagctaataacactgcattattattgtgcattcatttaaacaaatgtaccatgttagtataagatgttaacaatagaagaaattgggtatgagaaatatgggaactctgccctagctttgaaacattgttgtaaatctaaaaatactctgaaataaaagttatttttaaaaacataattcaacaaagacagatttaccagaggtaataaagaagactcagaaacaaaacaacaggcatgagttatggtcatagctctgtctcagccagaagctttttttggtctcactcatacgtctgtggactctgtgaggagaggcagctctgctgattttggctggaatctatcacatttttggcattgcctggctataggctggtctaggatggccttatctgagacagttgggctctggcccacccctcctcttatcttctagcactgctggtctgggcttgttcacatggtgttacatgggttaaaagagagagtggaagtacacacgattccaaaggcctggaatcacaaataaaacattatcacttcctccgcattctgttggacaaggcaagtcaccaaactagactagacacaagtagagtggggtgtgtcaggggttggggggaagcagagtaagtgaaaagagattccatttcctataggaaagagttccaaagtcatattgcaaaggcatgaagcattggagacatttttgcagacaaactaccacacttttttaagatgaaccagaataggtcagattatctttttatgacaattcttgatatgcttttatttctaggccataatttctgccttgcattcatacatgtatcaacaaatatttatgagtgccttaaatgtattaggctctttcacctatcttcttagaacttacaattatatattataatcaaaagtgaaatgctagattcctttattttgggacattatttttgaacacacttggctaggaaataagccacaatttatttatttttttgtcaatgttccttgaaccatactagacattctggtataaattctaactagtctttccttagggataaatatagaagaacttcagttactaaccaactgacatatgtaactgtgggggcagaaaaatttcaacttcctcctcttagggttccagcagagcctaagaattaaattgacatagatagataaaagcatgcaaatttatttaacaagttgtatgtgtcatggggaccctcataaagaaataaagacctccccaaagcaattagagtatattacttatataccagattgaacaaagaatagtaaactgtgaaaatgtggctaaactatgtgggggaccggtaaagaggagttattctaataaggtctgtatagtattctctcagtcccagcttctcattcttgaagacaaacatcttgccttttcttcgggtatagggagagtgtcttatacaggagttaaatcttttgcttttaggaacaacatgaaggccaaagtcatcttttatcaccagctgctatacaaatgtctttaacttaatgagtcaataagccaaaataaggtatttcagcctcttcataacatttgagcaacagtactcaaagtgtggacagactgtggaccagaagcttcagtattacttgggggcttgttagaaaggttagaatatcagaccctaaaccagtcctgctgaatcagaatccctgtgggtggaacccaggaatttgcatgttttctagttctccaggtaaagctgatgagtaaaagtttgtaaaccactggtttatgatccagtttttcaacgctttttcatcattaagaataaaaggaggccagccggatgcagtggctcacacgtgtaatcccagcactttgggaggccgaggagggtggatcacctgaggtcagaagttcaataccagcctggtcaacatggtgaaatgtcatctctactaaatatacagaaattagccaggcgtggtggcaggcgcctgtaatcccagctactcgggaggctgaggcaggagaattgtttgaacccgggaggtgggcgttgcagtgagccaagatcacaccactgcactccagcctgggcaacagagcaagactccatctcaaaaaaaaaaaaaaaaaaaagaagaataaaaggagttgggtatttctgtatcaccattaaatgaagtagtgaccatgatgcaaaaatataactttatacaaaagttatatttttgaattaaaatatttattcttattctactgtattctgaatattaggctttcaatttatttaattctgcattaccccagtccagaacatactattctttgttctggatattaggcaatggcttttgagcagaagaaataaagattaactttgaccttgatataacacaaaagtataaaattcaccatggatatttcttttcatgttattaatgttactctttttagctgatttcttaggttgttttattaattctttgtattgaaagatataataaaatgggatttcattacctcaagctttttcatttttgccctgatattcattctgtctcattgcattcagtcagcctcatttttccctctatcagctctcaactttttggactcagtgttcgtccatcctcacactttccatctttcttttatctttaaacaaacaactcattttaattgcctgtgtcttgattcttttccttttgtttcatggatgtcactttctctctctctctctctctctgtctctgtctctctctctaccaaatctgactgcaaaagccctcagatttcatgcccttgagtttgtgggtgagctgactgttcaggagaatcaagacaatcttattccaggtggtgattcgggaatccagtctgcctgcacctttatctttgccattttatcatccatcatgtaggaaaagagaagagagagccagaatgtctctcagtggactttactgtttgcattgaacaatgtctggggttgtcccgtgatccctgcctccaggcttcacaattcttcccccttgagtgtgggagagccggggacttgcttctaaccattagaacacggcaaaggtgaggaaatgtacattgtttcgtgtcattacatttcataagatgttgaaactgccttgctagaagactctctggcttagaagaggtaagctcccatatcacaagctacatatggagagaattgtacagcaagttgctgagggagcctctagctgacagccagcaagaaactgaggctcacagtctggcagctggcaaggaactgaatgctgccaacaaccatgtgaacttggaggaggatcttgtctgggcttttcaagctagcacgttgattacagccctgtgactctgaagtggaggatccggttaagctatggccagaatcctgaaccccagaaactgtgtgatgatacacgcatattgttttcagctgctatgtttatggtaatttgctgtataacaataaataatccacgcccttagcccggaagtgccatgcatccctattattcacatttcgctgactagaactagacatatggccaattctttgcaagggaagttggtagaacagtatttcttgtacccaggaaagagataactgcatataggtgggcactagcagtatctaccacaaaaaaagattcaataaacttttactgcttttttaacattcatgttctactggtgagatgggaaatgaatacattattagtggagatgactatatagtaataaaaagtggaattacatttgccattgactttaaagttaactatgtttattttttaccagtctttatgcactagaatgtgaagtctatgtaactaagtttgatattgcacttctattatcctttattaattatagaccctcacttaaataggtacctgtgtgaacacatagtaagtattatgatttcattacatgggttactataatctaagaacttgtactatgacaaaacttttcaatctcaggagtatgatagagatgttttatcatgacaattgtaaaagacataaaaatctttattttcaaatgaatatcagatgagaaaagaactatgagtcgttagatcgtcatgatgtctttactttttcatagccttggtggtgggtatcagtctatgacttatcaggcctttctagtttaagagactgccttagggatgggtcaaatgtttagtggatttgaagacagggctgccaatggtaatgaagaatgtgattcaataaatgtttactgcttttttaacattcatgttctactggtgagatgggaaattaatacaaaatcaataataataacagcaaaacttagtaaaccggagctgctcatatagggagaaaagtaaaagaacaatgtcattctttgctaatctagaaataaaatactataattctcttgtgtctgaattttggcagtctggttccttctgaacaaagatttattagcagtgagacttttgctatggagacctcattatgcctataaaacattctactgtggtttttcaagtaagatagagagttgcttcttaagaaatcagaaattggcattatctaaagaaatgaaaaacatcacagaaatttttgacatctgcatttctgagactatgggaaatgccacaacagagacaaagtgggcggcgttctgaggattctgtgtcacatggtagctccaaaggctatccctggaccaactaaaagttatccaccatcccacaaacctcaagaatgtcctgacatacatcatgtatctaaaattctccctaattttttattattaatttattttcaaaatttaacaaaactctttctgaaattgactaaaatttatactaagttgacatgccacattcataatcacactgtgtatatttacaacttggacattaggtttgcccatgtagaaaatcagggagacctcgatctctttcttggaagatctggggggactgctaagtatatcagtgctttattgtcactcaagtgaactgcagcatagccatcccctctacaacaagacctgaagtcaatattgcctacaggtgaaaccaactagccctgtgttagaggaggaaatgtcatgatgagatgatgtctccgagcctatgcagttcacctgccaaggaaaagcccaaggtgctatgtattcttctctttaggatttaggattatcatttatgtgctgttacacagtgaaaccttgcttgtgtgtatgtgaaagctggttggcattgttttcaattcagtttttggatggctaacttgattgtttttactgtgctgctggaatgcctctgtatctttccgcctctttgcctatcttttctaaaattatagcgatgaatactttagccaaaaaaaacaaaaagcaaaaactctcagatgagagtcagaattttaaacattataaactaatggagaattgaagtgtatagagtcaatgtatttgacctcttactttttaaatgtttaatcatatttaattttaactacataagtagtaaatgctaatgctgagccacaatgcaacactctcactatattcaaatttaaagttttgtgcttctggagccctatttaataaatcttttgcataacaaatgatcataaagatcatttgggcatatagtaacttctggaaacttcattaatttatcttttatatttagatctataatccacctgtaattgtgaatcttatatgatgtcttcaatcttctggtgtcacctttgctatagtaagtgactctctttctgaacattttgttctattcaagtaaaatacttatttgctctcgtgccaatatgacactgttttactatttatagctttattatatgtcttgatagctaatagtgtaaatcatccaggtttctccttcttgttaaagattgctgtgggtatttttggtttatagtcaatttaatttgtggcttatagttgatttaattacttgtcttccttcttttgtagtagtactatacagctatatatttaccatagccagatgcctgccaggtatattctccttgactttggcttgactgttgacttgattttattgatagaacattggcagatatgagatgagcaaaggcttcagacatgcttgtttagttggcttctttctcttgtgttcctgacattgccatgagaagagcatatgctgggtaaccagggctccaaatgagccagattgatccaagctgccccagctgacttgcaaacctgaaactaaagcagaatcatctcagccaaccttcagaccttccagtaggagagcaaatgcatgctcattgttaaaaaatatgtttactcctagctttatttatttttaaataaattttatttcaaaatagttttagatttacagaaaataaaaatggatctagaaacatttatagagagttcctaaatacccggtttccactattactaataccttacatgactatggtagacactggagtaagacctaaaaacaccaaagaatctcctacttgaaacaaagatatatgatctgtaattaaggctttttgatttttcaccccagttttctttattttctctgctaaatacattttcaccactttagaattgtttggattttttttttttttattttagaatagttttagatttacaaagttagtagagtccccatgtactccatactcaggttctcctattattaatattttatgttaatatgatacactttttataactaatgagtcaataatgatacgatattattaaccaaagtctgtattttatttagatttcctcaattcttatctggtgtcttatttatattcctggatcccatccagaataccactttacatttagtcttcatgtctccttggctgcttttggctgtgaatttttcaaactttccttttttttgatcatcttgaccattttgagcagtattgctgaagcactgagtagtactgctgaggtagaacatctcttttaagagtttctgtgatgttttcctaatgattaaactggggttatgggttttggggaggatgaaaatagagaaataaagtccccttctcattacatcatatcaaaaatattgttaaatgaaagttataggaggccattgttttggactaagctcctgtagtaggctccaacaaatcagactaaaatcaaaatggagtcacctatgctaaagttccatgtcactaaactgaaactaagctatctgatattcccagaaatcaggaaagagagatgattaccaattactcaataagtcaatttcttttttttttcttttttgacacggagtctctctctgtcgcccaggctggagtgcagtggcgggatctcagctcactgcaacctccacctcccgggttcaagtgattctcctgcctcagcctcccgagtagctgggactacaggtgcgtgcccccatgcctggctaattttttgtatttttttttttagtagagacgggttttcaccgcgttagccaggatgctctcgatctcctgacctcatgatccacccaccccggcctcccaaagtgctgggattacaggcgtgagccacacacccggccagtaagtcaatttcaaactccaattggcatgataatgaagttccttctgttttaatccttaaaacacaaggtaacctgaagtgacccgatgctaaccaatcagttattttttactgttttgtttccctgttcctgacttccaaggaaagtaacttctaaatgaccaatgtgatttttgttttttgtttctgcttttttcagcctttactgtctataaaaccaacagcatgtgctcagcttcttggaacatttcctctcttttatagaatgaaatgttgcctgattctagaattgaaataaagataattgagatctttaagctaaatatgttctgattttgtcttttgacatatatcatcaacctgagttatcagtgtagatgttaaccttgatgacctgcctgtggcaatgtttatcaggtgtctctgacataggagttaaaaagaaattatttaggcagatactgacggtaaagaagtcctcagtaaggttttctttttaatgaaaagcagcccccaaatcttcttcttttctaacaaagagcagtttgtaaaactgagctgcagacacaaaaacgcaagctggaagcttgtatgggtgaatgctggcagctgtgccaataaggaaaggctacctggggctaggcgtattcaaaatggcggctccaccttcccctttccttgcaaaccacacaacatggccccaggccacgcaaagactccatttgcataataagattccagtagggcaaccagtttcctcatgcgctatgtaaatgtcacacctggtccaaccaatctttggatcctatgtaaatcagacaccgcctcctcaagcctgtctataaaacccggtgcattccactgctagacggaagtcccattggggcgcccctgtcgcttagcagcagaaaaagctgctctcttttcgctttcttttttctattaatccttcgctcctaaacccacttcttgtgtccgcatcctcaattcctttggtatgagacaatgaaccctgggtgtttaccctagacaatgatgctgcttcatttccattacaaagttactctttatttctctctaaactcttcagaagaaagtcactatgcacagctaatgcttaaggactggtagttatacttctccctaaagacagagagtaactacatacataattttttttctgtacaaatttgtctattttccccaatttatttacttattcaatcattcatttatttatatcagtgtggactcatggtcatttattttatattttgggttgtaatacaacactatgtcctgtattatgttccagcttatctttttccagctttggctattgagagctctttcagttagctcctgggtcctgggacagagacttaccattgcggaattttttttttttttttttttttttgagcactttctcagtttatagaacggtaaaaatgcagttttcattaccactgggtaaaattacttctagacctcttaagctgacaaagcctgaaaaacacgtgtgtacactaatctgtgtacttacaaatatccataaatatttctatatgtaaccatcattatttatattaaggtaaatacgacatcatgccaatgtctccaactctaacccaataccacatggatcattccagacttctcccctgcttatcagtagcattctactcccaacagtcagaaaaatgccccccaccacctgacatttatgtacctaattttaaaatttcaatatacatgtatagtggctatttaaaaactgttaacagtacccccattagatgcacacttatcaactgaggtacagtgcttatatagagtgtcttttggttttagtcttacagatcctactcatttccaatcttagctcagtatctcttcttcacttccctttagtgatgttgttttacatttgtagtacagttagattcttttgtcacattctgtattctgtttctggggtttcctggcctcctaaataattttttaagctaatacgcactaagtttcactttttgtgctatagagttctataggttttttgacgaatggatagattcatgtatttaccagtacagaatgatacaaaatactttccctgccctaaaatttcccccatatctcctcccctattgcatctattcaactttccccctgcctctgaaagccctagatctcttgaccgtctctatcattttgccttctttagaatgccaaagaaatggaatcatataccacagagacttttcagaccagcttaatcactgaacaacatgcatttaagactcattcatgtctttttgtggctcagtcctttttatcactgaataaaattctattgaatggatgtccacaatttgtttatccactaccctgttagatgacattttggttgctttcagtttttgatgattatcaataaagctgctataaatattcatgtccagattttttaagggtttagtgttcaaagcagtcagttaaatacctagaagtgtcactgctggatcctatggtaaggctatggctaacttagtaagaaattgccaactgccttctaaagtgactacatcaataatgaatgatagttcctgttgctctatatcctcatcagcatttgatattgtcagtgttttggattttggccatttcattcatcatgtgtatagttgtatctaatgttggtttaatttacaaatccctaatggcaaatgatgttaagcattttttcaagtgattattttcaatatgtaagtcttctttagtgaagtatcttttcagatattttgccagtttttaattggattatttcttaccttattgtattttaggagtttgatgtacattttagatgcatattctttataacatatgtgtttaacaaatattaatattttcttctagcttctgtcttgtatttttatccccttaacatctttccagagcataagttgttgggttttgtttgtttgtttgtttgttttttgacagagtccaattactgtagttttatggaaagtcttgaaattaggtagcatcagtccaataacttgttttgcttcttcaggtttgtattggccattctatgtcttttgcctttacatgtaaacttcagatcattttgtcaatacctacaaaacagctacctgagattttgattgggataactgggttgaaactatagataaagttgagaagaatttatctctacagtatatataatctatgaacgtggactatctcgctataattatattttttattttcttcaccatcaatttgtagttttctacacccagttcctgttatgttttgttagctatatactaaatatttctctctcttcatattattttaaataatatctttaaataccattttaaatttccaattccatctgttcattctgggtatataagaaagcaattggcgtttgcatgttgatattgtactttacagttttgctctattcactcattagtttctggaagtttttggtagaaattttgaaatttttgagatttacaatcatgccttatgtgaataaagactgttttatttgttgcttttctttaatttctctgttattattctttaattttctattattgtactagttagggattccagtacaatggaaatatgagtggtaagagaggacatctatctttcattctcagttttagaaaaaaaagtagctagtctctcatcattaagtaagatgctaggtatgggatttttgtggatgttttcaaattaggtttcagaaagcacccttttttattaattttatgagagtttttaaaatattatgaatgggtattggattttgtaaaaagctttcctggtatcaattaatctagcatatatttttttcttctttagcatgtttatatagttgaataaattgatttgttttcaaatgttgaaccagccttacatacttgaaataatcccatttaatcattctgtataattatctttatacattgttagaaaactttgctaatgttttgctgaagaattttgcatcaaagttcatgaaagatgttgttctgcagtttttctatatcataatgtctgtgtcttgttttagtttcagggtaatacttctataatagaatgagttaggaagtgtttctgctgcttctatttttagaagtaattgtggagaattcatattatattttccttaaatgttttgtagaattcaccagtgaaaccatctaggcctggtccttttatttttttgaaaattactaattcttgatttgatttattttaatatctataggctatttgggttatttctcctgtacattttggtagattgtatccttgaaggaattgtttcattacatataagttattaaaagtgtgaaacaaaattattcaaatattcctctttttctctctttaatacctatgagattagtagggctggcacctattttatttattgtattggtaatttacgtctctccttctttttatttgttagcctggctagaggtttatccatttaattgatcttttcaaagaagcagcttttggttttgttcagttttgctatttttttgtttccaatttcattgatttctgtcctattattatttatttccttctgtttgcttaggcttatatttctttagttctctagttttacaaggtaaattaggttattaatttttaggtttttttctagtatttgaattttatgctataaattttcctcttagcattactgttgctgcatctcatattttttttcaacttttattttagattcagggggtacctctgcaggtttgttaattgggtatattgtgtgatgctgagagttaatgatcccatcacccaggtactgagcatactactcaatagttgtccccctccatgctccctccctctagtagtccccagtttctattgttgccatctttgtatccatgaatacccaattttgcctcccacttaggaataagaacataaaatatttggttttctgtttctgtattaatttacttaggataatggcctccagctgcatccatgatgctgcaaaggaaatgatttcattcttttcatggctgcatagtatggaatactaagtattccataaaaatgtggtgcatatataccatattttctttatgcagtccaccattgatgggcacctaggttgaatccatgtctttattattgcatcccacaaattttggtgaactgcatcttcattttcatttagttcaaattttttaagtattttttttttagttttcttatttgaacatgggtaatttagaattcttttaatttcctaataatgtagattttccagctatctttctattattgatttctagtttaattccattatggtctggaatcatactttgtataatctatatttgttcaatttattacgatgtaatttatggcttagaatgtaatctatcttgatgaatgttccatgtgagcttcagaagaatgtatgttctgacatccatatttacagtattctattcatttcaattagatcaagttgctcaatagtgctattcagatcaattatatccttactaattttctgcctccttgatctaacaattactgaaaaaggcatgctaaggtttttaactattatagtgactattctatttcacctttatttctatcagtttttgtctcatatgttttgatattctgtttgtaggtgcatatatgtttagaactgctgtctttttggagcatggaccctttatcattatacaatgttcttctttatccttcatgatcttccttgttctgaaatcagttttgtctaaatttaatatagctgctccaaatttcttttgattaggtttaacatagtatatattttttcatctctttacacttaatgaaatgtttatatttaaagtagatttcttgtagacaacatagagttgtgtctctagtgttaaaacctactctggaaatcactattttcagtagactttttagaccatccacatttaaagtgattattgatatagtcataataatatttgccatatttgtgactgttttcgatatcttgcaattgtacttagtttattttgttttttaaatcttcctctctttttctgccctctatggttttagttgagcatttcatgtgagttcattttatctcctttctaactatatcatcatggtttcttaaaagcatgtagtcttgacttatgcacttatgttctgatattaattcaccttcaaataatgccacaccacttcacatatagtgaggttatcttatccagggttttttcagttcttccttcttaccctttgtgatattgctgtcatctgtgttgctgctccatatattacaattatctaataaactgctgctattattgctttaaagaaatggttatcttttaaataaatgaagaataagaaaaataaaatatctttctttaccattatttatttcttctccagtgctcttcctttatgtatagcaaattttcagacctataatatttttcttctaactgaagaattttttagcatttcttgcaagtcaggcctgctagtgattaattctctcagtattttttgtctgataaagtcaatatccctcatttttgaaacatagctttactagatatagagttccagattaatgtttgctttttttaatcactttaattaatttattttaaattaattaaatttaaaatttaattaattttaattcttgctttcatggtttctggtgagaagtctgctgtaattttaacctttttctctatagataaggtgatttttttctccctctgacgtctttcagaattttttgtctttggttgtctgcagtttatgatataatatgcttagagatgtgtgtgtgtgtgtgtgtgtgtgtgtgtgtgtgtgtgtttgatatttgtgctgcttggtgttctctgagcttccttgatgtaccatttagtatcttttattagttatagaaaattttggtcattattacttcacatattttttctgcttcattctatcttaatttccattggggtatccaaattacgtgagtattatatcacttgaaattgtcccacacttcctggatattctgttttgtctttttcattctttttgcattgcagtttggaaagtttctattggactatcttcaagcttacttactctaccctcagccatgttaaatctactgatccagccatcaaaagttttctgcatttctcttacagtgcttctaattagattctttttaagagtttccatctctctgcttatattacctatctcttcctgcatgttgtctcctttgtccattagcggccttagcctattaattataattactttgaatttcaggtctgataattccaggattatctgattcatatccgaatctggttgtgatgattgcttcattgctgcctctcttcagaatgtttcattttgttttttatctgtttacttattagcaggtcttgaaattttttgatgaaagttggacgtactgtattaggtaatagagaaatggactgttagtgagggcatttatgttaatctgcacaggggtttggctttgttaagtgcttgctgtagctataggtgccagagtcacaacatttctgtaatgtccttgttttgttctcttttgatatttgattttcataattacttttcctcaaagaagagtaattgtagcttttctagttataattcactgttacactttgagccctgtagatgcagtggtaaaatttgagaggtgggaagcatcctatagtcttcccattaagtctcagtcttttagtgggtctgtgtctcaggactgtgagtttcacgaattttcctatagtgctacagctttcccctacatccctaccacagttcttggctgaagtgttcccagtttatctccttaaagccaattacctccctcttaactgtgtgaactttttccccttaggtgagacagaaaaactggtggcaccaagatcaagccttttcctcagctgagacaaaactgtgacagttttctctcctggagagtaaggctttgatatgaaggaggctttcactattacacatttgctcctttaccagaaccatgagagtcaatattttcggattctcactgcgagaaactggtggggttctcctgaaggtaaagcctagaaagtgtgactctcctcctccccacacctttacccaccaagaccgtccctcacagtagtttctcaaattcattctagtccatactcagcctccagcaattcatcaaaattgccatttaaatgttcctaccagtttatgactgcagtagatactgctctaggtaaatagatgtctgctatgactctctctaggtgcccctttctctccagattccagggtgttggttttccctgaaatctcagttctctgatgtgtccaggaaaagtcacaaattttcagtttatccaattctttcttatgataaggataggaattatgacctctaaactctttatttgatagagttaaaacaagagaagtgctcgctcttttaagcctctgaatttttggataattttatatgcagcaattttatagaaataactagttgacacatttaatcacatactgtatgtgtgtgcgtgcacttatgcacacacacacgattttgattgagattacattgagttcaaagatcttttgaagggagttgacatctttacaatattatttgttctgattaaatgtatggacatagtacatcttcaatttatttcttaaattatgcactgtagtttgctgggtagaattctgaaacattttttaatcataatttgacttcttttgatatcataaatagcatattaaaatattttctatttgttcatggtatatataataaaaatatatatttatttatatataaaaatgtataatataaataaaatttaaaatgtatacatgaaaattgctttttacatttttttaattttggtgtaattcttttttttttctttttttaaaattatactttaagttctgggatacatgtgcagaatgtggatgtttgttacataagtatacatgtgccatggtggtttgctgcacccatcaactcatcatctacataggtatttctcctaatgctatcgttccctttgcccctcaccccctgacaggccctggtgtgtgatgttcccctccctgtgcccattgttcagctcccatttatgagtgagaacatgggatgttttgttttctgttcctgtgttagtttgctgagaatgatggtttccagcttcatccatgtccctgcaaagggcacgaactcattcttttttatgactgcatagtattccatggtgtatatgtgctacattttctttatccagtctatcattgatgtgcatttgggttggtttcatgtctttgctattgtgaatcgtgctgcaataaacatacctgtgcatatatctttatagtagaatgatttataatcctttgggtatacaccccataatgggattgctgggtcaaatggtatttctagttctagatccttgaggaattgccacactgtctttcacaatggttgaactaatttacactcccaccaacagtgtaaaagtgttcctatttctccacatcctctccagcatctgttgttttctgatctccattctcactggtgtgagatggtatcttattgtggttttgattcgcatttcgctaatgaccagtgatgatgagctttttttcatgtttgttggccatgtaaatgtcttattttaaaatgtgtctgttaatatcctttgcccactttttgatgggttttttttttcttgtaaatttgtttaagttccttgtagattttggatattagccctttttcagaaggatagattgcaaaaatcttctcccattctgtaggttgcctgttcactccgatgatagtttcttttgctgtgcagaagctctttagcttaatcagatcccatttgtcaattttggcttttgttgcaattgcttttggtgttttagtcatgaagtctttgcccatgcctatgtcctgaatggtattgcttaggttttcttctgggatttttatggttttaggtcttacatttaaatctttaatccatcttgagttaatttttatatacggtgtaaggaaggaatccagtttcaattttcttcatatggctagccagttttcccaacaacatttattaaatagggaatcctttccccattgcttgtttttgtcaggtttgtcaaagatcagatggttgtatacgtgtggtgtcatatctgaggcctccgttctgttccattggtctatatatctgttttggtaccagtaccatgctgttttggttactgtcacctggtagtatagtttgaagtcaggtagcgtgatgcctccaggtttgttctttttgcttaggattgtcttggctatacgagctcatttttggttccgtatgaaatttaaagtagttttttaaaattctgttacgtaagtcaatggtagcttgacagggatagcattgaatctataaattactttgggcagtgtggccattttcatgatattgattcttcctatccatgagcatggaatgtttttccatttgttcatgtcttctcttatttccatgagcagtggtttgtagttctccttgaagaggcccttcacatccctcttaagttgtattcctaggtattttattctctttgtagcaattgtgaatgggagttcactaatgatttggctctctattattggtgtatagcaatgcttgtgatttttgcacattgattttgtatcctgagactgctgaaattgcttatcagcttaaggagttttggggctgagacgaaggggttttctaaatatacaatcatgtcattctgcaaaaagagattatttgacttcctctcttcctattttaatactctttatttctttctcttgcctgattgccctggccagaacttccaatactatgttgaataggagtggtgagagagggtatctttgtcttgtgctggttttcaaagggaatgttttcagcttttgcccattcagtatgatattggctgtgagtttgtcataaatagctcttattattttgagatacgttccatcaatacctagttcagtgagggtttttagcatgaaggggtgttgaattttatcaaaggccttttctgcatctattgagatatccagaaaatttagaagaaatggataaattcctggacacatacaccctcccaatactcccaagataaccatgtggtttttgtcattggtatgtgatggattacatttattgatttgcttacgttgaaccagtcttgcatcccagagatgaaactgacttgatcgtgatgcataagctttttaatgtgctgctggatttggtttgccagtattttattgaggatttttgcattgatgttcatcagggatattggcctgaaattttctttttttattgtgtctgtgtcaggttttggtatcaggatgatgcctgcctcataaactgagttagggagtcttccctctttttctattgtttggaatagtttcagaaggaatggtaccagctcctctctgtacctctggtagaattcggctgtgaatccatctggtccttgacttttattggtcggtaggctattaattactgcctcaatttcagaacttgctattggtctattcagggatatgactgcctcttggggtagtcttgggagggtgtatatgtccaggaatttatccatttcctctagattttctagtttatttgcattgagtttttatcacttggctccctgccttcagccccctttccaggggagtgaatggttctgtctcaatggcattccaggtgccactggggtatgaaaaaaactcctgaagttagctcggtgtctgctcaaacagccatacagttttgtgcttgaaacccagggccctgttggtgtaggcacccacgggaatctccttgtctgtgggttgtgaagactgtgggaaaagcatagtatctgggccagatagcaccatccctccaggcacagtccctcacggcttgccttggctaggggagggagttcccctaccccttgtgcttcccgggtgaggtgatgcaccatcctgcttctgcttaccctctgccacacccactgtcttaccagtcccaatgaagtgaactgggtacttcagttggaaatgcagaaataacccctcttctgcattggtctctctgggagctgcaggccagagctgttcctatttggcctttttgcccaggagtttttcataagtttttaattgaaataaaacatatgtgacgaacaatacaaaaatcattagtgtacactttgatggattttacagctcactggtataatcatcatgccagcagcaaagctacatgccaccatgtagttcttatacccaagcacgagtacccactttcctgacttctagcagataggttattcctggctgtttcatactttatattaattaagccatactgcatatattcttttgtttctggcttctctcagcattatgtttttgatattctaccatgttgttgagtataggttcatggagtttcattgctcatggattcctgttgcagatagttcatggagtctcagagctatataatactcaactttgtaaatgttccacaatctatatatccttcttactatcaataggcacttgggtcatttccaatttttaactattatttacatatatttttgtaatatatatacatatctgcagcagtattatggaaacaacttatatatgtaatatattaatgtaatacctatatacatatatttttgagtgaatatgcagcaatattatggaaataactagatgtatgttatatataactagttgacacattatatatatatatatatgaaattcaattcatcattttcaaaaataaatagccttttgggtcttgtttaagaagtctttacttactacaatgccatgaagctattttctcattttctttctaaaagctttatattttacttttcacatttagaccttcaatctttatggaattgttgttatgtatggtatgagataggaatcaacacatatatgtatatattcatatatatttttctatatcaatatacaaaaacacaaaaccatatactaaaatcaccattcttactccactgtactagtgttacctctgacacaaatcagatgaccatacatgtgttgagcagtttctggtttctttattcttttccatttgtttgttttgttgatttattgatttacctggtgtctatatcacaatatcttaatacgtatactatatatttggccttaatatctgatagtacaagtcatctagtttgtatttaataacaataacaaccactttggccattctagttcttttgcagttccaaaggaactttgattctaaatttttataatcaaaactctgataaaaatgttgcattaaattacactgtattttaaatcaatttggagaacactgaaattttaaaatgtttagtcttttattccatgcatataatctctttgggtctttcaaaatttcttctcaatagcatgttactgttttcagtgtagaggtctttcatgcctattattagatatatttggagctatttgatgtttttgatagtattttaagtgttattttatcaaaattgaattacctatgtatttattgctgatgtccagaagtaaatatgatttttacattaaccttctattcaaaggccttgttacattaatgtattaattctacccatgtgtctacagagtattttgtttttttaatgtacaaaaccatgttagctgcaaataataaaacttttcttccttcctattcaatttctaaacagtttatttttcttatctaggtcttacctaggacatctagtctatagctgcacctttattttattcagattttaattttaaaggaacaaatgacaattttcattgtgtgctgtttattgtaggttttgtgtagacactattatcagatcttaaaagttgttgcctatacctgttgtgctaatagtttctttttaatcattaatgaatatataatttcatttaaatattttcccccattaattaagaaatttttttttcttttttctgttagtgttgtaagtgtcttagttgaattttgaaggataagccaactttaaatttctggaataaatcaatgtcatcatgatatattgtcctagtcatatgccactgattttctaaaacaaaacaaaagactacagttaatccatcccccctgaataagataaaaatattatttcagctctctagccttctatgtacactaccatctatagaataactaaatttgttttgtttactatatgttagatgttcttccaggtattaaatctatattaacctctttaatactcatgattaaaatgagaaatgatatctcatttctatttcacaaatgagaaaattgaagcaggaagaggttaagtaccatgccgaaggtcaccccaaactaaattttgttcctggctggctgattccagagctggtgtgtttgtgattccaccatgctgctgggctgtgtctttcagctgagatttttaacctcaaatattttaacaagttatttagagataccaataggattctctggttttcttactattgtttcttgtacactggattcgtttgtttctctactggatcatatctgctattgcatattttagagaaagtctaggtatgataagactcctgaataaatgcatgtctgaaagtatatttctttattttcacatgtaaatgatagcactgggaaatatggcggtacatttatttcccctccacttactcttgcatgtatctgttccaaatctccaaacactaggatctttgaccattctttttttgtcattccgaaatttaaccacaatatgtgaatagctatatcttttacaattcattctgctcaacagaccttcttatcctgatgatgtatgacctctttaatcctgagaaattttctctcattgttttgagaatttcaggctatatgtttaagattcttgcagcttcattcaggtttacttaataattttttcacatacgaagacatttataagagaaaaaaacccttcataattatatcatccagatatatcaactgttatcatttctctgtaatcgtctcttataagccatgtctgtggtttttaaataatttaaatcacttgatgtttagtgctatattttgcttttatctcattacgtgttacgtattttttttacatatcgcagagcattagtaaccatttaaaggcttattttactccattgagttaaaggcttaatttattccattgagttgtcaaaactttttttacctagaaaaaaaagattctggagagacaatcacattcttacatgtagcttgacaaaccacccacacctttccctgctaagcccgatgagtttacagccaactaagaaaccataggtattagacagatagaaatttaaaaatactaactttacaacttataaaattaagtgaagaaaaaacactttgtctggtagccagggcgcacatgggatcccgcacttagaagagaccagcccttggtttaatgctactccctcaacactttcaaattagtcaccatttttgaaaagggagctctgcatttaaccgtgcacggggctctgcagattatgtagccagttctgctagtagccttagtcagtatttctagtgtttccttttaagtctggaccttgtaatgaccccccatgaaaaggaatttgcagagctgacctttgcttttcagctgaaatgggatcactcccgcccttacatcaagccccaatttcaagaacagagagagaaaaaaggcctcatcactaacctctagatgtgtttatcccttggagagggagctgttgaagaggatcactgttctttcccaaacatttgaaagggcagaggcactgctttatgagctaagttatgacttcctaaagagggaggaacatgtttttcctatgacttcaaaaatgtgaagggctgtcagtggaaaagatctctgattgattcagaactataacaggtataaaactcagtcagaagagtgaaagtaagaggcaggcttatttggagagaatgtgagattaatctattttaaaacgagtattactgaaaaactagaatctgataacttgagatataaaaatttgttatcattggaaatattcagccacgaaataactgaatgcatatctactgggaagaggtctttaaatacagagttgaaactactgcttcaggaggaataaataaaacaacttcctctgtaatttatttcgttttccttcttcaagggatgcgttattaatctattgctgttcttttctgttcttttaatttttcaatactctttcaatattgaatacatctctaagactgtgcttatatccatactcaactgtctttcaaaagtatatatgtatatatcacttttattaaatatatagtaagaagttattgtatgtttcctattgcaagccactggactgaaatttaaattatgtatataacatcttacttgattttatcagatactatcattatcccattttatagagcaagaacccaaggcttagataggtttactgtcatgttcatagatacgcagctagaaaggcccataattttattcaaactcccacccatctgattataaaactaggattcctaaataccacaatacagtgtttaacacatcctaatatttttgccctatatttatacacactcaaggtatcaaaccttttgcctttttcccagcaatccggcatacctgtcattagaaagttctgtagttaatattactatggcaaaaaaaaaaaaaagaaatgccacatctgactggtaatcatcatggaaattccatgagatgggtagagtttattattcccatcatggatgaagcaacagaaatttagaaagattaaataatttgcccaagaacccaggactacttttttatcaattttcaagaatacagtatattactattaactatagtcactatgttgtacaatagatctcttgaagttattcctaagattactcctaattgctaagagagtagtttttaggttttctcaccaagaaaaatgacaagtttgtgaagtaaggtctatgttaattaacttgattgagccattttacagtgtacgcatatatcaaaacatcatattgcacaggtaaatatatataattttatttcccaatttaaaaataagtaactaaatgaaacaaataattttaaataaacaaaaataaaattaataaatatagacttttaaatcattttgtattattgaaattcatagaaattaaatatacataaaaagcaaccacactgtatttttttggaaaaaaaaatttgtttttcatacaattgtatgtttgagtaagaaaaaaatcattcaactcctatctttgatttattatttttatttgcatggtttacactctgttcaagcaaggattccctatctggacaccacaagctacctataaactgatattcgctttgtgaatgaattacacaagagaaaaataaagctcaaaatctgcttgtcaaatcaaaactcaaaaagatagtaaatgctactatttaaatttctagatatcaaacaacacataagttatgattacctgtataactttttaacataataaatgaaatttaaacattaaatttaaaaaagaacccatgaatagtgacttgatagagaggcaggcacaggaacagacaccttgaattacactaaggaaaatactaaggcttcaaattaggatgaaagaactgcagaatttggcagcagccatgatccttgaatctttcttgcatcctggcttcctttgtcacttttgtgatctcagtgacttgtcatttttgctccttggttttccatctcagacactgagctgactcataatcccccagggcagcagtatggaaccagaacaaccctgtcccagacagttcagttgtgttttatcaatgtctcactcatacgacccactttcttcctcattgtcatggccacagtcctatgtacctttgctgagatggtgttcaaagaaatttcacagcttcactttgttctcaggtacatatgaatgttcaggggccgtcccttgccttcattctgcatttcagtattaagagtatctttcttactgaaataataacagaagtttttctttttgcttttctaacttcactgaactataccatattgagtctttggattaaaaaatattgcctctgccttctttccatgatattgcatagtataaaagagattccttaatttatgcttgagtttatcactaaacagatgattattttaaattaacactttttatttctttacttgtgcttcaggaaaatgccacagagaattatttaagactgttgggcttggcgtaccattcgtgttcttcgggttaatgaccagtttcctcaaactacaaaatgctaacatttcactgtttcatcatagaatgcacaggctttatattgatgcagagaagggctttcacagccccagaatgaagctaattgtactatttattatactatttatacttgctgcacctccttccattcaaggagagagaaccttttaagagccctgtcaaaactgcaggtgtgccagaggctcctgctaacagcaggggcaggctttatagcatttcctcaagactgcttcggatcacttttcagtgtgtaaaaccggattttcattaatggcactaatgacacgctaatggggacagggcagcacacccaatgccagaggcagagcaagccaggctgaaaagtggccagcccaagctgctgtaagatgaaatgctgcagggtgttgatacattgcatttcttctcaaataccaggcaggcccagggcctacttgttaaatgggttgcctttgaggctgagcagaagtggatctagttacagtttttcacgtaaggacaaaacaagaagacagaaaaagctcaggcttcagacatttgcaagctgcagctgtttttcatggcaggagattctgaagacttatgagctgacacattaccctcgacattaccatgcattgacctctctgctccttcttctccctggagtggtgttcaaggctactgtttgacacaagggccaccaaagaccatatcaaagcagtggccccatcacaactcatcacttttaaaacacatacaatctgctctaggtggaaatgtggaggagcaaatccagtgttctggcctttcctccagggagggagctcaggtggacggtagtccctgatttctaaagcagctcttcatggtaggtcagtgtaatttttaaacaaatggtgtaagggcaagggaggctacagaaggttgatggagatggattattttgacttccttctccttgtgtgatccatcagcacggaaaaggcttactgtgcattattcttacctttctttgatcttttttagggaatgctgggagaaatgttggcctttccggtttgcttgagtatttgtaatattaaaagcaatgaacaggctgcttttcagagaggatggtcagtcacagaaccaggaatgcatcttaacaatcaggtctataggcatagcaaaagcaagttgcctacaacacctcttcctctctctttactgaagcacaagatattggcatcctaggaaaaactcattgtcattcctgttctaattttacagacaaaggtgaaagatgcagagggaagttgaataacttgtccagaattacatagaagtttgcgaatgagccagaactaggaacctggtcttttaactttccatccactactgttctctgctttgtattgcttctcaagaaaatctcctttaaattgtggctgtgcaagttgtgccgccacaagagcctctttggtagggcagcagttgcagagtcagcctcctggtcagtagctgatagttctgcttctgtcgtatttgacatagttgcattcccttggatgtcatagctgtctcctatgcagggcccaagcaaaagggcaggaccattgttaattctcttggtcatttttcactgagacccatggagcttccaacaggaactttccttctaatgttccgttctggaaaattgggattttcttccattttatttctccagctggataatccctccaagttttacactgtgaatttttcatcaaagtaattttctcacgtccatatttgtagcattaaattaccaagaattctttgcaattcatgtgtacatagtagccatttttatgtcagtacaaaggattactatgctgaaatacacataatgaagcaatgggagttagccatttcagcattcttttttttttccctctttatctagattttggtttggctggcacagaagtatgaccacaagatggacctaaaatatgcacatttgtaagattttcccccatggtaagtaaatagttggctctctgtgccagtgcactgacataaagctattttgaatattcttgttaaggctggtggaattaggttgtgatagtaaagaatttaatgtatcttgaagggccaggataaaataattgaagaaacaaaagcatgagttagtaatcactggagaaagaagaatggacttaaaggctactttgcttgcttctttggcttgagatgataaaatgaaataataagaaaggaaatactctgtgtaatatggcaagttttatatatatatgtatatgtgtgtatatatatacacatgtgtatatatacatgttatatgtgtgtgtgtatgtatatatacacacatacacacacatatatgaaacttgtcttattccacaggagatacatatgtatatatacacacacacacaaatatatttaaattatattttaaataaatgtaaacattgtaagttgttttattcttgagtcaaatgattagccttcccataattgacatcctgaattcaaaatcagcaagagaatacaaattctcatagtacagtctattggttagttattgccacaataatgttgcatacaaccacaaaatctcaatagcatgcatttatttctcatgcatctgtgggattccattgatctgggcctgacttgctcatacattcacagttcagctggcttacttatacacgtctaggttggctctgttccacgttattgctcatcctcttcctgggaccagtaggttaagctgagtatgtcttttcattacaatgacagaggtacaagaactagtggaaacacacaaatgcttttttaagcttctgcttatatcaagtcagcatttatcacaaagcaaatcacatggccaagaccagtttcaagggatggggcaggtcactctgtccacgtgggagggacctgaaaatttacttagcaaagggcataaatacaggaagagatacagatctggatcaactactgaaatttaccatatagacacaccattgaaatcattagtagaagcaatggattaactgactataaagcaatctgactggattttaataatacaggacctagtggaaaacactggaagaagaataagcagtataacaatatcatctataaaaatttaaaatgtacaaactcagtaacacattcaaataaaagtaccccaactgagcctactaaaatggttgactgtggggaaaagagaaacatatctgtagtgtagtatatggatatacttctggatatatacagaaatatattcttgttaaatgttaaatgcagttcctgccatagcttccttttccatggataggaagggagttatggaaggagctgcatttaacatttaacaaggaactgcatttttaaaaaaagtcattggtatatactctgaccactagagacatatttgcaatcatgatcaacagaccattcatcaattctgattttaggccaataaatgaggtagtcttccttagggctaagtgatggtcttcaggttacaaaatctccccttctcatagttattttctcaaaaggctcaacaaagccacttggccctaacaaatacacatacttgtgccctattatcagaaattctaaatgagtagtactgagtatgatggttaattctatgtggcaacttgactggccaaggggtgtctggatgaaacattatttctaagtgtgtctgtgagggtatttctagacgagattagcatttgaagcagcggactcagtaaagtggattgtcctctccagtgtgtttgggaatcatccagtcttttgagggcctgaaaccaaccaaaggtggagaaaggaggaattcacccagtttgtctttcctcactgctgagctgtgatgtctcatttcatctcatcttctctggctttccaggtgggattcacaccatctgctccccggttctctgatccaatctgtattcatcaccagatttcctgggtttctaacttacagacaacaaattgtgagacttctcagcctccataatcacatgaaccaccttctcttaataaatatatgtatttatgtgctgggctcagtggctgacacctttaacaccagcaattcaggaggccgaggtgggcggatcacctgaggtcgggatttagagaccagcttgaccaacatggagaaaccccatctctactaaaaatacaaaattagccaggactggtggcttatgcctgtaatcccagctatttggggggctgaggcaggagaattgcttgaacccgggaggtggagattgcaatgagccaagatcgcgccattgcactccagcctgggcaacaagagcaaaactctgtctcaaaaaaaaaaaaaaaaaaatatatatatatatatatgtatacacacacacacatatatacacacacacatatacacacacacaaaaaaaacacctctatttttataaaactttctccttaagaattttgatatatttcaaaagtcaagaactcttgacccaaacatgctgtcgtcacaaagacacaagttaatttgtaagagaaaaggtacattttgtcagtcccattttctatttccacgctttttcacacccttccaattggctaggtgcttccatccctgagagttattatctccttttgctagttcttcccatttccctcttgacctaaggtttagttaacttgtttctgcttacttgcttttctagaggattaggcaaagttatttataacaagaaacagagtggaaatattgttctcttgtcatagagaacaaaataaaagactcatagcctttctagttgcatataacattgatcactttatacctttcaaagcacttccatgttctgcactttatcccttgtattcacaaacagatatgatagcatagtggcctggtaagatagttcagctcttcatctagagagctaggttgcagccctggctttgccaatgaccagctaggtgacttggaacaagtacagtggttcatgacttgccctgcccatgaatagccactaatagatacacagccagtcctgctctaagtcttgttttggaaacataaatttgtgtcagtgatattgatagactatggaagaatctgagcataacatgaattgtgtgtttgcatattatggtagttcattttcacactgctgataaagacatactcgagactggacaatttacaaagtaaaaaggtttaattggactcacagttccacgtggctggggaggtctcacaatcacggtggaaggcaaggaggaacaagtcacgtcttacatggatggcagcaggcaaaaaaagagcttgtgaagagaactcccattttcaaaaccatcaaatctcatgagatgcattcaccaccacaagaacagcacagaaaaagaccagccccaatgattcaatcatctcccactgggtccctcccacaacacatgggaagcaggggagctacaagatgagatttgggtggggacacagagccaagtcatatcattctgcctctggctcctcccaaatctcatgttttcacatttcaaaaccaatcatgctttcccaatagtcccccaaagtcttaactcattacagcattaactcaaaagtccacagtccaaagtctcatctgagataaggtaattcccttccacctatgagcctgtaaaatcgaaagcaagttagttacttcctagatacaatgggggtacaggcattgggtaaatacagccattccaaatgggagaaattggccaaaacagagggccacaggccccatgcaagtccaaaatccagcagtcaaatcttggagctccaaatgatctcctttgattccatgtctcacatctaggtcacgctaatgcaagagatgggttcccatggtcttgtgcagttctgcccctgtggcattgcagggtacagcctccctcccagctgctttcacaggctggcattgagtgttgatggctgttccaggtgcacggtgcaagctgccgatggatctaccattctggggtctgggtttggaggacggtagccctcttctcacagctccactaggtggtgcccattagggactctgtgtggtggctctgatcccacatttcccttcctcattgccttaccagaagttccccatgagggctctgcccctgcagcaaacttctgcctgggcatccaggcgtttccatgcatcatccaaaatctaggcagaggtaaccaaacctcagttcttgacttttgtgcacccgaaggctcaacaccatgtggaacctaccaagacttggggcttgcaccctctgaagcaatagcccaagctgtactttggccccttttattcatgactagagtggctaggattcagggcaccaagtctctagtctgcacacagtggagggaccatgggcctgacccaatatttaagacgtttattcctcctaaacctcctggcctgtgaagggaggggttgtcacaaaggtctctgacacacgctggagacattttccctattgtcttggtgattaacattcagctcctcattacttttgcaaatttctgcagctggcttgaatttctcctcagaaaatggaattttctcttctatctcattgtcaggctgcaaattttccaaacttttatgctctgttttcctttaaaactgaatgactttaacagcacccaagtcacctcttgaaagctttgctgctttgaaatttcttccaccaggtactgtaaatcatctctctcaagttcgaagttccacaaatctctagggcagaggcaaaatgcaaccagtatctgctaaaacataacaagttcctcatttcccaacaagttcctcatttccatctgaggccacctcagcctggactttattgtccatattactattagcattttgggcaaagccattcaagaagtttctaggcagttccaaacttctcacatttttctgtcttcttgtgagccccccaaactgttctaatccctgcctgttaccaagttccagagtcgtttccacattttcaggtatctacagtagtgccccactctactggtaacaatttactatattagtccattttcatgctgctgataaaggcatacccaaggctgagcagtttacaaaagaaagaggtttaattggactcacagttccatgtggctgaggaggcctcacaatcatggcagaaggtaaggaggaacaagtcatgtcttacacggatggcagcaggcaaaaaaagagcttgtgtggggaaactcccattttcaaaaccatgagatctcatgagacccatttaccactgtaagaacagcacagaaaaatacccacccctatgattcaatcatctcccactcagccactcccacaacacatgggaatcatgggagctacacgatgagatttgggtggggacacaaaggcaaagatttcacatatgcaagatttcatccttgagaacactatatgcatacagaaaactgcactcagtcgaaatgaactatgtaactgtccacaaaatgcacacaagcagacacctcaaatatctactggctacttcagctcactaggagccacaactatacatatccagtgttacaactttctgatttcaagtaagcctctctccacccttcacagtcactcacaagagcaacctttctaacatccccatccacaggcaagcttcaggtcttttttaaagcaggacaccataattattgtaatatttaagtgacataagtctgtatttctagacctttgggacccatttgacatctcaccctgcaaaggcttccaaaatagcctaattctgagagtgcttttctgagcttcagcggaagcatgggagaacactgcccaccttcccgcatttttgtctcctgcatctttcagttattcactctttaggaatgtgccaaggtgaaatccatgttgaattcaatataagccttcagtctcacccatttttgaaacagaagcagtctctgaagaatggtctagcacaattttcaaattgtttagatgtgattctttgtaaaatgaaggaagaaggaaacatgaactctaaaattttccaatttggggtcacaactggtcccactctagtcacttgggatttagtattcatattcaaaatgctgagacttaaagtttttttttttttttgaacatttcattagcactggagtcacaccccagtgtactccataaggtaacaaaagaaaataaaagcaaaaatctttatcccgtgttattgtttagtgagtcagtcacacacaacaaaggcagtaaatctccacagctaaaaggagcttaatggttgaaacatcctcaggggatatgagaagcagcaaaataataattgcaaagaataacacatgatgcctgcgattactaatgtttagtttctgaagatcgctatagtataatatttgaaagtgaattactgtattaatcctcactagaagctccaaagaggagtattttcagttttaatacagacttacaccatgactaaaggttcttttaatctttgttccctatctctgtctttccgtaaaatggtccatctaaattttcttaccttcctaaagtggaatgaggattatctattaaatagtttcaaagcccctgggaaatgtgaattgtggcgctatgactgcatgacagtagatggagccgcgaagacatgaggaattggctgattcactggggagagaggacaagtgtcagtgagtataggaaaccttcattcgttgatcccaagggatcacagagtgccccacggtccattcatgggcactgcacaaagaaacagaaagaaacctgcatgtcctcttcatgctcacaatggaaacaaacctcacctcttccctcactctcttcatgttccccaagttataaagttataagtaaaataatatcaaacactattttttattccatttttatacaggcatttataccttatttagctttttatattgaaaaaaaagtagcaaaaagttgcaaaaaaattacaataaactttacaatacctgtcacccatattcctcagtcattgacattctgctgtttcctctctctctctaaatagatctacatctctatctgtatgcatgtacctacatataaatatatttatgcatttgtacttgaaattattaatactgacgaaacttttgagattgtttcagacatcataactcttaatttctaattacttcactgtgtatcttccaagaatatgaaaattttcttacataaccacaaaacaaaagtaaattggagaaatttaatattgatggaatacaatagtgcccccttattctcaagagatgcattccaagaccaccagtgggtgcctgaaaacacagtactaaaccctatatagactgtctccaacttactatggttcaacttaagattatttttgcctttaggatggtatgaaaccattctgtttttcactttcagtacagtattgcataaagtaatgggatattctagacttttttataaaaggggcttcaggttagatgattttgctcaactgcaggctaacgtaagcgttctgggcatgttcaaggtgggctaggctaagctatgatgtttgtcaggttaggtgtattaaatggattttcgatttacaatatattcaacttacaatgagtttataaggatgtaatcccattataagtggagaaacatctatacatactgtttttttctatgcacatctataataaagtttaatttataaattaggcacaggaagagattaactgttataaaatagaatgattatgacaatatactataacaaaagggtatgaatgtactctctctctctctctctcaaaatatcttattgtactgtactctaggtaatggaaaccatgaaaagagaaatcgtggataagcaggtgctaccatacacacagtttctgacttacaatggtctgacttacagtttttcaactttaagattagtttatcaggatatagtcccatcaaaagtcaagaagcatctggattatgatggttcaatttatgtatttttaagatgggtttataggagtattaaatacatttttgacttgtgatgtttttgacttacaatggtttcatcagtatgcaattttaatgtaagtcagagtatctgctattatctaatatacaatacaatccaagtcaaattctgtccattttcaaaataatgtcttttgtagctattattttcagtctaggacacaattcaattttatgtattgcatttagtttttaatgttgtttagtattctttaatgcaaacagttcctcagctatctttgttttgtatgtcattaatatttgaaaaatatatgaagattaatctatacaagcatattcctgtgtgtttcttaacaattagatgcaggttatattattttgataggaatactacagaagcttgagacaataactatttctttagttcataacatgggttggcaatttggactaggctcagccaggcgcctctgtcctgtctggcctcactcatgtttctgccaccatttgaccaggaggctgagattgactgatttaggatggccacagctgagatggcttgtatcttctccaaatggtcactcatcctccataggctggtctgagtttgctcacatggcagctggccagggtttcaagataataagtgggaacatgaaagagccttgagacccgggcttggaagccgcacaacctcatttccatcacaatgtacttgtcgtagcaaattataagaccaagcaacattgaaggggtgggaaattcaactccatgttttgatggtaggagctgcaaagtcatatttcaaagcatgtgaatttagggcatggaggagaattatggctatttatgcaatcacagatagctatcaccatccacagtttatagtagtttttagcagtgttcattatcaaaaggaagtcatagcatatggcttgccattcccatcagcagcctctttgaatttgctatctgaaaataccaggtgtaaaaccctgctggttgagaagggttcagtgtagactaactctacttaagggccaaaaacagcttagtatattgttaccaacttgactgtgatttcctccatacatatagattatttgtaactttgagtttaacacattgtgtccattttatagactcaatctattgagaaagagttggatctctctctctctttgttttagaggttgtcctcgctctgtcgcccaggctggagtgaagtggcatgatctcagctcactgcaagctctgcctcctgggttcacgccattctcctcctgcctcagcctcccaagtagctgggactacaggcacctgccaccacgcccagctaattttttgtatttagtagagatggggcttcaccgtgttagccaggatggtctcgatctcctgacctcatgatctgccctcctcggcctcccaaagtgctgggattacaggcgtgagccaccgtgcctggctggatctattattttaagtaatcaagggttatatgtcacattgtgtcttgtcatattacatgaaagggctttgttgagtcaaggcaaaaagaaagaatgatggtttttcagactttataaaacactgcgacagacatcagaaaataacagacccaagactcccagaggatgactggggaaagccagcactgtattttcacaaaagtgccacatgaaaaaaccaagacacactcttctggagctccacagggtcatgccagatgcatgatcgaatagagattgtggaaagtgtacattctggagggaagagcattccaacctcagagcagaaagtaagaccccaagctggtaggtcacagagcaaacttaggggatgcagccaagtggggacatctttggacagtcatgacctgaaggtgatgggctaaaaagaaaaatgtcaacaggatttaacatctctgccttcggagttttgatatggtagctatcatcaaaaagttccacaaaacaaagtgggaatacttcttctccaggattaaagaagttaagttttgtgtggaagcacccaaaattggcatagtgcaataacacataaacggtgactgtttctctccctaaacaaaaatggacagaagtgatatatcagatatatgtagagagagagtttaaataaaattttgttaactttagtactatttttgcatgctttagtgaacatacctcaagcatctgcacacttttatttcagaatgtcatgtggctttaatttcttagcaggatcttgaataatctttaggcttgagaacacaggaagtaatttataatgatatggcatttagatcatgttcatgcatttaagtgccttaattttattggtaaaatctgtcaatgaaagagtaatagttgctgcatatttagacttttcaagagatttccatcttttttacttgacacatcttatactttatataattttaaatattcacaaatctacaacaatcaagatcttattagtaataattaaaacacgatgtggtaaagggagctccctaagtaatttggggccccagttttctaaattaaagcatcttatggttcaaattttaaagaataaaatttccacccaggaaagtaatactgccaccgtggccaaagatatttttcttatctccacaaagcaattaattcagctgaaataagagaaaatgatctttagaaaacacccattttatcatgttactgaactaattataactgttcaggaattctcagtaattttcacaagactctgactgttgaccctcaagttctgccaaaattttttatacaggaaaaatagtggtagtaacctagtcattaatcttatctctctggatacttacttatctctctttatttcacttatttattatggtaaatatcaactcatttttcagatgagaaagcagttgagggatcactgaaagttaaaaatcgtcaacgatacagggaaaaataagatagaacatcttgatttctgtctcagcggattaaacaaaatgctccttttaagaagtgatctttccatataagacttgtgcttcagccacaacaggaagcctcgtttgggcactgaattgtactctacaaagtcctgggctgacccattagcacacattacttttgacattcaactaatgcaatgtcaatttaactaaacaagtaaacttgttctgatggacataaaaaacagaagcaaatggaaccataaaatacacttgatgtgacagtccttcctcatctaccgtcagggtactttatttagttgaataactggagttgactgggttatcacgcaattattttcttatttattccttttgagcccagcttaactgtggcagaagttcttccatttaacaaatgagtcttcatactagtttacatattactgtagacattggaattataataatgaattgggctaaatctctcctcaagaagtttaattcgaaaagaaatgtaggcaccaaattttattatcacgtggtagatgaattaacaaaagcagacacagggtgttttaagagaccagaagaaagcagcttatcttaggctaggaggtcaggaagggcttcagttcattcttaaaggtatgtgggattgattcaggaagaacaaagagaaaaattcagatgaggtaacatgagaatgtcatggcatgagagttgggagggggtaattataagtgggtttttttaaagcagaccataagctcaggtcaagaagtggtgggagatggaggcagagagatgattttatcttgttcctcggtacaactgaagatgtagtaattttatttagagtcttttcagttactctaacctgcctgggtttctcctaattcttttacattcttttctaattcctttaccagggtttgttataagctctccagtggtgcaggggtcttagtacaagagctttctggatcttttctccttttccacaatgtccttttcttgccagaggaatttggttttttgagcctagcccagcccaggagcctggctttattcagggaaagccttcctaatgctattacctaaatgtggccaaattgttcctatataactaactgttcctgcagtaattgacataattgttctctgcacccagccaggtgaaactccagcttttaatgataaatttgtggaaaaaaaaagttaaggtatatacacagatatttacgtcacacctcccacctttgccccacttctttttccactctgttggcagcctcagaaatttcagtgcaaagacagtcattgaaatgttattaattattatgaaaaattagaaatgagagaatggttgaatatattatagtaagttcatatttgtaaactcatgtttaaaaacttttaaatgaagttttctaatattgtacaaagatatgaaaacttcctacgatgtatatttaattgaatgaattgaattgaattaaatacatgtctttgctttaatttttaattttcaaaaatattgcaacacttgagaaagttacagggaataatctaatgaacactcagagaatctgaaggatgtggtccgtgttgagtctgtgacttggccaagaattttggaagcatcgccttagaatccaggactccttatttcaagcctaagtttgccttctacactgtttcctccctttccatgataaacgttttatcagactatctcttttccttacttctcttagagcagctagaggtagaagaggaaattgcttcaaattcaccctctggtcataaattatatctcccatattttatggcaggacaattgtttcaagttttcttctattcttaagccaaagttgcaatatgtttcagagatttaccagaatttagattttaatatagaataagtgaatatataagtaaatcaacatataaataatattttagatttttgtaaaatgtcactaggtctgtaatacagtgacatcaatcaaaataaaacaaaagtcagtttaagaatgttcttcattgtccccaccttcaaaaagcctgggtgtgctaatgtaattaattgaaattataggtttaataactgcagtgagttttttgccattcaacattgaagccaataacaatttaatttggctttacattgaagatcaacacattctttgaccattttcctaagaatagcttctttgggctatacattttggaaactaacaagtgatttttaggcctggaaattcactggtggatgagagagacacctcacagaaggtagctggagttgggatcttgatttcctttgaacggaggtggatagaagcatacaggctcagtgttctttatttaaagaaattgcttctgctggcagtgtccaatcttggcaccaattcaggtcactcttagctgggggccagttcattcctccctcagtacttcccctgttctaaaatcgtttcctcaaatgaccctgatcctcagcactcactgactctctgaagttgaggactggaagaaatgacaatcatccaaccaaagcgtctcaatgtatttctagttgagcctttaataaacatgcatgacatgccacttttctatcttaaaattctgctagggtaccctacccttgtcagaaaagtaagttcttctgaccactaacattcagaaatttttttctatctacatgtttttttttcctacctcatgtcagaaattctgatatgcatatctccctcccaaatggtatgctattattattaattgacagtcattgatttaatctaatcatccaactttacaggtaaaaagtttgtaatttccacaagattaaagaactcatgaaaggtacagagtgaaacctgagttttcttattcccaaactggaactctagaatagagccgtgttgagaattcaggcctcactgcttcctgttcagtttctccatgccattgcttcctgttcagtttctccatgttgtccttgaatattgcctccaacttttatatcctaaccaccccagaactgccatcccaccaccaagaccttacaatagtgactgcagaagccaatcaagtttctgtaatgagtttacagactaggacacagtaacagattgtgcaactcaccagtggttagatcctgtcatagtaagtatccatttactgaatacctttcatgttttaggccagtgcctggaaatatagatagaaatacaatacatagttcctggaaataaagacagatataaaagctagcagttaaaagtattatttgcaaaagatttcccaacctttgccattttttttttgtatgatgacacagaaagtaaagccattgttttcttcttctgtgttcctaatttctataacgtgggtgaaagcagcaacgtgtaataggttaaacagtaaactagttgttctagctaattctcagctttggcatgtctcctcattcataaaatgagagagttgaggcaattaatcacaaagatcctcatcaactgtaacattctatgatgttcttttatccaaattcttattgacttgatggaaatgcttgtcattttcctataatatgcccctgttaaccaatgggtcattataaaatgactcatgaaactagagatttgtttgtattgagggtcaatttataatacccacacatagtaaatttctcactataatgcaaaagacatgtagcatatgtatgaaataagtgatactagctatttctagaggtgactctaccctattctgacacttttaaagcacgtgtttccattatttagccaaagattaccagggaaatttctcatggtcaagcctattctacagataaagaaagtggtagatttctgtccaaagtcctaagagcccagctcacacatctccctgcctaataacatagcctcccattgcctccaaacaagccagctaacgatcactaaccaagatggtacatctagtgataactatggtctgtataataaaccagacttccttttcaaaataagcatttcgtctcatataaataaccttactaggattgaatgaaggcaaataaacttggcatccatttaaaatggaaaatatggtcaccaactgtgataggcaacctctatgatagccatcaatgatcccttgtacctcctagcatccatgcccatgtgtaatcccctctccttgagcgtaggctggacttctttactcacttctaatgaagggaatacagtacaagtgatgaattgtacttcagatattaggttacaaaaagaacgtggcttctgccacatcaaggcctgcgttctccctatctctgagtctctgtctctgtctctctttgtctttctgtatctctgtctctctctctctctatctgtgtgtgtgtgtgtgtgtgtgtgtgtctgtgtgtgtgtgtgtgtgtctgtgtgtatgtcagagggagggtcttggaatacctgttctgggagaagcaaactgtcattttgtgagtggcctattgagaggccagtgtgtcaaggagctgataactccagcaacagctaacaaggcctcccagcctgccaacagccatgtgagtgatcttggaagcagatcgtcccccactcgagccttccgatgactgcatccccagaaaggaccttgactgcagcatcttacagactccaagccagaggcaccctgctaagctgcacctggattcctgatcctgtgagataataaacttttttcttagctgctaatctgagggtaatttgttatgcagcaatacataactaaattccaacaaagtaattttgacaccccaagtgtactcagtcttctaatctaagggaaactcatagttcatgctctcatatttgctgtcattttttcagcaacgacagagctttatgaatggatcacagctgtcccaatgtaattctccaagaggaaaccctggcaccatctgccagcagggaatcagccagcccattgttaacgacaataacagaaattctatctaaagtattttcacttcctcacactcatgttcaagcagagcttctgaactttccttttggcaaacatgtctcctactgcatctttagtcaaacaattgcattttctagccctttgcctggggacattccttgctatgccagctgcccagtgctcttccaaagtcagtgcccactcaggggaaatgccacacgttttcatttcaggttcatgtggatacccatttgaatgcatacctgtgttttaaactttcttggcgtgaaataaatttaggcttttacatttgtcttgtaaaaggaggacggtctaagatattcgccttattcctttagtttgttcctggcttctaaagtggcatccacgtgcataaaaatgcaacttatttcatcatttgtcagcatttccaaaacagagaaataccactttccttgtaaaagttatatttaaatataataaaattatttttcaggaaggcaacaccacaaggactcaaaagagacaaatctatatgctcagagcatggtcactgaattagagctttggaagaattagaaaaaaaattgaaattttatcaggaggagaagtgtgcttttaactatctaaatagtctactagacataaaagtatatattgccgtatctaataagccattacactcaccaataagcattgatggtcatctgttcaggttgggtagacaggtaccaagtggtaaaagtgtttaagaagaagttcatgtgtgaaaatacgaacactgagggctcggactcagacaagtgggagaaacgacctacctgcactgaagatgtaaatttaatgatggagtgaaggatgactattttgcttattcatctaattttacctaacctggactgatgttaactcaatttttttttatattctgtatttcatgttatttaaataaaaatatcatgttttccattgtctgcaatctattggtctgaccaaaagtagagagcacattaaaaatatagcaggattaaactctatgagagcagaataatattattgctacttgagtggtaatctaatcataatggcagtaatggttcccaagaatccaaacaagacattacaggaaaaaatcaaggcccacctccataggcactgacttgttaatgcagctttcccagatgaggatatgtctgcatgttgtgatagagtcttaagagagaatcaggaacttatacaaataaaattgtatttgatgaacctaccatttctaaaattagaacaaatgtatttaaatcctccaatcactctccagaattatgatgatgagctataagagatcagtacatttttcttacccattttgccttctttgtcaatttgaggagtgatggtaggaaggtgtgtatggctaaagagaggcccacatggccatgccagccagggtggccttgagtgaatttagtgggaaaagaagttgtaaggtcataggtagatcataattccatttttcttattatcaatgctacgtattggatattacaaatttcttgagttaggaagattttatattcctccctcaaatacattttgattctaaataattagcttaaatcaagtcagcctgatagagagagtactgaattccgaatctggagaacagaggtttctgtctcagccctgttccttatggtaggccacactgtgtttctacacatcaacatgcaatgtgaaaggtaagaatcttaaatatttatttatgtatctcaaaaggttgatgtgaagattaatattgcaagtggaaaatcagaagctattgattatatgattatattattattacttctgctaagatatttgaaactgatcattttccataatgcaaagtaatgacacaatatcaccataaatgtttatgtgagacctaaatgagtaacaacagaactagggtgtgttgatgcctctagttcttactttttttcagagactcttaatttatttcaaattgtacaccagtctgatttatatccagacaagcccatttcagtttgggggctcaggaaggctctttgcaacaccccattctcacatgtaacttctactttttctcattgcctaataaaaatctcagtaatggctttcattccacagtgtgcactagatttaaaaaactattgccctccccacccctgccaggtaagataatgcaatgtcttcaatccactagaagttaggagtgactgattgctgctgcttggctgagagctttggtggtaggtggggaaagaacaagacaccaggagtctggagaatcacccatgtattagtctctcctcatactgctataaagaactgccagagagttggtaatttacacagaaaagatgtctaattgactcacagttccacatgtctggggaggcctcaggaaacttagaatcatggcagaagggaaagcaggcacatcttacatggtggcaggagagagaacatgtgaaggaggaactgccaaacacttataaaacaaccaggcctcatgagaaccatttgctattatgagaacagcatgggggtaatcacccccatgatccaatcacctcccaccaggtccttcccttgacatctggggattacaattcaagatgagacttgggtggggacacagagtgaaaccatatcaacccacatgtgaagagtgaggattcagtagggttaatgaaaaagttgtggttattttacccatgaatgtctcccttcagtaaaattagaatttgacagcagatcttctcttagaactgttaatatctttttattttaaggtctaagagagaaaaaaagacaaattccaaatatatcatgctatgggtttttggataaagcaagtttgattcaaaaggctaagtactaggagtccatttatgtagaattccagcaaatactgaaggaccataaaagcaaatattaacttcagagaactaaaataattagaatagtttatgtatacatatatgcacacatgtgctatattatatacatatgctacatatatacacatttgctccatatatacacagatatgctacatatatgtagcacatatgccacatgtatatgtatgtagcatatgtgtatatatacatatatacacatatgctttcaacattaatcttcatatcaaccttttgagatacatagacaattatttaagtttttttttttttttttgaaacggagtctcaatctgccgcccagtctgtagtgcagtggcgtgatctcggctcacttcaagctccgcctcccgggttcacgccattctcctgcctcagcctcccaagtagatgggactacaggtgcttgccaccatgctcggctaattttttgtatttttagtacagatggggtttcaccatgttagccaggatggtctcgatctcctgacctcgtgatacactcgcctcggcctctcaaaggacaaatatttaagatttttaccattcacattgcatgttggtgtttatatatatgtagcatatgtgtatatatgtagcatatgtatatttatacatctatatatacatatatataaatatatatttaaattggatcagcagttaagagtccagattccaggagatcagatgttcagtctgcccttgtaagcgcagtccaattggatgctagtgtgtaagataaaccatcttctttgccctgcatagggccccagaagtttattgtagtggaaaggacactggggacatgagataaatcctctcactaatagaggcaaacatttgtaagtaagattgcaactaatcttctctcgctccagccttgcatgatggaaaactttgagtgaagatatgaacaaaaacaatgggttgcgttaatccttttcaacctgggaaaaggcatccacacctgtcaatttggggtggttgcccaggagggaactgtgggaatacagccatgggagaattagagctgagttgccaggcaggccagataattccttctttaacagcttgaagcccgggagtcacatttcctacttacaaaaagctttccaggacgtaaccaaatctgcggtttcccaggaggtcttggcttgtctcaccaacagcccatgtccttggaagacacaagcttttgttgttttgggggaaatttgggttgtgagtgtgctcaacacacccctggcagagcctggatgagagaaagaggctcatctttcaagtcctctgccactccctttgaaacagggctgtttttaaagggcctcgagacttacttcctggctgcgacttcaaagcacagatgaatgcttgatttagagctccggggcctccatgtctattattattattgtaaaatacgaacaagtcagccacgtgtttataaacgtcccatgacagcaaactcactggctagaggatgcaacattaggctgtgtctgcaccagaggtagggaggctttgccaaggggggcaagcccaagtaaggttcgttaaatgccatgaaaaaaaaatgcttctggagcacaaggcgcaggagcatttcctcatttttggtgagcattgtgttcgtttattaagaaatggtcactgacagcaatactgtctgccatgttcacatattctgagaatgcagaacaaacttgtgactcagagggctgagagaaagctgtaaggagttggggaagggagctcaacattactgttataattgaactaagggctcaggcctttatcagcccaccaggctatcagacggcggggtaatgtgactgtaagtctttgcctacgaatgagttcagtgcatttcctgaaagtaagtgaaaattgaatttattggtttactttctgttttcttggcaggtgagatagaacaggtataaactcatattagtataaactaatgagcaaaaaaataaaaaagaaaagaaagaaacagcaatcaaaagcaacagaacacaaagtaaagaaaaagataaatacagaaaaaaatgaacaaaggggtgtcttggttcaggttccttagaagcagggcttaaaacaagaactcaggtgtgcatgatatattgagggaggactcgtagaagaagagaagagagaaacaggaagaggtaggggtgtagactgagatggaatctagccttagcctgatgcagtggtaagctctggagcatgacctgaacaagagttggtgttaatttgaggcaagaagactgtcctttcatacttcagtgttagttgagcttcctggatgggggttaagggagaatagccctcaggctgatggctcttgctgaaagcagttctctgaggagggagcggctgtgagccattagcagcccacttacagcagcaaggcagatgggtctgcaagccagcaaagaatatctacaagacaccaacagtatccactccaggggcctattggagtgatagccagaaatcatcctccttgccaagaaccactctgcatctctcactccttcattatctacgtgtgggatagattaatgtggcctaaagcaatgggctctgaaacattggtcccttggaaggtttggaattgcatttaaaaattcccatcccctatatcctagtaaattctacgtttaaatcgatgtcaccagagaagatcttccacatgtgaacaagaagacaggcccaaggatgcttgttgaagcattatttgcaatgatgaaataagataacattctgaaggttcaccaatggggcaacaggaaatgaattgtgatgtgtcattccctagatcactgtgtaccagataagtgaactcactgatacatatagaaaacctgaagttgaatgaaaaaagcaagatgcagtgcaatgaaaataatatggtatatgtagataacatttttaaatataggcacaaaatattgttatgctttcatctcatacacacatacataaatgtgttatatataatacatatttatttgtcaaaatattttttaaagtttaaaagaaaatatagcagactcatcaaggaggtgagaatgaaaatggaatttgggatgaggtcaaagcgttttcaactatatctataatattgcatttttctaaaaaaaaaatttttaaattttaagtaattaagcccctaagtaattaagcatgcaaggtaaggtactactaggaagtatgcatgtgaggaaccaatgggccagggtgttttagccctgaccttgtacacatccagtctggcttcatagacacatgttgcagaatggcaaggaaatagttgggatagcaaagggttcagcaagaggtcaaatgggacaagggaaataaagagcaagatgaagactctgaagaggaatcccctactttcatagatatttctagaaccattgttggccccagtgacacagtttaccaatcttcagttatagcaatgctgttccctatgcatatgtaccttaatcttacagatcatttgtttcaggcattttttacttgattagtttccaatacattgtttagatttctttagattcggagagaaggcccaaaacataaaacaatttataattagaagtctgaagctataaaagtcacctaacatttgtgcatactattttcaaagatgtggaattgtgttacatacttaaaacagcatccttctaagtgtattacaatgatctgctttactcaaagtctactgatctctcaaagactccttgatctctcaatatgttttattttatataattcaaagagaaaacaaaggaggatcccttggttacgtatcttctggaaatattgggttacagctaatcatctttctgtattgtctgacttctccaaatctttaatattccacagtgggctgtgaatgcacaagtgtgaaacatagtatgcaatatttccctaacctatttgcacagagaattatttgttattggggctttcctccccacaccagactttagaaaatacagacctagaatttaaccagtagatcaaatgaaactttagttttatgtttaaaacaaagttgaaaaacacgcttctctaatcacatgagtgtttttctctttggattgagactcctctgcccaaatttgtatatagcttagtgtgtataacaggggaggggagggatttcaactactccttggagctgtcaagtactgaatcccactgattagcaaggagtttctctcaacgtctgaacagcttcttgccctggagtaatatgtcgctgagtcatagggaaacattgcttggtaataattgatgtacagctaaatcttctaagcactttttaactatacaaatgcttcttgcccccacgaacaatgaacaagagaagaggcttccttttaactttaaattaactagcatttcaaagagttccagaacatctttcaaactcacttctctgaggacatctaaataggaccagtgactccctgaaggcaccttctaccccagagctctgtttcctttagatactgaagtacaataaagttgctttatagtcatagaggaaataaacaggctgctgttctcaaagaatgcgaagcccttacctgtgccttgaagataggaacgtttatgagtcccaggggacagggacagcccccggatgtgagtagtttccagagaaacaagttgatctgaagtttttcctggagagttggaaaatctgccacatgtcatccagcgcttatttctttggtgggttttacacttgggtgtcattcagcagttttatgagagcaagacaatggatagagaagccataaaaaaaattcttctagttctttaaggtatgagtcatctttaccattgaaacctttggtcacagcctgaatagaagaggcaacatgcactgctttttttttttttttttttttttttggtaggggtggagggagaagagttttcaaatgtgttgcttccattcaggagggaaagattatttagggatctattgatttttcatatgtggtttgattgcattttccctcacttgagtttctggatgtgctcatagattgaacctcagttatgtgggaactttcagtgtcagtttctaagagtaagaggcacggcagcattaatttgaccttctccatgataagggatccattttagaaacagtaataatagctcacacttgttgaacacttatttgttgtcaggacctgatataaatgtttcatatgtctttacttatttaatgtgcatagcagctacaatgcagtagttgtggtagattgtgcaaaagtggctgcaattctccaaccttccctgtatctgcatccctttgcaatgtaactgcaactccttgcatc

SEQ ID NO: 531 - DNA, 103947 bp, Homo sapiens
tgcaaagataaacaaaaatacaaacctttaacaagattaactaagaaaaaagagagaatatccaaataaataaaatcagagatgaaaaaggagacattacaactgataccaaagaaattcaaagtattattagacagtactatgagcaactatatgcaattaattggaaaaactctaagaaatggataaatttctagacacatacaggattgaacaataaagagatccaaaggctgaacagtccaagaataaataatgagatcaaagctaaaataaaaattctcccagtaaagaaaagctcagacatgatgacttcattgctgaattctaccaaacatttaaagaagaattaataccagttctactcaagctatatcaagacatagaggaagagaaaatacttacaaattcattctatgaggtcagtattatcctgataccaaaaccagacaaagatgtatcaaaaaagaaacctataggccaatatccttgatgaatattgatgcaaaaattccttaaaaaaatactagcaaactgaagtcaacaacacattaaaaaaaacattcatcatgaccaatttggatttatcctagagatgcaaggatggttcaacatatgcaaatcaatcagtgtgatacatcatatcaacagtgaaggacaatgatcatttaaattgatgctctataagcatttgattttcaacaacccttcatgattttaaaaaactaaaaacacttggtatagaagggacatatcttaacacaataaaagctatgtatgacagacccacagttagtatcgtagtgaactggaaaaaattgaaagcctttcctctagatataaaacaaaacaaggatgcccactttcaccactgttattcaaaatagtgctggaggtcctagttaaagcaatcagacaagagaaagaaataaagggtgtccaaattagaaaggaagaagtcaaatttcccttgtttggagataatataatcttatatttggaaagacctaaagactccactaaaaaaaccattagaactgataaacaaattcagtaaagttacaggatatgaagtctgtaaaaatcagtagcatttctatatgccaactgtgaacaatctaaaaagaaatcaagacagtaatcacaattacaatagctaccaatacaataaaatatctagtaataaacttaatcaaagaaatgaaatatctctacaataaaaagtataaaacattgatgcaagtaattgaagaggacacaaaaaaatgaagctagctcatgttcatgaattggaagaatcaatattgttatccaaagtaatttacagattcagtgcaatccctatcaaaatatcaatgacatgctttacagaaattgaaataataatcctaaaatctatatggaaccacaaaagatccagaacagccaaagacatcctgagcaaaaataacaaaactggaaaaattacaatacctggcttcaaattatactaaagacctatagtaactaagcagcatggtactggaataaaaacagacacatagaccagtggaaaaaatagagaatccataaagaagtccacacactaacagtgaactcattttcaacaaaggtgtcaagaacatacactgtggaaaaacagtctctttaataaatggtgctgggaaaactggatatccatatgcagaagaataaaactagacccctatatcttgccatgtacaaaaatcaaattaaaataaattaaaaactgaaatctaagagctcaaactatgaaattactaaaacaaagcatttggggaaactctccagcacattggcctgggaaaataatttttaagaaataccctaaaagcataggcaatgaaaacaaaaatgtacaaattggattactttattaaaaagcttctgcacaacagaagaaatcatgaacaaatttaaaaaacaacccacagaatgggagaaaatatttgcaaactatccatctgacaagagaccaataaccagaatatataaggtggtcaaacaactcaataggaaaaaatcttataatctaatttaaaaatgagtaaaagaaatgaatagaaatttctcaaaagaagacatacaaatggcaaataggcatatgaaatggtgctcaccatcactgatcatcagagaaatgcaaatcaaaactacagtgagatatcctgtcattccagttaaaatggcttttatccaaacagctaacaacaaatgttggcaactatgtggagaaaaggaatcctcataaactggtgggaatttaagctagcacaaccactatggagaaaagtatgtcagttctatggagaaaagtaggtcagttcctcaaaaaaactaaaaatgaattactatatgatccagcaaccccctgctgggtatgtacccaaaataaaggaaaccagtatattgaaaagatatctgtattctcatgtttgttgtagcactattcaaaatagccaagatttggaagcaacctaagtgtccatcaacagatgaatgggtaaagaaaatgtggtatatatacacagtggagtaatattcagccataaaaaaaatgagatcctgtcatttgcaacaacatgaatggagctgacggatactttggtaagtgaaataagccaggcacagaaagacaagcttcacatgttctcattcatttctgggagctaaaaattaaaacaattgaactcagagatagaatgatggttaccagatgccgggcaggatggaggagaaggggaaatagttagcatgtacaaaaatttgttagatagaatgtataaaatatagtatttctttttgttgttttatttgtttgtttgtttgtttgtttttgacatgtggtcttattccaatgcccaggctggagtgcagtggtgtgatcatggctcactgcaacctcgacctcctgggttctaacaattcttcaacctcagcttcccaaagtgttgggattatagacatgagccagcatgccaggccagatctattatttgatagcacagcagggtaattacaatcaacaaaaatttgttgtaaattttaaaatgactaaaactgtataattggaatgtttgtaaaacaaataaatgataaatgctcaaggtgattgatgccccacttacctgatgtgaatattatgcactgtatgcctgtatcaaaatatctcttatacctcataaatatgtacaactactatgtacccattaaaattagaaaaaaattataaaaagaattactggaatatgaagtgtaggtggtcagagaaggacttttggaggaagtccagatctgaaaggtaagatggagccaggaatggtctgaaggcagggaggtcccatgcagcaaataaacaaacacgaagtatctgaatcagaaatacagttggaaattttgaggaataaaattgtcagtgtgtattgagcatagaaaacaaaggtagagaagtatcagatgagctcagagttagacaggtaccacgttatctaagatgttataggctggagtaagaaattggaattttattataatgtcaaagggtagcattggcaggtttcaagcagggaagtgacattacctcatttgcatgttttatataagatcactttagcagctgcatagaaaatgggttatgaggatgtgatatgtagaagtaaggagaacaaatatgaaactattgcaggtgtctagggacagacggtggcaggtgagatgagattagtagtaggaactatggtatgaagtagtcatatcaaaattttggagggatagccaacaggacgtttgtagactgaaaacagatggataagtaaaaagtggaatgttagaggaatcacagagtttacggcctgggacatgtgtaaatcatgattttgtaactgatgagatagaggcaggacagtggagacagttctgtgggaaaatcagtttgtcttttgtgtatgtgttatttttgaaatgccaatttgatatccaaaactcaactgtgacaattatagggaaacttggattcaggagtttaatgtgggaaaacaagttatttgcattttcagtgctaagagcttttctcagaaatataattacaattttagtcattctcttttaaattctattagattaattatttgccacaatcaacatattcatttaataagactctaaaaagcatgtcatgcatccagtcacaacacgtaacatgaccataggttatttttaatacaggccctactaactttgtcctaaactacacgctttggtgactgaaaaatgtttgtcccatgaagtgatctcatgagtaaatgatgaagtagagatggagaaatagtagtgaaggcctctggtccctaatgccctagccatctcgcccactgtcatccccgctaaacacacagcacagattttgaactcaagacttcttcctgtgactttatttaaatataaggtcatataactttttaaaaatttgtattccttacccctaaagtcttgcctttgtctggaatgctttattctactgcaatacttagccttgagtaaatttatttatgccttttatttcatatctttagttctgtcttgaggtaagatgactttagagattatgaggaatgaaacagccctaggttcagaggcctcagaccggcctgcagctgaaggagagttaataaagaaaacctgttattaaatggaagtgcggtggcaagcatatctgtcacttttcccaatcaatacagaagccgtgagaatgagctcccatttcatacatgttatgttatagggctgaagatctctctagcattcgtaaaatgacaacgggataagagcatgcagtggcaaaaaaagaactatttatctgcagaagcgctataagccctgagcagtatttccagaagcatgtccttaaacgttctattaatttataaatattttgaagtgaccctggatttcatgtgtgtgtacattatattgagccagagttttgattactttccaaggaaaccagtaagtgtaataatttttatgtagcaaaactgctagtcatttctgctacacaaaaatcccctggtcactttttgttatttgtgtgaccagggaatttttatgtagcagaaatagctagtatcacaaaaaaaaaaaaaaaaaaaaaaaatcatactattgtttccttaacattaggaaagtggccagtaggaagtggctacatggttagccagaacccccttgcagttaggtaggggcatgtgacaatgttctgctcaatgaaatattatacagcagaagtgatgggcactcttacaaaactgacccataaacaaatcatacgtatacttctccatgatctttcccccttctgactgaaatgggaatatttcacagaaaaatcttggaagccatgtgttgaagatgccagggcctcggttagcctagctctttgaattcccacaggagaagagttgaagatgcagaccacctctaacatctccaaaattaaactaaacagtttttacttactgtttttttttccttacagcttttaatggcatcatattttttaggatatagggaatctaaaaaatactctatgcaggaatatggctgatcctcacaagattggatgagctctgctgttaccaagcccttggcaatttccagaactatcaggctattgggagatgacatctgtttttgtggcctgctcagcatccttaacctcttatttgataataacatcttggattgcctctgaggaactacagatctcccactgcatacattcttagcaaagtaccaatcatggtactccactactccattctttcttggtcaagggttgagcaaaaaacaaatctaagtaaatcagaccctctgtacctgaaatctctaggggtgtgtcaggcagaatgtaagaggaactgaaaatggttgtcacaaattcattttgacagctgcactctgaaaatcattatgtcctacatcctagatcctcagatttatccttagaacctgaggtgtttgtttgtttgtttgtttgtttggtatctccttcaattctctgaactttcacatttcctttcgataaatccctttgtatttatattgctttatgttagtgtcatatatttgttagctatttctgaaaaacacattaccctaaaacttagtcacttaaaaacaacagtaaatgtttatttctcatgttctgtggttaagagcttgggagtgtctttagctgggtgattctggctcagggtctctcatgggactacagtcagatgtcagctaaacccgtaatcatatggtggtttgatcaggaatggagagtccccttccaaagtggctcactcaaatgtttgacaagttggtgctggctattggcaggaggccttagatttgttcttcatgggctttcttcttcttttttttaatttccaatttcttttatgttaggttcaagaggtgcatgtgcaggtttgttacacagataaattccatgttgtagggttttggtgtactgataatttggttacccaggtaatcaccataataactcataggtcttttttcaatccttactctccttccaccctctaccctcaaataggccccagtgtcttttgttcctttctattgtccatgtgttctcatcatttaactcccacttgtaagtgagaacatgcagtatttggttttctgttcctgcattaattcacttaggatagtggcctccagcttcatccatgttgctgcgaaggccatgttgtcattttttaatagctccattctttcttggtcaagggttgagcaaaaaacaagtctaaatcatggtgtatatatggtgtttatatatcacattttctttatccagtgcaccattgatgtgcgtcctggttgactccatgtctttgctattataaatggtgatgccatgaacatatgtgtgcatgtatctttatggtagaaggataattattcctttggatatataaacagtactgaaattgagggatcaaatggtagttctattttaagttatttgggaaatcttaggactgctttccacagtggctgaactaatttacattctctcatgggctttcttgggaatcctcatggcataatggcaggagaccccagagcaagtatctaggagactgaagtggatgatttttatggcttagcctcagaagttatagataaaggaaacagagatatgaggaggctattttaaattttctaattaaaaatggaagaaaaaaactgtaatgagatattttcatttatatgtcatttatgtcacattctattggtcagccagtgtgagtcttgattcaatgagggagggtctatacaagggtgtgattactaggacacaaagattattggaggtcatcttggagcctgatgaccacatagggttaatttctgtttcttgcaaccacagaaacctagctggtgcatcagattaagttgaaaaagtgcgggctgctttcacatattcttaataattttaagaggtcctctagaaaaattcaacttctgagagaaaagattccaataatttggcagtattcctcagaaaatatgtatttctattagttatgtgttcctggcactggattttgattatgatgattataaaattttcagttgtaaatgtgtctccaaaccatgggaacttttaaataacaatactgtacaaatcttgatgatggtgagactaggcccaagaccactttcttaaccatggcatgtgtccatagtaactaatctctcacatttccaaaagattaaccatttatctgagcatttgcagtaatacttagagacatcaatgcagatggtccctgacttacaataactcagcttatgattttttatctttcccatggtgtgaaagccacatgcacgtagtacttaaagtacccatacaaccattctgcttttcattttcagtacagtgttcagtaaattacatgagatatggaacactatattataagtaggctttgtgttagatgatttccccaattgtaggcaaatgtaagtgttctgagcacgatgaaggcaggctaggctaagctatgatgttccacaggttagaggtattcaaaacatttccaatttatgatgggtttattagaatgtaacccatcaatacagaggagcatctgtataccaatacaagtactttttttttccctgtgagtcatagtataagattaaagtaacttcctttagtaaattagaaccaaaaagagttggccctgtaatgcaactttcttgttttagaattgaagaaactgaagcccatagaaattatgcaatgttcccatagccacccagttgattggaaagccagaacttgaaccaaggtatcccaaattccatagcagtattttttttttctattacataagtctaaactgtgctatttgactagaagcttacaaatcagtccagttgttccatttggtatttgattgacaagagcatttcatacttccttctggattttatcaaaagtaatagtacagtaagtatatgaagaaattgtaccatatgactacttaatccctctttaagcaggatttggagatctgagcaggcaattctttaagtttccaattaaaactgaagagaaaaagcataatgagatgtttaaaagacaatttatagggtgtacagacttgttgtacagttccttaagtgaattacaaaagcacttaacttatacttgggatgtgatcttcaactcacaggcagtgcccagtggttttctgattttacaaccgatatacttgaagaatacttgggaggctgtcatttggagtgggggaagattcttaagaggcaaaaagccaagagagtgagacagaaaaataggttttggttcttaactggtgagttcagcaaatggtcttaaagattgcattttctctagagttcttggataagctaagttatttgtaactgctttccctggaactcttagattggtagtaatatttgggagcataaagattctttgccatataccctcacctaaaattctagatctgaggatttcaagtctagctccagttgaaggaaaactaaagtaggctttctcaattcagcatattgacatttgagtcatataattttttgttgtgggtgttgtcctgtgcattgtaagatgttcagcaacatccctggctttcaccctcaagataccagtagcagccctcccctaattgtaacaaaaatatcttcagacattatcaaatgtcccctgggggacaaaatctaccaaagttggaaatcactatcctaagggaagattctgaatcattcactgagacctgagacagtctggacaagtattttaaatagcaatactgtacaaatcttgatgatggtgagactaggcccaagaccactttcttaaccatggcatgtgtccatactaactaatctctcacatttccaaaagattaaccatttatctgagcatttaataaagcacagatttattttcttggacacataacactcttcaggatcactgaagtcactttcatcaaatgattattttgtacctgttatgccccaggcattgtgttagccacaatgcccaatctatacagttcatgtccctgaggagactccaactacttaatggtcttactgtcactcaggctacagtcagacttatttacttctagaatttttcagtaatgtttttgtcaaacttacaatcctccaagtttggagccaagtccataaaacagaagtatgtcaagacaatgtcaatcaattcactggttcagtgacaagactaccagatgatgtttttggctaaaaattagcactcaaactcataaacaaatggaaacagtctacactctaaaattagttctgattttctcctagatttcttgagagttttgtgaagagagacttttctaaaactggaatatgatttttgctcagataaattatgttgttcactttgccagcctgagtagctttaagggtagaagtggtaacacatgaagctccctcaaaattgctttcagggagatgagagagatactaaaaacagggatggaactgttcaatttttggatctgttgagctggaatcacgaatctgctaacaagtgaaacgaagccatttgtaaaaggttcatcttccagggagtcccatggcaattttaaggcagatttcccatcgagaccgtaggatgtcaatttatgaaaattgaactggattcctgaatcgctctataaattttaactaaaacaatactcccatttcaagtatttatggcctctgcctctcttggcttcagatcgtcagaagtacatatttggaggcattcagaaacttacaaaaacaaaagcatgcacttaaaacttcttttttaaatcaccgactcaccctctagctagagaagaaaatcccaacaaatcaactggagacttagcaagaaaagaagtactggaggaggttttaaaagggagcaggaaaacagaggtgaaaatagcttctaagtcatcagaatagatctttctgcatgcagtgaaagaatttaggtgcaacatatatcctcaaaaccttgaaaaaaatgtattaatgggaaaaggggtttagttcaaagaatgtggattttgaaaacacagtaatgttcacgtttcaacttggccatttattagctatgtaactttgggcaaattactcaatcctttaagtgctggttctcccaatcgtaaagtgaagttttaatccactacttaagggtgttttaaggactaaatgtgataatatatttaaaatgtgttttgcatgacctatgcctcttacactgtagccacaaatttaattattggtttgcttgtttgtttgtttgtttccatctggactaagtatgaggataaattgtggtagacaagagtaaaactgaaatgtagagaggaatgaaacttcaaaataaatattggatatatatacataataaatatatatatatcgtatgtacacacatatacatgtatatacatatattatatatacaatatacatacattatatatacatatatacatatattatatatactatatacatacattatatatacatatatacatacacacttatgtgtatgtatgtatatttgatgctatgaatacacatatgtaaagcaacaatgctgtgtaatcacaggaatatgagcaccagaattagatcatttctatttgagctttgaatctaccactaactgtgttatcttggttaggttatatcacatctccatgtctcagtttcttcaaccttaaactagggaaattatatttgctactacaaaaaattgtgatgggggctctcaaaggtaatgaaagtcaagtagttagcacctaaaaagctctcagtaaacaatattattattttagagacaacgatgtccacagctcatgatggcagtacacgtataacatttcgtttctgtgtatacatctgtacatcatgtttttgggtatcatcctaataaatttaaaagtctctgtttatcaaattataataaaatttgatatgataatttcttctgtctgttatcaaagtcaaaatttgtctttatgctgtattgttcagactctagctttaagaaaagctaagaaattgagcccaaagggattcctctccagcattagcccttaaatgtatgatttctgtagctggctgctgttttgttgtttcttgctgtacattatctagcctaatgacaaagcttaattaacacattttattctattaaagtgctttgttttgcaaatacatttggagggatttttgtcttttacataaagaactcacatttattgtgtattcttccccctacaatacacaccctaaaatttgaataagaaacaagaaaaacaaggagaaaggcaactgccacagacattttatgcaagcagaactggttttgtatctgatatgttgagtaaagcaaagcaagtaaaagtgggggacagtgtcattggagatatgtttatagctttggggatggggtggagaaaggtcaagggggtttatataatccaggacaggaagaaaggaatatactattacatgagcaaaaaaatgaggagcactatttatcagaccagatcttgaattttatatgctttatttcatttaatcccaaatcaattttgtaaggtaggaattattattatgaccaatttatagctcaggaaactagatcgtgaaaagatgaaatacttggccaaggtcacagaactgattcaatgcagaattaggactaaaaacatcgtctgctgaggttagactcagctcctcttcttaatttttttttttttttgacaatggcacttcaaagttaatggcattttgtccattttcctgagaagaaaacaaggtttagatagcataagtgactttccccttactgacaactgggaaaagccaaagttttgatccaactatgtatctgggttcatactgagtcatagaaaactacttgctatttttctagctatggagtatcaatatggtgtgttggatttcccttcaagggagtacactcaatgaactgcattcaacttggggaaaaaagaaaagactaatagccagaactgagtgcaaaaaagtgacatgaggaagtttgtgataagactacttttctcataggtgcatgccttcccttcagttgactggtctccatgtgtctatatcagttagcgactgccaggtaacaaaataccataaaattcagtgggcttaagttgataaccctttagtgttgctcaagagttaaggagtcatctggccacgtcttctggtcttgattgagctggcttacacatctgtggtcagctgtgggtcaggcacagctgtgctggtgcacactgtgcattctctgtgcttaggaaagtcagctgttggctaggatactttgttgcacctccaactggcctctatctaccagctagcctcaacttgtacataatgatggcagagttctaagaacgcaagcagataccacaaaaactcttgaggcctacatgcggagctaacacactatgccttatctgtatttcattgactaaagcaagttgtgaggacatcccagattcaaaatgatgacaaaggggatccactgctgcatatgaggagctgtaatgtcacattgcaaaggagtagaaaatttttccttcttcgaagttaacctaccacactgctctcataaaaatgatcagccaaatgtgttctcactaagatataaatggattatggcacttgttgcatgaccgccttgtgaatgtttgcatttttgatgtaaaagtattatagaaagacttctaccattatttgatcacttctagcagccccaaaagacatttttgagattaacaaataactctttttaaaaatatatgcctaacaaatatctatagataaatctcaaaatctgagaatgaggcataatttcttctctctcaaggcctacaattaaatgggaaaaacacaacatttataaaagggttaaataagctggtaggtttttctacaaataaggtaaatacatgtttaccctttctatccttttgattataccaccttactgagaacagaacagaataaccaactctgggaaatcctaaaataacacttgaaaaggaggcaacagagatgaaaaatggccacctaatttcttgtttatgtcttaaggaataaaaaccatgtgaaggactggtctgcttattgaaaggaagcatcttgtggtgtcaggaaaaaaagcccaactggtaggagagggctgtgttgattagggctacctcagaacacatgttagactgataaggtctagaaagagctgggagtttgtgctaagagttcccacttccctttcccttaagaaaaaaaaaaagctagcatatatatatgcatatatatagctagttttatatatcaaaagctatatatcactttttaaaatataaaaagtatatctatgtagatgtagatatctttttattcaaaggataaccatgttacaaggaaaaagactgataataccaaaacttagaggatatatggagccattgcaagtcatacactactaatggaagaataaattggtaaaaccactttggaaaactgcttaatagtatctactaaaattgagcatatgccttcctcttgacaccaaaacttctcttctgaaaatatgcctaatagaaatgtgcacatatgttcactagtagacatgtactagcatgcatatagcagcactatttgtaatagccctaagtaggaaccaaaccacacctgtgcaggtagaaatcaggataatggttacctttggtgaggaatgtctgggagggagcctctgggggcttctgagtgttgacaatactctatttcttgattttggagaaggtgtgttcattttatggcaatacatccagctgttcaattatgatatgtgtgcttttctgtatgtatattatattgcattttttaaaaatagccatattgtaaagaagttaaaagtctaattgaataaaagtaaaatgaaaacccacagtgctaaacaaagcagaggctagcacattgccagccttcaatatcagaagccagcagaggcatccaagagttgaatttctgtgggtcaactgggaccaaatgccctgcataagtagcagagtaccacaggctcaccaactgaacttcataaaactggagcgagctgggtgggatttcactgttcatgaggggagactgaagaaggctgaaattcttgcctgaaatggtgactgcagatagttgactggttgacagagtgacatatagcagccatgcacagaacttgtggaagcctaagactggctcactgatggaatcactactcccctaatagctatggagcagaagttatgagacccaatataagttctggttctggactgagaatccatggggactcaggtgggggcaactgcaaaacaaccagggagaaatgagcaagagaaagacagagggaaattttaaaagatctttaagataaatatacaaaataaaatttcaaaacaaaggacaaaaattaacaaaagaaagtgaataacagcaaacaagtaagagatgaaatgactcttgagagaatgaaatggtagcctactcaacataatttttaaaaggacctttatgtctctgagagatagaataagaaacaacatctgtaaaatatattaaaagttttaaaacaaatatattaagagtgaatatgaaggaagataagattgagaacagatgaatataaaacatggcaaaggactagctgataaaaatgtataaaatacatgcaacactttataatatcccaaactggaaaaataatctaagtatttatcaatcaactgatggatatgttgcttatccatcaaatggaatttgagcaataaaagtgaacacattactgttatgtaaaggtaattactacaacatgaatagcccttaaagctattatgctaagtgaaaggagcaagacatgaaagcctacctatcatacgattctatttgctatggtttgactgttgcactccctgaaaattcatgtattgaaacctagtcaaaaatctgatgctaagaggtggtggctttgggaggtgattaaataataaggacagagccctcatgactggaattgttacctgtgtgaaagaggcccaagagaaacctctcaccacttccataatgggaggactcagtgagaaggtgccatctatgaaccaggaaacaggccctcaccagatactgcatctgacagtaccttaatcttggaggtactgtcctggcttccagaactacgagaaataaatttctgtcgtttatatgctacccagtttatgatattttgttatagtttttatatatatgttttatatgtgttatagtttttatatatatatagtgtgtatatatatataaatatatatatggttttatataaatggtgtctaagtctgtttatatatatactgtttttctatatatactctttatgcatatatgtacatactgttcatatatgtgtatatatatatactcagtatatatagagtatatatatacacatatatatactgtgtatctatgcatatacatactgtatatatgtataaatactgtatatatgtgtgtatatatataccatatatgtgtgtgcatatactgtatatatatgtgtgtgtgtatatatatataaatatatatatggacttagacaccattcatgtacaacatccagataaaagcaaatttatagagagacaaactctttcaccaggatttctgattctcttattatctctttgcaagtactttcgaaagtcttctaaaagtcttcttagaacattttgatatataaataagcaagaacaaaaattggtgtgtatgtatgatttgtgagtgatagaaagacagagacaaatagagggtgagagacagagggaggaaggaagggagatatttgttatcatttatctgataatattcaataggaactctgttgttcaaaattcctcccatttagatacatgggagaaaatgtggtttagcctattaagacccacatgaacaggcttactgccttcactaatgccaatagtttattggaaaagaggaggttttatctgaaagaggccaatagtttgcctgcctgcattttttctttatctgtttttgtatagacaacatcttaaaatgttagatttgctccacttggaatagtttcatctggagcaaatatatagtcccttggctttaaagaatgggacattcagagctgatcacacccttggattcaataatcaaaatagccaaatttaatctgaatatgactagagacattgtgtgtctgcatcccatgtaagtctattaaggactgagcttaaggcatacaacctagaggtttcttccagtgattttcagtcttagagtttaggagttgaaccaaatagatttctatgcaatgtcaatagatggagagttcactttctgtccaagtccaagtaagtccactatgttgatatctgggactaggaccagaaccttgcatgcacttaatagttgaaaacagaacttcctatttttaaaaaaaaatgagaccaaggaaaaggtttttctttgaagttttctataaaacctcatggggtggttataaggatttgtgaaacattaaatatctttgagtttggagaattggcattgtagcagtacaaaattgtgttcctttttttctccttttcttaataaccccattacatgaccttctaaagtgtttgttcccttaggaaacataagatgatttgcaatattctgtaataaaacttggaaaagatagtcatagcgctacttcaataattatgaacattgcttttagctgcaattttccaacaaaccgttcatacagtaattgtgaatcctggaataatgctttggcctagagtacaaatgtcccctcatgttgtttgtggtatgggctcagcattcctgctccttgggtatcctgaagctttgtcacttggcacatgaatgatcttaatctctaaactggatcatgaaaacaaacaagcattatggccttattcctggaagtacagatctcttcctggctagggcttctccttcaactccaagaatcatcccaccctctcccaaccggcacaggatcagcttgtttgctcactgaagactcatgcttcagtgaatactgtgattgaagttcccagttggtgcagtcaacattccagtgttctgtgatgattgtgagccagcatctgtctgctgatggcaatctctccgtggctttctcacagctccaccttcccctccactcacatacattcccccaacaccagggctccaagagatgtgtttctccagagtgacccatgcacctacctgtcatagagacagattgttttcttgttaagagatggtcaccaggttacgtcctcagatttctggaaggaagaatatttctcctcctttttgctcagccaaaggacttctaattaagattttttttttcttcttttgagttttcattgtcctcttggcaatcagacagaacatagcctgaccacttaggtaactttacagagaataaatgaaagctggacagtttatgaaaaactaagaaaagctgagctgcttgacggatttctaaagaagaactgctttcatgaagcaggaaagaaagtacagatatttgtaatgaaaccaggaacttcagggccattcagccagaggctacagacccccacaacggtactcattttggagacagcacaattaatttcaattctacaaatactgcatagagaaacaaagagtgaaaagagcaagaaaaagagagcaagagagagaaagaaagaagggagagacgggggaggaaaaaataataagagtaagaaaagaggggtaaaggaagatgaggatttcttttccccaatttgcttatagcaggtgttaaaaacagtccagggaatctaaagaggttcaacaaaattgtattcaggatgctgagatgggaggatcatttgagcctgggaggtcgaagctgcagtgagcaatgatagtgccgctgaactccagcctaggaaacagagggagaccctgtctcaaagggaaaaaaagaaaaaagaaaacacctcaaaaacttactaagatgagatttggtgcacacttggtgcatggagtgttcctgtttgttaatctatgctcagggacttgcaaatttcaaggacagcatctataaactcatgagggtttgcaccctaggcaaatagctctcatgtcaccctagtattctgccactttttagccaggctgatgactgaaatgtcattttacttggtcttagtcctcatctgggtgaaagccacaaggaccctctttctgatgatgtcagcacaatttccaaatattttcccagcttaactctggcatttttgtctatctttttgatgggctttatgagtcaagaaaatgaagaagcttttaatgattatgttctccttggattggactgggttgccattgtgattcctccacacttggtggcagcgctgatgaacaaaaacaatgggctttttttctaggcttctttcagaacgccttaataggaaacacattctgcattccccatgtgcatgttttcagtgaaaatctttatttaattttagtagagaattcagtccaagggttcttccatgtaacaaagggtagtactgatgggaacacatccctggaggaaattttagatgtagattcctcagggggcatctaggaaagcaacaatgcttaggtccccaaatcatgttggtatttctgaaaagtgttctgctccccttgggtatggatttttttttttctaaccaaaacagataaagaagaaagcaaagaaagaagacaggaaggaagaaaagaggggaaaaaggaaggaagaaagagagggaggaaaagagagaggaagggagggtggaagggagggagggatgagaaagggatggagggagggaggaagagaatgaaattctttaaactaatcgttaatctttaggaattcattttcattcttaccttcactttccaaacaagaagttccaatctgttccaattgataatttaaagggaagactctgccagctgagcaaaaacaaagggtagggggtgttgagaaaaacttcttaaatgttttgttgcagccagcactggtgccttctggatactagggataccagggtcattcagggatatctaactttctgttcatttctgagaaacaaacttcccctggattccttctttctctttggcttcacctaattctcctcacctgttttcagcagtgaggaagctctttattttacccagagtcactgtttcccccagccctctttgtactagagaatctggatacctccacctgcagcctgccaccctgcatactctgatactatgtgtcttggaagctttgccctgaggaaccatccagagaaagttcagccatcctttttgtgggtttatgccccgttaaaactgggattggaagcatgtttccatgtttccatctgttaattaccaatacacagcttgacatgcctgtgggaagccaggagccacttggaaaggtgtgggcagaggattcatctcatccaagcagccccctaacacatgactgctgctacgtgtcattgtatatagttagattgacatgggcataaaggagcaaaggagaagcccaatccctactgtctaaggaaagcaccggtgctattaagctatttgaactttccctatcacagcctaaaaagcactcagacatttttatcagcattccaaggcaaagattcattggatagagtattttttccccaacgtaatccagatctccctttagaagacgctgggaatttacacgagaaatggggcaggccatgagcaaaacaaaaaaatgactgatatccttcttcggctttcatgaatttttcttttagctttggcccccacctctactactgatcaaaattccagggcttataaagtgctggtgctcagctaggattacgttaggataacagaaagttgagtcactacaggaagacactgaagttggcttaaaggcttaattatctccacccagacctacatttatgcataaaaagctaccaagctaggtaaatctttaacagtagcatggcaggctgtgccacacaaagaatcttaagtcatgtaaatcaaattataaagaagatttctgccttgatatttccagaagaccagtcttgatcaaaatctcaggtgtccagttttggagcttcccatgtggtgaaatatttgacaaccagctttgagggctcgttgcttccctttgaaaacaccacagacctgtgggatttgaagagctattatctgagtcttagagatgggggtgacatccttttcccactattagcccaatctctaataattggctccatatagactgaataatttcttaaccatacttctttttcaggttcctgtctcatttcatcttgaaatcagagtattagaaaaatccaaagttattcagtgtttcctgactaaggaaacctcacaatttctaaaagtcaaaaaagttcaaatattccccctatcaacaagcacacttgccagtggtatttcaaaattaaaatgaaaaacagtaatgatagaagtgctgcagcctcactcctggcatgaacaaaatgctaacaaaatctcttctttctgcttatcttcagatgcagggtatatgctaatatgtatttcagggcaaactaatgtcaagggagggaaggcagttcctgtctttttgctattttttaagcaatcctctccaatagggctgcttctgaaaataagtttctaattaaacttcccatactatattgcagttaaatagggtaaaatttgctgtttgatgtattgagaaagcatgcaaacattagaaggcaatgtgaaggttgctagaagcaatgtgaaaccacaatttcctaggcattacgagtaattattagcaggcaagttgttgagttcaaccagaaaatgctttagttgtatcttgttgtatatcaggaacagcctaggtttgcattccatgtaaaaggagaagagaccactgttccagttggttttccaaatagaagtgaagaaaccatgaagatgtccctatatccagtcccttagccaggaccagttcagttggagcatggacagtcaaggaggctggagttctcccagtaaaggatagtgtaaggtttggacagtgtgcctttttactaattttggcaagaacatcttccagtaacagaaaagatattatacatatggtaagtagatggttaaaatccagtcctgactctgccttgtccttttttgaatgggtcaatgtgtcaattattcccttctaatgccttctgggtttgggaagtgttcaaactatctttccttcctgctgcaattagatttttataatgaacacatgtaaaggcctgcctgatgattcaaagatattctattttctcttggccttgcctgacttacatgtcctaatgatacccctgccccggtatcctttagccttgattccccatgtgtttccttttctggagatggcagaaaggctcctcattctgcttccaaaccttgagcctggaagaagttctcccaggtcaaatctctgaggaagaactaccctaccactctaaagaacagagtcacttttcttccagctcttcctagcgtttcctttaaaaaaaaatcctctatatctatggctgtcaggcaaaggacttaaataaatgaaatgtatatactaacactgttgctcctttagcccaacataaccatgccttttggccttaaaaggattaaaaggtaatactctgttccttgactctgggatacagatctattttaataatgacatgtgtcttcttatcccttgttccagcctttttgttttccttatatattattgttattaaacatactattaattccacttgtttattttgtttctgtctccccccactaagttgtaaactctgtgaaggtaaggatttttatctgttttattcacagttgtatatttagtacttagaacacgggtgtggcatatagtatgccctgaatacatgtttgttgaataagtgaattccataatgttaagtattagatgtgatatcaagtaaccagcaatcatccactgtatttacaccaccaggtcgagtgctcaaatacatcaaaggaatgtgtgactgccagtgtcagcctaaggcacctactttccagagataagaatggaaccaactcttactccttgcttaaaggaagcccatcatcatttctcctagatcctagggagaaggaggatctattcccatggttgcctctcactctgaacatctgcttctcccttggtcttgggtcatcttgccatatccccattctgaaccagaaggatccagattttgcattcatctacagtcacccacagggtgttaatggaagattaaggagataattcaggacacacacgcaatcctaagttaaattttagagataactactctgaacaaattctttggcaaatttgccctattgccagacaatcttcctatttttcccgttttgctctctggtccctgatcccaattgcagcttaatgatagaactggaacaatctgaggagtcaagtaaaatgcatctcaaaaatgtccatctcaagaacagaaaatgggagcatataggcactggatcccatggctctgttggtcaagtattaccccctgggatattaaactcccttccattccaggcttgcacaggctgagcagattgccaatggccagccatgcataaagaagccacagggcagacagcaaaagaaacttatcttgtagctaaaaggaagttctgccaagttacacatgtgcaaagtatttcgccatggcagtggctaaaataaaatatggtctagggaactaagagggaaggtataagagatatcctttataaggggaaactgtaatggcacttcccacaccagaagaattaagacaataagaaaagaacaatttttttcaatcatgatatatatttatatttatatacatatacatataaatgtatatgtgtgtgtgtatatatatatgtatttttatactttttttttaaaaaaagaatgctaaactttcagttccagtaatagtagaacaggttcatataaatcccctgctgagaaccaccacaaaagctggttgaattactaaaacaaacaaaaatgtcttgaaagcatcaaagacctcaaaagataggagaaaaaaataaaataaaataaaaacctgtgcaatttttggagaagacaatacccagagatgtaagcacagttaatcaaagttcctttggccttgagcacaattttctaatcccaagaaagaagtcataaacctaagctgaacttttcatagcttcacagggatagggcagaaatcaaagtccagacccttccaaggctgggaaacctgaaaaatcacccctccttgagcaaaagtcaaaaggcttatttccttcaatgagaataacacagtaataatggccttgcctagagtacttcctttcacctggtgatttagggcacatcaggccttaagcctaaattcaggttatctggggctggtgaacctctggggcccatctatccttccttcctccctccttccttctctctcttcctccttctctccctcccttccttcctttctgctttccttccatctatggagaaattgtcattattctaggcctcaaacttttcctgtaaataataccttaaataaatgtccatcatttgaaaactaccaggaaacaacagaaatgtggctcatggagcaagcagaagtaacatacaacagaaatcaattcacagggactccagtcacagataatatcataaatagtcacagaatagtaattgatgactaatcagcaacacataaaatggtcaaaaaaattaacagtgtacttggaaacttcagtaggaaaattggaaactgtaaaaaaagattggtagattccaagcgtttaaaaatttcttatcacagaaattacttaaaagtgtgtttaaaaatgaagaaaataatacaaaagatcaatgaaaaaaaggtttttttagaagataaacaaaatggacaaacctctagccagactaatgaaaaagaaaggaagaaacccaaataaataaaatcagacatgagaaaggagatattagtgtagttgctttaaagtctgttttgtctgatataagaatagctactcctgctcagttttggtttccatttgcaagaaatatattttttcatccttttaccttgaatttatatgaatccctatgtcttagctgagtctctttaagacagcagatatttggaaaagaagttcattatgtaatgataaaaggctcaatccaagaagaagatattacaatcctaaatttataggtacctaacactggagctttcagatttataaaacaattaccactaaacctaagaaatgagatagacagcaatacaataatagtgcgggacgtcaatactccactaacagcaccagacagatcattgagatagaacgcccataaagaaacaatggactttggccgggcgcggtggctcatgcctgtaatcccagcactttgggaggcggaggcgggtggatcacaaggtcaggagatcgagaccatcctggctaacacggtgaaacctcgtctctactaaaaaaacaaaaaattagccgggcgtggtggcgggcacctgtagtcccagctacgtgggaggctgaggcaggagaatggcgtaaacctgggaggcggagcttgcggtgagccgagatcacgccactgcactccagcctgggcaacagagcgaggctccgtctcaaaaaaaaagaaaaaatggacttaaactatacactagaagaaatggacttaacttatatttacagaacattccacttaacaactgcagaatatacattcttctcatcagcgcatggaacattctccaagatagaccacgtaataggccacaaaataagtctcaataaatttaagaaaatcgaaattatatcaagtatcttctcagaccacagtggaataaaactagaaatcagctccaaaaggaggactcaaaactgtaaaaatacatggaaattaaacaatctgctctcgaatgattttgggattaacaaataaatagtagtagtgacacaagttatcaaaacctctaggatacagcaaaagtagtgctgagaggaaagtttatattgttaaatggcaacatcaaaaattctgaaagagcacaaattgacaacctaatgtcacaccttaaaaaattagagaagaaggacaaactaaacccaaagcagaagaaaaggaataacaaagaacagagcaggactaaatgaaattgaagaaaaaaatacgaaatacaaatgaaacagaaagggggttctttaaaaagataaacaaaattgatagactattagtgagattaaccaagataaggagagataagatacaaattagctcaattagaaatgaaactggggacattacaaccaataccacaggaatacaaaagatcattctacattacgatgaacatctttatgtacacaaactagaaaatctagaggaaatagataaatttctagaaacatacaaccctcctagattaaatcaggaagatatagaaactctgaagagaccaataaaaaagcaataaaattgagtcagtaatttaaaaattgccaaaagaaaaaagcaattctggaacctgacagattcacaggtgaattctaccagacattcaaagaagaattggtaccaatcctactgaactattttgaaagatagagaaagagggaatcctccctaaatcattctctaaagctgatatcaccctaataccaaaaccaagaaaggacataatgacaaaaaagaaaactacacaccaatatccccgatgaacatagatgcaaaagtgttcaacaaaatactagttaaccaaatctaatagcacatcaaaaagatgatacatcatgatcaagtgggtttcatcccagggatgcagggatggtttaacatatgcaagtgaataaatatgatacatcacacaaacagaattaaaaacaaaaaccatatgattgtctcaatagatgcagaaaaagtatttgataaaatccggtattcctttatgataaaaaccctcaacaaaataggcatagaaggaacttacctcaaaataataaaagcgatatatgacaatcccaaagccaatattctactgaatgtggaaaagataaaagtattccccctgagaaccggaataagacaaggatacccactttcaccatttctgtttaacatagtactggaagtcctagccagagcaatcaggcaagagaaagaaataaagggcatccaaactggaaaagaggaagtcaagctatcgctgttcactggtgatatgattgttacctagaaaaccttgaaaacttatccaaaagactcctatatctgatttttaaaaattcagtaaagtctcaggttacaaaatcaatgtacacaaattagcagcactgctatacaccaacaaggaccaagctgagaataaaatcaagaactcaatttattctacaacagctgctctctctctttctctctctctctctctatacacacacacacacacacacacacacacacacacacacacatatgaatatacttaaccaagaaggtaaaagatctctacaaggaaaactaaaaaacactgctgaaagaaattatagatgacacaaacaaatagaaacacatcccatgctcatagataggaagaatcaatactttgaaaattactatactacccaaagaaacctacagattcaatgcaatttccatcaaaataccatcatcatttttcacagaactagaaaaaataatcctaaatttcacatggaaccaaaaaagacccctaatatccaaagcagttgctattgtttggctctgtgtccccacccaaatgtcatctagaattgtaatcaccacgtgttgggggaggggcttggtgggaagtgattggatcatgggggcagtttccccatgctgttcaagtgatagtgagtgagttctcatgagatctgatagtttaagtgtggtacttcccccctcaccttctctctctttcttgccaccatgtaagacgtgtcttgcttccccttcaccttctgccataattgtaagtttcctgaggcctccccagccatgtggaactgtgagtcaattaaacctcttttctttataaactaccgagtctcaggtggttctttacagaagtgtgaaaatggactaatacagcactactaagcaaaaagaacaaatctgaaggcatcacattactagacttcaaattatactataaggttatagttaccaaaacagcaagcagtactggtatgaaaataggtacttagaccaatggaacagaatagagaaccgagcaataaagccaaatatttacagccaactgattgtcaacaaagtatacaaaaatataaactagggaaagaaaaccataattcaataaatggtgctgggacatgtagaagaatgaaactggatccccatctctcacattatacaaaaatcaactcaagatggatcacaagacttaaatctaagatctgaaaccataacaattctcaaggataagattgacaaattcttctgaacattgacccagataaagaattcatgattaagaccccaaaagcaaatgcatcagaaacaaaaataaataaatgagactaaattaaactaagaaacttctgcacagcaaaataataataataataataataatcagcagagtaaacagacaaaccacagaatgggaggaaatatttgcaaacgatgtatctgacaaaaaactagcatccagaatctataaggaactcaaacaaatcagcaagaaaaagaaaacaataccatcaaaaagtgggcaaaggacatagacatttctcaaaagatatatacaaagaccaacaaacatatgaaaaaatgccctacatcactaatcatcagggaaatgcacattaaaaccacaatgtgataccaccttattcttgcaagaatggctataattaaaaagtcaaaaaacaatagatgttgctgtggacatggtgaataggaaacacattcacactgctggtgggaatgtaaattagtaaaacctctatggaaaatagtatagagactccttaaagaacaaatataaatctactatttgatccagcaattccactacagggtatctacccaaaggaaaagaagtcattatatgaaaaagacacatacatatgcatatttatagtagtacaattcacaattgcaaatatatggaacaaacctaagtgtccattgaccagtaagtgcatgaagaaaatgttatatatatatatatatatatatatatatatatatatatacacacacacacacacacacacacacacacactcaccatggaatactactcagccataaaaaggaacaaaataatgtcatttgcaggagcttgaatggagctagaggccattattctaggcgaagtaactcaagaatgaaaaaccaaataccgttggttctcagttataatagtgggaactaagctgtgaggatgcaaagacttacagagtgatataatagacttaggggactcagggagaggagaatgggaaagcagtgaatgataaaagactacgtattgagtacagtgcacagtgttcgaatgacaggtgcactaaaatcccagagttcactactatagaattcatccatataaccaaaaaccacttgtaccccaaaagctatataactttcttaaaaagcaaaaaaggagacatcacaactgatatagaaattcaaaggatcattaattgctactttgagcaactgtataccaagaagtttgaaaatatagaggaagtggataaattcctagagacagacaacctaccaagattgaaccatgaagaaataaaaaacctgaacagatcaataacaaataatgagatcaaagctgtaatagtaagtctcccagtaaagaaaagcctgggacctgatgacttcactgctgaattctacgctacatttgaagaactaatattaatcctactgaaactattctgcaaaatagaggaggagcgaattcttccaaactcattccacaaggccaatattacactgatacgaaaaccaaacaaagacacattaaaaatagcaactacaggccaatatccatgataaatactgatgcaaaaatcctcaacaaaatagcggcaaagtgaattcaacaatacattagaaagatcattcatcatgactaagtgggacttatcctagggatgcaaggatggttgaacatatgcctcaatgtgatatatcatattaacagaatgaagggcaaaaacatatgatcttttcaattgatgctgaaaaagcatttgagaaaactcaacatccctttatgataaaagcattttaaaagctgggtatagaagaaatgtcccttaacataataaaagccacatatgacagagccacagctagtatcatactgagtgaagaaagactgaaagtctttcctctaggatctggaacatgaccaggatgatcactccataaaaaaaaaaaaaaaactattagaactgattttaaaaattcagtaaagttgcaagatataaaatcaacatacaaaaattagtagcattcctataatatataccaataattaacaatctgaaaaagaaatttaaaaggtgatcccattcccaatagtcacaaatataattaagtaccaagtaataaacttaaccaatgaggtgaaagatctctacaatgaaaactatgaaacactgatgaaagaaattaaaaaggacacagaaaaagagaaatatatttcatgttcatgggttggaaatcaatattgttaaaatgtccatactacccaaagcaatctacagattgaatgcaattcctatcaaaatatcaatgaccttcttcacagaaatagagaaaataattttaaaatttatatggaatcacaaaagaccagagttgccaaacttctcctgagcaagaagaacaaaactggaggaatcacattacatgacttgaaattatattatagagctatagaaccaaaacagcatggcactggcataaaaacagacacacagaccaatggatcagaatagagaacccagaaacaaatccacacacctatagtttacttatttttgacaaaggtgctgagaacatacactgggaaaaagacggtcccttcaataaatggtgctaggaaaactggacacccacattcagaagaatgaaacttgacccccatctcttgtcatatataaaagtcaaatcaaagtagattaaagactgaaatttaagacctcaaattataaaactactcaatgaaaacattggggaaacactccaggacattgctttggaaaaaatttcttgagcaataccctacaagcccaggcaaccaaagcaatgtacaaatgagatcacaccaagttaatatgcttctgcacagcaaaggaaacaatcaacaaagtgaaaagacaacccacagaatgagagagaatatttgcaaactatccatctgacagggtattaacaaccagaatatataaggagctcaaacaactttataggaaaaaatcaaatactctgatttaaaaattagcaaaagatttgaatagacatttctcaaaagaagacacacaaatggcaaacaggcacactagaaggtgctcagcatcattgattatcagagaaatgcaaatcaaaactacaatgagacatcacctcaccccagttaaaatggcttttatccaaaagacaagcaataccaaatgtgggtgaagatgttgagaaaagggagtcctcatacactgttggtaggaatgtaaattagtagaactactctgtaggatagtttagagtttcctcaaaaaaaacacaaaaaaacaaaaaaactaaactaaaagtagagctaccatacaatccagcaatcccactgctgggcatatacccaaaagaaaggaaatcagtacattgaagacatatctgcacttccatgtttgttgcagctccgttcacaatagccaaaatttggaagcaacctaaatgtccaccaacaaatgaatgtataaagaaaatgtggtacattgtttactgtatacacaatgcagtactattcccacataggaaaaaataagattctgtcatctgcaacaacaaggatggaactggaggttattatgttaagtgaaataagccagacacagaaagacaaatatcgcatattctcaattatttgtgggatctaaaaatcaaaacaattgaactcatggagatagatagtagaaggatggttactagagcctgggaagggcagcaggagtatgtgggagaaatggggatggttaatggccactaaaaataaatagtaagaatgaataaaacctagtaatagcacaacagggtgactagagtcaataattatttaattgtacattcaaaaataactaaaagagtgtaactggattgcttgtaacacaaaaggtaaatgcttgaggggatggaaacatcattttccatgatgtgattattacacattgcatggctctattaaaaaaaaattgatgtactccttaaatatatacacctactatgtacacacaaaaacttaaaaattaaagaagaaaatttatagtgttttttatgacttaaaatatataaaaatatttggtttatgtttccattgatttctattttaattacatcatgactaaatatggagatcagtataaagcaaaatctttgaaatttattacttgaataatgaccaagcacttggtcatttttaaagatatttgtttcctaattttttagcataaaattacatatttacatatatatgggaagaaaaccccagttaattttattgctcagtcctttcatttgcattgttaattttgtttgcttgattagtatagatctacttgtgatcaattctttttcttcctatctctctcaatctaaaagtgtttttatcttgcgtttcttactgaaagatctttttttctatgttgaagttattttctctgagcagtttgaagatactattacatcttctggttttcagggctgctaatgaataatagtcattatcagtataatttgtattcctttgttggtgacttttctgtctggctgcttttcaaagtgttcaattcttgtatttgtatatgtttgcctttcattgattctgaaaattttcagcataatattttgcagttttaccctttcccctattctttatttttgttcttgtacaacagatcagacttactcattaacattaggcgtttttatttcatcatccatttgtgactctaatgaaactttgaatcacctgggaagcatattagactacagatgctcagcccgagctactgagattcagagttttcaggaggcagggccctggccactggcacataaatgactctccatgtgactctaatgaaccacagagtttgagaaccactgtaactaggcaactaggaacgtaggaaccaagataagattgtgcctcgtgtagtgaaagaatgaaaatgttgggggaaacagtttggcacataggacagagtacacaggcagagagaatcatacgaatgctaaagcaagggctgcttgttccatttgcaagctcaacgccaacgctaccccacttcatcctagtacaactttgtcatgtgggggtttcagctgtagcctttcactttaacgtgaattttctcagaaattgacttggaagaagaccatgcctgtgtccctgagacatgtattatgtttaatatatatacagagagagagagagagttcaattcacaaatcatagttgaaggtttccacaaaagtacaagatgctattctttttcccaaagcaccactcagataatacgcaggaggctgagtccactaaaggatccagtaaaaactccattattttataggtactcttggcctaaatctttaaaagattcaggaaaataaataaaaattttctcacacaaattatttctttggtttttgtgattcatcaataggctaagtgatttttcaaatcagctaaaaaatggacacttatacacacccacactcacatacccttttaagttctaaaccaacatagccacttctgctatatttagctttttttttttttttggcagctggtcctattgttgtatggatttgtttctttttttttttttggaaatcttttttttttaaatttatttatttagttttttattgatcattcttgggtgtttctcgcagacggggatttggcagggtcataggacaatagtggagggaaggtcagcagataaacaagtgaacaaaggtctctggttttcctaggcagaggaccctgcggccttccgcggtgtttgtgtccctgggtacttgagattagggagtggtgatgactcttaaggagcatgctgccttcaagcatctgtttaacaaagcacatcttgcacctcccttaatccatttaaccctgagtggacatagcacatgtttcagagagcacagggttgggggtaaggtcatagatcaacagcatcccaaggcagaagaatctttcttagtacagaacaaaatgaagtctcccatgtctacttctttctacacagacacagcaacaatctgatttctccatcctctccccacctttcccccttttctattccacaaaaccgccatcgtcatcatggcccgttctcaatgagctgttgggtacacctcccagatggggtggtggccgggcagaggcgccccccacctccctcccggacggggcggctggccgggcgggggctgaccccccacctccctcccggacagggcggctgccgggcggagacgctcctcacttcccagacggggcggctgccgggcggaggggctcctcacttctcaggtggggcggctgccaggcggaggggctcctcacttctcagatggggcggctgccgggcggagacgctcctcacctcccagacggggtcgcggccgggcagaggcgctccccacatctcagatgatgggcggccgggcagagacgctcctcacttcctagacgggatgtcggccgggaagaggcgctcctcacttcccagactggacagccgggcagaggggctcctcacatcccagacgatgggtggccaggcagagatgctcctcacttcccagacggggtggcggccgggcagaggctgcaatctcggcactttgggaggccaaggcaggcggctgggaggtggaggttgtagctagccgagatcacgccactgcactccagcctgggcaacattgagcactgagtgaacgagactccgtctgcaatcccagcacctcgggaggccgaggctggcggatcactcgcggttaggagctggagaccagcccggccaacacagcgaaaccccatctccaccaaaaaaatacgaaaaccagtcaggcgtggcggcgcgtgcctgtaatcgcaggcactcggcaggctgaggcaggagaatcaggcagggaggttgcagtgagccgagatggcagcagtacagtccagctttggctcggcatcagagggagaccgtggaaagagaggaggggagaggggagagggggaggaggatttgtttcataagagatgttggtggggtaacccaaaaagagattaagaaactagagctgcctgtcattagtttctgacatcttagaccttagtgatcttatctctggggcagaaaagaacagagtagacataagattacacagaaatggttaagtgtagtattagtaaaacaatcacctgggaagagaacatacccctctctgtcgcggtgtgattccataggaaatcaacacactaaaaggaacacgcacttcaggcaacatcaaaattgaaggaaaaacttttccaaaactgagtttgtcatgtcagatctagaagactgcatggagattttcagttgcttatctgtatgtggttatagtgagtggggaaaagctcagcccaggctcactgaactggagtgtaacagccacttcatgcctattgcccctggtaggtgtggggctgcctgattaccgcgaaagatcagcctgactggcctgtgcctttgtcctgcttgcaggggaatttgcttctaccttgcagatatcagcatttataaccattccctgcttgacccatattcaagatgtgtggcttctgcgacattttaggaactatttttctgaattgctgtcctggatctaagatatttgtacacaatctgtttggcaaactaactactgctactgttacttccacacttgaatgactaagtagaacagatgatgtacattaattttatgagctctggactgatacttaaacttcattttaatctgcattagctcattttttgcttccaaaacatttattcttctgagaagcaattcttgcccacagccttaataatgtgtagattaggttttgtgagatctcctcctttcttctctgtctctacctctgctctctctaggtgattatttaccctttaactgtaaaataactttggttttcttaattctgaatttttaataaaggaaaaagtataaattacatagaagcatgacaaagaaaaatggactccagatctttgcataaatactgaccttatattttaactaaaatgtgtaaaccaaatttttttaggctatcttggtagcacagatgatggaaaattgtatcaatatcagccattagttggcagaaagaagaaagcaaatatactattactctagggttgccaggtaagattcatttaatatttgaggcatacttatatttaaaaatatatttattgtatatgtggaattcaaattgaacttggtgtccagtatttttatttgctaaatctggtaaccctatattactaggatgtactgcatttgatattaaaaccattctcaaggcttactttgttatcagtcacaacaaaatattaagggctttttttctttcttttttttgcatatttccacatatgcaaaaatgtctaatgcctgtgttgctccttcctgggtttcataaatttctccgctgcctaagaccagcaacctcaaatgttggagaacttttaaatcagttattttccaatgaaaagtatttcagattcaaattgccattcaagtgtttcctgtagctctatactaaagcttaatcgttttcagctctaggtttttagaagtggaaagcatggttttgctaagtacagcaaagagtttctgaggacactgggaattctatacctgcagaaatgtaatatcttcattgaccagtgtgcaggggagccgcaggagtagcaggatcccagactttgatgtcagatgagccttgctgggttcttggcaatggcaacaattaatcaagggaactttggcagtttgtttatctgtcatatagttcttcattcattaaaaattagagatagagagatggaggcatgttagtatgcactttcaataaggcaccaaatgaaaattagttgttgttggataagattttggcgtattatccaatatgttgtttgctcccagtcaagttacctatcttggccacgacagctgaggcagccattgtcttaggaagaaggcagatccccagcagaaacaaaaacagtattgcctccatcgctcaggtctgagtttcaaaatagacaacagtatgctatgctagtaagtgtttagctaataagcaactctttaaaaagaaaaaaggccataatttgtagcacttatgatttctgtgttgtaaacattcccatcatgtctgatttcagcctaccaatgtgacatcactgaactcaaagttgacaggacatgcacacaggccactgggctcggagagtgttattttggaactcccggagttggattttattttttagtcttggaagaagaaagattcaggatataatgtgatacagtttcctgctacccagcagtgcatgcaaatttttcatatgctgataggagaattgtggagtgattcagaggagatcaaactaataagtggcccagcctatatgcccttatgatctgggtgtggtgagataatggaaacctaggtagaaagaaaactccaaacgtcttatcgtgtttcctctttgaatttccttagattagaataattgtgtgccattgttaggcagagaaaaggcctaaggtaagacttctgactctccaagatcttctggtagcatggagaggagctacaaaaactttaagcctccatagctaaagatgcaatattgactggcatgtggatacaactctggaaggcccagagacctctctttttgtatctctttctaaggatcttgctaattttttcagttctctcctctgtgttgtgggagctagagtcctgcaaacagcacttcctagcctgctgtgcctgcagagttcccacttgtattccaccaatgagaagtgcttggtgaggtttgataggtggaacagaagaatatttcattatgtttctgtgcctttgggcagagtgtacgcctcagcagacagcagacatgagacagacccttaagaatcacccatcttagtgctgcaggtagatcccaactatggccagattctactttcagaccttctaatagacacccttgtccagcaactgcctatacacttccagtgatcagaaactcaatagaactagagacagcctcttctacactggacaaatctagctctttttgaaagaaaatgaaacttttgaaaatatttaattatttctaaatatgtctttaaaggtcactttatgcccacatactctgtgtactccttgtatttagttctgggtaagttggaaaggcctattgtgatttattcattgtcattgacttacagcataagttattgtcaaggtttaagaggagtcatccgaaggtttagaattgaagcggcgttcctgtctaggataaatacctgagtttcatcatctcacaccaggaaaatagaggatgcagacacacaagaagtgagtttaagagcagaagctcaataggcaaaagaatgaaaacggagaatagcttcctctcctgcagagtgagacatatggcggggatgtgaagcgggggatcttctggttctgtggcgaaatgcctggggttttatagatgagcttgaagaggcagtatctgatttacataggacccaaagattggttggaccaggtgtaccatttacatagtgtgcaaagctggtcaccccaccctaatcttttattatgcagatggggtctctacctggccggcgccatgttgtctgttccttactgtacacgtggttgtcaagaaaaaggaaagatggagccaccatgttgaacatgcctagtccccaggtagccttttcctattgacacagctgctgacattcacccctgcaaggcttatctatgtctgcagctcagtttcgcaggctgctttttgttagaaaagaaatgatttgggggctgctttttattaaaaggaaaaccttaccaacgactctcttaccctcactatctgcctaaataatttctttttaactccctccaatattttagactaataccatcatttgctccttctttcttatatttagttatgcaatgcttattaaggcattgtgcttacactggggaaccagtagtctcaggctttcaaacaactttcggtctaacgaggagacatacaggtcaactaggacctaaaatacagagaattaagtgttactacaaagctaacacaggtgtattggtaacacatagaaaaggctctcaacttagtcttaagggaatatagaaagcttccttctgtggtcttccagaagtatgggatatgagagaagtgaatagaagttgaatgtagggtgggatgatggagccctcacagttgaaagcacttgttagaaaagggtatgagccaaaaagaatgtagaaccctgagtgaaaaacagcgtacccagcgtggaaagcccctcagtgtctgaagaggccagaggagccactccaccagttcataactcaccacccaaggcccagttgactgaccaaggaaaacaagcgagcaggaaatagatgataggccttggcctacacagagtagttagaggagaagtgaaatttgttgaagagctgaaaaactacaagtgactagaaaaacagcacatagactaccagtaagtttaaattgtggttcgacacagagtaaggtaaagtagcagaaaacaattccaggtaatctgagagtaaatttttttctcaaggtctcccatgtgttaaagaggtcaaattttattagaggcacagatattttatgttgattaattataaatgaattgagaacaaaaaaaatgttatttttttcagccatatcctgtaatattttaaatcattgacccaacaataaataataccattgttcttcagctttttctgactgccaagaaactcagattcgggcaattcattaggaaagaaaagaaaggaaaagaaaaggaaaggaaaggaaaagaaatatacacatatatatattttttgaagttcctattaagtcttttgtttatatacttggtttgccagagctgtacctctttctttatagagcctggggccagcaaggaaggtgccaactttccaacattaagggaggagaactgtaattcctgggtgacaatccaactgattagttcaagaagattactggaattctaagaactgaagaaatgtaggttttctgaccataaaattattttcaacaccagcctaatacactctgtaaagggcattcctccatggctagacaaactgaccaagcaagggaaggatgtagtatggggcgctttcatctatgttaacatagagtgagtgtatcacatgcacttggcttgctcacaaactgaaacatatatatatatatatatatatatatatatatgtatgtatatatgtatgtgtatatataggtatatacacaaatctctgtagtgttcacattgtaaaaagacatccaaaaagggggtttatcatggcaaattcaaaatcatgaatatatgacacactgtgtaacaagctcaagaactttaagtgtaaaaatatcaccctgatgccatttgttccaaagacaacttggagaaagtttgctttagcagacaggacaaccacaaggcgcacactggagagttaggagaagagtatcccctctacattgctgagcccacagcctgacagatgggaagagcaatgaagcactctgaaaagcacaaggtgattttggtggattaggcttatattcccaaagtgcaaataaatataagagttttccattttctcagaagagtctgctatatgcaggactaaacaagtgagatgctctatataggctgacctgaagaccttcctttccaataacacctccttcaactttcttccacagagcccgggctcccttcccaggtcacccctttgtattaacacatttccccatgaagttccttctttaacatgctgacatgtcttgtgaaaattattttttttctataagaataaaggtatataggatacgtgatttatggtccatttttaaaataacgttctcttgagagttagaagttcattcaaagcattatcagcaagattttcttataaattttggacgagtatccaatagtacttgatggattcattttgcattccttggccagaagctctccagtggagcacctgtgctgggactctttttggtgctgtccaattcagcagtgaggccagatgaagtagaagtaaggtctgcaggctggagtttcatccagagaaatcttcttggctgtgaatcagtacaggagcataaggtggggacagtgagggatagtagtaggaatggcaacagaaacaaaaagaggagaaagggtagcttctaggaattgcttaaagagcacaagaagaatgtggaagttaataaaaggaaactattggtggtgacagaagccaatgatgttggaggctcttgttaatggaaagctaccttgagaattgagtataagccctaagctttgcattttttaaaaatggaaagcagccatttcatatttcaagagtgttctcccttaagaaaatgaatggtatacaagctatttctattgtggtctgtgagccacagcttcctaactgtgtaaaagcaacacttggctgaacagtgactacaagaagaaaaaaaactaccacttttacagcacaatgaaaagaacgaaaaaaaaggaaaatttcctttgccatggaatttcctgctggatagaattattcacccatccttttcttctagctgtcatgactagttagggtgtagaacaggtaccacctctctttggtataatgccacactgaattaatccaacttggagtcatggatcatgggagcctagaacctttaagcctgatcagtctgcaaacatccaaaacaagtagtttttcttctcttatttctggtaatatacagagtattttaaggcattatgcccacatttctctgatatgcttgacttttgaagagaaagcaaaaggagttccctcctcaaatataatcttaaagctgctaattcattagccatccagaggttggtaaaaggaatgtccacttattgtttttaaacctgtagactgtagaccatactgaaagcaatggccagcagaagtaacaaatgtcatgaaaataattagtgaatcgttaagtgaaagtagcaattttatgcaattactttaagtagcttaaaaatctttattttcctagcatcacatagagagtttttctaattttatatccaaacactcgtatacactatctaaagaaaataaatgtttaaaaacccccagtaacagaacccaaccagatattgcttaaatcttaacattttgactaggagaatatgtttaaatcccgaagaatggaaaatagcatgcctcagtctgaggaatgctggtgttctttccacggcaggctcacttgggtcaagtgagtgtaattacttctatggagccagtctttgtttaaaggcttgatacttctccattgcctcttggaattgctgaaagctacaatgattcacttgggtacaattataagcattgcttttcagaaagtcttatataaatactacttggaagaaagaaggagaaggaagctgaaaggataaatcagtaatcagaaaaactttctgattttttttttccatcatttgtaattacttgattatggaattataggtaaaaagtcatgtccttctgtcaccattgtccacagcaaaaaccacacaaaaaatataatgatcctagagaaacacttgcacatgcaaacacacacacacacacacatacatacatacatacaaccatgtttttgcaagaaaaagggaagtgagacacacatgatcattcccttggctggatctgatccccctgtaggaacatagatattttgccatgtgcagattttggggaaggatgttggagggactcccttttctcccaacagcaaggtgacatcctgatttgtgttatttccatgtaccctggtgataatcattctgacttatgaaagactactcttggaagactatcagggccacacaagtcaggttctggggccagcagtcaattgttggttgggaaagagccaggttttgagaaaaagagaaattcggtctggattttcctacttttctctgccgccagaatctattgttggaggaaaaatcatgcagatacttcagcctactctctgtagttcttaaaacaaatctccacccgtttctcctttattcaatatgctgtgtggcaaggcaaaattccactggtgccatttaaacataaaagcaaagccacaaaaatttgctgcctcaatttgaattctggaacataaaagagattctcaagttgccttcagatctgtgctgtatgtgaactttgtgctattcgattgctggttatggccaagccctggaactctcttccacagctgagatgtttcctgctgtccccacctccttttctctagtcagtgttcctggttaggtgcaattagaagctcagctgagctagaagtatttcactggactctctaagagtgaactggagggatcccctagagaagtggttctcgaactttagtgttcattagaaccacctggaaggcttattaaaacacacattcttgtgtgcttcactactagagattcttgttgactggaggcaggcggggggaggtggggagctgggaggtggggagcatttttaaaaagttcccaggtgcttatgctgctcagaaggcaacactttgagcagcatctgtctagtgttattcataaacacaaatctaggcaataggagaacacactggttcatgtatccattcatctaacattagtgacatgtcccaagccctctgccaggctctgtgatgcacacctgaataaagcccagagcagtagggagggtgcacaagcttaataatgtgttatgggaagtatacatagaaatatgcacagggaagagtggggtgcaaaagaggggaggctcaaatctctctggatgtgtgagtggggtcaggagctagcatgaaaagtttgaagagaagatcgatgctggactacatcttaaagggaagtccagtgccacagcagggcagcaccataaagagtggcctgagattgtagtagagaatactgcatggagatctgtagtggcatatagcctcagaaataggaagagaggaatggaaaccagatataagacttgaatagtcttcgatagtcaaggcttggttaaaacatgaatcctaaaagaagcaatagaatagaagatagaaataatacaatagtgctagtaggcttaagaacagattgaataaggggagtgaaggaagggagatgatcaatgatgaagatcaggattagtggcgaaagaaaatgagtttgtttctgaacacatcaaattaaggtgcctatggagcatgaagttagacctctctattgcctaattccatctttctagatggacatgcaagctctggagcccaggagagagatttgggctgggattactcaactttgacctatgagcagttgaattctcagaagtgaatgaagctgcccatttgtttatccattcattaaatgtttactgagcacttagtacatgtcaggcacatgtgagaagtatattagtattctgtgatgacaaattatgacaaatttagtggcttaaaacaacacagattgagcatctgcccattgtctaagtcagaaatacaggttggctgggctggtttatctcctgtagagttaacaaggctgacatcaaagtgttgccaaggctgcattcctttctggagtctctaggatgtgtctgtttccaagctcatttaggttttggcagaattcagttccttgaggttgtaggactgaaggtccttggctgtcagccaagctgtagtttccacctacaggctgcctgcagtctttctcactccttcctgaagattcccttcagcaaacctgagtcttcagaaaggaagattccctgtgggctgggtcactctcacgcttcaagtctctctgacttcctttctgctatacctctctgccgcttcctcctctgagacaccactcagtgaattttctctgcttttaaaaagtcatgtgattaaattcagcccacttatgtaattcaggataacctctccatcttaggcccataattttaatcaaatcttcagaggctcttttgctacataaagtaacatactcaaagatccaccaattaaggcacaggcatctttgaaggtcattcttaccatcacaatgaactggaaattctgcatttaacaaaacagacacaatccttgtcttcatttttattttattttattttattttattttgtttctattttgctaactttcattttacattcagaggctacatgtattggtttgttacatggataaattgcatattgctgaggtttggtgtatgaatgatccctcacccaggtacccaataggtagtttttcaacccttgcccttctcccagcctccccctctagtagtcctgagggcccagtgtttactgttcccataaaatttatggagtaggaagatgtttagatagatatgaaatgacaacctaaagaattatataattattaaatatgttgaaatctctaaagattgcaccagactgtaaaaggtacagtgaaaaaaaatggcagcttaactgttttgtagagagaaggaattcttccccaagaacatgaaaagtgatttgagctctgaatgatggatcagcactacatccatgaagaggactgagagaagagcatttcagaaggaagaaacagcatgtacgaatgccttaaggcaaacgtggtacaaataactgaaagaaggcaagacagctggagcagagggaataagggatgtgggacaggagagaggggttgggcatgcaggacaacatggggacacagaaaggctttcagcaaggaaatgccatgttcagactttaatttttagatgactatttagagtgcagtatgaataaggtattgtaggtgccaaaagagctacagtgttagggatgtagttctgtgttcccagaatgaaatgataagagctttaggctaagcatatagtgaaaagggaggaaagtgaataaatttaagagctgtttaagtggtctattttgtcaagattccttggttacatgtaattcgaactttcaaatgagtgaaatgtgaggtgagaacagtattactagctcacaatttccaaccacagaaagaccagggatggcagtgacaagtcacggacacaagggcccagggccctctcaccgtctctctgtgcagtgggttccttgcctctgaatgcagtagaccagtccagtgtgacgactggggcaggggtggagagcatgtcctgccagcaatcccggcatcccatctttacgccagaggagaaagaatcttttaaattttaactccatctagcgataagcaagtgatcaagtctggctaattccctgattagtctaattagtcaagtttgactaattccctggatcatttgtttattcctagaaaaacattaggttagaggtaaggtcctaatctgggagatctagatattttttaaggatatttttcagaaaaaaaaaatgttctgagaaaacagaacagtaagtgctcagtacaaaaagcaaaggcataggtaagatagatatggtacattatagacagggtgcagtccaaagtactttttatagcttgatcatctaaatcagtgattaccgaattatgcttgttttctgtttccatcaataaagttttattgggacacaaccatgtccatttgtttatgtactgtctatgactgctttcacactgtgacagaatagatgagggctgggcacggtggctctcgcctgtaatcccagcactttgggaggccaaggtgggtggatcacgaggtcaggagatcgagaccatcctggctaacacggtgaaacccatctctactaaaaatacaaaaaaattagccgggcgcagtggcgggtgcctgtagtcccagctactcgggaggctgaggcaggagaatggcgtgaacctgggaggcggagcttgcagtgagcctagatcgcgcgccactgcattccagcctgggtgacagagcaagactccgtctcaaaaaaaaaaaaaaaatacaaaaaattagccgggagtgaggtcacacacctgtactcccagcaactcgggaggctgaggcatgagaaccacttgacccaggaggcagaggttgcagtgagccgagatcatgccactgcactccagcctgagtgacagaagaggtgagcagtctcaaccaagatcgtatattccacgaagcctgaaatttttatctccccttttacagaaaaatttgccagttcctgatctagatgaatagttgtgtctttcaagagaaggatcaagtttgaacagaaaagcatacatttggttttggacatgttgagttcaagtgcttttgagacatcaggttgaaacagtgaatacatggttggatatttgaaggtgaatttatttaaaaaagaaacagctttatgagaactttaacaatttctcatgctcctcagaaacaactgattgttctgtagcaacagttagagttaccatcacaaccagttttaaacccacttagtcaattcatgataactttctcagagcaagtttttgaaagctaaccaatgagtaatagtgttcctctttggaaggacaaccagttggcaagagcatgactccagtgaacatactggaaaggcaaccaatccacaagggtcttctcccaagaaatcatgcttctatagctgacatcaacccattctctgaactatttattttctaaaatttccacgtacaatcaatagtctgctttgtttagaaagactgcctaaaaatcataactctcccttgcttcagtaataaatttaactttgtatttcagttagtaagtggtggtttcttccttaaccttagcctgagatattttttttaagtaccttaagtgggccgggcgtggtggctcacacctgtaatcccagtgctttgggagtccgaggcaggcggatcacctgagctcaggagttcacgaccagcctggctaacacggtgaaaccccgtttctactgaaaatacaaaacattagctgggcgtggtggcatgcacctgtaatcccagctactcggaaagctgaggctggagaatcgcttgaacctgggggggcggaggttgcagtgagccaagatggcaccattgtacactagcttgggcaacaagagcaaaactccatcaaaaaaaaaaaaatgtaccttaagtgcgtaggcagttgcggccgtgggagaagtgagttctaagggaaagcatactgagaagtcaagaggggctagagtgtagtcatacgaatgctcacatttaatgactatgtaaagaaggataagactacaaaggaaagagtgaaggaggagccacagagataaaaagaaaatgaagtacatatgttggcatagaaactgaggccagaaactgttttaagaattaaggaacagtcaacaaagtaaaatgtcactgaggccctagttgggataggaaatgaaatatgtctactgcatttggtgaacaagcagaaatttgtgacttttgtgagatttgtttgtgtgcaccaatgagaatgaaattaagatcagaagttgagatgtgagtggagacgagaaaatgggaacaaaatgtataaacagttcttttgcagatagagaaacagatggcttagtgtcaatttgatttttctaagattaaaaaaaaagatggaagaggttcagtaaaaaagagattgaaaatataagagagaaaagatataatcaacagtatggtgcatacgtaggcagtgactggaagagaacagagtgggcagtgaaggagtttggttcaaataaaagcatatgtgcctataaagcaaaacataacaaaaacatggagcaagagtgggtggaaatgtagaatgggctatacattgggtagcataacattggaggaggacaaatttccttctttctttcatctctttggaggaagaaagcaaaattatctcctgagggtgaaaaaccaaataaatgaggtaggttgaagtctgagaaaaattaggacatttagagagagaagagacagagactcaaaaatataacattgagaaaagaggtggggaacagaagaagaacaagaaagctagctgaaaatgattaaagaaaaaggaaagagaaaaactaggagagtggtataacaaaagccaagggatgttgtacaaaaaaacattagatgctagttgcagaggacaaggaagataaaaacagaaaatagtcttatttgacttaagacataggaaattgttggattttccatagagtaaaaccatacatctacttacagtatgttaaaaggtgaattagaagatttcaaattaaacaacgtcatttgaacatatttgtttctgtccctttaataattaatttattaaaattatagtaaataacttaatatctacattatacttaatataatgagagtgaagaagttaaaaataatctacttatctactataagagcaaataacagaaaagacacaacaagagataacagttgctgagacattttaggaagatggaaagcaatgaaggagtaagcagagatgagcacagtaaatagcaactgcctgcaagtgcccaagagaaaaagccatttcaatagagaaccataaaaatattcagaatttagaatcaacaagtcaagatctgggcaaaaagcccatatatggaacaggtagatgatgcaaaattcactatactaagtgatgaagtctccaaacccttttgaccacttgattcctagaataatagggcctagacatttatacaggttgaagaatgagagattttctttcaataaaatgtcagatactgacatctcaaattgctcttcactccaaaggggcaggtcccttcccaatcaatcaccagtaaacacatgtctggccatgccacagagttgagctgactggtgactcatttctttctttcttttttttttttttttttctttgagatggagtctcactcagtcaccaggctggagtgcagtggcgtgaactcggctcactgcaacctccgcctcccaggttcaaatgcttctcctgcctcagcctcccgagtagctgggattataggcacctgccaccacgcccggctaatttttgtattttttagtaaagatggggtttcaccatattggccaggatggtcttgatctcttgacctcatgatccgcccgcctagtcctcccaaagtgctgggattacaggcacgagccactgtgtccagcctggtgacccatttctaaatgtaagtgaataacacaagaccaccagtcatttaaggaacactaacacagcagaaagaggccaaaacaaagagaaaaagaacacacaaaaactagaagcagaaatccttctcattaccacaaacaacatcactagaattaatattcccagagagttaaaaaaatgaaattgatagatatagatatgcattatgcccagaaagaacaacagaattaggaagggagtgctgatgaagcacagttttggagctgagtagctgaacaaatagaagtattggagaacagagtctcaagaatgtcaaggtgggaattaagagaatcttattttacatgattaagcatgtattgctatttgacttttaaatgtttgtgcatacattaactttttatgaatgggaaataataagtgtattagacatgagatatgtgaacaaaggttataaataatctttccaagatctttgttctactctcaaaaccacatgattatatagaaacttactcctgaatgacttttcagtaagcaaaacaactaaggcaaaaataaaaaaaaaattatttgaaacaaatgaaactaaagacagaatgtactttagtacattctgaatgggaacctctagaatggggaaaaagcagtgttaagaggaacgtttatagtgctaaatgcctacttcaaaacgttagaaagatcttaaataaactaatgctgcatctaaagaaactagaattaaagagcgaatgaatcccaaagctaacaaagaaaataaataactaaaatcagagcagaactaaatgaaattgtgacccaaaaacatataaagggtcaataaggtgaaaactttgtttttttaaaggataaatgggaataatagaccagaccactcactagattaacaaagaaaaaaagagagatgatccagataagtataatcagaagaaacaaaggtgacattacaaccaatcttacaaaatataaaatatcctcagagactactatgaacatctctatgcacacatgctatgaaatctagaaaaaactgataaattcctagaaacacacaacctcccaatattgaaccaggaagaaatagaaaccctgaaaacaccattaatgagttaccaaattgaattagtaataaaaaacctaccaaccataaaaagccctaaaccagctaggttcacatccaagttctatcaaatgtaaaaagaagagctggtaccaattctactaaaaatattccaaaaacttgaggaggaaggattcctccctaactaattccacaaaaccaatatcatcttgataccataatctggcaaagacacaactaaaaagaaagctacaggccaatatccctgaagaacatagacacaaaaatcttcaacaaaatattagcaaatcaaattcagccacacatcaaaaagataatccactgtgatcaagtaagctttattccggaatgcaaggatggttcaacatatgcaaatcaataaatgtgattcacctcataaatagaattaaaaacaaaaattgtatgatcatctcagtagatgcagaaaaatgattcaataaaatccaacatctcttcatgttaaaaaccctcaacaaagtatgaatcaaagggaactcttaaaatattaagagtcatctatggcaaacccacaggcaatatcatactgaataggcaaaatgtgaagcattcctcttaagaactggaataagacaaggatatccactctcatcactcctattcagcatagtactggaagtcctagccagagcaatcaggcaagagaaagaaataaaaggcatccaaataagaaaaagaggaaatcaaatcatctcactttgctgaaggtatgattctatatctagaaaaccctaaagattctgccaaaagacccttagacttgataaacaacttcagtaaagtttcaggatacaagatcaacatacaaaaccatacaccaataacattcaagctgataaccaaatcgataatacaataaaatttacaatagctacaaaaaataaaatacatagaaatacatttaaccgaggagatgaaagacctctataagagaactacaaaacactgctgaaagaaatcatagatcacacaaacaagtggaaaaatatttcctgctcataaattggaagaataaaaaattattaaaatgtctatactgttcaaaagtgatctatattctcaatgcaattctatcaaattaccaacatctttcttcacagaattagaaaaaaactattctaaaatttgtatgaaactgaaaggagcccaaattgccaaaacaaacctaagcaaaacgaacaaagccagggacaccacattacctgacttcaagctgtactataaggctacagtaaccaaaacagcatagtacttgtacaaaaataaacaaaaagacgaatgaaacagaaaagagaacccagaaataaagccacatatttacaaccaactgacttttgacaaagtcaacaaaagtaaacaatgggaaaggataccctattcaaaaaatggtgctgctgaacctggctaaccatatgcagaagaatgaaactctatccctacctcttgtcatatacaaatattaactcaagatagattaaagacttaaatctaagacctgaaacaatcaaacttctaggagaaaaactagaaaacattcttctggacattggcctaggcaaataatttaagtctttaaaagcaaatgcaacaaaagcaaaaattggcaattgagacctaattaaactaaaaagcttctgcacatcaaaataaactatcaacatagtagacagacaacctacagaatgggagaaaacatttccagactatgaatctgacaaaggactaatatccagaatctgcaagaaacttaaacaaatcaacaagaaaaaaaatccattaaaaagtgggcaaaggacatgaacagacacttcttaaaaagaagacatataagcagccaacaaacacaaaaaaatgcttatcatcatgaatcatcagaaaaaatgcaaatcaaaatcacaatgagatatcatctcacaacagtcagaatggttattactaaaaagtcaaaaaataacagatattaacaaggtagcaaagaaaagtaatgcttatacactattggtaggtatgtaaattagttgagccactgtagaaagcagttggatatttctcaaagaactaaaaatagatttatcattcaactcagcaatcctattactggatacatacccaaaggaaaataaatcattctacctaaaaaacacctgcagtcatatatttatcacagcactattcacaatagcaaagacgtgggaaccaacctagtgtcttgtcagtggtggactggataaataaaaggtggtgcatatacatgatggaatactatgcagccataagaagaatgaaatcaatcctatactttacagcaacatggatgcagcttgtggccattatcctaagtaaatttatgaaaaaacagaaaaccaaatactgcatgttctcacttataagtgaaagctaaacattagtacatgcagacataaagatagaaacaatagacactggggactccaaaaataggggaggaagggaatggggcaagggttgaagaactatttattgagtgctatattacctatttgggcaatgggatcaatagaagcccaaatttcagcaccacgcaatatacccagataacaaatctgctcatgtaccgctgaatctaaattttttttttagaaaagttgaacatatactaactatatagcccagaaacttcactcctcagtagcttcccaagagaaacaatgactcatcctcattcaaagactaaaatgtagagacattaatcaaagactaaaaggtgaagacaccaatgtttgtagcaattttattcattagttaaaaatgagggaagtccatcaactggggattggataaacatcttgtggcaaacccttcaatggaatactatacagcaatttaaaggaaaagactactgatgcatgcataacataaatgaatctcaaagctcttatgccaagtggaaacatttaggcacaaaagtcacgtgtgattaatgcccagaactggcaaaattattgagacctaaaacagatcagtggtggcctagggctgggaatgggcaataagactgactgctaaggagcaggaagaatgttttggggtgagggaaggaactgaaaaccagattgcagggatggtggctgtgtgactaaaactcatgggactatacacttaaaatgaaaaaaaaaaatatgctatgtaaattatcactcaaaatagatgctttacaaagttaaaaaaaagacctttgttctaaaggaaaaaagagaatatgattctggtaataacaaagatacaggatggtggaaggttttctattttactatttttaataggatatattcgagtgtacttataggttaggaagaagaagaaggagaaagagaatcaaaacgcagacaacagagcaaataatggagaaaatgtggggtgggaacaggacccacaaggcaaattttagaggtggagcttcagcacaagatgctccctcctctgcactgaaagggataacattgatgaagtttttgttgtcttttcagtaaaaaagaagcaaggctacctactgcaagtgacatcagtgatgagcaggtggataggtgagaatgacatttgaaatatccttgtgggttactgagaaagcaagcaagctagttgtgtaaaataactttcaaaccaaaatgaagactcattggagattggaaaccacaatctgtagcaacaatggtctacagagttaaatgattttctccaggggcatttatcagctacattttttgtaagggtataatgaatggctagattgatgctaatttgcaaggccatgaggatgttgaagcaaccaaaaacagaacataaacactgcactctagagaggtgggctatcaaaggaaggaaagagttcactgaagaaaaagagaagggttgaggaattgaattctcagggtatccagaaaacctatgtatagggagcaagggaaaaaaagaaaaaaaacatgcagggataattatggtcagaaattgaaaattgaaatttaggatttcccaacaagtgcccaggtctggagtatgatcctgagagagagtggctcaaggggttgaatggagattgttggagtataataagtcaggaagctttccacatggataacaaagacaaccaggatgattgttcagcctaaaaggagtgaaaagaaagacagtaagtcaggtaccaatgcttgagcaacaatggagtacaacagctacatggaggacctcaaggaagaaatgcttcctaaaggtagaagcaaaaggatctataggtaataaaaggcatcaagacctttgtaaacatttctcaacctccccttgtctcttgactctgctagttatggttacctggccagatcagcaaaagaatcaggtgtcactaaaaagcaagttgaacaagattaagaattgctgctaaacgaaattatcatgagaaatacactggagacggtgcaataaaagaattcaagtcagccacaaaagtgtacctgcccaaatgcctagggccaagacaaaaatcaggatgggcacaacagaaagcaatcaagataccagggccaaatcaaagagagtagctccttttaattccaatttttatgtacatgtatacttaggggagctccctattgaattggctgtgtactacaagcttaatggcgtgataaatagaaagatgcaaagaggcaagaatggatgagcaggggtcgttctgggcaatgtaaagggaccagttcaaagcctgttccagaatgacttggcccactaaccgtggtagagaagaccatttggagtggtcaaagcactggccattgactgctctgctttgcatttgcctgtgagcacagcacagaagtctttgcaatagatggctcatcctcattctcagaatgtttcctgccttactttcttctctaacaacaaatgttcaatgctttccagcccctgttgtgtgttacattagggcaccatgaagacgcttcttgtttattatctctctcctctgtcttcctgctccttattcccctttctttaaaggcagactctttcttggcaatttttttatctccaagcttggagcccctccctatttcctctgcctctttactcctcatatgtacttttaacaaatctatagggtgccttcaaactaagatactttaaaaaataattgctacattcctctaatcttcctgagcacaaattctaggcatcagctgcctgactatacacagaaagttattttagggtgcaaatttgggaccattgtgaaattccagtggccatgcacaggtttcctcacagctttctgatatttaagttttttaggcaggattgtctgaagctgtgtagcttaagggcctttgagtaataattatcatcatggctttacctctaatgcccactgtaagagcaagatcatctgaatctttctttctatagaatagagagcacaaaaataagcaaacttgaagagctgtgatcataaaagctaactaaatactgccatgaaacagctaggatttggatgcagaaacagagtgccagagaaacactaaacaaaatgacaaaccacagttaggatctcaggaattgagaagatggacctgtctggcagctgaaaacattgatgtccatcattaatgcagagtcaggacttcccagagacgaaattcttctgcaggaaaaagggtgcaaccatcagcctctgcccttcctccatgtgagatctctttctcagtctccagggaagcaatgtccttttgcttcctactaaatacctggacctctccatccctatattacccactccagagcaatttgcacagtgctccacactttcccctaattccttctcttcaaattctgtcttggccgggcgcggtggctcacgcctgtaatctcagcactttgggaggctgaggtgggcggatcacctgaggtcaggagttcgagaccagcctgaccaacatagtgaaaccccgtctctactaaaatacaaaaattagccgggcgcagtggcgggcgcctgtaatctcagctacttgggagcctgaggcaggagaatcgcttgaacccaggaggcggaggttgcagtgacccaagatcgcgccattgcactccagcctggcaacagagcgagactgcctcaaaaaaaaaaaaaaaaaaaaaaaaaaaaaaaacaaattctgtcttacgtgcaaacttccaggatttagctgtccgctggatgacgatagatagtgagtggattaataaaagctatactcctagcaaaatgttttgttagatctcagtagcaatgcctcaactgtacaaatgtgcagactttcataattgcccttaagtattcactaatcctggaaatttcaagcaaagtagctatctctctgtgtggagaaaagatgttaagttatttgaggttttcagcatgctgaagtttacattataaaaggaattgctaattccacctacacccttgaaggagggccatccattaacaagagaaagcaataccttagggcaaagtttctgcctatctgcaagggaatataccaattactaagacaactttatcccctacatccaactaagccgtttttgatcttgatccaactccttaatattttaggtaatgcagataaagtcaattttcgactatccatgggtggattatctgcaaatctggattttatcttcttgtgttgatcttgtcatctgttttgtttatctaagccctttaaaagcactattgttgcttctgtttactcttatttcctgcatgcagtaatgataattccctatatttgtttggcattttatggtttgtgaaatattttcacatgcattctctcattttgatgtagcctccgttaatccaaagtaggaaggggagtctttgaaaccatagcattttgtcatcaaattattttcttgggaaggtatatgctaacatgttggaagttgattaagaaacaaaacaaaacatatctgagatcatgttggtcgtttgcacaggcctgcgtggtgccagtgattataccaacatcaaatggggtaaaaggaggagataaccagatagaagatcaccaactgacagttgctcatagcactgttctactgtaaggctcaaatcctagaatatcagccacattcaaaggcaaggccaaactcacatttaagagtgagtttatacctctatgttgatgatcaattgatttttaacacaaacaactaagcaagtcaacaggaacagcgatttttttttctactatggtgctgagacatctgctcttcactgatgtcacttgcagtaggtagccttgcttcttttttactgaaaagacaaccaaaacttcatcaatgttatccctttcagtgcagaggagagagtatcttgtgctgaagctccacctctataatttgccttgtgggtcctgttcccaccccacgttttctccattatttgctctgttgtctgcgttttgatcttctttctccttcttcttcttcctaacctataagtacactcaaatatatcctataaaaaatagtaaaatagaaaaccttccaccatcctgtatctttgttattaccagaatcatattctctttttttcctttagaacaaagatctttttttttaagccaaacatgaacttagacccttacctcctatcacaaacaaaaattacctcagaatagatcagagacctaaatgcattaggtaaagctataaaacttttagaagaaaacatagaataaaatatttaaaaccttgagttagataaaaatttcttagatatgatattatgtctatgatattatgtcaaaagcataatacatacaaaacttgataaatcggctttcactgaaattcaaaacttttctgttttaaaagacactgttaagaaaataaaaacacaagccatagactgagaaaaaaatttacatatcatatatctgataaaaatttatcctcaaaatataaaatgaactcttatagcccagtatacaaggtaaacaaccaattatgaaatgggcagaagactttaataaacattttaccaaagaagatatacaaatgtctaatagcacctgaaaagatgctcaacattattaattattagggagatgcacattaagaccattatgagtaccatttcacctccacaagaatggctatgattttttaaaaagataaataataacaaatgttaataggatgtagagaaacaggagctttatatattagtgatgttatgtaacataaaatggaacagccactttgaaaaactattaacagctcttactgacacatgatcgaaggctggaggtagagaggagagactggaaataaaaggtatcctgtcctccctgtgactgatgctataagagaaggatgataggactcatctgtctatgctcacttggaattccacaaactccctttatacaaccacctagaggaatgggtaccctttagtcttacatttgcatagcttaagggaacaaatttggtggctgttcttggaaaagttgagtttttttcaactacattgacttggcgacttaactctagaaagagtagcctctaacaaccttaaataactaaaaatacaatgcaaaataaactctctgcttgactgaacattctgattctatgataatatctctacctccttagcttcactccaagactttgtttcctaaagttcataggcaaggcttattcttgcagctttacagaaactaagcccaaatgaagagcttctgaaccattccctactctaaacagccattcctgcctgtttgttcggaggagcttacagcctcattggccagagcatccgcgcagggaagggagctatgagcatgaaggatggatgctgtgtcctggctacaggacggcttcagcataattatcctgcctgggactttgcccattatattataatgaattgctttggaggaaaagatcaaatggtggagaaatcctcaagagaaagaatacatctgttaaaaactcccaccaaaaatgttataaagtgtttttgtttactaaatctttcaagtctgaaactggttcaagtataacttagcagcttgttgtgagaaaagagagaaaggaagaccacataatccaccaaaactaattaaaaataatacacacacatagaatggaattatagatgattttgtgcagcataaatgtataaaacatgtttataaatattgatacacatgttaagattgtctctgtgtatgcatttaagacaaaaagattccaaaaatgcataaaagtgttctatacatgagcacatgtgatcccaatttagggttatttctaaaaggttttaattcttggctttgtacttgattgcaagagattcaaatgaacaaatttggtggaagtcctgggaattctctctgctcttcagcaactactctctaattttcagcaattacatttttatcacccattgtgatcctataacgttaaatgtgcattagaaaaggagaggaaaaagcctgtaatttcacaagctttggggatcacaggttgggcacctgctttattacacatacaaggaattgatgctaaattttattcctcgaaatgattctgattacaggtagaatgtaatagaattttctatcctgtgactactcacaggataaaaaatacacatataatacttaccatgaaacaccaaatgtgtatttgctggaagggacatgcagaatacacatacagtactcagcgtgaaacaccaaatgcacatttgctggagttgagaaatcaggctggaatttgtaggacgtagaacaattgctctacaaacccatgaccaagatgactgatcctaaacacgttctcaagaagccacaagagccttcctttcctctcctgtgtcttatccctttcctcctcttgcccccttccccactatgcaaaaagacaaatagttatttagatctcccacaaaagcccaggaaactggacaaagggtgacaggcttggggcaggaagggggaagcccctgccacagagttgcaaataggtctctttttcttgggtttgcatagaaagtcctctgaatgagcttgctgtggcctgccccttaccttctcatagattgttaatataggcagtaggaaaagtacacacagaacggtttagagggagaagggaggactctgggaaatttactaaaaaattaatggatctccgtctggtgcagtaaaggcaattcttgattgtttgcaccaatgcagtgagcagattatcaaggcacagacaaggtttccttagtccgaaacatagagaactccggaggcccttatcaaaaccatttccctcctggtttagcgactggttatggctttaactgcatcatctccatcagcaatggcaggccaagctgctgctaggagcaaaagctaaggctggttttcctgcaaagcagaaatacttgtcatttcacaggggcctggtatctgagtctcattcagccatcttgtttcctgtgaggcccaggctgtatggacctgggcttattactgggcttatttgtgttttggtttgagaataggattgagcgtgtggtaatcagatgatgctctctgcaaaccgcctggggcagagcagctagagttctgagggaagcctccagcttcatccttcgggaactccccttaagtcccgtagctccctccctgctcctacctttggcctgagaattctcatgctgctccttagaattctaaagactcatgatgtctggcactctgctaggctggaccttcacttttgagacggattcaaaggtaaattttgttttgttttgttttgttgatatggagtctcactctgtcgcccaggctggagtgcagtggcgcaatctcggctcaccgcaagctccgcctcaccgcaagctccgcctcaccgcaagctccgcctccctgcaagctccgcctcaccgcaagctccgcctcccgggttcacgccattctgctgcctcagcttcccggatagctgggactacaggtgcccgccaccacgcccggctaacttttgtatttttagtagagacgaggtttcaccttgttagccaggaaggtcttgatttcctgacctcgtgatccgcctgcctcggcctcccaaagtgctgggataaaggcaaatgttttaaccaaaaggagtaactctgtaagggttccatgtgagacactgtggtatcttgtaggtggaaaaaactttatgatatgagaagaataagctgcgaattcttcttcttttcacattaccaaagatacatgttttctctcttattttaataagtcttattttaataataaaattgtaattgcaagccacctctaaagtctatacatgtcttattagtcattttatttatttatttttttaatgctcaaggggttgttttgatacagacacgtgggataccagaatgcctttattttgcagaagaacaaactgaggctggaaacagaactatgcaaaatgatgacttaaaacatgaatacttacatgtttatacgtgtctttttaatagaaaataaatagccattaaaatctaggggaaaattacagagaaattcagaaataaatgaaccagaacatcacccccaggtatttctgctatggagttatcgatgaattttctcccagtcatattgtctatgaatttgttttaatttgtggtgttttgcattcatactatttgcacaattttgtatctttatgtttttaatgttaagaacataaacacatcaattacttgttttcacaacaaagtatttccatgaatgaacatgcctttgtatgctagacagtttcctggatttttaacctttagatgttttctggtgtcacattaatataatactgtgtccaaaatctttttaccttttttgctttaaaaaaaaactagttaaattagtcaaccaatgttctgaagaatattgttagattcaaacttttaaagtatgtttggaagttagttttagatgagttgcttcgaaaatatctacgtttttaccttgctttagtttttttccttatgtaagcatatctagtttacattttcacaaacagatattagaggtgtgttgttttattaactgtttaaaagtctgtccagtatattcaatgaagacatcaatcagaataaaattacaagctaaaaataattctgaaacctttctttataaaatggttatcatgtgtgtcatctatgttgttgtgtttgtaaatacctatgctaagtggatgggcatagctcacccaataactgaaaagattttttgtggggacacaaggacccttcttttaggtacagaaactgcaacaagctatatagtggagctaaacttaggcgtacagcagcctttccaagaatttgtggcacaaagcagacaggaatattctacacacacacacacacacacacacacacacacacacacacacacacacacattccgcttcctgtctctgactttctaacttgaccttacttacttgcaaacttggaaatacaggcattctctctctctctctctcatagagtcatgattctcaaacattaaaatagcttaaaaattaacataccttaatgtcatcttaaagagtgaggaaatatttagcgatcctgtgaacaatttttattttctgtaaacttccccaatcctcacatttaccttcctaggtaactatgtgcttgacttatatattttttctgcattctttgtagccctttctttccccccatggacaactgtgtgtcccagcattacaatacatgtgtggacaaagaagctttctgtccagagagaaattaaacattccagtggcttttctcaccaagtcctgacacagagtgacccttggcatctcatttgtgggcgagcgttgaagatggtggagagataacctgaagcaaatctcagcctgttgttcaggctgccttgggcagtccagagaagaacaacatttagaacatttatgacctgtaaaatttatcctctagagttgagcccacaatttttggccaataattatatgtgagagtaaaatataagggacatatcttggaagcagtattgctgagtacttcagaaatgaatgactattttaatcaacctacctacatttgggcgattatccaaactatttggctttttactcctctccccttccaaacttaccctcctaaaaaatgtttgagagttaataaaatgatgtatttagagctcttaagccctagttcaccttgtttttttttttcttagttaccttcgtgattacttctaattctgccctgaggtgcaaacttgattccattcaaaggaaaaggaaaccaaaacaaacaacaaataaaaagtaactgaggagtgtctccaaaaactactactgaaaacctagtttacctacagttcaaatatgatccactctcgccatctgctggctgtatttttgattttttaaaagggaagtactggcacagacacatgggctaacgttattgtgttttgatgtgttgtgaatatgtgtggggaagctgggcactaaaccgtccaacattcaaattcagtatgtttttgagcacctatatttagctgagtctccctagtttataatttggtggagggttttatacgtagagaatcatcacagtcaagacgaagtagagactgggaccaacggctgcatccgtcagggagaacttctgtcaaagaataacgcacagacactgggtctcagaaagtggctgtctctgaggactcagcgtgtttcttctctttgatgaaactaatgatgactcaactccatggatctaattgtctccctctagaattaccttttctgagtgttcagggctccttgatggttttgggtttgtttgtttgtttgtttgtttgttttttgagatgaagttttgttcttgttgcccaggctggagtgcaatgacgcgatctcggctcactgcaacctctgcctcccggtttcaagtgattctcctgcctcagcctcccgactagctgggattacaggcgcaagccaccatgcctggctaacttttgtatttttagttaagactgggtttcaccacgttggccaggctggtctcgaactcctaacctcaggagatctgcccactttggtctcctaaagtgctgggattacaggcgtgagcaaccgagcccagcctacccagtggttttttctttagacggagtcttgctcttgtcacccaggccagagtgccgtggcacaatcttggcccactgcaacctccacctccccagttcaagcgattctcctgcctcaacctcccaaggagctgggattacaggctctcgccaccacccctggctaatttttttgtatttttttagtagagacggggttttaccatgttcgccaatattctcctcctccaaaaggcgtgcctcagctgacccatcgaggtttccccgaatataacattaaccaacctatttggagtgttttacccaaacacatgtatttaagccacacaataaccctatgaggtagccattattaatcgtgttttatagatgaggaaattgaaatccaaagatattgatgacagaactgctaagtgatagagtcagcacaatgcctggatggaaattcacttccagaaccacatcttcaccacaaacattgctgtcagggctctccaggtaaccctgtttctgtccgtgcagtgtgcagctaacagaattcccttatctcagctgggaaacaggagtgatggaatcatttcccactcccaagtcatcgccacaaaacttctccttcaaaatttgtctccggaatcacttgttcaaaaagccctttgaatttctctttctctctgagtactcagaatatgcctgtcctataaaatttcatttggcggcttgttttcttcgtgcccctctaatattcaccaagattatatttatttgactttactctcagagtgtactttgtgggggggggacaaaagtgattatttttcctctaatgctgtcgtataaatgctatggcaatctagtacctctcatacgtagggatatgcccaggtcttagggaaaactcacttgtacatatctgtgttattgggcctgtgggccaatgatatttctatttcctgttctgcaactttgtgtacaacaataatttaaagtagcttccaaaggataaaaaatgttctctaagaaactgatgaatctatatttacttatgttgccccacatcctgcacattctttttcttcgaattaactttcattttctttctatctttcctttccttcaggttaataacctttgctggtggggttctccagaatcagctgccaaaacagagtctgagtttcaaggtacttattagggatcaagccctgtggaagacacaggggaagctgaactgtgagggcagcccacagaagcctcccctgccctgcagggagctctggagtgaatactgttctgtccaccagagctgggccccagtgggcgaacaagaccaggcctttgcacccccacctcactcagcatcaggctgtgtgggttgtcctaggaaggggtcgactcaaagaagaagacactgaggagatgacagtgggaccatctgccaactctactcccagaagctgggcagtgaggctttccttgctgggattcttggtggagaatctccctattgatcacggtggcatgaattctgcctatagctcacacggtgctctttctttcttacaatccatgtcacacaggctgtgcttttgcatacaaacagggactatctactgatgcacatactttgtcttctcagtaaagaatttaccaaaatacaaaagagctacctcagtgtccataatctgcaggtgaacctgaaactccaagaaactgaccaggaaagagaagcatgggaaattaagagccctacctcttcatttccagaaacatttccatagggctttcaaatgttcctttagttccttgtaaggagtaagagaagggcccgtatttgcatcctcaggaaggggagggtaagtgtctgctttccccaccctgccataagaaaactccctgactctgtgcctgcatcactgcaggtcctctgagacgcagacacctacagggaaatagacgtgtgaacaacgtgttggaaaaaattcctgtgaaggataaacagagcagcagagaaaaacttcagtctacaatggaggttcaatacctgagaaagaccagagggaagaagggggaccgagcgagcctgacagcacaacatagctctgggaaagccttggccaggctgacgcacagttccaacatagagatggtccattagagggagtcgtgggataatccaattctatttcccttactaggctcagtaataatctggagacagcccaggaatcgtgcatcctctgtatgaatgctgttgtgggtcctaaaggtgcagcagcagctggatactgtcaggtgatagacatgaaaggttattttcagaaggagacatgagcagtgtattcctgggactgctacaatatgcttagtattcagcaccaaatcctcaagaatgggttcatagttgtctctggtcaggctaccatataaaaaaaatgccatagacagggtggtttaaacaacattgatttctcacagttatgaaggctgggaattccaagatcaaggcactaacacacttgctgtccagtgaggagctgcttgttggtgttcagatgtccgtctttctcttttttgctttctctctcttttttttttttttttttttcttgagatggaatcttaccctgtcacccaggctggagtgcagtggcatgatctcggctcactgcaacctccgcctcccaggttcaagcaattctccctgcctcagccttccaagtagctgggattacaggctcccaccaccacacccagctaatttttgtatttttttttttttagtagatacattgtttctccatgttggtcaggctagtcttgaactcctgacctcaggtgatccacccgccttggcatcccaaagtgctgggattacaagtgtaagccaccacacccaggctgttcatctttctcattgtatcctcacatagcagagagcagagagacagaaagcaagtgttctggtgtctgtttacaaggacagcaatcccattcatgaaggcttcacccttatgacctaatcaccttccgaaggctctgcctcctaatattatcgtatttttggttaggatttcaacatattaattttaagagaatacaaacattcagtccatagcaatagttgacttaaaagaacacattaagaaagttttttttttttaatttctctttcatacctgcttaattcctgatcctaaagaagggtctccaaacacactcctcaaattgataactgatacaattgaaacttaaatcaacagatcaataaagaaatagcatcttttttttttctttttttttgagatggagttttgcttttattgcccaggctggaatgcaatggtgcaatctcagctcactgcaacctccacctcctgggctcaggagatcctcctgcctcagcctcctgagtagctggaaccacagaggcacaccaccaggcctagctaattttaaaaattatttttagaaatggggttttcctatatttctcaggctggtttcaaactcctgggctcaacagaccctcccgcctcccaaagggcttagataacaggtgtgagccaccgtgcccagcagaaatagcatcttaaccactggaattagttaagcatttttaaccactgtgactctagtgagaactcagcaccacctcaattacataaaattacaaaattgtttaatgtataccgactatgggccagatacgctgctggatcagccaaaccaagttaaatcaggcgaaatcttgacaggcctctagggtttgacatccttgataaatgaaggataatatcttgtttgcggatttttgtgcttccaaacatttctatcttttcatttagtatgttaccataatatttctatctctctttttgtttttgtcaaagcaatatccataggtcaggacactgaaataatgcatataatgcataaaatcttgtgatgaaaagatgccatcttctgccttcattccattcttaaagtaactgtttctaagcttcttcttctaaagtgattatttctgtccatttctgtggtactctttttggtatttcattcaattctctaaatactatgtttctactaatgtctccggaactatctactatctcttgcctctttgctatgttgaatttcactaacatgctaccaatctgttagtaatgcaaagctgtattaactaaacatttgagcagttttcaaaaataccaccttgagagagttttaggattatcgcaggggaaaagtcagaatgtatctctctagggtcttgggatctacaccagagtggtttaagcaatcgagattgggcattaattgtgacattgtgagacgaagttcttaaaatgattctgggtaagaaatttttgtttgataagcaaaatgttttcccagctgagccaatgagccaacttttgtctcaaaataattgatctgctggaatttcctgaaggcagtagtaaagttaattattgatgattaatcttacctttctcaggcaaagtttctctggtacaaacaactatgtcatgttgacaaaggttgccgtgggtttttggccttaatagctaggtaatgttgatgcaggtggttgtggttctcagctccatgggtatttagcccgtgtatctcccactactatcttcctttttcacctcttctctgtagttatatccctgtttttaattcaccttgtggttatattcagcaacttgaaatagctttcatcactctgccttttttattctagcagttttggcccttgactgtcactctgtaagatgagttattaagacctctacttttctacttttcttccccctttcttcctgccaatttctgtcagctgggctgtgtgccaaggtgtaaaacatttgcgttatgcttttaaccataattacattttctgagctgtcactaatgattgagtcaacaacttgaaaataacaagttgtatttacatgaatgtaataagaatgatacatttctacaaacatttgactgtgtgttgagcacacatttaagttctctctgcatattaattgatttcaacctaatactagacactattattagctcaatttcacaaatgaggaaactggggcacagagaggtttagtatcttgcccccagtggtttgctgcctactcttttaaaataccatgccttcattctctaccctagaacaggcaccctcattctgccatgcctccaatttgttcatttcacagggatttttcttaccctgagccatcccagaggctgttctcagtgttttttgaacttcttctcccaactttacctcaacagttcctacttaccatgctgatatcagctaatatcagttcctcagagagatcttctctaacagggtatcagaagtttcttcttcttcttcttctttttttttttttttttttgacagagtctcgctctgttatccaggctggagtgcaatggcacaatctcggcgcactgcaacctcctgggttcaagtgattctcctgcctcagcctcccaagtagctgggattataggcgcccaccaccacacccaactaatttttgtatctttagtagggacggtgtttcaccatgttggtcaggctggtcttgaactcgaggcaggtgatccacccatcttggaccaaagtgctgggattataggcgtgagccactgcgcccagtcagaggttcttctattgtctctctcatagcttccattatgttatttcctggaagtcagcgtaatttgcaaatacataatcctttttgtgtgtatcagtatactgcctctttttccttcttgacaatgagatgcatgatgtcttgttcactctagtatgctcatagcctaggatagtgttggcacttaggaagtaatcaattttcttcacaagtaatggcctataaaggctcataaacgtaatttcactttctagttaaatacaaggctattatcatgaaaatactattggtcattcagtgaagaatggtggaataaatttgcataaaatctaacacctacaatagaaatcaatttttaatgcaactagacattcatttgctttcctgaaatttgactcacagaagcataataaataaaggacaggtgaataagcctctggaccatggagcagagcaataataatcatccacatttgtaaaggtcttggcactttgaaatgccttcacaatgcactttattccattaatccctcccagtgacattattatgtcatcaaatacgttattcaggattgcacaaacaacacgtggcgggaagaaaacacggtttttcttttctatgtccagtgttcttactcagaccttcccaccttcccctttctaaatacaaattctgaagcagcattctctgaaggacggtctttcctttgacaatggaattgtttttatgttaccatcagtcattttgccttgtctgtagtatttaaaacattctcatttcaacaatagtaactttgatctcttagtcaggtatttgataaagaacaaataaattattcaaacaacatcatgtttagtggtgagcaaaatcctttcaggagatttagccaatatctggaagaagcttcactgaagaggaattggagtggagccttgatgtcacactagaaagcttagatgagggagcagctgagtttctaaatctgcttcatgatactttcactgaggagctttggcactcatgcacactcttaggaaactaccacagtagatagttacagtgtgtttatattttaggacattgatttactcactcattgatgcatttcataaagagctgtataaaaaggattttatttcttaagagattcaaactctttgaatctacctttgcacttattatcaccctgtatatgagattgtgttcaataactacagttttgctgctgcatttcctggttgattttggacttgggctacaacaactcgttgtaataaactttgaaattctgtcttaggccacatttcctagaagtagaatctgagatgggaatttgagtataaatgatttcttgtggggagggctcttgagaaatggagtgatgggagcaaatggaacagagggtggaactcagcaaggatgtgtgctcagcaggaaagcttcagctgatgccagagaaagcccaggagaactcactgtaccataaagacagtcccacctgaggcaagggggctggccttttgcacatccttgcaagtcactctttggctactggttactggggggagaagaggacagctgtgagccatcaacagccaacaatctcagcatttggggggcatggatgcacagcccagtacagggaactggacttcaacatcaacaaaacctgttactctgtccacgtaagtgcaggcattcatccttaaaaatgtgagaaatccacttacttctctaaaacatcaaccatcaccttcagaatgacatagcactataattataaatctaataagtataagctaagtttaggataagcatcttcacccatgtttgagtgacagtaagtcacgtatgtgtcaatgcattcttacacaaattgccccatatatttttaaacgttcaagttggcgtatctctcctcccatttcattcaggtatcacatagtttttgtagtacactgaagcagattattatacagggataagcatttgggagttccaaagaaacgtgagagcatatgcaattgtaggaagctgaggaggaaaatggcccaaattaagaccatccagttatccccagtcatgagagcacagagtttatttgagataaaatgagagattcgattaggaaatgaaggcagagactcgatcatgacaggccttgagtaatataaaaatacatttactattatcttaagaaaaataagtgctaggttccttggctaaccttacaaattaccataaactaggtggcttgaaacaacaataatttattctcttatagtactggggattagaagtttgcaatcaaggtatcagcagggctgcactccctccagagactctaagagagaatccctcccttgcctcttccaacttctgatgactgtgggcaatccctggctgtgactgcatccctctcagctctgtcttcacattgccttcactgggaatctgtctctccctgtctctctcttataaagatagttgtgatggtatttacgatccaccccaataacctaagataatcttctcatctcaaaatgcttaacttaatgacgtctgcaaagaccctttttccaagggtcccatgcacggatttcaggatggggatgtagatatatctttgggagccattatcggcctaccatggtggaaaatgtataaaattatttaaatcaaaggctcagtatgatcaaatttatgttttagagaaaaaaatactccacaagcattatagaatatgaattagatggagttaatactaaggtgaggaaaccttacaggaggtctggtcaatcgttcagatgattagtggtgagaaattgtatgaagacataggtcttgaagaaggagaaatgtggccaagatataattggcagcatgaagggacaggttactatatgggtgagagagatctaggagccaacgatgattcccaggcttctagactgtgcaactgcaggacgatcttttgttcactgaggctggtcatatacggaggaggagcagacctggcgaaaaaggattatagcttccattttggccaaggtacaggaagtatgcagtagaagagggagacaaaccagtgtggtcataactgatctgtccagaagatggctctcacacattttctttgtttccagtttccaacttagttggaaaaataattgctaatttacaatgaaccaacacattgacacatgactgaaatgtttctctatagagtgataaatacatgtcctaaaatgtagaaattatttcctatttttcctccctagggtttcaggacattgcatctgggtgccaaaattctacattaaacaatcagagagggagtcatattgtacacgtagtgcacatctgtattgatccttggcagcctacttacgatttttggatggttgaattgcggtgtgactgtaagataagcaagtggagatgtctaagacacacccaagtgtttggtacctgccaatgtcatctaaagacatttttaaacaatgcacattccattataggaactcaaaagacactagaacccctgatacatattttgaagagtttaaggagataaaacaaaacaaaacaatacaaaaagtaccttctgttcccctccataatttcaactgaggaaaaaggcgtagggatcaattggataaaaatcaaaatattgcttctattaccaataaagctggatttgataacataatttatatgtgaattaacagactttctaataattctctgaagtatactccttgggacaacccaaaaaccaaaagagagtttgggtcttgaagagaacacactggaatctccttggaacatgagtgacatgtgttcccctcccagctttcatgtgttttgcttggaactcccagcacatgtggctcttctgtagggaagttccctgggttgctgggacactttgcctggtcatacagaggcagaagtacccgaagcaacgtttgatcaatgacagagagggaagaaataaaagcccagcttcctcagatccagaacaactttgagatggaactcacagtccctagtacccctgtggccacttccttgcttgggactctactcttgcttgacttccttctatgtctgtcctgcttctcctcctctcttcctgtctcccctaggtgccttacctatgtaaattgtgtgtgtacgccttcctatcttagggtttacttctgaggaacccaacccaactctgagctgtagaatggatgcagttcctcagagtgttgcttcaactttggcacctatagacagctccactttttcatgctaggcctttcaattccaaagccttccagatgtcatttctaaactggcaagatttccaccctttcaagctgtgtgcattctcttttggaaatcatgaaaacatcacagatggccttatgatataaataattagtgaagaagacaattattgctcatctgtgatgaatcaagcttctttttatttagtcagcaacaagctggacatagtcattacatagccctagggtctacgcagccacacagattataagtttgtcctgtatttttgcctcatggggtcatgtgctaaatatttatatgaaatgtcactatcatatactctcagactatcaatttctatgttaatatttttcttggcaattgctctgcaggcaaaactacagcctatatgtgtaatagcttcacatgtcagtacttttcttaatgtctcataaaaagaaattgttcctctgacaatttaactaagatacccaaaagagccaaacaagtctttcaacatcctctttaatgacttcttgttgtttttattcagttttatgaaaacatctaatttcatcactctctctgacttttattgatttaagctggcatgattaccctttataactcaataagttggcttcagaagtacacacagtcatatgtcacttaacaacaagaatacattctgcaaaatatatagttaggcagtttcatcattgtgtgaacatcataaaatgtacttacataaacctggatgtataacctatgacacacctaggctatatggtagagtatattgctcttaggctacaaacctgtgcaacatgttacgtactgaatactgtaggcaattgtaacataatggtaaacatttgtgtatctaaacatatccaaatatagaaaaggtacagtaagaacaccgtattataatcttatgggaccactatcatatgtgtggtccattgttgacctaaacttcattatgcagttcatgactatacataaagattttcttaggtaggatgatcaatagagagcaaactggactaggagtcagagaatccagctatctttttgtatctgctttaaattgtttaacgaccaagacaaaattaccaaacttttaactttgtttaatcaacttttgagaaaatgatttttacattatgatttccaacatctactttagttccaaagttttctgactctgggagctttaatcatacctcattggaccaaatacacatctgcctttgaaaaaagattactaattagcatttacattaatcaaagtgtgatccttgaattagcaatatcaacatcagctgggcatttattagaaatacaaattataggccccatcctagatctactgaatcagaaactctagggatggggctcagcaatttgttacctgtcaaagtttgagacccattgatttatacaagtcaaaaacaatcgtcatggtaacaggaactgagttttaccgacaagagccagtagtcctccaaattactcaatgtggtttgccaatggccacccaagagcttttgattcagtatatttggaacagcttccaggaatctatgttttaaacaaacaatagagaaaatttcaaggaccaactttagacagtgattacctaaagacagtaactgagttgctggtctgccctcctggcaggtgtcacagagtgagtactctagacctaattaatggaggaaggaaaaaaaggatggggaggagataaacagagcaagagacagagatgcatgtcatgtcagtgtcatttcctcaaggctgggaagtctagaacagtatcagtgctcccatttgttgcatgtgattactacaatatcaactcttactggaacaaactacaaagagtccttgagaacaaacgtcctgagtattttttatgttcagtcaatccttggtatccatgttttctgcatccccagattcaactaactgtacattgagaatactctgggaaaaagaaaatagaaaataacaatacaacaattaaaaaacaatacaaataaaaaatactgtatgacaactatttgcataagatttacattgtattagattattataagtagcctagagatttaaagtatacaagagggtgtatataggttacatgcaaacgtgatctcattttatttaaaaatattgagtatgcataggttttgatatctgcagggtcctggaacaaatcccccacagataccatgagatgtctgtatttttgcttaagtgacaagatgaaacaaggcaacactataacatcctactcactatggagcaaaggataggctatattgggtatataaacaagataagggtcaacgaaaaaaagtgtataagcctctattctccctcatctcacagaaagggacactattcctgagaatagctactgcacatgcagtaggtttgcattttaagagaggaacactgttcacctcatttctgctactctatcttcttatagtacaagtgtgaaagtgcacatataattgagaagaaaaaaattggaatttactcaagaaagtatatgaatttacagaatgtgatagttttcaaatatgttcactaattgtcattccactttttttccttcaacttttattttaactcaggggtacgtgtgcaggatgtgcaggttttttacataggtaaacgtgagccatggtggtttgtaacacagttcatcctcatcctgttagctgggtattaagcccagcctctattagctattcttcctgctgttctccctccccccacctcccaacaggccctagtgagtgttgttccccctcatgtgtccatgtgttctcataattcagctcccacttataagtgagaacacacagtatttctgcatcagtctgctgcagataactccatccatgtccctgcaaaggacataatctcattcctttttatggctgcatagtgttccatggtgtatatgtactacattttctttattcagcctatcatcaatgggcatttaggttgattccaagtctttcctactgtggctatatcactcccctttttttttcttttttttttttgagacggagtctcactctgtcgcccaggctggagagcagtggcgatctcggctcactgcaagctccgcctcctggcttcacaccattctcctgcctcagcctccggagtagttgggactacagatgcccgccaccacgcctggctaattttttgtatttttagtagagacggggtttcactgtattagccaggatggtctcgatctcctgacctcgtgatccacccaaagtgctgggactacaggcgtgagccactgtgcctggccgtcactccgctttttaaaatgtgaaacttaagatccctcttttttaatttccaggcttagtggcccactcctataaaatagaatgtggtggatgattgcagaaattaggtcacagaaagcatttccttctgtgaaatacttctgtgaaaggcttgattgcttctgcagagatttttcacccatttggggatgccagctccgatactgtgggaaaatgcaggcagtctgtgggaagtttcttatggagaggtactgaggccacctgccaacaatcaggcacaacctgccatccatgtgaatcagccactttggaagtggatcttccagcttcagtcagtcttcagataactaataacaagccttcagatgaactaatatctatgacttctaggaaagatgaccacttgcctccgaaaacctttgcacagttgcagcaagtgggaggactccacaggaagcgctagaggttagatgtgggcaagctctgccgctggagtacaggcagtgcctggtcctgccaagccattgtcaggcagtcagaaagagctcccaggatcattctaaaaatcttgcttatcacttcacatatagcaagcttcagtcccaaggcaaacactaccaaaccctactactttgccttgaaaccacctgaacgtggcatatggtctgaaaagaaaagagaataaataggaaattttaggaatttatactgtggctgattctcttgtctctttaattatagaggtattttatatatcatgtttgaagttgtttaaagcaacaagctacaaatggaagtaaacaatcaagccttagtcactcaaaggcatcacttgcattgttcacagcaacttcttggcaaggacatgccatgctagtggctcatcagtgatgggatagagcacaagccatctgagcatggaagatccacaagataggatgggcatccacgaatgtatccagagcagtggaaaattctctagaaatcagcaatggtgacgcctttgattgacaacagctgttcaacagcacaaagcaaaaacgaaaacaaaaaacaaataatctgatcaaaaaataggcagaagatctgaatagacattctcaaaagaagacagacaaatggctaacagatgtagaaaaatatactcaatatcactaatcatcagggaaatgccagtcaaaaccacagtgagatatcctttcatcccatttagaatggctattatcaaaaaaacaaaaaataccaaatattggtgagtatatgagatctcctcttatacactgttgaaaaaataatcagtatcactaatcatcagggaaatgcaaatcaaaaccacattgagatatcatctcatcccagttagaatgactattatcaaaaagacaaaaaaaaaataccaaatgatggtgactatgtgcagaactcctcttatacactgttggtaggaatgcaaactagttcagccattatttaaaacagtattggaggctcctcagaaaaattgcaagtaaaactatcgtatgatccaataatctcacactgggtatctattcaaagaaaatgaaatcagtatgtccaaagagataactgcatttccatgtttattgcagcagtgtttacaatagccaggatatggaatcaatcaataacaaataaattttaaatttcatatgtatacacaatgaaatattattcaatcatgaaaagaatgaaattctgtcatttgcaatagcatgggtgaacctagaagacattatgttaagtgaaataagccaaacacagacagaaaaatactgcatgatctcattcatatgttgaatctaaaaaagttgatcatgtaaaagtagagagtagaatagtccttactagaagctgagaacagtacggaggagaaggaatgaagagacgttggtcagtgggtacaaaattacagttaggaggaataagttctggtgttctattgcacagcagtgtgactgtagttaaccataatgtattgcatatttcaaaatatctagaagagaggattttgaatgttctcactaaaaagaaatgacaagtatttgagatgatggaagtactaatttccatgatttaattattacataatgtatgcattattgaaacttcgtgatgtaccttataaatatgtacagttatgtatcaattaaaaacaaaataaaacaaaaataaacaactgtcattttgaacgtggcaatgggagacttcaacatagcaattcagaagataagatcaataatcaatgcaatttcagccattgtgcttccctgagccttcagagtagctgagcaagtcctgaggagggtggagtcctgagctggttgactctagtgagaaccaaccacttttatgtaccccaaaccacaggtgtgtttggtatctgttaggataagctgggtaacacttttcaatattaacagagattaaaactttattgtttatttcttgattgtgacatattggctgagcattctggtccacatcattggctttcacagatgcaagcttataaatcctccaccaccttgcacattgctaattgctacagcacaggttaggaaacttgacaaaccaggcaatggctctgaaagcttcagcctagaagtaacatactttcaatggctaaagtaagggacatgtgaggcctacctttaggagaacagaggatacaatacttcaatgtgtgcagaaggagaaaaactagaaatattgaccagcatgaatgattaccatgcctataaatgttgacattttctatgtgatataaaaaaagcctaggaagctctggtctgtatcccttgataagaataagcaacaatttccaaaatatactagtcatcagatggtaccgcctgggtgatgggatataattttaaaatgttttcaatgtggggtgggcaaatagagatatataagaatatctcttatatatgtacttataagaataagtacatatcttggcctttactgatgtggccaaataaaaacaaaactcattgactatctacaatgaccacttacatacttctttgtatcttttttatcacatttaggtaaagtaaaacatatcagcttgtaggcaataagtagtttagacatcatagttagggataaaacactttttcttccctcctctggtttccatgaaggggtattttccctgaacacacctcaacccttgcccaactcctcactcagggaaatcaggatgacttatcagaatctgagcttggaatgaagactggttgtgcatagctcagccacctcccttctcttctaccttatagccagattgcctgcataaaataacagtccaatattcttctccggaatctcctggagattttacactgatatatctgcaattgggaaacttgtgatggttgagatgcctatggctgagtttgaaatgtgattttgtggttcaataataggatgtccccttgtttctggatatttagaacaatctattattatctgaagtcctcttcatatttggattcctatttttttcaatttcttagactatctctgaatgagtttccagctagggtgagcaatagtaagactcttatttactggatatcctcaacaattcctctccccacaaacaccaatactgaattccaagcagctcagaacatttctgaaatcactgttataaagatatttcattgattttgatcagtaataaaccatttattgatctactatttcctacacatgaggcaagaaacaaagtataagacatgagcccacctcataaagaattggtaatatgggatgtctctccttgtaaaaaagctgcaatttcatcaaccaaaatgaaagcatcacatttttttatttcctgtaactgattctttttgttctataattcaaatttttgccagtgcaaacagagacttcccatttgacaataatgtatttccttgattaaacagtctttacccttttattaatggggttatttgttttttgcttggtgatttaagtactttatagattctggatagtaggcctttgttggatgtgtagtttgcaaatattttctcccattctgtaggttttctgtttactctgttaatagcttcttttgcagtgtaaaaactctttagtttaattaggacccacttgtcaatttttgtttttgttgaaattgctactggagacttagccaaaaatcctttgccaaggccaacactgagaagagtattttctaggttttcttctaggatttttatttggccaacaaacatatgaaaaagtgctcagtatcactaatcatccagagaaatgaaaatcaaaaccacaatgagatatcatctcacaacagtcagaataactattattaaaaagttaaaaaaaataacagatgctggcgaggctgcagagaaaaaagaactattatacactgttgctgggaatgtaaattagtttagcctctgtggaaagcaatttggagatttctcaaataacttaaaactgaactcccatttgacctagaatgccatttcttggtatatagcaaaacaaaaataaatcattctatcaaaaagacacaggcacacatatgttcatcaccacaccgttcacaacagcaaagacatggaatcaacctaggagctcatcaacagtggactggataaagcgaatgtggtacatatacacaatggaatactagaatgaaataatgtcctttgcagcagcatgtatgcagcgggggcccttatcctaagcaaattaatgcaggaaccaaacactgaatactacgttttcacttttaagtgggagctaaacattgagcacatgtggacataaagatgggaataacagacactggggactactaaagggaggaggaagggaggtgggcatgatttggaaaactgcctattgggtactatgcttactacttaggtgatcagatccctactccaaacttcagcattgtgcaatatacccatgtagcaaacctgcacatttaccccctaaatctaaaataaaagttgaaattattttaaaaaatttttaaaaagaatctttagtcttttccatggtaacattctatgaacttaatgtccgcagcccctatgactttcatttcccccttctttcctaagatggcttttcagtatagaaaaagattctgtgtgtagttcatatactcttctgtgggttatcctgtggtccatatactcttgtgtggatcatcagaagcctcttctgagttgttgttttcctgcctggtacagtctggggattgggaatggttccatagcacctaccaccgtcaaccataaatattaccatttgcctttcatcataaagatggtgcattttgcagccacaccaatcttcttttcaatgccacaccaatcttcaggttttggggatggtgaatggccatcaactcagaaaagtcaacatggattaacctcaagatctcactgcaggtatgatgctaaattcatgtggtccaggatatcctttgtatgaagtttctcaagactgcaggtcttctgaaaatccccatgctttctcactttaccaaactcttctttttcaatgtattcatggtaaattcattcataccaaaatataacaattatgttcaatagtttttcattatgcaaattactttccaaaaataatcactgccgttattttggtaccatcttttcagatacctttactggctctttatttattcaagaaatagtatttattgcctgaaaggggtggcaaagacagagttgagtttttgaaaaatcaaatgagtttctggttggaactttatttttcatagattgtgaagatatagtattgaaagtggagatattggattgtgagagccatgtttttgagagaaaagtagaccttttgagttttaagcctggttttgaatattaagagctaaggaggctggaggactcagaggacaagattgataccagaagcagtagcacagggaagaacgcacaagactgtcaaagtaatttctggggatagatttagtgtaaattgttgtgggagcaatgagaactgagaaaagtaagtaagagttgggtgttgataagaatatttgagagagctttgagcttttcccgaccaatggtgggattttgcactggaccagaactcagctaatttctcagctcatataggactccactggtgcccacccagatccccttcacctgcagaggccccatcccacagctgctccaagttttgtttgcttaggcccttagctagcccctcctcagagaattgccttcacccaataggaattgcctctcctgcgatagcacacttctccacctgtgcttccaagaagcagcctacagccaatgattgaccgatgaaggatacttaagcccagcccccttgcctggaggtgaaagaagtctgtggtgctattcactttccacagcgactcttggaatcgcaacgaggctggactttagctaaaaccacaccacttttttttctaagttctttcacttctcctcattgcttctctcactccctcatagtaacacttcagggttattataaattcaaaaaattaactttattcctctgtaactaaatttggctttgcatcagtttctactgttatcagaaaacctaatcttgctcaaagtaaattcagtcacttctggtttaaatttcattaggattccacttccatctctgttcctccctgttctgagattggagaatggcgctattggatataaacttttgttggcttatattttcttccatggacccacttgggaagcagtacagaagtactgtaccacacagggagtcgggtgcctgtgatttgatggtgcactgcttctcatatgccttggggcagaatgggttgaaggtggcttagccccaacacaaattcaccctttatcttctgaatccctgagtgtcacccagattccattccattaataatggctaagttacatgagtttcccagtcagcctctacccatcaaaagcattcctatctctcttcccacctctctgtcgcctggaataaaaatgcttgtttaaaattggaaatttttgatttatgaaaatctatttctttggctctgcttgaaaatgcacgaaagataatctcatgtatttgcatcaaacgctccatcttttttctttatgagatctcttgctcatcttcaggtaaaaatttttgattgctttttttttattggtgtggaaaatagaaaagggagacatgttttccacactgtcaggtttcaaagctcttagttatgctagtcagtcatagaaataaacagctttaaactattttcatgcatatttatatccacacagcaaaaaatacaagtcaaggaagtgttttctgtgtgaatgtcaagtgaattaattaatagcttcctagatattggcgaaatttcatttgactctttattaaaggttgtaaatggatcccctgttatagtattgcattggatcgtgatgatgaatcgtcagcaaaatgcctgactggaccctgggattaggggactggaaaattgacaggagtttcaatactgtatctcaatgccttctcgggtagctgttcaggaaagcaaggcaaatctttgcttttgtcttgggttgtttggttttctattgttttaattattaaataaatcagagggacagaacttaaaaaggaaataagcagtgggcccttgtgtgcccaccaacaaacttaggttataaagttttaaatattcatccctcatcccatttcccaaatgtttttcttcttccaaagaagctaccagcttgtgatgtttatcacgtctactcattggtaataattctacttgtgtatgtatcaatcagtaacatacaggattctattttatgcttttaaccttaaatggtatctacatatggtgtttccttcaacattataatatttagttgtgtttttttaattcacactactagatccagcactcatatccacttctgtatagtgtttcatcataagatgaatccatcctcttcttaaaatattttttatttttaatttttatgaatacatagtaagtgtatatatttgtggaatacatgagatactttgatacaggcatgcaatgcataataatcatatcagggcaagtaaggtatccatcacctcaagcatttatcatttctttgtgttacaaacaatccaatcatatactttcagtcatttctaaatgtacaataaattgttaactatagtcctcctgttgtgatatcaattatgaccttatttattctatctaactatatttttatatccattaaccatcccccgcacccctcactacccttcccaacctctggtaagctttattgagttcaattgctttaatgtttagctcccacaaatgaatgagaacatgcaaaatttgtctttctgtacctgacttatttcacttaatataatgtcatctagtcccatccatgttgcaaatgacaggatattattcttttttatgactaaatagtactccattgtatatacatacattttctttatccattcatctgtcgatggacacttagattgcttgcaaatcttgactattgtgagtagtgcttcaataaacgtgggagtgcagatatctcttcaatgtactgatttcctttcttttgggtatacctagcagtgggattgctgagtcatatgatagttctagttttagttttttgaggaacctccaaactgttctccatagtggttgtattaatttacatttccatgaatggtatatgagggttttcttttttccacattgtctccagcatttgttgttggctgtttttggataaaagccattttaactggggtaagatgatatctcattgtagttttcatctgcatttctctgatgatcaatgatgttgagcatcttttcacacatctggttgccatttatacatcttcttttgaaaaatatctattcatgtattctgtccagttttaaatcagattattagctttttttctcttgagttgtttgagtgccttatatattattcgtattaattcctcatcagataatttgcaaatattttctcccattctgtgggctgtctgttcactttattgattatttgttgtgcagaagctttttaacttaatgtgatcccatttttctacttctgcttttgttgcctgtgttttggggttattactcaaaaagtctttgtccatgccaacatccggagagtttcccccaatgttttcttttagtcttaatagttttatagtttgaagtcttagctttcagtatttaatccattttaactttacttttgtatatgttgatagatacggttctagtttcattcttctgcatatggatattcagctttcccagcactatttattgaagagactgtcctttccccaaggtatgttcttggcacccttatcaaaaaagagtttgctgtaaatgtatggatttattgctgggttctctatctgttccatcagtctatgtgtctccttttatgccagtactatgcttttttgtgtactatagctctgtagtataattcgaattcaggtaatatgactcctctcgttttgttctttttgctcaaaatggctttagctattctgggtcttttgtggttgcacatacattttaggattttttttttctacttctgtgaggaatgtcattggtattttgataggaattgtattgaatctgtagattactgtgggtagtatggatatcttaacaacattgattcttccaatccatgaacataaaatatttttctattttttgtattgctttcagtgtctttcatcattgttttatactttacattgtagagatctttcaactctttggttgagtttattgccaattttttttttttggagctattgtcaagggattgcttctttatttctttttcagattgttcattgttggtatatataaatgctactaatttttgtatgttgattttatatcgtgcaattttactaaatttgtgtatcagttctaaggtttttttggtggagtctttggtttattccaaatataagatggtattatttgcaaacaaggataatttgacttctttctttcaaatttggatgccctttattttattctcttgcctgattgctctagctaagacatcaagatttattctctcaatgattacattgaggctgtttccattttttggtactgtaaataatgcatgaatgataatttcacatctctctccttatgtttattggcaatattctttccagaatacgtattgtcaattttactagttactgccaaagttttccaaaatgatggcaccaatttattccatcacaattagtgtaggagactctcatcattccatcttcttagcaaaatttgttgtacactactttttactgaattaatgggtatgaaattgttttttatatctgttttaatttcaatttcttggattatacctaatgttaggcaacttttcatatatttattgggcattactttcttcttgcttgggaattgcttgtttatatattttcataatgcttaatttaattttcttctgagttgtcaacatttatatatctattatatatatctttgtagtaagtctgataatttatattcattcaaatattgtcttgatctgtggcttacattttactttgtgcagagtatctcatgaagcatttatctgtttttatttatgaagtttttatttattgtatcagttatatattgccttataacaaatcactctaaaaatcagtagcatagattatttgtttgctccattctgtggattggcagtgtgggcagaaatcatccctgctctctgtggctttggctggtctcactcgtatttatggtcatgtggcaggtctgctggggaacagctggtcccagatggcctcactcatatgtctagctgttggctggaacatttagatgaggtacctttgttctcctccacgtggtacctccccctgattggctaaggctttcctctctcttagcaaggtggttgccagagggtggcggtgcaagcttcatgtctcttgaggcctagcttggaagtcgcccacatcagtcccactgcttttgatttctcaaagcagccgcaaggccagcccagattcaagatgtagtaaagctacagattccctctgcatctggatgggcaaagcatcaacatcacactgtaaaaggagatatgccagaatagaaagaatttaaaatgtaacttagtcatacttaaaaggtatgtatcaatgttttactttaaattctgtatcttttgtatcttgaataaaaattcccccactctaatttcataaagatattactttttttttctaaatttattagagttttattttttacatttagggcatttaatccagctgaaattgatttctgtgtatgatgtgaactaatctcatgttttcttcatgaataacaagctttgtcagtagcattcattgactgttccatcattgcagtgctggtttgcaatggcacttctgtcatatttaacaataacattgattaagcagaatccatgaggcaccagcaggtaagaactttataattttcttccaatgtgctttcaaacacattcacttccctacctgagtttggaatcagctatggaaatatcaagaactgaagcagatagatgtcaaaatatcagccttcttgctagataaaagcaggattaaaggacatgacctacatgtttaacatcaatgggcttgttaaccctgaggtcccaaatcgacctgccaacctgcccagagctgtgctgaacagtcacattaactctgaaggaaaattgcaatgtactctcctgctggactgggtgtactaacaactgaatggaaacggtgtgagagacaaaaaatgtctggagaaaagtttaatgcttgagtataaacaagaaaataatgagactttctaagattttatccaagggacaggttaacttcattctgccctacattattggtaccactgtaactaataatcacaacagctaaccatttcgaacaccttaccatgtggcaggtacattaaaagcttttaaccatcaagtaaaatgtatagggtgtattagtccaggtgctttaaggagaagacactaaaacaagattaggtgtgcaagagatttactaggggaaattgctgtgaaggaaaattaggaagagttacaggaggctgggagagccatcagactccaggtaaagaaaggaggaaagaactgaagatttcatgaagagtctttgcagtgtccatgctaaggtatttttccaaagctaatgtggagtctatcactgctatgtgaccacaaatgtagtggcttaaaagaaaacaaatgtattatcttacagttctgaggtcagaatttctaaaatcaaggcactggtgaggttacacatcttttaggggcttagagaatccctttccttgccttttccagagtctaggagccacctgcattctttggcgtgtagcttctccattctcaactccacccctccccgcaccatctctgacctctgcatctgtgatcacatctcctttttctgattctgaccctcttgcctccctcttagaaggactcttgtgaccattttgggccaaccgaggtaatccaaagtaatcttcctatttcaagatccttaacttattcacatctgcaaaattccttttgccatataaatagtaacaggtccaggggattaagacataggcatctttcagaaaccattattttgtttgccacagaatcttcaagctaaaaattactcatcagagaagcccatgaaatgggcttcctttaacatccctgctgttctcacttgtctgggagcagctcaggggaggtgatgcccccactgaaaacacaatcagaaaactgggaggctgattttcatgaccaccacaagaggttagcagaggaaacaaagacatactgagggtgagtaacttatgtacgaatacagagccagtggaataatctctctttctctcccacatgctccttttctcctggtctttctctctctcaatctcttggtcccctctttgtctatatcttaatctctgacttttttgtttttgaattttctgttttggagcctgaacacagtgattgcttttcgatggtgttataaaacttgccaagttttctctgattctagtaactagtttgccaaatgggaaattatcaaaaataatctaaaattatgaggaagtagaataaagtccctccatagacctgatttgcctcctttcaccaagagaatgttacagattggatggatatggaataaacactgttggtcctgtatcaatggctagagtttaatttgaatataatagtgaattatgcttaatgacattaaaaattggccaggaacggtggctcatgcctgtaatctcagcagtttgggaggccaaagtgagtggatcactaggtcaggagctcaagaccagtctggccaagatggtgaaagcctgtctctacaaaaaatacaaaaaattagctgggcatggtggcaggtgcctataatcccagctactagggaggctgaggcagagaactgcttgaacccgggaggcggaggttgcagtgagttgagattgcaccactgcactccaacctgtgtgacagagcaaaaccccatctcaaaaaaaaaaaaaaaaaaaaaattaacaactaaaatcttggtaaccaggtagccctggcctgttcctcagtagctccctgagtgcaccacagacaaggagctttgaaattctactccaaacaccagagagcacacatcttcgaatgcagtactggggactcttcaagggtcaatatgtatgggcatcaaaaatatgttggttcctaacccaaatgcccatcaatgacagactggataaagaaaatgtggcacacatacaccatggaatactatgtagccataaaaaagaatgagttcatgtcctttgcagggacatggatgaagctggaaaccatcaaaataacacaggaacgaaaaaccaaacaccacatgttctcacatataagtgggagttgaacaatgagaacacatggacacagggaggggaacatcacacactggggcctgtcagggtgtggcgggggaggggagggagagcattaggacaaataactaatgcatgcagggcttaaaatctagatgatgagttgatgggtgcagcaagcaaccatggcacatgtatacctacataacaaacctgcccgttccgcacatgtatcccagaacttaaagtataattttaaaaaaaatgttggttccagaagaatttgactttgacatcagatattgaatataaataaacctacttacatgctatatcgtagtaaatatattcattctattaagcctaaatggttgtatactagcatgacatcaatgctagtgattatttgtcataattctaaagaagaaattattagaattctaaataatagctgtatatgaagccatttcctcccaagaattcagggagtttctaaagtaaagcctcagacagacaaatccaaatcaaaaaactttccctccttcatcactagagaaagactaagaggatagtttgtcaagaaaagactctacggagagataaaatgctgaaagttatgaacatatggtacccaagggttgaacatttttaaaaaatggccttaccattaagaaaattggcaggagaccttaccatattattacactatactttctaatattttcttcttccagattaaactctaaccaataatacaaaggtgttttatttcatatccatcctttcaataaaaatctccacaaaatttaaacatggtagccagttacgtatctaactcattagacacattgccgttccacatagtgaaaaatgatatttttggatgtttatttcatttcagaaggagagaaatctcagaatcccaatggccccattttggtctttttttttgcaaagttccaaagtaatgaatcagtagaaatgtttgtaaagatactaaaaggttgatttcccattttaaataagtacctctattataaaaagatagagatttcaaaaaatacaaattaggagagaaaaatcaatttcatttctgggaaaatctgcagtgtgtttctcatgagaaaacaacaaaatatggattttggctttcctcctctttattctccacagggatgcaatttatttctttacccccaagacctttctcccctttgatgttcttgctgtctgacctcgacctttccagatggaaggattgcctgaggcctgaaaagattctattttccagttgaggctgcagcatctgcccttctttcttaaaccatcaatgaggctagagtgagaagaggaaggagaggcgctgtcggtggcattcatctttaccctacatggctcatgcttttttttttttttttttttttggtacacgcaaattgctcctttagaacctgaagctgaaaaaaacatttttttaaaggggtgtgctgagttttacaaaagctattgctttgcttcatgtaccatttactctcagggctgaacaacattcattaacaaatatatcctgtgccacttttcatgcagtgattttttttactagttatttcagtctgatctcctatgtcatgctggagatacatcagaaagaaacttccggtcacaaatgttgctgacctcaaataaggaattaagaaacctaaatttaaactatttggtgaatgcaaaatttgattctcaaaatgaaaggctatgtgatttttatatcagagtgatcaatatatattatcttatatttttaaaatatttattttgacatatacttatctgatccattatataactgaaaaatctcttgggacaatatatcatatattaatatttattgtaactgcaatagtaataataatagcaactaacactgagcacttaacatggaaagaacatggtattatgtacattatatgaattccctttttaaatccttttagcaattctatgaggtaaatactgtgatgctgcttattttacaggttaataactgacacaaaggagataaacttgcccaaggtctcccattttgtaaatggtagagtggaagttgacatcagatctttctttccaggtactaaaccattattttatacaactctaaagaatgttattgaatttcttcacagacattcacagaaagtttatgcaaggagagggactatactaatggtaaccaaaaagaacatgttcacagtctgttcagatatgtgccaatctttctgtactcctcggtcaaacatacaacaatgtttctgccatggatgatcaatttcaggtcctatgatatcccaatagcagagcaaagtcaaagaaacctgacttattactaagaatatcactgagtgctcttcagtctctttcagctcagggcttttcaaacattagcacatgtaagaattatctagagagcttattaaaaaacacattcctgggcatcagccttatatattctcattcaacaggtcttgggtagaaccaagaatgaatttctctactccagaaccagttgaggctgatgctactacacagtctcactttgaataacactggtctagtggataacaataactttctacctgtaagttcagttttgccaaagatggagggtctagatctttagtagacatcactagaaagcttgcttgaagtgaaagctgcagaacgccaacaccagaaattcttgtttatctgatagtttatgggagaaactttgagaataagtgctggtctctaaatcggtgaatgagaagctttgatgtataggtgaagcgttcctgctttttccaacgagggtctagaaaatgtctgaagttatattacctcctgtctcataagcttgatatttagtcctctagttatatcctcatctttatgactcaacaaatatttacttcatgtccacatgtaccagatattgttcaaggcaaaaagcaaaacaaaacaaaacaggaaatgtccatgcacacatcaacttacaattctcttcccaatttccactcaggaaaccccagttagccagggaactgcaaacctctaccctcctgcctgcaacccctttccctagtatagatcatagggttagctcccttgacatcaaccacagggcattatgctatgatgtaggcatcccacctgaggacaaagattgtcctgcctagaagtcatagtctcatctcccactctcttacaagtgttgaccccttggaaacagagttcattaggcctccttggacctgatgatttggaatcctgccccttcagatggtaaccactcccttataaaaggttaattccaagcagtcagcccttcattcccatcaagcattcccagcgtgagccttgacaactatggcaatctcagaccatataacctcacctgactcttcagattcctgctgtggtagaactgattctgtttcaagtggtaaacgactgggggaccagtaattgcaggaagcagtgtgagaaagagtagaaagaagttatgctttacagagcatcagaactactacctgaatttaccacttaatatctgtgtgattgtacacaagtttaatgtctccatgtctcattttccccatccagtagaattgctctgatcattgatgagaccaagttggtaaagtccctagcacagtgcttgctataaaatagggatggaaatgattggtcactatggtaatgttattgcaaaagtaacccagtattcctcctttccctgtgtccatgctcctgtgcaatgtcacctgcagttcctccattaagaagccaaatctacttctccaactcttgagtctgggcaggtctccaacttgacttggccaacagaatgtggcaaatgtggcataagccagtttcaggccttggtctcaagaagtcctgtgtgttctgctcattctctgggattcctgtccgtattgccatatcaatatgaataagcccaaaatatgaataaagcccaaaatatgaataagcccaaaatagcctggtggatgatacagacctcatgaagcccacttgtcttgtccaagtcctcaggtatatgagtgagcccaagtgaaactgcaaattgaccttattgatttgcagctgaaaacagaggcatgagccagcccagctgaaatcagctaactgggcctctaccagcaggaccaccaagccaacctataaactattgaaaaataataaatggttattgtactaagccataaaattttagggtggtttcttatatagcattatggtcgacatagataaacttcactgttcttttccccaattccttcaaatattttgttcaatgttatacatcaaaaatcaaaactaaaaacttctgtgtcccttttaactcctttctctccctgtatcccaacacaaagccagtcagtcaccaaccgaaaatgacttggattcaagtgtcctgcagatctcctggcaaattttcttccctgggaaagaaagctcttccccattcgtttttccagagaagccagttacatgaaaagttcctaataccagtttatatccagcctgcctcgtgggttggacaattacctggaacagaacttcttctgggtcagatcacacaatagcaatggtttcctacttctcactgaagctgcaaaggtctttggacacaatgttgttcagtactaagccccttattttgttttattttgttttgtttagttttgtttttaaccagctttctcaggttgaggaaggcccctgtttctgaactggaccctgtctcatgcagaggacttggtctctatcccgcccttgtctatttcttcctcctgtcatgcccagtagcctgacatcatgactgtgctctttaccactatatcactaacactggttcattgaaagtacttttaaaacgtgtgtttgatgggaaaataaataaaaactggataaattaatattcttcccactgaaaacatctttctccccttttccatctattaaaatcaaacaatttatgtaaaaggcagcttaagtaacaatcacaatgtattatttgcacctctccaggtgcagattacttttctgcgtttttaatagtttattgtctatctgtctgatccttgaaatatatgggttagtgcaattaaaatatcgcaaaacctgcaattacttttacaccaacctgtagtataaatgctgaatcatattctcaaatgaaaattgttccatgttgaattggagccatagtatagaaacgtctcttaactctaggccgggcacggtggctcacccctgtaatcccagcactttgggaggccgagatgggtggatcacgaggtcaggagatcaagaacatcctggctaacatggtgaaaccccgtctctactgaaaatacaaaaaattagccgggcttggtggcgggcgcctgtagtcccagctactccggaggctgaggcaggagaatggcatgaacccggaaggcggagcttgcagtgagccgagattgtgccactgcactccagcctgggccacagagcgagactccgtctccaaaaaaaaaaaaagaaaaaagaaaaaaaaaagaaatgtctcttagttctaaacaaggaggaataaatataaaaggctaactaaccttaatattcaaagcaccacaaggagcttggagatgtactgagcaaaaagaatgaaaagatgcctcagtctgctgtatacaatataatgctgtgtaacaaactatcccaaatttagtggcttacaagacacatttatttcctgtttatatgtcttcaggtcagctgagatttggctgatctaagctgggctcaaccaagcttagattcaagctgcagtttgggtccagatcttaactatagctctcatccttcttagaccagtagtttccagaggcaggctttcctcatgataaaaggcaggagcacaagaagtcgagttcaaccatatatcacatttaaagctactttatgcaacatatccactaatgttccattggccaaagcacttcacatggtaaagctcaacataaatgagttgaagtatactctgcctactctaattggaggaactacagaggtacaaagagtgtgactctgggaagtgttcaatagtggagaacacaaatataacacctgtggttggaaacttaatgaatgacaaatagaagtattttgagcttactagaactaagacaagtaattcaattccaaattgctgtttcctcactgaatatacatgaatctttcattttatatacattataggctaaaggtcactagaaaagaaatgtggtattataaataagccaatcactagtatgcatttttagatgacaacacaggacatacatttctaccctcttttcttctgttcagctgaattataaccttcaaaaagactatttaatttggaaatggcactagtaactagaaacagctttgatattaatttattattgatagaaaatttctgtttgtgcatgaattttctgctttcagaattgcctctgagatcaaaaagagtctttgttttgtttaagaaaaatacattattggttaacataccatatagtatagataatcttataaacacataggaggtatgaatttgctgctactatgattcaaagtcaaagaaatgtcacatttctttatgctcgttcagtcatattaaatctaacttcaagtctgggaggaaattgagtcttagtcattattaggtgctatcccatgatttcccattgaccttacctgattccctcttcctccactctgcaatgccttgaattataccagggatgtcaagcagaacagaaccctttgggaagacatgttgatcatcttccagctagcctaacaacccctgaagcctcagagctctgcagttttcaaggcatcttcagacaagaatcctcatgaagcatggcatttcatcaccactctatccaacttcctagaattaccacagaactatctttttgaggtcctgatgacttttggagcatctgagacaggaagggaatattgggttactacttcttgctagaccagcatattagaccagcatataaccttccactcttgttataacttcttttccctccacttatttatgattctcatatttgacaatcactcatctcccttccctccaaataaaataaaggtctaccttcttggaagtgcctcacgtaatcttattgagatttagcttttgaaagatcaaacaagaaaagggattttcttaaagatatttgcttttggctctaaggcaaaaattttaactgagtcagaggaataaagaggttgggttgggtggggtgcattgggttgggatggggagtggtggaaacagagaatagaaatcacgaatagccctcagtctactgcttattacatagcaggagattcaaaacacaaattaataaacctataattttcctgccacaaagctatttattttattatcattttatgtcagcttcagaatgaaattattcccatttcttccatgccatattattctattcagtagcatagttaattagaggacttcattaatatggagacatgcttacttaattagttacaatatatatttctattgtctatatatttttccttttagcaattgcagtctaaagggtagagttcagaaattaattttagcagcttctgggaaaccctgtacataacaaaaactaaaatgtcaatatgccataagaggatacttcacagcttttcaatttattttaatataaactagtgggcactaacaaattaaagcacatgtatcttcttgaaataactggatttgttgtagaggaaaattttactctaattcattcttgcaatcacttgctaatattttatgcttatttctttcattactgtaatccgatatatgaagttctgagaagttttcttcatcggtcaaacaaagaattaagcttttttcaatagtattctatgtcagtcactaattaaaatttatttaggactcataatgtacctttatagaagatacatatatgagttcaattaagtgaagaactgcatgtttttgtaacttcatttatgatcaatcatataaagcaacataagatacggttatttccatgtatccacagcaaaacaaaacagtcgactagagcttataaaattcattctttcaaaaagtacttctttagcccttactatgttctcaggtaaacattttaaaacaacaagataatacatattatgggacaaaactgctatgtaatttcatttgtattaattcaaacaaagctgagatataaaataatgtattttaactacaaaatgaatagacgtactgctatgtccatctttaaatgcaattaaaaaccctcttcttattctttacgaaccaatcaatcagttatttccaaatcttcttgattagattaaattttattaaatgtgtgccactgtattaaattctaggaatacagccaataacaaagcagtcatggtccctgccttcaggatacttatagtctttaaattatatgtgaatacaaactaataaagtacaaataccagaatatgtaattcaaacatagttatctcattttaaaatatccaccatggaattttatattggggatacttacctcctttgggatttctttcagagttaaattatgctgaaccaaaaacaatactgcccaatgaaatgccacagcacgctgcccagatttttgcattagttaggtaagtagcccattttagcaattcagccttccaaaaagtctctcatgccatcaatcccaaaaggaatgtctgattgaatggcaggcttgcatgcccattcagggcccaattctcttctgtcttcctctattctgcctctagagtgttaaatgggaaagacagagcacagaggattgtgggaggtttccatggtccaggccaagaagtactgcagttactgctggtcacatctctttcaccagatgcaatcacgtgactgcaactgactgcaagagaggctgggaaatgtagtctaaggttgagtccagaggaaagaggaaatggttttggggagcacatagcacttctgtgtcacaacttgtgtctggatgcattttagccgttcctggggaaagaaagaaacaaacaaaaaaataaacaacaacataaaacctgcttttaaagaatatttattctatggaaagttattaaaaactatgtcacaaccttcttaattagctcttttctagttaatttgatattttaaaaaattattttcagttcatttacatctatagaagagttacagaaatagcacagagagttattgtacatcctgtacccagcttcctctaatgtttaaatcttacataaccatagtacacatagaaaaaaactaagaaattaacatcggcacaatgttattatagatttcaccacatatttttgacttacgtcttttcttctgttccaggtatttctatctacttttaactcacacatacacacacacacacatgaacacatccctaaggctttatttcttctttgagtttcctaatttctagagtaaaagacatttttccattctcataagtaatcattattcaaatatcattggttttccaaaagtgaaatcttacatagactataaccattgccaggagtgtggcagtcatcagaggaaagatgctaacacatggtaataatgataagaataacgacataattgaggtctactgagctgttactacatctggcaagtgctagtatgactcacttaattcttgaagaagttgtatgagaaacaaattattttaaccctcttttcctggtaaggaaactgaggctccaagaagttacacaattcatcggtcccacagctagtgaggaaagagcctaggttcacttcagtccattttaaccacaaaacttcaagggaaaactgaaactaataaggacaaaagcatatccaaggcatttctggatggggttatatccaagcattcacaagaagtatccattagaaggagcatttagaggtaggtttttgaggacaaaaagaacaaaaaatgagcctaatgatttaactttttgcctttattcctagtagttcagcatttacctaggacaacaatccttcttccctctcagttgtcaggggtcacataggaattaaactggttgcaagagcaagagctgaggttctgagc

SEQ ID NO: 532 - DNA, 40001 bp, Homo sapiens
aagcatttctctttttttgagcaattgtaaattatattatatattaattttggtgtccatgtgttcattgctagtatggaaaaatacaattaacctttttatatttatcttgtattctgcattgttgaactcacttattagttctaagagatttcctacagattccttcagattttttatatagacaaacatgtcatccacaaataaacgcagttttctttctctctttctcatatgtatgtcttttatttacttttcttggcttgttgcattggctagaagctctggcagaatgttgaataagagtggtgaaagtggacattctttccttgttcccaatcttaggaaaagtgttcagtatttctcaattaagtaatcctaggtgtaggtttctgtaagtggtctttgtcaagttaaggatgtcatcttttcctatttttctgagagcttttatcattaatgggcactgaattctgtcaagtagcttttctctgtagattgatataatcacgtgatttttcttcttcaatctattagtatggtgaactgcattgattaacattcaatattaaacctgccttctatcctgggaataaaacccatttggtagtggtgtataattctttctatctatcactgcattttatttgctaatatattgttaaggattttttgtttacattcatgaaggtctataattttatttttgaactgcccttgtctggttttggtatcaaggtaatactagtttcataaaataaattggaaagtgttttctctcttctctattctggaagacattgtatagaattggtgttaattctgctgtacccatatggtagtattctccattgaaaccatctgggattggagacttctcttttggggagttattaaattaaaatttcaatttccttcattgttataaaagtattcaaattttctgtttcatattgggtaaattacgttttttttttttcaagaaatttgcccatttcatttaagttgtcaaacttatgtgtgtagagttgtttatagtatttcctttctatcctttgctgtctggaaggtctgtagtgatttctcctgcttcactcctgagatggtattttgtgtcttctctccttttctttgtcagtcttgctagtggtgtgtcagttttattaatctttttaaagaatcaactctttttttcattgattttctttattgctttctgctttcactttcattcagtactgactgtatttttattaatttatcccttcttcttgccttggacttatttgctcttctttttctaggttcttgaggtaggagcttatattattgagctgagaattgtttttctaatgtgtgcacttagtactatgaatgataaatgtctgtctctcttagcaccacgttagctgtgtaccacaaacattgatgtatattttcatttttattcagttcaatttttttttaacttggagcttcctctttgacctatgtgttatttagaagtgtattgtctagttttcaagtatttgaagattttcctcttatctttctgttattaatttctatttttattacattgcagtcagagaacacactctctatgatttcaattcttataattttttgagatttgttttattgcccgggatatggccaaaattggtattgattgatggtgttcaccttttctctttttcttggtcaatctagttaaaggtttgtcagtatgttgattttcacagaactaacttatggttttgataaacaacataaagatgttggagagcaaggaggcattggaaataaaccaaaagctgagttttcattttggccacatgctcttcataattgtttatttttggtttgaaataaataaataaacaaataaataaagggtttttatgtatgatgcttgtgctctaagtaattcgggcaagagtgacaccactgcctgcctatcagcacttgcaaagaaaaaccaattactgtcagcccccttcaaaaaaatgtatctgctaaaattgcttgatgacatggaaatccacactgaggtgcttatacccaggggcaaccaagtctcccctgcagctggggcctataaccatatttccttcatttcacaaaaatcaaaagtttaggaaccacgaggaaggagcaagaataaacaccactacaaacctcaaaccaacagcgctgagagattacagcagcctcaccctgccatttggggctagagactgctcacatttattctgtggtcagcgtccattggaaagcaacgcagcacacaccacggctgtgtttgagctgatattcactaacactgaactaactgcattccaatccaaagacttcgcaagtgccctctttcttaactgggaatctggcagaatgttatatttaaatatcaaacgttgttaatcatgtcagcggtactttagtttggataaaatgtctttcctattgtagctaattgcttgaatatctgcagactgatatactctttgtagacatttatgctgtcctctttttataactttatttcattttctcttcatttctggtgttgactcaaagggcctttatcacctcatgctgataatctgtgctttatggccgctggtgtgattgggagcagttgaagccgcgtgcaataatacacacatataaatatttgaacaggaaaaagaaggtctgtctgatgtagaccaaggaagaaatgcatttaaacaaataatgccactagagggaccttgactctgaaccacgaataggcagggtcagacttggaagggcaccctctcattgcccggcttgtacgggtgggcgctagtgccacggcccattttaaaaagcaggttcttccaggccccatggcacagggagccgagctgggtccatgccagcaggcttatgacgtcattgttgtagcttgcttatttggtcaggatcactaaaataattccctttgagaagaataaatttgctcttgcagaaagttaaagacctgagaggttttaattagtttaccctgccctcgcctttggtcgccaaacgttattgcagagttcaaagaacatgatgttgtgtgtctccctttcccatttttgcgtgggggccttttccccctttttagcacctcctgtgaatagttgaaaatgagtggcaaaatgacattcgacttagaaagtaagagcaccaggaagcaaaactggaggcaaacacagcagctaatttcaccaggcatagctggtgctgtccgcggttgtccctgacagcgcggccgacacagaaccacctgtgtttgctcactagctttccccaatctgcgagaaaatggcccgggccggtcacatggcagccagataggccaggcaccatgggaatacaaaagccggagcttttagcagagttaatcattaatgcgccttttctttgtcccattcaggagtgctgacagggctttgatagcctgtatttgccatcagccggctgcagtcctagccaggtactaatgagacccctggctccaggctccctggcagagcccagagcccagcctggacccaggtgctgccatcaacctgaagcctgcctgccccctgagctccctcctgctgcccgctgtgcccccactccttaggccttgttctggttgatcacccacctgcctggaatcctgcacgtttctgcaaagcatctgcctgagttcagcgaagcaaggctaggaaatgtgtgattataaagcccataatcctctcttcccctgtgtcatccttcccccagctaggaaaaaaaaaaaaaaaattagaaagctaagctgaattttttttttgtttgtttggatgtgtaccaaggatggattgttttgccctaacatcagtggggtgttttctttccaaaacttagcttagagagtcacccacgggtatattctaatatttccactcagcaagtaaaatgcaggtgtccctgacagcaatttttttaaatagaaaacctcaccttaacatccttaatggtaagtagcttgtgtgtcaacatgactggagctagggtgaatgagaaccacattaaaaccttccagctaccagttcttttttttttttcttttttcttttgtgatggagtcttgctctgtcgcccaggctggagtgcagtggtgcgatctcggctcactgcaacctccgcctcctgggttcaagcaattctcctgcctcagcctcctgagtagctgggactgcaggcgcatgccaccactcctggctaatttttgtattattagtagagatggggtttcaccacattggccaggctggtcttgaactcctgaccttgtgatctgcccacattggtctcccaaattcggttcttttatttgaaatcaccaccctcccaagaacgagatatcccaaccttctgattttatgcttggcctccagcgtgctcaaaatgttcttcagatttgtgctaccatcttaccactagccttctcaaaaacataaaccacaaatgcaccattgtcctttaagagtagttgaaaacaagcaaatcagcatctttgaaacctggcttaataaagaatagagattttaaagtttgagggaattaaagagcagagatttttttctaggaactgtacacatgaaaattttgctgatggctgctgatgatatataaaggcattgccagtaaacgtattacactaaatgcatggtactgccaatggttctcatatctccctttctccagcgtcaaaatacctttaaagatcatatccaattgatctttacaacatctagggcatattggatgatgtcaaattgtattgctatctttttttttttttttagcaaatgaggaagcaaaagttgacttggaagtgaaacaacagacggatcaatagatcccagaaggatgtgattgtgtggccactatttcgggatggagtgacagcttgccattgcatgctacttcatgcaccttgtggcctggtttcattcttaaggaaattgtccatcctccctcaattttactgggcaccttctatgtactgcagagcacttggctctagagggagcaaagacagatgtaatatggttcctgccactgagaagcagttcagaaggcacaacatgtactacaaaaaaacacagctcagggagagaaagtgtatggcatttcactgctgtatgaagaaatgcctaagtactttcatcctggcagaggttagccccagatctgaaaactctccagaggaaggaaaagctgatgatttcagaggtcctggatgttagaatgtggaaggcacccaattcaaataatgttatcagttttaacataatgagcagctccatagtgtcatcggcttttatttttttaaatgctcttcatacaggtagcatgaacacagtttataacctctctattccatttgatcacaagctcttcaaccacagatttgtacataaggttagagttgactctactttttaaaaattccatctttgaagtagaatgatagttaccaaaggttggaaaatgggagtgggggagtgggaaaggggagatggtcaatgggtacaaaaatatagttagaatgaatcagagctggtatgtgatagcaccgtaggatgagtacagtcaacaataatttattgtgcatttaaaaataactaaaagagcataatttgattgtttatgatgcaaagaaaggataaatgcttgtggtgatagatatcccatttaccctgctatgattatgacacattgtatgcctgtataaaaatgtctcatgtatcccataaatatatactcctactatgtactggcaaaatttaaaaaattaaaaaaaaaatctttctttgttcctccaccacatgcagttggtctaaaatacaacctttggctttgaaggaggcaaagctcttgactaagcatgcattcaattaaatgtatttcaatgtgcccaaagaagataaaatagaatattattttgttatttggggggcaaagtgatctgaatctctcattgggataatcagcaattaaatggctatatgagccacataatgcaagtcaagttaacatattgatagtgaagtattgatattaattcatatggacattctcctataattgttaaagtggattgaatcaaaagagaaagagggatgtgtagtgtgcatagtctcattttctgggaaaataatggatatcttagtttaacaccccctaagtcaagaatttgagtgcaaattgtttatgtggaaggtgatcccaggaaacgtggcaatggagaggagagaggagagaaaacaatcactgacaggtgtgtgtgatcagttcatcgctgtgggagacgggagctcggccctgcagggaacccagtgagaaactgtgcaaagcccactccaagattgtccacgagcaaaagggaagctgggttatttgcccaccaactcctgtccttcattgattgaggatgcttcctggatgtgtcaactctccaccactctggccaccccagccactggggcatacactctccccacaggatgtattccatacgtagggagatgtctgcaggtgacctctgatgggccaacggaatatgaccaatgcttcatcacaaacttcactgaaggggaagcagagggcagagaaatgaagctagcactggggccaattgaagtctacacagtgtataagcagagcccttggccctctaaatataaggggaaaaaagatgctgcttcttggataaaccacagttatttccggtgccttctgtttgcaatataaggatgctatcgaatggagagacgggctccgcaaaactcaggctgcagatgcccagtgggtttaccttaaaagcacaagaaagccatcatcagctctcggatgttgcacctcaaagggtttgcatgttcccccgtgtggacactcatcttcccaatatcccaggagcttggttggcttggctgtggtcatatgggaatgaataaccaggaagtgaaattcatgtgtttatttattcatggtggtagcccacctaaagtgctaattcttaaagcctctttgcacaaagtcagttttgtaagttccattcaactcatccatgcccccgtagcaagggaagcctcaggtcactggttttcagagtgtcttaggagatgatgatacctgcaccagcagcaccaacattccctaggaacttgttagtaaggcatatggtcaggtccacccccgaccttctcattcggaaactcctgcagtgggccttggactctatttccacaagccctctgggagatgctgagggctgctaagacctaagaatgcctggtgttccaggggaccccactttaaggccctctgcctcctctgcttccccactgttctcagttctgtacattttttaccatattcatgagatgtagatggtattaatgttaaaataccatatcgagttaataacagcttttcagaatggaatggggaattatcttacatctcaaatgaaaaaaattataaaaatataaaatacaggcatctggaaaacacagaaacacaggcatttgagatgccccatacctgactctaacaacactgaggcttttgaaatggagattccttctctgtctcacaggaaggtatttcttttccggtatcctctctgaaccaatctggagcatgagagcagagcagagtgaagagagctgttcctaccatggagtggcatagaactgcagggagtccagtgttctcagcatgataaggaggggatgctgggaaaagtgcaggccctccaactcaccaggccacctgcaagctgtgcctgcctgcactgcacaggcccatgcacctctcaaggggcgaatgctcacccctgggttttagaaaggtgtctgtctacacaatggctttaaatacaaaccagatgcttctcctgctgctcaagttcagctgagtagccatttatccaccctggctctgaaagtaacacaggctccttggatccacggagaacagcaatgttagtctctgtggggcccttttaatggaaattttaaggacaaatttgacaacacaggtgttgtaggttgggttccttaagaaggagacattgaggtggaaccaagcaaggtctttatttgggaggggaatggatctacacctatgagagggaagagaaagaaaaggatgagccctagcgggcaccatggggagttctggacctggattgacctttagggttgttctcatttggggtaaggaggccaagcctttatacctcagtgttgctcagggactgggcatgagatgaccctggagggatgaaccagtacccagcacaatggagttgccttgtctgtggactttgagacgaactctgacagaacaggggccccttacctcagtattgtgatctccagttatgattttgaacaggctatgaaaaaattatctgattttctattcttattgaaaaaaaagtcagcagaaaagactttagcttaaaaaaaagcacaaattatgcttttgtgtcttttgttgtagttactttctccacaaaaagacttattttttagggatactaattttctaccccagcagtcaaatggaggagaaattctcattcctatcttactctgttgatagaacagtacttcagactgaagacacacattatggataatttcaggccatatccagatgtgaaagttaatctgggatgggcttgaggggtatttgttagccatttaggacccctatagtcaacctaaaaatattaacccattcatatcaacaccaaagtgcaaacagcctaggtgtgcatcaacaggtaaagggagaaactgtggttgctcccctccatacaatggtaaactaggcagcaatgaaaaagaatgagcataagatatatacagccatatggatgaatctcaaaagcacactgaatgaaagtaaccagactcacagactgcatagtgtatgattccatttatgtaaatttctaaaacagagaaaactcatctatggtggaaaattaaagaatagttttcctcagaaaggggagtgcacaagaagaccgactgtgaagaggcaggaccaaactttctggggtgatagaaatcctctattgtgacaagaatttgggttaaacaggtgtctacatttgtcaaaactcagcaaatagttaatgtaaggttagcgcattttgctgtatgtaagttttaacttaaaaatggaaacaaattttaactctagttaataataaagtacatgctgaattgtttagggatgacatgcacagatgtgtacaacttcctctgaaatgcatcagaaaggaagatggatgggtagagggatgtgtcagaaaggaagtgtggggggatgttaacgattatcagggttatgagtgatcactgaataattcattcaactttcttgtgtttgaaatgtttcataatatagtgccagggaaacatcattcaagataaatttacccccttccaatcctgagctaccctctcccacttggtgatcacagcccctgagtgttgacggccaaaagacttctcttccacacaaggctctttgaaggctattacataagtgaagggagaatttcatgaatattttggtgaaaggagaatttcatgaatattttggaagtatataataaaatgacatgtttggtttgcaccacagtcaagttttccatctgttttgaatgtgttgtgttactccctcaatctcgattgttgggagacccaatacagacagtgaggttcttccctaacatctgggcacgtagcatgttcacccctctgcttgcagtgatgagaatgcttagtggactatgttctatgtctgtgttccatgatctgaataaaacatggactatgttccatgttctgaattgaaacaatccttgttgttctaaatgagtggccaagaaactggctcattctacagtacaggctctatggaatgacctcaaagttgctcactgtttagccccagtggtaacttatcggacatctccattcttcagttctatgagatggtggtttgaacacatacttgacaacagcttccactgtggaccagggagtggagcccaggagccaagggcctggagaaacaaaggaacctgcacccagtatcgcagaactggcgctagttcgttggttgccagagatgctgtaggagtaaattctgggggatactcatcggggcaagtgattttagagtaagatcagggctaggaatgccttaaatacagatttataaaagcaaaaaggaaagagaagagaaaacagagatctcagcatctttggaaagctcaacagggaagaatggagaagagagtaatagccagctatcccagcacaatttattgaatagtgagagctttccccattgcttgatttcattgacttagtcaaagatcagatggttgtaggtggaagctttatttctgagttttctgttctattccatgtgtctgcctttgtactggtaccatgctgttttggttacctagccttatagcacagtttgaagtccagtagtgtgatgccttcggttttgttcttccggtttagggttgctttggctatctggactattttttttttgtttcatatgaattttagaatagtttttttttctaattctgtgacaaaggacatctgtagtttgataggaatagtgttgaatctgtaaattgctttgggcagtatggccattttaattatattgattcctccaacccatgaggatggaatgtttttctatatttgtgtcatctaggatttctttcatcaatgttttgtagttctccttgtagaactaaaacagagccgccattcaacccagcaatcccattactaggtatatacccaaaggaaagtaaattattctaccaaagagatacatgcatgtgcatattcattgccatactatttacaatggcaaagacatggaattaacccagatgcccaccaatgctgtactagataaagaaaacgtagtaatatacaccatggaatactacacagccataaaaaagaatgaaatcatgccctttgcagcaacatggatgtatatggaggccataatcctaaaacattaatgcaggaactgaaaaccaaataccaaataccacacgttctcacttatcagcaggagctaaacattgggcacacatagacataaatatgggaagaagagacactgtggactatgaagtggggagggtgggaagggagcagatttgagaaacaacctactgggggctatgctcactatgtgagcgatgggatctataccccaaacctcagcaacatccaatatacctatgtaacagacatgcacatgtatctccaggtatctaaagtaaaagttgaattaaaaaaaaatatgtatatgaaagtttcttgtaaattataaagaaacttttaatctattctacgatttttagttttttaatgaacacagagtgatgattctgtttagaatgataaggaatgaatattctaaccattgtaataaaatgaattccagagtgaggaaaagaaagcaaaactgcagataaaaggagactattgtatttattaagctcttattggtgccaagcactactttacaaactgtatattgaattcttaatgttcacaaaaactctataaaataagagttatgattgccttcatttgacagaaactgaggctcacagagactagaacaccatcacagagccaccattcgagttgagaggagggtaagtcctccaggccaccccacacatcagctctgcagacctctctgagcctcagcccctcatccggacagcggtgctcatgacagcagctgaacaggggtgctgtgaggattcagtgagattaggtgatggatgagaatgtgttttggaaagtctctattatcattattttacccatctgtcctagagaagagagattgctctttcaccggctgatagagtgtcacccacacgagctggcagaagtgctctctgccaaagggcatgctggatggagtggcagtgcagcctcagactctctcgctggcatgagcgatggttctacaggcagatggtgctgggaatgaattgctgagagggtctgccagaaacagctgcctgcaaacacagtccccctcccagctggtcttctagacacacgtgttcccttaggctgcaggaagtaccaatgatgatgcttcacaaccttgctcacgttcagagtgaggtcgctctgggtaatgtgatgggccaccaccctcttgattacagcagctgcctctcccacgtgcctctttgtcctcacttagaaagtgggtggtgtgcatagggacaagggacaacacgggttgcttggggcacacctgcttcagagcttgtttgcagacctcctcatccccacctccaccagggatcaggagtgctgtgtgctcagcagatgttttgccaatgccgttttcacaggcaatgcttttttctttccttttaaaatgtaatatattgaggacccccaaacagctgtctgatgggttccttgtctattagagcacatttcctctgcaaacaacagcttgcatctggagctgccctcagacctgataccttcccaccacgccccataccttgattcctcccttgccaaaagttttcccagaagagcaacacaggaaataaagttgaagacgcattgctgatggtgaccaagttctgcagcctcttgtagcactggggcgaacttcatgaagccccggctgacccagtggggagcctctgcttttcccaccacaaagtgatcctggcgcctgagcatcatccttgtgccactgaacgaaagtgagagaaattctaggaaactggagccaccctctgcagctcgggtggcctcgctttaacatctttgtcctgtgcctatagttgtccttaatacccaccacactctgcttgtctctcaaggtttggcatgaaaatgtttcctctgcaaggggtcagaggggttagtagggtgagacagcacaggatacccagacagggaagaagaggaggactgtagagaagctgagaaggtacggagacaggatggccaggggctccaaaccattcacttcacaattggaccaactctttttatatcatccatgaaatggcttccatttgcctcctgtgccatggaaccttctctccgttcccttttcagagtcttctctccatcactaaccatcacacttggagcctggacctcgatgctccctacttagggtccatcatcccaagaggctaggactcaggccccaccagccttggctattggcttgagcttgagggcttgggctcaagacaatcaactcagtccaaggtcagctttctttcacttgcatgaatgctatcattttctattttgcaatgggaattgtgagaaaaatgtgagcaagactgtaataatgcatgctcaacagaggaaagccaattccaagctcatgctctataaatggggagactatattgttgttttagtatacaccagacagaacacagcaattgatgtcatgttttacctggtggagcactgggctttgagtcaggacacattggtttgagttccagctttgctggcagccagctgtgtgtcttgggaaagtccctggccttttctctttaactaaaacataataggcatgatcatcaaggccacctacttacacatcaaagtcaatcttcacagcaagctgggaagtaggtgtctatggttcagatgtggaaaccaagggcacaaagtaggggagtagaggagtgggatgttgagggacctgccattctgaagggaaacttctgtagccacagccccagaagagctctgatttgtctcccaatagaaaccacttgctcagccacaggtcattgacttcaagctgtctccttccccagcagccctcaaggtgctctgcccatccaaggtgccacgagacacatggcagtggcttagcattactccccagatgcacccttgctctgtgtgccatcctgctttactggaccctgcctcgtgttctcacctctcctcccagctcctctcagcagtggccctggcctccatgccagctctcctatctgggctcagcagttctcctggttcaacaaatctgtgttgcttgtgctgtgtcagcttggtttacccaagagttttatttcccagaatccctacccctgcaagaacctgggttagagttgaccaaaagaagaattacttgaggtttgggctacagaggcaaagcagtgtccatcaccctctgaaggctgttgagtaggcctggcacaaggatggatggacgcagaagtgcctggtggggctcaacgggtcctcgctgtcctctgttcagtgtccagctcattctctgcaggctcagcccagctggccgggaaccagacacccagagctgcacagaggaaatggcttcccgcagacttttgccaaactccctcacggcccctctgccagggcaggtcctctcagattcactggtagatgacgcttctctgatcttccaactcccctttccaaatctccactctcccagctattcccacagagtggaaggtccgattccaatcacacaatcccgctcctggagcattccctggctccctgcttcctgcacagtggaacatccctggggggccctcactgctgcttcccagaaccaggaaatggaaagcgagtgaacattatggcagaccgtggctacaaaagataatgctgtactgccgcagcatttttaacatagaaatcttcctttgagttacctgtcaattttcttaaatgcaggaagaagcctttccggaggctggcagagacatttcttagcattttattttctgaaaccttcatggagatccaccatgacaaaacagggctgatggccggagcctgagtcagcaactcccagagcagggttatgatttctcacacctccgggggggtccatcgaggttgcaaaattctaaaacagtaattcttgtaaaatcactctaaccataaggagttgggaagagagacggccaatgggaaatgaagaaagagtggcggcaaaatcaaacaatgaaacagccatcaccccagggaggtaggagtggagctgatgagaagaacggtgggcccctctctataggcggagctaatgcagcgctcaggggctgggtggccagcgagcccaacctgctgcagctgtaacaatagtgtgtccagtgacagatggcctccagcgctcctcggtgacagtgacgttacctggagcactgggaaggaccggcactgaggggccttgaggagcagcaatcagtgaacaggaaggaattaaagtgtctcctaccagcagagaagataagcattttataggggacaggctgaacaagaggttttttttatcacttgtccctgaagaacaaagaagtcattcttttcctttgtggtggggtgggtgagggtgtggggagagtgaggaaatgtctactctattcaggacacctaggcagcttttgaaatccccactgaaattaacaaccaacgttcatcctgtacctgctttgggtaatgtctggggagagagacttacccgaaaattcgccctgtgtggctcatgggatggaaccagaagttccccatcacaggtgaggtgtgagtgatgctgagaccagacaggcatcagctttggagcttgcagggcctgctaaggaggtcagacttggttcccaggggaccaggctccgtccagagcctgtccccgccatttatgtgggcaggtttgtgttagatgccggttggctctgaagcagtgccacaattatttcaccccaagtttaaaggcactaaattgtacctgaagaactctaggcccattggaagtggcctgggaagcgaaggtccagtcacacactcttatggaatgtctctctctacagggtctggcagattagaggtgatggagagcaggggccagcgctggggaggggaaggttgcagactcaaagcaacatagaaatgtcggcacgcatcagagttctagagtgagccagagattgtctgggaattcagcttgggtgaaaaggtaggaaatttacatgttggtgactgtaaaggtccagtgcagaatctactgggctgaggccttgggcctgccctgtaaagagagccatgtgtctagtgctccaaggccacatgtggctagtggctatcatactggacaggcaggcacaaaatgtttccatcacacagaaagttctgctcaatggccttgccccagacactgacatttccatcatgacaagccatattaaacaaacaagtgtttgaaaccacctccccatgcccccattttcggttgtttttcaataagcagagatgcagaaacagggaatcctggaagcgttctggtatctagaaagcctcattaatcaaccagttttatccccaggcccccttactctccccgtctctcttccttacctggcccatgtatgtgtgttcatggtttacatgtgcacgtgtgggtgtgcacacctgatacagcagtgttctctttcctgctgcctcctaagcagaatgaaactgtctccattaaacaagctaaacattctcataatctccagcgaggacacctcacctaagccctctggtgagagagccgtcctggacatgccacaccgccacggtgcacctaacattgagtagctgatggttcttccagggctctccaggtattgtctttcctgaatacagtcaagttgcagcttgtgaattctaacgccggtacacaggatacaaacatggttcagagtaacccctgaaaatctctaaaatttccctacaagggaatgctgtattgtgtctcaggacgtgcaacccttcccatttctcggtggcagctggaaaatggttgttcttcccatgagcagtggcatggtacttggctgaagttccacgattcatttggccaaagaaacccagtataatgacagttgatgcaacaaaatattcatgccaggagaaacaggtagggttctgaacaaaacacagggcagagctcacaggtggtaccttccctagtggagcaacgacctggcgcacgcaggacgggacctctctctctcagcatgggtgctggaagtgaagtgcatgtgaaatgggcaccacagggctgcagtgccagccacctatgcagaaacacaatcaatcccaccaccacatatgcctgcactgcgctcacacatctgctttccaatgccaaaccccaaacaggccatagctgcccaaccactgggcagaatttccagagtccagactgctgggctgtccaagtgggcaacatttgaactgcagaggcagagcctgacccgtaactccttcctgccccttgccaggtagagagtatctctctctgacaaagcgggcaatgccacccacagtctaaaaatgacaaggtgcccttcgtcccaggtaactgaaaataaaagtgttatcaggtaggcacagacaggaagcaaggcaggtatcaacagtgccaggctgagtgttctggggccaggcacatggttgtgggcatccctgggtaagaatgtccagcaatgctatttgatttaaagtttcattttcctggtaacatgaggaaaagtgagagccctgggaaagatgatggagaatggagttacttccacactgatttgttgcagcctgggggctcattagaaatggatccacacagctacattacatgaccctgaaaaacacgggagtttttaaaaagcaggtcatctttctttctttctttctttctttctttctttctttctttctttctttctttctttctttctttctttctttctttctttctttcttctttctttctttctttctttctttctttctttctttctttttttttttttttttttttgatggagtctcgctctgttgcccaagctggagtgcagtggcgcggtctcggctcactgcaagctccgcctcccgggttcacgccattctcctgcctcagcctccagagtagctgggactacaggcacccgccaccacacccggctaatttttttgtgtttttagtagagacggggtttcaccccatgttagccaggatggtctcgatctcctgacctcgtgatccgcccgcctgggcctcccaaagtgctgggattacaagcgtgagccaccgcgcccggccaaaagcaggtcatttttcttaatgcttcctacttaacgtgaagataaagtatcaatatcaaataaaatatttttatattttcatcaagatatttactgtctagaccagctagtgaggacagctcagggattggataattttctgttgatcttgcttttctaacgtgtttctgggccagaaaacatttgcttaaaatattgtctattatttttatattctaaaaataattttgaaactggtaatacaatcagcatgcacagtccactaagctagggcactctgctgattccgccaggtggacatcttggtgtcagcctccaaatacaacttcactcccttttcctggacactgaggaagacattgagattccagacagattgttcttaaaaaggtatcatttgcaactgctcagctctgtggatcaaaattttatccagattgtgcaaccaaaaaacttttttacaaaaaaaatgtgttgaagtcgatatgatttccaaatttctaagagcctcaacttttctctttatataataaaagctatgtttagacattcgccatcaaactgccatattattctctttgtaggataattaaatgttataaatttaaactaaggacgagtatactagctagttattaaactaataaaatatccccttttgggttttatagattcaggtctgtgcataaaaatttatttgaaaataaaatcacttaaaaaataaaaaagcttgagagcttcaggaccataagaaccgtctacctctccattttataaaagaaaaatgaggcccaaagagaggaatcagtaagtcatagatgaagatattagcaaagccacaagtgttgaaagttctctaatactatttctattttagtctctgctcttctgccctcaggaagctcagagacaagttgggattttaaaatcagttctcttggccaggtgtggtggctcacacttgtaattccagcactgtgggagcccaaggcagtggaatctcttgagaccaggagttcaagaccagcctggttagtgagacttcatctctccaaaaaataaaattagctgggcatgacagtgcatgcctgtggtcccagctactcgggaggctgaggcgggaggattgcttgaggccaggaggtcaaggctgcagtgagctgtgctcatgtcactgcactccagcctgggcaacagagcgagtccctgtctctaaaatataaaaataataaaaagtttaataatactaaataaaattacttctcaagtaaaaaaatacagagaagctctgtggtatcgctaaccacacacaaaaaaaataaataaaaatataaacaattttaaaggtcaagtgagctcttccgtagcagctcttcaaatggcatgtagatttcactggccacagcccagctcccccagcctaaaccaggcccatagcatacttgagccaccctggggatagctgccctgagggctcagagtaaacaggtaaacagctgtgccatgcttttcagtgcaagggacctaggtgagcaggcagaggtcaatgtccacaccccagtttcatcaacaactcactggccacctaaggtcacccaaatgcctttttatctgaatctacaaaaaaaaaaaaaaagaggcagaataggccatgatggaaaaggccatactctttctgaataggagagagaagtgcctgggaatgatacagggagaagagagagggaattgaaatagcagtcatggctagtaaagctgcatgtataaatggttctttggtatccttttagaaatctagtacctactggcggctatctgcttccccagcatgtgagcagctgcatgaggctccagctcaggttagtggagtcagtaaccccagcctgtgggcagctctgtgtctgcagggacctgtgcaccctcagccctgtgagaggcaggaagcgaaaaccacctaagcagtagaagataccttttagacctgtcttgctgaatttctacaaccaccaggagaggaaagccgaacagaaactgctgcgtgctttgcagttcggagaagtaatgcaccttacctaaggttgtataaatagtagatgatcagacaggaccagccccagctcttccttgtcctggcgtgttctttcccctacacctaccatttcagaagaggaagctctaattgacaaggagctctcagcttatcaacttacttcatttatctgtaggctagagaacttggggacatattatcaaagaagcaaagaagaaaaaaaatcaacagaataactccacatccaagaggtcaggttttctccgctctcctcaacttctgtctctgtggccacccgagagggctccgggcccctctggcacctgcctccttgggttttcctctgctcctgtttatgggttttatcgagaagaggacagtgtgacagtgctttgtggtgcattaataaagataagagaggccacagctactaaacagagttttcagaacccctcccctggtttccctggctgcaggcctgcatgcacagacacacagaaccaccgatgtgggaactattactgccctccgattattgttattgtaatgcctattcagccgcccctttgtaagttcctagagggcggggaccatgtctcgggctgcttttcatgaattcatgccttcatgcttccattcactcaccctacaaacatttattgagtgctaccatcactacgcccgcctcagtgctggggactcagaagatacatcacatcctatccccagcagcacagcccaaccctggctgccagtcccaatttgttcttttaggaatggaaccccccaaatagggcacaggctgcaacatctgcatcagccagaaggtcaggaggcaacaggtggtatcttcttccttcatcatcttcttttcctccaaactcctacaacatgatcatatttatttcataacaaaaacatctaataaattccacattttaaatctactattttaaacctaaaattcttcttttctcaaacttggcttcccatttgaattagtaggggaatgtcaaaatactgatgcctgggtccccacacacagtggatctgatttagttggcttgggcatggggattttaataagctcagcaagtggctcgaactgtggcccaggttgagaaccaccatttcaacccgaaacagaggagaggttctgggctcaggagcaggaattgctcctccatttgtttgcagatgtgccagtatattctggaccccaagactctgaagctccctggtctaagcctatgttgtccacctgccttctgtaccggagatctcacttcactccttgccttcctgcccactcttggccttgggttgtgtctctttgcctgtgcacacagaacacacctccgtgctatggtcctgtttaggcttcaggactctggcccatcacagggccttttgcctagaaaagtgctctttcttctgacttcccagagcctggctgtctccacaccctgggctccaatgatcctgctccttctctgcctgcagttgagtcttcttttcttttcccttcactatggggtacacaccactcctccttcctggcctgcttggcctggtgacagcgatgcttcttaggaagggggacctactgaggcacccgcacctgtggccatgtggtagcttctaggagataccagaggggactgtggaaggacccacaaatcattctcaaccaacaccagagggtgcatatccttgtccttgaagttcaattcaaaggacatgtggacaaagatgactcttggaaaatgcaaataaacaccacaatgacacaacatttcacatccactaggatgaccgtgagttcattgctgttgttgttttaagggatataagtgttgacaaggatgcggagaagctgaaacccttttacaatggctggtaggaaagtaaaatggtgcagctgttgtggggaacggcttggcaatacctcaaaaaaattgacataggattaccatatgacctagagacttctaggtatacgccctaaagaactgaaaacagagactccaacaaatacatgcacatgctgttcacagcagcattattcacaagtcaaaaggccaaaacaactcaaatataaaactgaaggaaatattcatgaacatacactgtattcatataacacgtatttaatgttagaataccttacaaaacatataacatacaccgaaattggaattaaaggatgagattaaaaacatgaagaaacgtgtctttcctagaatccccagtggtgaccaccaatctgctcgaatgctcccacagtgacttcccttagcctggaaatttcaagagttacaatctgaagagattcttccactcccacctttgctttaattcctggcttgaaagaaaatttaaatttaaggacaaactttcttgtgctgctgtttttaaggtgaccgttttgtttcccaaatttcctctggaaaaagaacattccttcaacaaggtctctcttttctaaggagaaaaggatcaaatacagaccctcaaaccgaggctctggtgctagttcggggaaacagacacatgcacggtaaccatttctaaacacagagctgttttcagcttcatattccacagatcttgaagtattcacacatcttatgcagtatttccttttggttaagcttagccccttggaaagattaagaaagtcgtgtcctaagagtcccggggaggccgagataacatagtgagtggagtccagcctgaggtctcctgtctgctaggcagggatttcagggtgagtttcaaggacagcttccaaggctgagtggattcttgtggtcaccattgcgaaggtgtatctgaggtaattgaaattacgttagcatggtgacatatagaaaaagaatatggggacattttactcctgagcatgagggagaatcgctgagagccaggcaaggtgaagaagaaaaagagaaataataaattctcggctgggcacagtggctcacgcctgtaatcccagcactttgggaggccgaggcgggcagatcacgaggtcaggaaatcgagaccatcctggctaacacggtgaaaccccgtctctactaaaaatacaaaaaattagccgggcatggtggcgggcgcctgtagtcccagatactcgggaggccgaggcaggagagtggcgtgaacctgggaggcggagcttgcagtgaaccgagatcgcgccactgcactccagcctgggcgacagagggagactccatctcaaaataaataaataaataaattctcaaaggagactttcttttttttaataaaaaccatgtattggatcagttatcttctcaaatctctagtctaaaataatgtgggcagttttacaaggaaatacatatattggaccatatgaaatgaaccgtcaatatttgttataaatctatgaaaacattaagttcaaatggtttcgtctaacacctatgtaatataatcagtaaattccaggtactgtgcgatttaggcagagtatatgtgtgtatatgtgtgtgtgtgtgtgtgtatgtatgtacatgcacgtgtgtatatattttgtagagtccagggtctcctgtcaaacttctgggctcaagcgatccttctgcctcagcctcccaaagtgctaagattacagttgtgagccactgcacccgacatatgcagaaaatatcttactgcagtataaaacatatatctgagaggaaaagaacaagagagagaggtttctaacttaaacacagctaaccaaggaaaaaataaaatcaacatttgaatgaatattgaaattctcttaaaaaaagacaaatgagggggaaatcacataagcaagtaaggtttcacacacatggtgctctagaaactaatcagtggacagattcagaatccatatctccctttccaaaatgttctctggcagaagtcattctgtaggacaaactggaatcaaaagagttatgaaaattgtacaatgggatgaaggggcttcccctgttggggaatagatagctgacatgctggatggggccagggttcaaacaaaggcccctgttgagtgggagcaggtacaagacagatggtttgttaaacattgccagcatgcttgcgcagtgccgtgcggcggtcagagcctggataatggtcaccagggcattgtgtagcagcgcattggctaatttcagcccagctaaagctattgcttatctttgttggttttgcaaagattaaggcagtttctctgctttgaatgcaccacagctgcccagcaaagcattcctgaagttttgtctgaattcccactgctaagaggggccaagcaaaaggtggctcgtgcaaggacttgttttaagctcatatgtgaagttgcttctcctcaactaatctggaccactcttgactcttacttctgggcaaaaccctctagagttacaggggccttctttctcagtgagtcctttcctgtgtggttcgaaatgcatctgctggggatttatatttcctagatttatatttcctattgggattgattcatttgctacttttgtggaaaaaggtaaacaccattgtaaattccatccggtgaatcatggggaggcggtggttccaattaaacgtgtttgctttcggaagggggcccttggcttcttatctttatgtacagaagaaaatagagctcaaccgggcctctgcagccaatggaaacgcacctggcccagtcagctgctaggctgagtctctgctgctctgggctccaactcgctcctctcggttgtttgcagacaaagggagagtagctgcgggtcatgcagaggggacagtccccttggctctgcctatagtcccaaagcaaagcagggggtgcagctactatctgggtatgttaggaaagggtgatggctgatcggtttagtatttccaacagttcaaatgtctttatcttcttttaaaggtagtgcatatctatccccacctaattgaaccagtgctgtatttacttcaggcagccccctctgcctaaattagatcatttctagctataaaatcaagaaagtgtgcccagcagattaagccctaaaagtggacttgttaactacatctacagaagcaaagagagcaagagaatttttatatactctccctctctccctctctctctcttttctctctctctctccctctctccctctctccctctctctctgcctctctccctctctccctctctctctgcctctctccctctctccctctctctttccctctctctctccttctctccctcttgtttctctctctctctccctctctccctcttgtttctctctctctctctctctcatgcatgcaccacacacccctacctttagaactaggaaactaattcgccttcctggctccaggcctcagcatctctgcttagcatcaggcatttgtcatatagatctcaaatcaggaggctttagtgagcagctaagggctgacaatgtgtcccagggaaaagaaacccataaaggagaaaagcaaaggtctgagaggttcacctgcaaattctggacattgaaagcaactgtacgtctcctcaggtgcaaataattgaaataatactactactcaggccatggtgcagtgtgctcacccaaggcccttcttgttttattttattttactactttcccctggattccctgtgtgttctggctcccaaatcactcactcacttaggaacctcctggaacgggtttcctagtttgggtttggaacctgtctagaagcttctattgggagagagagtgctgtttgtgactccatgtcggcagctttcctttgattcctctagtccaaggctgctatttttcctaagccgttgtccatctgggtctaaatgtattggcgtgtagagtttcacagacacttttgccatctcatttttcaaagaatcacattttaatggggatttttggcaatttcattgatttttttaaactcactttatatctttttctttgctttggttttattctgtcatttttctttttctttttctaatatgtttagttatgtccttaggtatgtggtctttcggtgtcttgtttgctatttgtgtattcaaaattatgtaaaactttaagtgcaacttgagagttatgggtcataaagtttgacatttgacacttttgttcttatccagttccaagtattttgtaatatcttttaaatttcctctaaaccccaatggttatataccatacattataatgttttatgtgtccaagagatggtcgaagtggttttattgccattactgattttttaactttatttcattataatcaacacattgtgtatgtattgattacttggcatttacaaaagttttctttgttccatgggaattaaaatgaatattctctgtgggtgtaagttatgtacatctattagatcagtgttgtccaaaagaaatataatgccagccacatatataattttatattttctagaagccatattaaaaagtgaaaatgcacaggtgaaattaattttaataatattatttaagacaatatatacaaaacaacaatttgaacatataatcaatataaaaatattaacaagatgctttacattatttttctgtattgagtgttagaaacctggggtggatttagctctttcagtgcatttcaatacaaatactaaaattggatacacttgatctgtatttagatttcaatttacaattgaaagagcagattgttctaaacatacttaaaagtttttcaatacctgaattaagtattaggttttaaaatttaaattaattaaaattaaataaaatcttaaaattttcttgcattagctacacttcaagtgctcaagagttatgtagctatcggctactgtattggacaatataacattaagtaactgttataatgcttctcaaatattccaaattattggtaatttttgtctcctttgtcagtgtttttttaaaagatttattgacatctctcctactattattatatctataagaccttacattctgaaattgtgtgtgtgtttcaccccctgtttatttttttcctctttctgggactcctgttatagggagccatgttcttaactattactttccgtctcaatctcttcatcttgctgagtccttcctgatttgttcttccactgaatccaccctactattcagtccctcaattatgctctttattccaacaattaaagtctgtttgtggctgtgtgttcttgttttgtttttcctgatctgtttgagaatatttattaagcttcctttaattcatgccctgcctgaactcccctaccatctcatctagtgtgtgtggctcagttattgggctggccctgaccctttcatatcctcctgagcccacatgcatgtggaaacaccggctgccttggctggtctgacatccctgggagaaggagcaaaggcccaggtgcaggccttgcctgcctcgtggtgaggatgagcctgggggatgacatcggggtgcgtggcttccatgtttattgtgggctggacctcccctgagtgacccaccctctgtgccaggtgacagaggagctctggagagctcccagagccctactctttttctacagctgcctgccttaaaatcatccccaccttgcttaagtgggagctcgggaggagagtgctttagggctgccagagtaccagctggttcaacaccgggggactgatgctttgctgaggtgatggggaagctcttattttcttgagggaagttcagggaaggaaaagcacataactccacaaccccagccagcctcccttttggtacctggccctcctgaccctaggctatcatttcccagattctttttcgagaatcagcaaccttctaccttccatctgtggctcaccacatttgggtttaataaaagaatccaacatctccattttgttagttcatcttgccaggaaaagcgaacctcataaagtgccattttaagaatgaaatcatgtcttttgcagcagcatgaatggagctggagaccattattctgagttaaataactcagaaacaggaaatcaaatactgcatgtcctcacttgtaagtgggagctaaacaatgggcccacatggacatagagatggaaaaaatagacactgggaacccaaaagccaggagagcagaaggaaggtgaaaactgaaaaattatctgtcagatacaacggtcactgtttgagtgaagggttcactagaagcccaaaacttaccattatgcaatatatcaacgtaacaaacctgcacacgtgcctcttaaatctaaaataataataaaagtttttttgtaaaaaaaaaaaaaaagaatgaaagaaaaataaaataccattttatttttatttactttttttttttttttttttgagacagagtctcactctgtctccgaggctggagtgcagtggcacgatcttggctcactgcaaactctgcctcccagtttcaagtgattctcatgcctcggccttccaagtacctggtattaaagtgcgcacggccacaccaagccatttttttatatttttagtagaaacatggtttcactgtgttggccaggctggtcacaaactcctggcctcaagtgatccaccagcctcagcttcccaaagtgctggggttacaggcgtgagccaccacccctggccagaaaatgacattttaaaacatgtaaaaatgttggtgaaaatgctcaattccatattactgtatcattccagtctatttcctttcatcatgttttaaccttcccaaactgtgtcagtgaaattgggacaatcaaggtctctccctcttagagcttgggacgagtcaataaaataaaacacaatgggccccagcacatagtaaatcttcacttaaaaagtcacaaggtctctgatcctcagactccttggcccacactgacttactgaagggattaaagagatgcctcactccacgagctccataaatgcttctctgaaaaaaaaaaagtcttaagtaatcaatgcatcaagttcttaaagctactgataacacataacctctcacagttcacagttcagctatgttgctcacaatgtgtcaatgagatgtaaatgtggaaaaacagtataattgcttgacccaaggctatcgggcaattttctctaggttcacaccagcagcccttaatcgatgcacatccacaaatgggtgggagggaagagtcatcagggaatggcttctcctcatatcacttctcaactttagaaatcatgatgcctggggaaccgggtgtctgacctaggtagatgcttttttgtgcaaaaaataatgaagtagcctcagctctgctaactcagccctacagcaggctggactctggtgatatatccaatagatatcaagcttacaacaatgcttagatgtgactgagatttaacagagttaggagtcattaatggaatttatattggctaacctaaaaagtaactcatttaaagcattagaatttaggatatatttccaataactcatttactacaaagacaagcaaacaaagccaatcttccacccaagaacttttcctaaaatgggacttgctttgatctgcgctgtctaatatggtagcacaaatggctaatgagcaggtggaaggtgtttggtccaaattgagatgtgccttttagtgtaaaatacacactacattgtgatgacttaatatataacataatgtaaaataggtctttgatagttttatattgattacacactgacataatttttggaattattaggttaaataaaatattattaaaataaattttgccttttgtcattttttaatattaattatatttctagactttggctatataaatcactctatacttttcaaatattatttgttcaatggaaaggtgatcttaaccaggagtttaacaaaaggccacatttctgaggcatgtttctgaggcatatctttcgtaaaccattgttgttgtttttttaagactgaatctcgctgtgttgcccaggctggagtgcagtggcacgatcttggctcactgcaacctccacctcctgggttcaagtaattatcctgcctcagcctccccagtagctgggactacaggcacctgccaccacacctggctcatttttgtatttttagtagagacagggttttgccatgttggccaggctgatcttgaactcctgatctcaagtgatctaccggcctcggcctcccaaagtactgggattacagctgtgagccaccgtgcccagccgcaaaccattctcagacacataaggtgactccacagtcaaagaagttgtacccatttttccatttatcccttagtaaagctactgagcaccttttgtgtgtcagactgtttccagcacttgccagtttccagcaaataggaggcttgtctttgcatgcacagaggcagccaataagaaataaaagtaggaaataagtgaattttagagtatgctcaaagccaatgagtgctatggaaaaataaaaagtggggaatgagggaggtgtgggcaggtgattccaactgtagctctggttttcattaagaaagtggcattgaagcacagacatggagcaggtgaggtgttaagcatgctgaggctgaggggagagtattctaggtgggctggaggctggggatgaagttgaggagcagggagagggtggtagatgatctcagcgggggagtaggatgaagacacaggaagtattactggatctcagtgaaatggggatgacattgggtgctgaggtggggcgtggctcaaacctccttacatttttaaaagatgactacctcctttgttgaaaatagagtataggggccggtgtggtggctcatgcctgtaatcccagcactttgggaggccgaggcaggcagatcacgaggtcaggagatcgagaccatcctggccaaaatggtgaaaccccgtctctactaaaatacaaaaaattagttgggcctggtggtgtgttcctctagtcccagatactcgggaggctgaggcagaggaattgcttgaaccggggaggcagaggttgcagtgagccaagatcgtaccactgcactgcagcctggcaacagagcaagactccgtctcaaagaaaaaaagaaagaaagaaaatagagtataggttggtgagggtgaaaacgaagtaagcagcaggaggctcctgtaataatctaggcatgagatgggcgtggatcccattggtaacatggggttgtggaaagtggcaggattctagatggactttaaagacagaactagcagatgtcttgatggactgaatgtgtgaggtgtaaaggaaagcaagtgtctggatgactccagttttggcctaaggacctggaaggatgtaactattgggtacccactttttgtgccagtcaacatttatgcaggaactacaggaatccacacagtaagaaatgctccctgcaccgaaggagttcacagcaaagtggcaaagacacatgagtgagaatatgctgcaccagatatgatagtacctgtgcacagagacaggggaaagatccgtctaacttgtctgtggggggcaggcaagggacgtttcaattaggttgtttggggatgttacaaattcatcagaccaaaaaaaagaagtgaaaaacattctaaggtcaaggaatagcatgttcatgtgcaaagcccagtgttgacaaaggtagactattgtttggggacttgcaagtacagggtgggtggtgggttgccagtgggtgaaggtccggcctggagagacttaaagtaggacctgctcatgaggatctgtgcagagctagggaggttgggccttctcctggaggcaggggagagctatcagaaggtttcgggcaaggcaatatgtgatcaaagttgtgttttccaaagataagtcatgtggctctatgaggaatagactggagagaggatacattaaagatatataaaggagttagggaacgattacaattgtccaaggttttgttgagctttagctagagagaaatgagagtgagagaagtactaatcaaagagacttttttaggtgtaattcttacaaattgatgtccacttgaaagatgggctttcaaatacggaagaaagagtacgaaacataatctctctcatttctggtctagaagctgtcaggggtgctatcattaactgagatgggaaaacaggagggagaggcacatgctccaagaatgctgagtttgaggtatcttagtttgaagccccccagatgacgaccctgaaagaaagattcccttataaggagtttgtttgaaacactgtgaggaagaagggaagcagggcaaagaagggcaggtgccccacgagattgtggagcttaccgcagtggcccctggagctcagttctgctgtggcttctgagagatggatgcagggaacaggcatcagcaccacttgcccaagggagacggagctctcaccggctctcaggaaggcactgacttctgactttcttggaggcaggatgcctgggaaatcctcaggcggaaaggaagatgctaccaggaggaaactggtgcagcagcatgtgtgtggaaggcaagtgccaaggggctgtgtcaagggcactgaggacatcggctgaaggggcctttgagatgtatctgcaggttgagatgctgaaacaaggagaagagaattcacatacgacgttccagtgagaagtcaagcaggaggccataattctgggacactagcatgtttggctaaggttagcataagcttttcaaaataatttcctttctaaatatcccttgctgtgaagatatcccctctgcaacagtaactggtgtgcgctcctctgcctctccccagcagcagtgacctcgttgaggctgaattgaatttctggaccaacacttctccctcaataaaatttcactgtgatgggcaagaaaccatggagtgttacttctaccttttctgagaggattatttctaagattttctttctttctttctttctttttttttgagacgaagtctcactcttgtcgcccaggctggagtgcaatggcatgatctcagctcaccacaacctctgcctcctgggttcaagcgattctcctgcctcagcctcccaagtagctgggattacaggcacctgccaccacacccggctaatttttgtatttttagtagagacggggtttcaccatgttggccaggctggtctcgaattcctaaccaagggtgatctgcccaccttggcctcccaaagtgctgggattaaaggcatgagccttgtgcccagctggggttgcttttaagaaataaaattggccggacttggtggctcatgcctgtaatcccagcactttgggaggccgaggcaggcagatcgcctgaggtcagaagtttgagaccagcctgtccaatatgatgaaaccccatctctactaaaaatacaaaaattagccgattgtggtggcaggcgcctgtaatcctagctactcaggatgctgaggcaggagaatcgctcgaacacgggaggcagatggaggttgcagtaagccaagattgcgccattgcactccagcctgagcaagaaaagcaaaattatgtctcggaaaaaaaaaaaaaaaaaaaaaaaaaaagcaaccccgctctattaaacaggtagagtccagctttctcaaaagtgaagaataaattttgtcataggctgggtggggtgactcacatctgtaatcccagtactttgagaggacaaggcaggaggattacttgagcccatgagttcgaggccagcctggcaacatacggagaccccatctctacaaaaaaataaattttagaaattagccagatgtggtggcatgtgcctgtggtcccagctacttgtgaggctgaggtgggaggatcgcttgcaccctggagcactctagccttggcaacagtgagactctgtctcaaaaaaaaaaaaaaaaaaatctgtcatggactagccttagaaacattcttacattcatccccccactccccgcccccgggctctgttgccaaggctacagtgccgtggcaccatctccactcactgcaacctctgtctcctgggttcaagtgattctcctgcctcagcctcccgagtagctggggttacaggtgtgtgccaccacacgcagctaatttttgtatttttagtagagacgaacttttgccatgctggccaggctggtctcgaactcctgacctcaggcgatccgtgcgcctcggcctcccaaagtgctgggattacaggcatgagccactgtgcctggcctagaaacattcttcaactggagttggaatttttgctttagaaggaaagctccagagactttattaaaacaaaaaccaaaagataaagaaagttgagaagatcctatgtccttcatggcaggggccagtgctatcagggatttggaaatggagtatacagtggaagtaagcactcctgtgttttcctttggccaaaggcataaattctcagtctgtcttctatatttatgagcccatcagcctaagaacaatatcaagactatgtaggcatagagctttggaagtatctgaggctctgggtaagttctaatatcctctccatgcagttgacagtgtgccctgggatgggtcatttgatctttcaggatctcaacttccatatctgtgcagtggtgaacaagacccatctcacaaatatgtcaaggtaggatgggataggaaatgggaaactgtcacagatgcgataaggctcttgacagtggagaagatgtggtttagaatgcctttcactgttttctcaaccctgggtcattcttaaccttcctaaggctctggttgcaaagtgcaggcgatgaccctaaccctatgaaatgcaggccgttcactcctggggtcccatggcatgtggctcagagtgactcagaaatgctagagggcccagtggagtctttctttctagaaaagccttggatcttggagaggccctggtctctggttccacttggaccttccacaagtgtgtagtcctaggtgggttatatcacccctctgtgcttcacttactgcatctgcttcacttacttctctgattctatgcttaagaatccggacttggctacttcatcctcttcgttactctggttgactcaggaacaggtgctagaagcttcatgagccatgtgctcctaatgagcgctcactgcccgccctcagagtttgccagcaatcccagccccaagcagctgaccctacaccctaatctcaccttcagctttcagttctcctgttggcgagccctggagcaggcggaagaaacagccatcttattgggtgccacttcccaatgtcaatcggatctcctttaaactcagctatggtctgcttcattttgaacttagggtaaaattcaagacagttcagcaaagaaaatggatgaaggacgcaaccctttaattcagttcacaacccctgagggtggacagtggccagccacatgctggcccctggaaggagtgaaggaagtcgaacactgtctagcaaaacaaagcacatttggaaaataaatgtcatttaggatacaactaccaggtgcacacttctctttatgtttcagttcactctgccttgtactttaagacacgtttcctccgctacattgacccacctcccacctcggccgaggaaagcagatgccacgtagaatgacggtgattcctgcaagctctatgagtcagggacatatggtgtccccacgttccatgtttactcttgtacctggagagattagtcagccagaagcacagaatcagcctgaatgccatctggcccttccctggagcaggctgaaggtgaaaagtcagccctgcataccttgatagctaggtgagggctgtcaccaatgggggtggaagtatcatctcatgttgtacccactggcagactcatttcttctgagcaagggagaactgcattctggagaaaggacactggccattcaggctgcaattcgggttccccagccctcctgtgccgtcctcttcccagccatgagacacccgctcctgaagatcccctttcccgtggtcagccggaggcccgggaatgagtctaagagtcattggtattctgtgttttagctggtgctttgtcaatgaaaacattctggactttggccccacatctgcctgcttttcagctctggtcctgaggtcttgggtaaccttcccaacctccctaaatctccctttctttgtttgttaaatgacaatcctcatagggttgttgcctaggattaacttatctgagataatctatgtaaagcacctggatttaggagaaatgcaataaaagttagttcccttcccccttgccttggattacatggttttattctcttctgccagagattccttggggaaaggaaagcgattgtgtaatttgctgtaatcctaagtgacgaagtaaagttcttatcaaaataattttgatgtcccattggcatgtctgggccacggaaataatgacatgatgaaaattaagttgacgctattggctgacagaaagagcttagctagtcagtacaaagatagctagactggcacccaaggagccccggatcttcccaacaaggagaaaaattacacccagctctctggggaggcactggacttttgtaggcctacaagttctcttgagtcaccagcattccaggttcactccctgggggctctctaatctgtgagacctggctatggttcttagcccaccagccccaggagaaagacagtttggcagtggattttataaccaatcccatacatggagcttttccataatttatcttggggcaatatattaagccacaagttacgaagttccaaattatgaaactgtctctactgaatttccaccagcccaatgggtgtcattgtaggatttatatttttttctgggaagaatcatgttgtctttaaaaaataaaaaataaaaaaaaagaaagcctctgcttcgaatagctatctctcttgcagccgtgcactgctggctgcacaaggtcctgggtgctgttctctgggtcaacttccctgagtctgtttggagaaattgtgacatctaaccaacttcagagaaatcgatgagggctggaagggtggactttgttcccctgtggtgttctaatgaatattttcaggcttaaataactgcccaaaaatcaaaatcattgatttttccaaagggcagatacaagcagatggccccatcataaaggtacttccaatggttttccagcactcactctttattcttcatgttgaacaactgcaattctggagactgaagaatggaaaggaggaggctgggtacagtggctccctgctctaatcccagctatttgggaggctgaggcaggaggatcacttgaacccagaagtttgagaccagcctaggcaacatagagagatctcatctctacaataaatttaaaaactaaccaggtgtggtggcacacgcctgtggtcccatctactcaggaggctaggatgggaggatcacttgagcctgagaggcagaggttgcagtgggctgtgattgcatcactgtactccagcctgggtgacagagcaagaccctgtctcactacaaaaaaaaaaaaaaaaaaaagtaaaagaaagaaagaggaaggaaggaaaagtcctgaggttgcctactgtggcacatgcaaagggcagagggcatctttttgcagcaaaagctgtccagttatagaaggcatcttggaagccttatgcccttgagtgcagcctccttggtgagtccctgagtcaggtggatccccatgatcggactctagggtttggcttgtgtttccgcaccagcaaagagttgctgtgaccaggaccgttatgtgcatgcagaacaagagtggcgccagagtccaaaataaaaccgtgctggagcagtgccagagtgcataagcacagtctctccttgtagccaaggtgggaaccacagctgggtaaagaaagggtttcagagtggagaagagtgggctccagccctgaccggatctctcctggatgagttcccattgtcttacttacttcaaggttcgatttttttcatccataaaatggaatgacaatgtctctgggggctgtggaatttcagcatatgttcaacgtgttatgagaacaaggatagaggcagtttacttgttcctatggagaaacaaggaaaaggaatttggggccgggcatagtggctcacacctgtaatcccagcactttgagaagccaaggcaggagaattgcttgagcccaggagtttgagaccagcctgggtaacatagtgagaccccatttgctacaaaatataaacatgggagaggtgggacactcctatagtcacagctactcaggagactgaggggaggatcatttgtgtgcaggagattgaggctgcagtcaactatggctgtgccactgcactccagccagggcaaaggagccaggctgtgtttctaaaaaaagaggaagaaagagagcagtgggtgagggggagagagatagagagagagaaagagagagagagagagaatgaaaaagaaaggaagggagtgagggagggagggaggaaaggaaggaaggaaagaaggaaggaaggaactaaagaaggaaggaaagaaggaaggaggaagttggggaagcacagcctgtgaaatttgggaaagattttttgcctcaaatcccggggcacttttccatgtcggatgtgaacacccagccctacttctgttgtgatccttagcattgaaacctgcctccccaagaagagaaatttttattttgagcattgagctattctagagaaaccactattaatgacgaaaaatcacatttgagccatgagcaacatcttgggcctttggtagtcccagacatgagacttggggaaggtggtttgggggttacttttccagggtaaatcccttgtcctccagaattgccattcagacataattaatattctccctgcttcttctttccagaaaaaaaaaaaacccaacacatgcttacacttacttgttgggcctaattgttgtccaaattagtcctactttttcagataaattgtgtctttagaaaagtgttgaaattgggtggagctcttgagcaccctttgtggccggtctttcaccctgacattggcatgtgtggtaccggccacccatgacacatctcctgccctcctgccctgaaaaggttcaaagtcacagacacactgaatcagagcgctaaaagggctatagaaaacctgcaataggctgggcacagtggcttatgcctgtaatcccaacactttgggaggccgaggcgggtggatcacttgaggtcaggagtttgacaccagcctggccaacgtggtaaaaccctgtctctactaaaaatacaaaaattagctgggtgtggtggcatgtataatcccagctactcgggaggctggggcaggagaattgcttgaaccctggaggtgaagtttgccgtgag

SEQ ID NO: 533 - DNA, 40001 bp, Homo sapiens
tggatatgaatagagatataatatagataggtatataatatagatatggatacagatatgaatatggatgtgatatgaatataaatttgatatggaatggatttgatatgaatgtagatattatatagatgtgatatggatgtgaatattatatggatatagatatagatatggatataaatacaatatgggtatagatataatatagatatagagatgtgggtatgatagggacatagatataatatatatgaatatagatatattgatatggtataaatatgatatataaatggatacaatatagatatgaatttgatatgtgtatgtatttgatataaatagggatatagatataatatgggtatggatatgaaattaatatggatatagatttatatgaatatggatatagatatagatatggatatgccataaatatggatatagatgtagtgtgggtaatgatataaatatgatatggatataatatgggtatggatatgatatggacataggtatggtatgatatgatataaacatggatatagagatgatatcagatggatatgacaggaatatggatatagatttatatggatattgatatgatacgatatggaattaatatagatacgatatggatattgataagatagggatatggagatagatgcagacattgatgtagattcagatccagatcctgttatgggtactgatatagatattgagactagatgacatgtgcatagagatgcacgttgctctggatacaggtattgatacacacatagacaccaatatagacgcagatacagatattgctgttgtagcctgaatgtatgagtgagaggacactccttagacttcacctccttccacccttcctcccatgttcatcccagccagcatgctttggacaagtgaccgtctatgaggcccccatatcctcatctctgaaatagaggtgctacttcagaggatggaggtgtggattaacgagaaaagcataagaaatacatcacctgaaactgttattcacttgcagatgaattaagtgttccccaaacctggctaactgacaaggcaagtctgggatacgctggcccagcgcttcagcactcaatccatgtggacactggagttcgaaccaggaaactgttcataattggggtggtccatgcattttccctgttggcatgcccttcacttacctcaacaggacagaagaaacgaatagccagaatgaataaaaatgaggactacgtttggaatagaaatgagttgctcaaaacctcctctttctttctcaattaagcatcactacgtggaggctgccggatcaccaagcactagaatgagatggagcacaagttggctgcccagcaaattgctgccttcgccttgatgattgtacattccctccagctctagctggcttaactgcaaatatcattagattcaaaatctcactctatctctctctccctccctccctccctctgtgtgtgtgtgtgtgtgtgtgtgtgcgcgtgtgtgtgtgtgtagaacctattgatagccacaggcagagctaattaaatgcaatgcacatttcatactttcatgcaatttcacacaattatgaattttgcaataatgcaaatgaagagaaaaccaggaaccaaggtgggtgagttgtgggagggggcatcagagggccaagaagtctctggttctttctaagcttccctgaaccactggaaacttgccaaatgtccccaaccattgcctctatcaggttgttgtatgcaccaggagcaatcattgggaggcatttagaatctgagtgatccagggtcaagaggcatcttggagaggaggtggagaaaacttccacctgagcctcagagtcccgcaaagtggtcctctagtcacactccctgttgcaatcattactgagcaccaacaggctacaaggatagagcagctgaacacaggtcatcacgaggtggctcactgctttctgaatcacagttggcaaacttttgtgcaaaaggccagacaataaatattttaggttttgcttaccagatgtttctgacacaactatgcaactctgtcattgtggccatctataaacaaatgggtacgcctgtgttccaataaaactttattggcaaaaccacatgttgggtggatgtggcctgaggaccacggtttaacaacctctgatataagggatcactggaagagtgttttagaaatacctgaccaagtgtattggagagatgtagagtcaaacacataaaaacatgaccactcaaagtgacctcagtggaacaatgggtctagttaagagtttcacttctcagactgaggtaggaggtgggactcaactccagaggcggggcttgggcactgaaccagattgaggactagctaaaacagggtcagagcaaaagcatctttccaaaaagacactcccaccagtgtgtcaacttagtgttgtcaaggcaacaccactgcccctttccatggcaatgatccaatgacccaaaagttactaccccttccctagaaatttctgcataaactgccccttaatctgcatgttattaaaagtgggtataaatgtgactgcaaaactgccctgagctgctcctctgcctaccgggtagccctgctctgaaggagcaatcatggagctgtgacaccgcacctcaataaagctgttttcttctacctggcttatccttgaattcttttccggacaaagccaaaaccctcctgggctaagccacactttggagctcccctgtcctgcatcaagaccactgcctgagatgaagttcatcctctaagggctggaagtggggaagctctgaagtggcctctgcacaaatagagaaggccacatggatggtgactcatctattaattggatattcctttggaagtttaaaggctaggtgttcccaagaggacaagctttgggggctccacacctactcctagcaactgtactctaatcttctgatttgcaatggggctgctgtaagtctcagtttttgaatttctgaaacacagattaatcatgcaactacaagactatccttgtaacccagtgccactaaagtgatctgggaatgtcccttccgtacacctctacagacacaactaagcaaagctttcatagtaatatcagagtagcagccaggtgtatgaatagaggccagaaaccaagagcacacaggagctttggaggcagaaggcacatatcgctgtgactgcagggtagggcagcggtggtagggcatgaaccacaggatgagagaggtgctccagaagtcttcttgtagagcaagagaccaatgttgtgctttttgttcatggccctgttgttgcatgtttctcagctgtacagcccataaatgacatcttggctttaagagataaaaacccagccatagacttgtctcatgtcggcccacacagagaaactcctgggggacttggtcattggacagaccatggatttagtcttggcaaatagatttagtttccccaaccagctgaaagagggtctgtttctgttgcagtctaatcaatgcacatatgggttgcttgttcaataaaagaaacttaagtggagatatttaaggaacttgagaagtattcaaaaaatctaaagcaaaaatggtttaactgcagacactggcatgtagttcttaaggtatacaattaggaaaatttgtacagtaattaggtcagttaacgagagttccatgttcatcctcttcattagctaagcctgagaatttttcttttcttgcccaacatctcaaaattcttagtttgagctgatttttctgataaattcttagaaatttctggttgaggccgggcacagtggctcatatctgtaatcccagcactttgggaggccaaggtggatggatcacttgaggtcagaagtttgggatcagcctggacaacatggcgaaaccccatctctactaaaaatgcaaaaattagccatgcatggtggcgcatgcctgtaatcccagctactctgaaggctgaggcacaagtatggcttgcagctgggaagtgaaggttgcagtgaggcgagatggtcccattgcactccagcctaagtaacagagggaaactgtgtatcaaaataaataaataaataaactaataaataaataaaggaaaatttctggttggcatgaggtcttcctattaacaaaagctgacaggtgagcattttatgtaccaggagtatttgccaagctgaccccagtgatcccagtcttttgccaaaacaggtgcagaccatagaaagtatagaacctggtcaaaccaaaagcagcccctattcacaatacagtgcccctctatcgtgggactctcctttgcttggctttctaacttcagctcccactactgacatcatcacactgctctcagtctcggcctctgctctgaagagcatggtctcccctgctccacactgcacaacccatcatctttcagacatctctttctcagcttgggttctctttcactgtcttctctactagtcgtatttctattcatctttctgcgtccaactcaaacccttcttctcccaagtagaaccttgtaacctctgtaaacttgcatcctatcaaacttcttagtgcccattttcaatagtaagtgtcaacgtttgtttttaattctctctctctctctctcttttttttttttcttttgagatgaagtcttgctctgttgcccaggctggagtgcagtggcgtgatcttggctcactgcaacattggcctcccaggttcaagcaattcttctgcctcagcctcctgagtagctgggattacaggcacaccccaccatgcctggctaatttttgtatttttagtagaaacggggtttcactatgttggtcaggctggtctccaactcctgacctcaagtgatccactcaccttaacctcccaaagtgctgggattataggcatgagccaccgtgcctggcctaattctctctttcaatacatagattttggtttcccaaaaccagtgagcatggactgcattttatatgtattcaacaagtgtttattaagtaactaacatcagttgttcattatttgtaacttaaataatatgaagtcaattggcatgattaaagctctatggtcttctgcaaaacagcaatgatcagttaccaattgctttctttaagtatagcgtggagaatggagttgaaagtgaccagcattgtggcctttgttctggggggtgcctgccatactgatggcagctgctgctccagacagcctgtcactgccatcacgttggctgcagcagggaggcattgcctgggctgcacgccccatggagccagcgggagccccatcccttctgagttggggtgggagctccctgggtgccgctgcagctgcccaaactgcctgcagacccaggccactgccccattggcctgggaaggccccctgcccttgcaggctcagaagtgcctgctcccactgcctggctgctttctgctgttggtgtctgctccaatctcagaaaagttggggcaaaacctgggcatcatgaatggcagcagaaggcagataggttcctgggcagaaggggatgggtccctggtaaagccaatcccatggactggaatgaagacttgtggtgccttttctgtgtcctcccatggctgcccatgagccggctggcacacactttctcccctctgtggtccatagaagccctgggctttaccagagcaggcagagaatggagagatgacaggatgaccagcagcagacaggagtgggaagaccactgcagatgatggctgcagagatgatggggacaacctgatggtggagaagagccaccctctccagagtctctgctgcgagctgaacacttgatgggatgacctgcatacaaagaggagctacccattgtaagtctcccctgagctgttctaacactcaataagcttctctgtcttgctcaccctccacttgtctgcatacctcattcttcctgaacgcaggacaagaactcgggaaaaggtgccactggccacagagatttctgcccagaaaagcgacaccccaacgatcctgtaacaataccaatgctattatcccaaaataagctggacatattcctcagtgtggaattttggagaaggcggtagacgcagcattgcaaggtcatgtttctacctgtactctgatctgttttattggctttgtaatttttctcatactgtctattttcctctcaataaaaccttagaatgctcttcaatatgtaagataaataaaagccagaaaaacaaaagtttgagtggtcacttcaccaaagaatatgtacaattgaaaaataaacatatgaaaagatactcaacatcattagtcactaggaaaacgcaaattaaaatcacaataagataccactacaactattagaatggttaaatttaaaagaaaatcccactgtaacaccaaatgctggggagaatgaggggcagtaggagccctcactccttgctgatgggatgagtgacatatcatgacacagccactctggaagatagttaagagttccttataaagttaaacttaccgtaactcaggaccacattcctaagactttattggagtaaaactaaaaaacccctgttcacacaagaggctgcatgtaaatgtttgtggcagctttattaaacatctccaaaaactggagacaataccaatgtctcttaattggggaactgaaagacaaatggtggcccaaaatagaggtcagaaataaaaggaaagaactcttgattcatcaaggaagaatctcaggtgaattacgctacttgaaagaagctagccccaaaacactgcatactgtatggttcaatgtatacgacatacatcttggaaaaggcaaaatgacagagacagaaactagatcagagattgccaggggctgggtgggggatggaatgttctgtatcttgattgtggtgctagttacatgactgtacacattcgtcaagactcacagaactgcatactgaaaaggttgagttgaactgtgtctaaattatatcttagaaaaaaaaatatatatatatatttttttttgagtctcgctctgtagcgaggctggagtgaagtggcttgatctcagctcgctgcaacttccacctcccaggttcaagcgattctcctgcctcagcctcccgagtagctgggactacaggtgcacgccaccacacccagctaatttttgtattttcagtagagatggggtttcaccatgttagccaggatggtctcaatctcttgacctcgtgatctgcctgcctcagcttcccaaagtgctgggattacaggtgcaagccaccacgcccagccaaaaaaaatatatttttaaagctagcaggtctgattttaattaagatttggaagtctacctgcccaggcttcccaaggtgctccagtcagatcctgggtcaccaccaagtcccacagaaaccagtttggagacctgtagactagctcctcactgagccatttctggatctccaactctctgtcatctttcacctgggaccctcatgggaggtggatgcagcagattctctgaaatcctacttttgaacactgtcgttttcatcagcaaagccacttcctggactgctcctatgtccaccacccagactgtccagccaggctgggcaccttcctagggcaagactgtctcagcttgtctgcgtggactgtcagcctccagtctagagggagggaagtacagggctgggcctcctgcctcttttcctatggagggtggggatggcattgcacgcacatcaacctgatgctacagggcttggcctcttgccttgtgtcccgtggagggcggggatggcattgcacgcacatcaccctgacgctgcacttgccccagaagtcagcactcagggattttcctccaccatggggctgcctgaaaatggaaatgaattctcagcacaaaacaaaaagacaaactggtatgatgcctcagagcatgttcgtttggggtttttagttgttttaaaattttcttttcattctaataaaggacagctttgtctttaatccacagatatggctgaatcgctgttttccaagcagcacacagaaaattatcctacctgaggagcggagtagtatccatggagacacaacaccaaggccttcagggtctcataggctggcaggcccagcaaggagcaagcgctacggcttgttagtaagaggcggctaatgagagagcctgttactgactctggggtccctgaaacacctttcactggggcctcgctcattcctgggaggaatgcagttgagtggtttgataccaggcttgagcgggactgcaggatttgactcctaacccctcatttgtggctgcaggatgctagacaagcacttaactcctttgagctcttctctgtaaaaggcagactgtagcacctaccccctaaatgtattgaaacgtttcaacaaatgtgagcacagaatcagtaccctgccgggtccacactgagaaatcaatgacagctgtgattaacttcatgcccatgcccattgggtccattcaagccaccgagccccgtggttgagttgggctacaggccgccctgtccccaccaacacagcacatctcggcggtcccagacaggcgggaggatggaccctgagacagcaccttagggaaggcgtgaacgcacgggaatctggcgggcatctttggtgaggttccaccttctcttggcagagaccttggtggaatcccgggactccctctccaaggaaaccccatcagaggggccctggtgggtacccaaagagcagcctaactccagggagaggcaaaggacaagagaggccgaggagccaacctgacgcctagaaatcattcaatatgtatgtattgagtgagtgatttaacgaatgacctttagagtacccatagctctccacttcacctggctggctgacaccacatacagacatctcaaagacacagaaggtagtggaacagagcggtgacttgcaggggaggcgcacagcaaggccatgctggccccccacaccacgcagttcccaagggagctgttgacaaaaataactccttttgtgttctgacttcccctttcacaggcctgaccaccatgtctgccttccccttccttgctccccggaatcctttctgttccccagaagtgccacgatctccctgagactggcctttgctctcgctggtgcaactccctgtctttggcatcacccatgatgacttcagcacaggactcaggtcttggttgccatggcaccgatcagaggcccttcaccccagtgctgcagcctaacacagtgctttatcacgctagtcacttcccagaatcaccttgtttatggttgacttgtgtgctgtttgtcttctccaactagagtgaaagccccatgaaggtgagattttcatagttgagttcatcactgactccccagtgcccagaacatgcctgaggcataaaaagcatagatgttggatggatggagggaaggaaggaaggaaggaaggaaggaaggaaggaaggaaggaaggggagaggagaggagaggagaggagaggagaggagaggagaggagggagggagggagggagggggaagggagggggagaaagggatggaggtagggagggagggagggaggaaggaaggattatgggtatttggatggatagatgaacatggccgggcgtggtggctcccgcctgtaatctcagcactttgggagtccaaggcaggtagatcacaaggtcaggagatcaagaccatcctggctaacacggtgaaaccccgtctctactaaaaatgcaaaaaattagccgggcatgatggcacacgcctgtaactacacaggaggctgagacaggagaatagctcaaaccagggaggcagaggttgcagtgaaacaagatcgcaccactgcactccagtctgggcgacagagtgagattccgaaaaaataaataaataaataaataaataaataaataaacaaacaaacaaacaaacaaacagatgactgcatgcatatctgcatgtgtaaatggatgaatagatagataaatgaataaatgtgtggataagggtatgcatgtgtggatggatgggtggatggacggatgggtaagtggatgatgggtggatgagtgatgggtgggtggttgagtgaattaataggtggagggaatagattgatggatagacaagtgcctgggttgatgacttagccagtgggaggcagatgcttctctcctaggactttctgtcttccaggtaaaatgcctcccagctttgtgctgatgctagttctcacaatgaggcaaattcattttatatcatgcaaagaacctcaactttatggggaaaaggccatccttggcttcacagacaaaagtaccccaggcgggttgccaggacctcattccatgcctccagttcgatggggcgcttggggctgagtggcgagagcagcccctgagcaatgtggtgatttctgaagtgtgctttccctggctgagctcactgagctttcatctttgtaattacgctgggacacatttctcattacagacaccaggagaaaccacaagcaagcaggcagctggttaagcaagaaagagcaaagcaaagattgacctagtttggataaagtgggatcttacctgagtctttcccagatggaaatcacacaaaaccagagctctctgtgtcttgcacacacacagattgtttttcttcactctcttttcttttacagtgatttttttttacaagttttgttctattcaaattgagtagaagtataaagaatgaaactaactgggaaaatctgaatgttcagcatgcacaaagccgcaggcactcggcgtcctctggagcctctgcctataagtgtaggtttgaacctaacacatgaaagtctttagaagagttcagattaatatatgtacatgatgcatgatggatctggggatggctggagaggtgcggggagggcggcatgtatcctgacagctcattttggctcagtggctggagtcataaccatggttaccagttcagggtctccagatgggagtgaccagggcagtgagaagctcaaaacactagcaggactgagaaaggactgagaatgacaagcccagagtaaagcaactcagcagccgggacatgtgttcatgtacttgaagagctgcaatgtgggagagaatagtttatgtgacttcagagggtagaactcaggctaactgataaaagtttcacagagggacagatgcacgttttgaaaatgaagcccaaacttgtccccgcagctggccgagccctgcacaatgaggccgctgtcttaggaacaacctctcctaatgctctccttgtttgctctgctccagtcacaatcgcagaacttcctccaacacaccttgtccttggtggcatcaggacattggcacttgctgttgtctctttctgaaatgaaatcccctttcccttactagggctggatccggtttaactctttactcagagaagtcctccctgaccaccgtggctgaggcgacgccccagggtcattctctgatgctgtgatcatctgggttcctttgattctcagcatttatcactctctgaaacaaacctgtgtatgcgtttatttcttcattacctcacttaacgtgtatgaagacgggctgcatctctcctgtgggcctcctatgcccagctcctaggagggtgtctgatgcacagaagggactcagccatgacagactcagtgagtgcatgaatatgcacagagcagagatgctccagcagggtccgagcaatgatgtccctaccactcagaaatcaaaggaccagctgtatcaccttcacacaagagagaataagcctcacccacaccagcgagacagcagagcctgcagctgcatttcaaacctgagccggttctctagcctgcagggattcgaggctgagaggtgtgcatttcaatcataagttttgtttttgaaaatcctgagatttctggcaattttgttaatatttgatgtatcaaacaataatcaatatctctcttaggacacttttagccatgactttatattaacctattttatctcaatgtgcatttgttctggaatgaaaatccagtgtttctaaattcagatctcctaggttccatattttcaactctacaaaatctaattaaacatgagtttagaaaatgatcattatctctcacatcctgggagggtccacacaagcgcttctccaggggggcttgtcttgagtcaagttctactcaaggccatcatatgggcaaggccaaattttaatccagtgatgggggtggtggagggaagcttatttttcatattaagacaaatacagatttgtagggcaaattcactaagattttaaagaaaaggcttcaatatttaagacatttcacaatgaggtgggacacttctatgctatttttggctttcaataaacccaaatagctagaagtgaccgtatgacatcattctggccaatgagtttgattcagaagtttgtgggaagagagtcctgttgtgaataaaatggcagcgccttctcctgcctggtgtgccatgatgatgcggccatgcagacgaaagcgggatcaggaaggagaagcaggatggtggaatgaccttgtccattgacccaacagccctggcccgaggctgtccaactgtggacttgctgtaaccagagaagctacccctccccttggccgggactctgtggtagaattttccagaagtgacagctgagtgcagtcccagatggaaatgcctcgtttggcctccagaacagaggcacaacaatgaggtcccactggggattttcagagctcaggacaggtggcaggtcacctctccagaagtctctacaggacagagttcagagaggagtttggctctgaggcaaccaagttaggctttactggagctgccgggaaacagtaatggtggaagaaatccccaatccactggtacagcaggaaatggcttaccgcaatacgacttgcttagggcttacaggtgccgtctcgtatccatgaccgggtcaaacatagagcctccacattcccgtgctttgtctcataaaagattagctgaactgtggtttccactggtcaatcagaacaaagtgctcgctaactgactcaactacgctgtagttaagagtatctccacaggaccctggactccgacccaccctctgccggacagatcacgcagcctctgctcagacacaaagagcacactccacgagctttgcttgttcctctctataaaagaaaagcccttttctaccaggcatttgagacgcttgcagatctcagggtcagagtgagcccagttgccacagtcccttccttcaactgcgacagtcttttcaaatagcatctctccttccataggtctagacttgaacacacacataatcttgacatccccaagctgtaagggttatgggaagttataggtccaatctcgttatttgcttgtgagtaaattcagtccagggctggtgaaaggattgtactaagtctaggtagtgtaagtggtgagctctgggccagacctgacccctgctttcatgttctttgcagattatcacagctacaagggcaatcccaggtgagctgatgcaggcacacacatctccaaacacacagcatcacacgtgcacaggcacacaggaatgtgtgcacacctgtatctacagcccctggtcagtccgaggagcagcgagtgttgctttcttcacaccaccctatagttagattgacacctcacaatgagaacgaaatcaggaggccacagccctggatataccctgccctgcacaaaatcatccagttctctgtctcctctctctgtcctgctcccgctccacagccacttctaccagaggtggccttctcctgcgctgctctacccaagtaatggcaaggctggaggagtttgcagtgaccacaggacgtacaggcaaatcacccttctaggccccgtgtctaggagttggactatcagacatccctctcgagagtggaatcgagcagggtttgttcttctgtgtctggcctatttcacttagcgcagtgtcttctgtgttcacttatgttgctaggggctgagggagggaaatggggaaatagactcaagttccagttaggagaggtgaataagttccagagatctgctgaatcacacagtggttagtgttaccaatactgaatagtgcactttagaatatgttaaggggccagatctcacattaagggtttttattgcaaaataacaaactcccacacaggaacacaccagaatgtttagaggtgatggacatgctttgtcttttgattgtggtgatggcatcacaggtgcatacatatgtccaaatttatcaaaatgtataagttaaatatgtgcaatttttatcaattatacttcaaaaaacttctaaaaagtatagttaaagaatcaacttttcctgtaggaaggggaggaaagggactttatcatgataatatagtataattattttatgtgcattgcaaaactaatatgtatatcatgtatattttatgtacatagcaaaattctacccccactgcaatttaagttaacaatcactgaagactcattttgtgccaagctatgtaccaggcacctaagacaaggctccacctgccagaccccacagtgaaatggtgcagaagtggtaataacagtcaagtaaatgtaaatacatgatatatgtacataaacttataaatatgagtaggtgcatacaataagcatataaattcatattcttatactgtatatgcaatacatatatggaaatatgtatatttatgagctttatctcatataaaacttaagataggatgttgttgtccatcctgtcatcatgtgctttttgaaagtgaggaaattgaagcttaggaagttgaattaacttgaacagtaacacagacctcataatggggtatcccaaaataagactctggtggtcctattccagagccagaaatactaattgtcttattgcattgaagacagacacataaatggtcaatttcaatagaatggacactgttacaaaggaggtgtgactagatcctaaatccatcctgaagtttactcagaagggaaaagagaacacagctttatcagagaaatctaaccatccaagaatgctgggttcttgtaactgcttccatgttcagtttgctgtggtatgttgctgggtgcaaatggatgaaaaagtccagtctcatacagatatgcagttggaagggagacggatttcaacagtgtttacagatctcttcagttccttgtgcacattcttttttgatactataccaaaacttagcagcagtcatttttttaaaggttacatgcaatgcaagtctgaagttacatgaattaacttttcatgttctattaagtgaaaatccactggcctatttgaagtgtaagggaatcttttaccagtgcataatttgataacatcatgttggtcagtgggaaaacaaaagttcactatgttaggcagattttccattatgcaatatcagaaaatgaataacatttgctaatatcaccagatctcattagaaaaggcttgaagtctggggatactgccaagacaatgagtgtagatacaagttttccaaaatttttatttgaacttagaagctcaaattttatcactggaaacaaatactattcgttactttcctcaaagtgacaggctcacttcgtttatatttttaaatacactttttattttagcagagttttaggtttacagaaaagttgtgaagagaatgcagagtccacatacaccccacatccaatttccactggtgtgaatactgatacattgttattaatttaagcccatagtttattcagatgtcctttgtttttacctacggtcatttttctcacagaaaaggattctgggatgccccacagtcccatccaggatatcacagtgcatttagccatcgtgtctccttaagctcatcttggtggtgacagtttctcagacttgccatatttttgatgaccctggcagttttgaggagtactggtgtattcgtcttttctcatgctgctaataaagacatagactaagactgggtaatttataaaggaaagaggtttaattgattcacagttcaacatgggtgggaagatctcaggaaacttacagtcatgctggaaggcacctcttcacagggtggcaggagatcgaggtgcccagcaaaagggggaaaagtcccttataaaaccatcagatctcgtgagaactcactatcatgagaacatcatgagggggccagtcccatgatctaagcacctgccacgaggtccttcccacaatatgtgggagttatgggagctacagttcaagatgagatttgagtggggacacagccagaccacatcaactggtcaggtattttgttgaatgtccttcagttgagatttgtctgattttctttcttgtggttagactggggttatgggctttggggaggaagaccacagaggcaaagtgccattttcaccacatcttatccagggagcatattttcaactcttgatgttgaccttgatcacctgcttgcctcaaggagctttcatcagctttctccctgataaggtttcccttttctgtcaccccctgcacactgtgttctttggagggaactccctatgcagggtgcaacctgtacctagggagtgggagtgaggcaccccctccttgaggttggagcacctacgtgaattatttggaattcttctgcacaggagattggacctaatttattttggtgaagatttgcaaaatatccaagtctgaacaactgtagtttatctgtcagttaatctttcaagtaaaactgctgtttcttgaaaaacagagcagttcagtgctctgctcaaatgagcgtaccgagtttttccttggggcagccattgggtcctggtaagccacagaagacccttaggcccatctccctcatcatcacacaaagtgtttgctcagagcacccaaagttcaagaattaataaaattaatactttttactgtttctatgagtcagttcttaagtgatattggcattgctttattttcctgaaaagcgtggtgatgaagggtgcagggatggcccatgctgttcagtgccccatccttggtccatgcaaaggtgccagcacttttgcctacagttgttcttgccccatcagtgttaatgccagtggaaaagacagataatgtcatagtatgattgtgaaaatagttttgactttatgaacccttcaaaagagggtaccctagaggtaccctggaggtccagggggtacactttgggaaccactgtcagaaggtaaaaacgtagcttcctcttgacctagttaaccttagctctccaggtctctcagagagaatcaagatcaacctgctgtagtcaacctgttgctctccatggtcctacagattctcatggtcaccttgactttgctccagctgttcctcatttctgatgctctcctgtaccagaacaatgggtgcctattggaaaagtcaccctgaaagccccaacgccacctccccaaggccccaagtcaggaaaccgtaaagtcttcctcctggttcctttttgtattcattgtcccccagattttaaaaatgtctcctgccttattactgattaattcattgaacacttattaagcaccctattgtgctggtccctgggctcattaccttgagtgtcctgctcttccgaagagagaagatgcactcagcctttccaggcaaataaaacattaaccctttcccctgagtcttaaaaaattttattttgagccagagttaaattatcagcatatataagcctagttattaattacattccttctcattaaggaagtttccagggtcaagttttcaactgaagtttctaggcagtttgcccaagtaaggacttcattaagaaccaaggcaaacattaaaaaaaaaatgcagagagctcaaaagggacaaggaaatggccagggaagatggaaagccacgttttcctaatttactctctcacctcgggctccctctttcgccctcttggatcttggttgttggggatgaagagaggccagctttgaagggatctcagtcatacctctagggctctcaatctggaagtatttccaggagatggaaggaagaatgccaagaaggactgcctgctcgaaaacgagaggttggttttgtgattctgtctattgcgatagattcatctgcaagaaacagaatcaccagctaagaatgcattaaactcaaagacatgcaatcatctcacttaacaaaacgtttggagggagaggatcttgggcctgatgcagtggtccattgaggacccaggttcttcctctacttccactctgccatcttccctgtgttgctggttaagcctggggctttctgccctctgtttgcacagctttgagtgtcccatgcaacgataaccaaattcgagacaggaagaaggaaggagcaacttctcctttcctcttttaatcagggagtaagctccttctgagcctccacagcagtctccccttcatgtaccattggccagaaatggttccatgctcaccatgagcccttcctgtggcaagtgagaatgatgtcaaggtgggaatgcgtggtttatcaagggcccagcttccctcagcaggtagccgcttgaaccagagtagggtttcctgagctgggaaggggagtggcaatggtcacaggaaggtacccagcactgttcagcatggtaagtcaaggagacccttcccaggtccatgtgaggttcccatagtgtgaggctaccaaccatccatgttccctgggagcaaaagaccccttcctactccacctaacagatgcaggcatcccagagaagcaaagcgcccttcctaagatcaatcccaggtcctcccaaaaccaacatccatgctctcagcccttccttctcgttgaggatgttatggagaaaataaaagaatcaactgcatgggccttggactagaggttccttaaacagacccattctattcctgaaattctattactttaatcaatcaccatgataccaaaatgaaatgcatttattcactgtcattgttgggtaacacaaattaatatgtagatacagatggcactgagtattttgaagcaaaatacaatgtatatcaaagaagcaaaaaccatgtacttataggactgaatagtttaagcaaattcacagcatcattgggtgtgaatttgttgagcagagcacagccttttgcctagaagtggcaatttttgaacagcattagttaaaaagataaacctccccacaaaggagaaaatttctaagacctatatagtaacacaatgttttatggggtgaaaagtcatagagatgacagatgagatgagatgagatgagatgagaggaattgatggatacaaggacagatataggcaggtggagcatcatcgtcattgcatattcacccacccccaacactgaataatagtaacatccagatggaaatctcaatgctctcaggacacctgagggcatcaaaacttttctaaggccccaaagctaactccctctgaagggttttcttgcatcagctcattagtaagattcttggtcactttctacagtctccacccagttttgaaatactgagaatttcaagaattaagatgagcgaactttctaatctgccagtgtgaacataactaaaccagcttccctgggaaaaccacaacttctgaagaagccacatctgaatgctggggtccatcaaatgcacgtcttgcatttgaaaatcaagggtatcccccagaggagcctgcacctggagacacactttaaaccactcattcctctgggagagaaataaattcccagtattttagtaaattgctgcctaagaagggcagagaagagacaatagagtcggttgcttcagttccttgtgacttcagaaaccactcaggagaccggaaactttcccagcttgttataagattaataatttctggggtcttgcttacacagaaatggaaaaatagaagattgtttcgtgttcatcttttcttcccacctcatgcatttttcttctcaagcattcacactttgcctcagctgaagagttatttgattaatttgccgtttggtttattttccttgtgacaccatcttgccctgcagtgtcgctgggcaccctggcctcacccctggctctgagcccatgggtttggattctatcgctggtctaggcagctgactccgctcacacttctgattctcccatcgatggtgccacctgctctgctctggaagcttctggttccttgtctgccagcagagacattcacacctgcaccacaggtgcacccacatgaagaggaggctgctcatccactctctgtgccccctactttccttgttaccaaaccctcagaatcatttcatcaccatccaaattaatgttaatagcacctatcatttcttggcattaacacattaccctaacagtacacgaaagacgttacatgtgctctctggggcaagcagagtcctaagatggaccccagtgagtcctacccttgtgcaatcccctcaccttgaccctctagcataagcagagcctctgagttgcttccagtcaacagaacacggcacaggcattgggatgtctctcttggctacatggcaccccacagagatgtcatcttcacagactgcactggaagaaacccctgctggccttgaaggagcctccatgtcatcagagggtctatgagagttggcacccctaagacctgagaacagctcctggctgacagccagcaagaatacagagacctcagtcctacagctgcaaagaactgaattccagccaacagccatgtgagctgggaagagaaatcagaggagcactgcctggctgacacctccgccaccagctgaaaccccacgcttgaccatgaaaatgtatcctgagatcagtgcttgccgttttaagtcactatatttgtggcactttgttctagaccacagatatcttctacactggctcatggaattctcaccacagccgcagagcacaggcagaattaatgtagtgcttctcaaagtgtggtcctcagaccagcagtgtcagcatcctcagaccagcagtatcagcatcctcagaccagcagtaacagcatccacagaccagcagtatcagcatccgcagaccagcagtatcagcgtcacctaagggcttgttagaagggccagctctcaggcctctccccagatctgctaaatcagaaacactgggtgtgaggcccagcagtctgtacttgggcaaggcctccaggtgaccttggggcaccttcaagcctgagaaccactggatcagccagctctttaaagttgcaggtgatgagaaacaaaccccaaattctcttcggcaccgcgcagggagtttgtggccttgtcaggtaggaaaatgcagaaggacgactggctttaggctcggctggatccaggagctcagcctattgttgactttgatttggccacatcatggctacaggtgggctgtgagtggagagaggtgaggtgcatcagaggacagccaagctcagaaagaggagtggatggacatcgacaggaagcaagcacagaaattgcaggtgctccccgcacagtgaacagtgtttgtcatcttcacctctcagataagcaaactgaggactccagagttaggaatgtatcagggcctcaaggctgggatgtggcagaacagaaactcaaacctgctttccttgttcctaaatgtcatctaactgagttacccaggatggcttccagaagaggcgagcatgtgtaggaagagggggcactttcttttttttcaaaaaaagaaaaagctgcaactcaggaagggaggcggccagtctcccaaagttcacctaataagaggatatcagcccaaccatctttcatattctaaccctgtgtgactttgggttgctttgggggcctctgaggacatttttctcactggacatcactgcacggttgtccaggttactcacttccacaaagcctgatgggctcctccatgtggaaaccagagccaggtgtgccacccaagcaggtgccctcaccccagccatggcgggactgtctgtgcagcttccaacacccgcctcccagagcagcagggtgaaagtccagcttccctggggaatcagtcatttcccctcaggccagttctcagcatccctggagatcatcctagggtcctcagtgaaggcagcaaattgcataacaaaaactttatcaggaggagagtttgaaaaagcctctcttggagggccacagtgggtttcggtgaggtaaccaaagtctcctttcccaggtgaggactgaagccaattagcagctcaggggctgagacgctggcctcaaactgaaacatcagcaaattctgtgaaacttggtgagataaagaatctcatttaggactaaagaagactttttcctctcttgtctcagattctctacagatacaatcattttcagaaagccagtagcaagaaaaaaaaatttccacggttctctcatcccagaaatgcactcagtgacttgatgtttttaaaatacatattcaagatacaataaggagcttcaaatatttttagatatcatgcagtgctggagaagtgagagtgtggagaaaagcaactgccccatgctgaacccagtgcaaagcaccctgatgacagtaagaagtcagccaggagttttatacatacttaccatgatcaaataggtgtaaaaacatcaggagaagtgttgaagtaaacttatttgtaagaggcacattcaaaatttccattagaaaagttaccaagcacgtggtttatatgctcatgtaaacttttctgggaaagtctccaaatttgttgagaacatggacaatttctacctagttccagtgatgtgtttggattctggtccttggaagacagaaaaaattaccctttactgagaaacgctttcctgtgaagacactgattacagaattaaaagatgcccactgtatttccatcgtgaaacaatgcacacagattcctaagtactatttacattgttgaaaatagactgtgtgactcccaggcatgttgtggtctgtcttgtatatgtaggaggtttgctgttgtgatttttaaatgttagaaaatttcatttaaaaacagtagctcttctcaatccagtttcaaaatgcagtcacacatatgcaccacagaacagtatgattatattaatcttctttcatgattctgaacttatatgcaatacaatgggcagacactaacatctccaatttctcatgagtacttttgaaagctgcatttcatttgaaagcaatatttacaaaactctcacttggctgtggtttttgcatagcgattaattttcaatagaggaaacctggagaaaattccttcatcttttccctggttctcttggaaggattagaaaatgtggtgttagctcctgcagctttccagtaaccatttggcatgacctctcgttaccgtgttattggaaagaacacaggattctttggggaacacagatgtggcttctgcacacataccgtgctggaaggttaaactgttaatgccaaatttctttacagatgaatttaccttttcctgatgcagagatgcaactgaggattggggatttaggataatctttcagggaaacaaatgcaaacactgtacaaacagagatgggtgacgttagcactctgcaggcccacctccttgctgaaacctgcctcctttctatctgaggacagctgtcactcacttccagagtccattttaatgctgtgatgatgttttcactccaaggcagctaccacgggccttttgtcttcctgtcattctctctgcattaaaatattaatatgcattctctgaaggaattattgatgaagtatagattctggaataaaatggatatttctcatgacttcaaaactgattgactaatcctgggtcatatctaccactagattgatttgttaaggttttatgaaaagaaataggaatactaattgatattgaggatgaaaatatggcctgaagaaagcataactacaaatcattagacaaaatcaagttggctgttttagtgtggccagctagttgtacttgaaatgtgtaggatgggggagcttttgtgcaatgagaggttggggggaggtagcttttgttcaacactctaaatctgaacatcctgatagatgttatttatttattatttatttattttggaagaaggtttattgtaacactggctactggttacctcctttggttgcagtgacagaaactgaattcgaatcagcttaggcatgatggagtcatcgaccagctcctccagccgggtctaaggagggaggctcttcaggaacacctggacccaggggctgtgaggatggcacattcccctctctgcatctctctgcaatttttaacctcagcttggtatcatgacacgtgcagattccccgtcttccagaacatggagacacagtgatcaacagtgacccaagttccctgacccccgctttagcagccccagcagcaagggcagcccaagctttccaccttagggtgacctcagatgcccactcagtagtcttcaatggggttgcacagcctctcagggaactttgcctgtggtgtcacaatgattggagggtgcttccagcattggcaagggaatgagggagtcaggaacgctaaaccaccttgcacagttgagacctgtgcccaccctccatggtggatgtttacttgtccagccagagattcccagagaaaagaagcttgttaattttctgagcctaggagcgtatgctggtttgcaatgaacgtaaagcatctgtaacacacactgggttttccagaaacagacctctgtgaatttgtattttccgaagtggaaaggcctgacatcaccgggagttgctccccattttagagtcacttctgtggccgtgccttagggtcttcttgcattggtataaaggaatacctgagagtggataatctattttaaaaatgagtttaattggctcacagttctgcagacatcacaggaatcgtggtggcatcagcttctggggaggcctcaggaagcttccaatcatggcagaaggcagaggggggcacaaacatgtcaggtagtgagagcaggagcacgagagagcaagaggacgtgctgcacactctggcgacggagtctcactctgtcgcccaggctggagtacagtggcacgatcttggctcactgcaagctctgcctcctgggttcacgccattctcctgcctcagccttccgagtagctgggactacaggcacctgccaccacacccggctaattttttgtatttttagtagagacggggtttcaccgtgttagccaggatggtctcgatctcctgatctcatgatccacccgcctcagcttcccaaagtgcagggattataggcgtgagccaccgcgcccggcctcctgcacacttttaaatgaccagatcttgcaagagctccctaccaggaaggcagcaccaagccatgagtgatccatccccaccacccaaacaccgccaccaggccccacctccagcattgcagatcacaattcaacagatttgggcagggacaaacatccaagtgatatcattacagcaacaccgctggtgggctggagctgccaagggcctgtgggcaccctccctgctttgtgagtgaggccatcgcccacccacagccggccagccggccacagagcatccgtggggttgttccggaacattttcattttgaaatatatattttattatcaattgctttcctttcaagtgacctttatattacagctagggcataaaattcatttcttattaaatcgtgcgtgtaggtaggttacattatttcatttcaggagtagcacatagatccttgactgatggctgtgcaaggaggctgatgggacaaggggcacgagcggggatgactggagctcccacagagagtctcggctcccaacgcaaaaaccggaaaccatgcctactacacttgctcagagacaaagtacaggggaaaaaatggaagcatgcacagaaataaatgtggatttaaaaagcaatacatgtgtcttaggattctccagaaaaacagaacaggatgtgtgcatgggtgtatttgtatacaaaaaaatagagaaagagattagttataaggaattggctcgtgtgatgattgaaggcaggccggcctcacgcaccacagtccgcaagctgagacgcagggcagtggatgttttcgctccagtccaagagcaggtccgctctagacccgagaagcacggagacttcagtcccaaagtcagaaaatgacccaagtcctagctcacagtcgtcagacagcaggggctccctcttacctggaggaggatccgtctttctgatctattcaggtcaggcgtggattggcggaggcactcacacggcggagagcacctgcttgtctcagtctaccgactcaattgctaatctcagccagaaacgtccgggcaccccagcacccagtcatgttgacacataaaattaaccatcacgacacgcaaaactaaactcacagatcatatgcgctgcggagaaaatcttctcactacagaactctgtgcaatttaacaaaaaaaaaaagtcattcttgcatcatctagggaggtgggtcaggcgttacctgaaattttcctggttacgtatttttaggtatcaagagaaccaagggagcattttcttaataaagtgattacagggccctaatgttgccgattaggatggacattttcagaattagatttgtggagttaaaatttactgaagtcgggagttctcccccaccccgggcactactgatattttgaaccaggtaattctgggttgcggggttgggcggtcggagggcgcgtcctgttctgtgttgcggggttgggcgggcggagggcgcgtcccgtgctgtgttgcggggttgggcgggcggagggcgcgtcccgttctgtgttgcggggttgggcgggcggagggcgcgtcccgttctgtgttgcggggttgggcgggcggagggcgcgtcccgttctgtgctgcggcgttgggcgggcggagggcgcgtcctgttctgtgttgcggggttgggcgggcggagggcgcgtcctgtgctttgtagaatgcttagccgcatccctgacttccatccagaaggtgccggtaccacctccatcaggtatgacaagcaaaactgtctccagacattgccagatcttccggggagcataaactgcccctgcccagttgagagccactgctctaaaggaaacaaggcaattcacgcagtgccagctgctgattttttttttaatttaatgtggacagtgagctgcacgtgctgttagacaggagcagtgatacccacggctgttgactgagacactcccaaattccatgtccccaaagctcttaagcatctttgtgcagaggcccaggctaaaatattcatcctgctcatcttcatgagtgtagcagcatcatagcaactgcctctggcggccagcgctggcgagtgtttgggaatgagcgcacatcagcacacgccagctccaggcctggtaaacaggggtagggagaagtggccgacgacttcagcttttcagagcatgaaggggccgagtcttgaaactcaccacaagatgtttccgagaggagaatgtgatggatgctcacacattcaacatgacaagtgttaagactcatcattgaatcagatcgcattaaaagattaatataaaattagattcaaagatagctttgaaggtggacctttcccttcgcaagagttaagcagagctctaaaagcagaatcagctgcaaggcacaggcagcgttctcctccgtttcttcttgcacatggagttttcaccacgggctgaaagaaatttgccaaagagtgaatgtttcctccaagatatgcttggaatataagagaagatgccgatgacaacgccaaccaagatgaccccgtctcccaagagaagatgccaataatgccaaccaagatgacctcatctcccaagagaaaatgccaatgacaatgccaaccaagatgaccccgtctcccaagagaagatgccaatgaccacgccaaccaagatgaccccgtctcccaagagaagatgccaatgacaacgccaaccaagatgaccccgtctcccaggagaagatgccaatgacaacgccaaccacgatgaccctgtctcccaagagaaaatgccaatgacaacgccaacaaagatgacccgtctcccaagagaagatgccaacgacaacaccaaccaagatgaccctgtctccccaggggatttgggaggttcctcatgcaaacttgtgttctctctgctgaccatgccgcccaggctcccgggggctgggctttgtgctattttcccacttccttctgtgctgaatccagaaacatccctgaacatgggccctcagtgtaaacactactgcccatagagcactcagggcttgccagtactcagctcaaagctttactcagatggtttcattgaatccccaaggaaccccacaaggagggtttggtccttagcacagttctccagatgaggagccgtgaaaggatgcacacctctcccaaggccagaatggcagtgggtggtggtgctgtgatcccacactctgacccctgacaccctaaggcaaacctcgcacctgccaggctgacccacagccctgtctgcctctctcactcctcccaccactccacccctcttgacagggaggtctcctcaacacagagaggcccgttctgcctccataaatttgtgccagaaaaaactgctgtccaaagacccaaccctccagccttacctggagaagcctcagtgccttccccaccagatcttactcttaccgtctgaggccccagcactgtgcttttgctctgttaaaatagaaaccagggcatactatgtcctgctcagagctccccagaggcttaaaatagaatcccagggtggtgtgaaacccatgagcttaacttcccacctcaaaatctagaaaaagaataaatgaaacccaaagtaacagaaaaacagagtatataaatctatgaaatagaaagtaaacaataaagaaaattaaaaaggcaagcaatgttttgaaaggctaaaaaaaggttaaatttctagctagacagaagaaggagagaaattaaaaattacaaatattaaaaataaaaggagtgccttcactgagatactgaagtcatgtaatgataaaggaaagttatgaatgaattaaggctaatatgtcttaaccatcaatgaaattacaaattcttaaaatataatgtatcaaaactacacaagaagaaacaataaaaactgatttaagaagaaatatatcatgtaaatgtcctatatgttttaaggcatttgaatctgttatcaaaaagtttcccacagggcaggtgttgtggcttatgcctgaaatcctaatactttgggaggccaaggatggaggattgcttgagcccaggagttcgagaccagcctgggcaacatagcaagactctcatctctacaaaaaatttaaaaattatctgagtgtggttgtacgtgcctgtattcctggctatttggaaggctgaggtaggaggactgcttgatcctaggagttttaggctgcaatgatctattatcacatcattccactccagactgggtgaaagagcaagactccaaaatttttttaaaaaagaaataatttcccacaaagaaagttcaaggctgggtgctgcctgcctctccctcgtgcatttccttccactggcatcccactggtaagtcatccaaatatttagtgttgccacatttcaggggctgacaatgctatgcccatcaatgatgatgttctcgcagccaggtcagaaagtccatgaataagcatcaaaatcctagtttagaatctgcctcattggctcattgttggtattaattgtcataactaagttttcctagctaggacacagctgggaatgcccccaccaaagaggaattgagaggttcttgcagaattcacactgtgggagagtgaaaagaccaggatcagatagagggagaagctgaactatgatgcagctgcccaggtcttgaaactccccgagctctgcacctgggagaactctacaaagtcatcccttccagcgcaacgggcccacattcctgtgctgaccaggcattagacgaggctgcctgaggccggaagcatagctttggccaggacagcaccctccggcagaaagcaatgctcagagaagaatgtggctggaacccagcagccacgaacaccccaagcaacccagggacttggtgcctgggttctgacaagggaggaactaggtgccgtacctctgcagccactgccatcaacatacagaaatcaactgtgtttccacatcttagcaacaaaccgtggactacaaactattcaaaaataccatttataatagcattagaacacataaaatacttagtcatacatttaattaaatgtgcaagacttctataccccaaaatagataacactgtagataaaaattacagtagacctcagtagatatataatctgaatgtcctgtatgttttaatgaatttacttctgttatcaaaacgtttcccaaaggctagctgtggtggccgtgttcatggagagaactcagcatttttaagatgccaatttgtctctacattgatttatatagcccatgaaatccctataaaagccctagtatacctttttgtagaaacttataaactgatactaaaattaatgtgaaaatgcaaagaacatagaataacctaagcaatctttaaaagaagagaataaaaatggaggactctgcctacccagcttctagattgactaccttacaatgatcaactcagtgtggtgtttgcttaaggataggcaaaatgatcaatggaacagaggagagaacagaaatcgatccacccatatagagacagctgatttttttttcaaagatgtcaagataattcattggggaatgaatgatcatttccactactgatgctggaataattgcatatccaagcttattaaaataatcatcatcatctcaattcctgcttcataccatacacaaaaataaatatgagacggattagatggattatagacttcatcctaaaagctaaaattataaaacttctagaagaaaacaaaggagaataacattgtcaacttaggagaagtaaagatttcctgaaaagtaccagaaagcattcatgataaattggacttcaagattaaaaacttcaagtctttagaaaacattattaagaaaatgaaaaggtaaaccacagatcagtttaaaaatattcacagtacacatatcctaatgaaaagcctctgtaaatcagtaacaaaaagagctcaatttttaaaaaagtagaagacttgaatagatattttttctttctttgtttttttttttttttttttgagacagagtcttgctctgtcaccaggctgcagtgcagtagcacaatcttggctcactgcaacctccaccctccagtttcaagcaattctctctgcctcagcctccccagtagctgggattacaggtgcctgctaccatgcctggctaatttttatgttttttaatagcgacggggttttgccatgttggccaggttggtgttgaactcctgacttcacgtgatccgcccacctcagcctcccaaagtgctggggttacaggtgtaagccacgataccaagccggaatagatgttttaagaaaagaacatatatgaatgtccaacaaatacatgtagtggtgctaaatgtcctgaattcagggaaagagacattgactcccactgggatggcgctttttgtgttggcaagcatgggggcaactgaaactcttgggcattgaggacaaaaacataaaatggggaaaccacttggaaatggtttggcagtttcttacgaagtaaaaaggactagcctatcacccaatgattcaactcttaaattttacccaagagaaataagaataaatccacacaaaagatttgttttattcatgatccagtactggaaccaatccagaagtcatcaacaggtgaatgtaggacaaatgcaacacagctcatcaatagaagggacaaaccttcagtacctgaagcaggtggaggtcaccaatcgtgctgtgtagacaagtccaggcttgaaggagcaccctctgcaggattccgtctacaggaggttccagaacagggggaaaaaagccgtgaccaccaaaattgtatctggtttctcacatgggttgtgggaatggcatgcaaacaagaatgagtggggatgaaaatattctctatcttgtttaggacacacatgtttgccaaaagtcatggaatgtcttacttgaaatctgtgcctttgttaaatgcaaattatacctcaatgcagtggattaaaaactaaagtgaaatccatacttttccctcaacctcaaggctcccccatgacctctcctgcctcccaggatcctcccacactggtccccacgctctggtcggctggtcctcaggtccaaggagctgcttacctttggactgtgtgcatgtgcatggctccacctagacagctctcctgccatgcatctgcaccgacagccattgagtacattctgagtgtgtgtgtgtgtgtgtgtgtgtgtgtgtgtgtgtgtacgggggggtgtagtatttaattcaaggcaaacattaatcaaaagtaagacatggtatttcctagtagttaaagatgtaaattctggaacctgggttcttaccctggctttaccgtttaccagctggacaactgtaggtgagtgactcaacttctctctgcctccatttccccatctgtgaaatgagtatggtaatagctactttatagagagctgcaggaagggttcagtgagttagtacctgtgaagtgccttcagcagcatggagcacacacgacgctccagttcagtgttggcatgtctatgggttgtcctaattcaacaccgtcaggattcaaaggaatagcaatgaacttagggtcatctgtatttcaatagccatgaacttcaggtcattcacttgaggtgacctgggctttagcctcaatccttctagcagcgagttgggtgcacttacaaaagcaacatgcctggggctcatttctcacctatcagatgaggcttaggctggatccctgcttccaaattacagttcttcaaggccacatttaatatatgtatttattacttacttaacagttttctttaaatcatcattttttaacttggatatatctaacctcatcctacgctataatatcaacaaaattaagggtttgatttgttaattaatttttttttcttaatacacattgaaagcattgtttgaataccaggaaaaaatttaactgtttgttcacaggctctctcaaactgtctcacatgtcacctgttgtatgcatgttgggatacacggggctggatggtggctgagcgctctcctggcccgaggctccttgtgcctccacagtgctgctaggagacccgacagcctcagctgtgctgggaaagagaaaccacccaggcagcagcatgaggcagctgggagacggctaagctcaggacgcccagggtgctcggaatgattcaggctggatgatgatgaggacggagtttctatgggagacagttacaaaaacatcgagagaggaagaaaacaagccgcatgaatctcttcaggacagagtgtttcattgtctagtattatctaacattacaactgggaaaaaagaacgctcttagaatctcaacatgggacttggccttatatgttaataacaatcactccttattgctatcaagtgagctgaatacgtatgggatggctatttctttgtcttgctttacttccccatgagctaaaggcacagagagatcacgtgcaccatcgtaggcaaagtgatcctcccagattcaacatccttgcccagcaatgcacgcctgtgctctgatgcatcagaatctctgtgtgtcttacaaaaccctcagacatgcttcagagtaaggaggagaatgacatgataggaagccagagaaatgggcaaaggcaaggtcatttagagtgagagttgacaaacattttccgaaaagagacagaaataaaatattttaggctttgcgggccgtatggtgtctgtcacagctactcagctctgcctttgtagctcatgaaagcaaccccagataacttgcaaatgaagtgacatgcctgtgccccgatgaaatcttatttacaaagctatctccctccatgctaggcatggccttgtgccacgttcactagcaaccttggagcctgccacgggagaccacacctgcagacaggcccacttcctcactgcttagggacctgggagggccggactcctgaactgagatagaggaagaccttgcctgtgtaagctaccattacccttgtcttcttgaaacatgcagctgagcctaatcccagccaatgcaacctcctttccacccaaggacctaggctccagggccacaggggctgggtctgactctacctttgtatctcccatcccccagtttgcagcccagtgcgcaatgaaaatgtgtctcttcttgataaattatgagatttctttcaatcctggataccaaaagtcaagttaatttctttctttctttctttcttttggctggtttctttaaaaataacagctttattgaggtataattcacaaattcacgtaccataaagttcactttttaaaaatacagtttagtggtttttagtataattgggcctcattattcctagattccatatttgcaaattagcctacttacaacaatttcagttcatttctttttactcctctttgtccccaaaggtaaagccgggcccagtctctctgaacactgccgggtgcatcgtaagtggcaccagcctacagaaggatttacccaaagcagggctgtccatggttaaactgtgctagacccagtacatttcaaatctgattccctctgccaacaagtggggcatcacggatggcttctgagacccagctggcccctaaaacataaggatgagatgtgacgagggcccaggtgctgactgaatgtgaggcccggagaaccgcggcagcctgtctgagcagaagatggtcaacctatccttgtttgagtctttgattgcacaattcccttttcaaaaggtaattgaagttatttaacagctgtttgtgttggaaaagcaggaagaaacagaaagatatgtttccaaatgtgtgctgccttctcttgctccatctgaatcaaatcatgatattaccagagttttaaaatgcaaaagaatacggaggtagctgccaaaaaaccacctttctttgccattggttctttgttgaaacaaaatgcctttcccaccttttcaaagtcagaaatggagctcaagttcattgcaggattaagaggttcttgctccgcacccccacttgcctttccctgtatcatcaactcagccacgaggggctgtggctcactgtctgcctcacgattgaaaccccggctcacgggtccgtcttctccagggagagcttctcttccctagaactgcatctgtggggacgagctgacatgcgatgctgtgtactggctcatggataggaaggcagggcgcatgcatgctcaccaccaaaacggggcaagaacacggggaccagcccacgtgtaagcaactgttagattcaggaacagcccgccagagtcttccacagccgcctgctgcatttagcttggatctcagggatggcaatgggttctgggggagttcagggccacaggatgtggtgggaacgtagaggacacagagcaaaggttaccttccagccagtgggaagcagcttagatcctaggagtgtgtaaaattgaccaagaagtaggatgggttggggatgggaacatgggagggggagaggtcagagcacctgttctagtcccatctgccttcatgttcaggagggccagctgctggtttgtgcgtggcatcatagggatttctagaagtgcccagcagcccccagatattatggactgaggcctatccttcaggccacagtgaattccacaggctggccagcaccaggtagatagagtcctgccctgacactgcacgtggatacaagaagagaaaatgcctccttccttctgaggtcacaaacggagacagcagcagccagggatttcctgtggaaaggccccagatgaattcccatgcccactcatggagaaacatccagcatggcacaggtggaattgactgcctggtgtcagaaaggcccaacaggagctgacctctggccccgagggcctctgtaattctggctgagcggagcacacaccctcgcctctggcttctccagctccagaagctgatggctgttccaggcctggccacttggagcagaacagcccctttggttcaaagatgggccctcctgggacttctactggaagtaaatcccagaaagaagattacccatccttccatgatgtctgacgctctaaattaagccagcctgttgcccagggggttatctttgtcaccccaagaagagaactggggtgtagatgatgccaccctctaggaaatagagcttagagacagagtgacatctctgagcccctgggtacagctgtgacagaagcttttcagttgagacttttcagtcttgtgagcctacaaactcctgtgactctcctagtcactgctgtcactcatcaccagaagagtcctgtctggttcaatcaccgaggacaatgacatcttcgggcctcgctgtcccataggtttgtgttaaatggtgtcaccatggtgacctgccaggtctctgcctaggagaagcaagaacatgcatttcagttgtccaggcacttcctacagggggacaggatcgagtccacggaggagcagctcttgagggtgatgccccagacctgagggggacagagagtatcccccctccattcctggctcctcagaactcactgtgccacacactccagggactggtggaactgcagaaaaccggacagggatgggaggggaggcaaagacagtgctgcatagacccccaccgaacaaaatgtgattgcttgcttatttgcccttctccagctagctattccagaagaccatctgggaacccacaacaattagacattgcttagccggagcctgccagaaatcaagtgcctccatcatattataaacagcccaaagctcagtgtagaaaacacagactcagacagtgcctccatcatgttataaacagtccaaagctcagtctagaaaacacagactcagacagtgcaaaagccacgcctgcagtatagcctgtgggtctgacactcagcgctccagacgctgctcttgacgggaacgagtgtggaaattcaagaggcaagcatcttgcccgcccactctgcactcatgccagcctgtccttctgccagctgtcttgtcgtctcagtcctcctagcactctgcctcccaggaaatgtcacccaagtacactatgggaaggcaacactagtttttattcattttctgggaaaattctgtgaattcttggtgaattttcaaaagccactagacctcatttttgaataagaaaaatcacccaatagaacagagcgaggttgagtcccccccgcttatgactatattgaggtagattttacatctcataacatttacccatttcaagtatacaattcaatgatttttagtaactttaccaagctgctaaaaattacatcaccataaaccggtttcagacattttcatctccccgataagatccctcacacccatctgcagtcactccctacgcccacccccagccacagggaaccaccaatctacttcctgtctctgtgatttgactttcctggacatttcatgtaaatggaatcataatagttggtcttttgtgtctggctttcttcccttagcatgaggttttcaagtttcatccatcctatagcaggtatctgtgctttgttccttctatggcagaataatattctgtggtacagatgcaccatatttgtctactcatccaccagttgatgggtatttgggttgtttccagtttgggactactgtaaatttgtgagcaaatatttttgtaaacctatgctatgcttctcttgaataggtgcggaggagtagaactgctgggtcttaaacaacagggttgttgtgcaagcagcaaggcacttgagtctaaggtcttcaagttcatctaacaaggtgcctcagagcacaggatctgcacttgagccctggcttggccatttttgagtgagtgtcagcttgagctggtcatttaagcctttaaaacctcagtgttctcatctgcaaaatgggggtaataagagcccagtgatcactttactactccaagtaagagtttgcagaaggcaggtcagcctcctttggtgtttttaattggtttgcattcctgctttgctcgtccttgacttggagatcttatgtcttgggaaactgcctcatgtgcttctcactcactgcccctcacttggcacctctgtgcatgcacaccaggctgttatgacactgcaccccttgggccagctttcctaccctgcctccttctgattgcagctgctgtggccttgatattctcctgggttcctccattaggagctgttctgtcagctgtcacattgtcattgtccattatctttctttagctaatattcatcttgtgttctaaatgatgcattaaaaaaaagaaatgctcaatctgtacaatgaaaactataaaacaccaatgcaagaaatagaaggcaacaccaaaagatgaaaagatattccatgttcatggattgaaagatttcatattgttaaaaatatccataccacctaaagcaatctacagattcaatgcaatccctatcaaaatacccatgggattcttcatatcaatagaaaaaacaaccctaaaatgtatatagaaccgcaaaagacccaggatagccaaagctatcttgagcaaaatgaacaaaactgaaataattacattacctgacttcaaattatactacagagctatagtaaacaaaacagcatggtactggcataaaaacaaatatataaaccaatgaaacagaatagagaaccaagaaacaaatccatacatctatggtgaactcattttcaacaaaaatgccaagaacatacactggggaaaggacagtcccttcaacaaataatgctgggaaaactggatatctatatgcagaagaatgaaactagactccatctctcgccatatacaaaattcaaataaaaacggattaaagacttaaatctaaaacctcaaactctgaaactactaaaagaagatatcaaggaacctctctaggatatcagtct

SEQ ID NO: 534 - DNA, 40001 bp, Homo sapiens
tggtattgactatcagcaaagttcaaacgatatgaatgctaaacttcaatctttttagaaactctgtacaataagttgatgtaactgatatttagcataggtatcccatcccatccctttcttaatgcctttaaaaattattttatttatggctttttttttttgagatggagcttcactcttgttgccgaggctggagtgcagtggcgcgacctcagctcactgcaacctctgcctcctgggttcaagcaattctcctgcctcagcctcctgaatagctgggattacaggcgcccaccaccatgcctggctaacttttttgtattttagtagagagacggggtttcaccatgttgggcaggctggtctcgacctcctgacttcatgtgatccgcccacctcggcctcccaaagttctgggattacaggtgtgagccactgcgcctggccttaaaaattattttaaaataacaggtaagttgtgcttttttataaattcaagtgattgttactttcctgggtgccaggaaaatcaaaattggctagttgggtttcagaactttaagaaaagtctttcacttacatgttccacttgaagtaaatatcgaagacatttgcttagcaataattatattgtttaaggaggtttgtgattgtttgtgcttataaccatttcctgatttagtctcatgaaattactttaacaactttcacccttcagctgccatacaaacaggtatgtctaaaaggcagtttcctcagaagcagactctgtgggagagatacttacataagtgatcttcagggggtactggcagaagaaacctacagggcagtgagagatacataaacagggaagggaaagaggctacgctaaggctcaggtgaagggtagtctcatatgagcacgtgagtagctctggagcataaactccaataccagatttttcccaaatattagggaactgagctcaggaattgtctagaagctgccctaagaactggaggacggtatagcatcccaggcattagccaagaagtttcctattggctatgggcaatttttgatgaagaatgcaagtatgagttgctggtttctaacacctgcagcagctaatggtgagagtagtagcctggttaaaaaaaaaatctgggtggaacatcatcaatattggttacaaggaagaacagaagcagtgagcagtaaattaagttgagaaagtcttcagagttattttccttaaagatcgtaaatactctagtgagcagttgcatctttgaacttatagaagcaataatttgccacttacaaaaacccccagatggattgaaccaagcattcccagaatcttgtttcaaatgatgttttttttacattcattcatgactttcccttcatcctgcatcatataatatcatgtaaatgtcaaacaaagaaatcatgctgtaatttctccatagaactaggggaaaaatgaacagggccagccttagctatctaactctaccttaatcaccgaagaagatagtaaataccttgcaaggcaaaaggcaatgccaatggactgcagagaaaaaaaaagaaagaggaatgcaaatcgagttaaatttgaaatacactctggtattacctgccccttaagttggagataaagtcatgacagcattttattaaatattcttccttaatcttacacaataatctatatgccttacatatatgtcaattgtcttccaaagaaactgattatgtaataactgcatgtattcaaacctttactaacaactcagaaaagaaagtatatattcatcttaatataatgaaaaatatacatcaatattcaatgcagataatatatgtaaatgctcaatttaggcaaaatatttatagacaatacattatgaaaagtaactaacaatagaataataattttttgctgtttaagtataagttcttctggggaaagtatagactattttaagcacgaatcaacaataaagttcatatttcacttaaatttataaacacaacacatgcatgtataaatacatatatataggcatacatatggtttttgcttgtttgtttgttttgttttggttttgagatggagtctcgctctgtcgcccaggctggagtgaagtggtgcaatctcggctcatggcaagctccaccttccgggttcaagcaattctcctgcctcagcctcccgagtagctgggattacaggcgcaggccaccttgcctggttaatttttgtatttttagtaaagacggggtttcaccatgttggccaggctggtctcaaactcctgaccccaagtgatccgcccaccttagcctcccaaagtgctgggattacaggtgtgacccaccgcgcctggccatatgtatacataaagttttaaaagctgatttaatcatgtcccttctgtcaagagaatggaataaatagactatgtgtggaatgtgttcatggtaatactctattgctttgaggctggttcctcttatcatgttattactgctcattcttgaatgggtgatttaatcagaggtttttaagataaaagaacatagtgaaggttctgcatatagagttttcccagtttcacaacatgcagctatttagcataggtgtttctataactgttataacactgccagcttttgattttgtttatagtgccgtggggatccactgcagcctgtggcatcacagacaaggcagcatctggcgctgtgagatgggagaggagaattctagttgtagagtactaaaacatttgctagcacaaatctgctcaggatttccttttctccctccccatggtaattttgtttttctccatttatacaaagtgtaaatagatcaaaaacccgtttattgaagaatcacaaacagcaaagtgagaaatctaatttagaagaataagcccattctgtgcccaaacatttttttgtgttttttttttattcatgcagtttggcattatctaacatttggtttttccttcattatactgagaaacattttagtcatcttatatagttctctgataatttttttctttcagaggtcatattgagaagctatgcctttttcatcctttatagaagtgatattcttggaacacactctgcttgctattcttctaatatctacaaaaatatacaaaagagataatgaaatatttataatgaaacattgtactacaaattaagtttcattggagtgaaatagaagcctatctcagagtatgattccattggacaatatggtcattatatatatatattttcctatattactttgctctaattgtactatgatttatttctataatttcacatacttagttcttctacatgtaaattatatatgaattgcattttatattttgaatatttataaataaatactaatctataattttctttgaagcaaattttttccagttataaaaacacaaatgctatgaaataaagcagtacttcagtactagttaatagattcttctccggtggctgtaagaggcattttcttgtttattgacactttatggcatacgtttttgggttagattcttaataaaatggatgtaactgtcagtccaagaaacatatcttttctacagacatgtttagtttgattttacagtgttaaaaatagcgccactaacattcaaaagttggaagatttcacataaacatgttaaaataaggcttctcttgaaaaaaaatgggaaatgctggttgtaatagaccctaattttaacctggcaacacttggctgcagttgaatggcaatgtttacttcagttggcagtgcccaccatattctctggtgacatagtgaatgcttacaaacttcaactcagccttttgagtttttttttttctttttcctatttaaacaaacaacaaggtcccagtagagacttgagtttgggaatcctgcccaaacagattttgtttattatcattgttacttttttttgcttttgcttttacacagtctaaggtaagtatccttcagttcaaacaatcagaggtattctggtcaagcttcctgaaaaattagatgaaactttcattcaataagatcataattcactatattttttctttaatttttatacaattattcttatacaaaccgttcattaataaaaataaaatgtaacacgtttaaaatttaaaagtacatgtttcattcacaaagaacattttgatgtaatatattccagatcactcacataggttaaaaaatatttaaaacagacttttaacagtcagcaatatgctggtaacattacatatatatgtatgtataaatgaatatttatttatttttaaagtgattatagtctagtgactaatttacaacatacgtttacaatgaaaatataaacccattcgatgccaaaataatacatgactgcattatcattttaatggctatataatattctatttcatggatattaaaaagaattactactatggactacaacggatcttccattatgagcattcagattccatggacgtttttgctattaggaacattgcttcctgacatcactaatgcagaaatttcccagctgtgcttagttattacctggagacaaattcttgatgaaatttagcccgatgaaagtacccatatttcgaagactctaatgcctgttatcacattgcacttagaaatattacaacgattcatacttctaccaacagcatatgaggaaaccaacttctcctcaccacatagtggtattagcattccattaacagagaggtattcacttaatgaggttttagaatacagaaaactaatttgtaaatagcagtcccaatgttatttcagcacagggatgtgtccattaaagtccgtggtgtccaatcattcattttgcatgagtgctatggcagagtgatcaaggccccgtgacctagggtgagttctggagacaatctgcccagatttaagtgtagcattactgcttactagcagtactatttcaattgcagactacttattttgtctcttttttgtgcttttagaaaatgcaaaatatcttacagagtacgtaaaatgaaaacttttataatatcataatatatattatttacttttctttttcattatactttaagttctagggtacatgtgcacaacgtgcaggtttgttacataggtatacatgtgccatgttggtttgctgctcccatcaactcgtcatttacattaggtatttcttctatgatttacttttcaatgaagtaggtaaagactagtttacatacctaaaacatatcattcagagttatattattagcaaacatgagttagatccaaaccaaggtctccatgcttcagaagccagttcttttttttttttttttttttttttttgagactgagtcttgctctgtcacccaggctggagtgcaatggtgtgatctcagctcactgcagcctctgcctcctcggttcaagcaattctcctgcctcagcctcccaagtacctgagattacagacaccggccaccacgctcagctaatttttgtgtttttagaagagatgggctttcaccatgttggccaggctggcctcccaaagtgctgtgattacaggcatgagacaccgtgcccggctgtcagttttattttttgcatctacattgatgtttttccttgcaatatttaggacttcatttttaaatgcacataatttcaacaaaactaaagagagtttcaaaaggagatttacaacagattttaaaaggtccatcatatgctggtaatatctcctacttaatgttaacaaacaattagtgagttattttgcattaatttataaaaatgtgaaacattcttaagactttttaaagcaattgctttaaaaattattctcagttttaaattttcaaatacattcagacatttaattagacatatttaggaactctagggcctgaaaaagaaagaaagcaatgagtagtccatctttgtaaaaaaggaaacattagtaaattgaatacaagataaagacttagtagaagaaaaagatagcaagtattccttagaaactcactaccattatgttagcccctagtcaggtttagttttttaaatttacatttacagtaattaaagttaaattaaatgaaaacttcctttctcaagttccctagccatattttaagttctcaattgccatatgtggccagtacgtactgcattggacaaggaattacagaatattttacataattgcagatagcattttattagaacacaaaacaacgtttaatgggggaaaagtatcacatcgttcatagtcaaaatgttattgccaaatcatcacttttttcagagttcttttctcaagaaaagtgcaagaaataaaacagtgaagtaaatacaggacacattagaaaaacagttcaagtaatttagattctaccacctttaaaggtggtatagacaggtagacagatgatgaatagagatagacaggtaggaatatgaaattacagtgtagaatggttttgataattaaataaaatcaagtaaaatagtgcatgtaaaatgtagctggtacaatataactatgttatactgtgtgttaaaaaatgagaattctttttaacactatttactgaaagtgactaaaatacaattcttgatattcaattaactagatgaaaagagagttaaaagaaacttattctagacctaaagctccattaccatgtgacagaaaatgtgatatttatttccatagtattgtatgtgtggaaaactcaaaactgtaagcaaatgtgacttctatcaaaaatgctgtatttgaaggatggaaacggcatccatggctctgattcaatactggcttcaatggtaacgtcaatactgaggatgaactaatgtaaactggctttagctaagcattctacttaaagtcagaattaggcctagatcccagattttctaacaagctctggcaaatagatactctaattatatttttggcctctgcaacattatgagtaatttgttaattctacatatattatttgtctaatatgtgatttgcattctgtggaaatgaaaaatatctctgtccttatggggcttatatatttatggagcagcagtcaaattggtaagcaaaatttgtaaataaattaatgagataattttacattatagtctataatgcactttcagatatagtaacattaggaatagacaacacttaacctaaggctaataaacctttaaggatttgactaagcttacacttcattcagtggcagatctgagtatctactatgagagttttaactgcatgcatgatatttttcttagtctgttcaaactgttagaacaaaataccatataccgagtggcttatgcacaagaaaaacttatttctcacagttctagaggctaggaagtccaagaccagggtactggtagggcagatctgatgtctggtgagggcactgtttcttttcataggctgcatcttccaactgtgtcctcacatggtagaagggatgagctagctccttggggtctcatttataagggcactaatcttacttatcagcgctttgtcctcattacctaatcacctcccaaaggccacacttcctaataccatcatcttggtggttaggttttaacgtatgaattttggagggacacaaatattgaatctatagcagtattctagtatgataatatatttaatttcaggataaggcatctaaaagaaatcattaaagatcgaattcatatattaatagtttgattttcttacgggaagataaatataagttacacaaatcttttcttgttcagtgccttaaaatctccctaaatgaagatttataatttaacttggtagtaaactttgtgattttgcaactccagcattcaaggcaatactatatctaagggagaaaatcaattttaatgtaattttattctttttttttaatttctgagatctttagttgcatagcacaaaatcgagaatcaacccacactagggttgagttttatatgactaggttttgtgtttctttggcattgttggtttttgtttatcctctattcctgatttcatctttcttttctgagatatgtcccaaatgcactgacgttttctttcttccaagccatttgctacatatatatatatacacacacatacatatatatacgcatatatatacatacatatacatatatacatatatgtatccttgaaatagatattgtttttattaaaatatattcttgtagttataattaataattaaataaagaggattttgttcttcagtattaggcttagaggggcttattttattctaggtatattgtcactaagaaatacctaaaatataagaaaaacgtgtcatgggcaaaagacaaaacaccgtgcgtcagtctgaagcactgaaaccggatgcacatccacatctattgacaagtttcagtcttttggtgtttctcagaataacagaacacacccagttagcctctgtattagtttcctattgctggcatcacaaattatcatgtactcagttgcttaaaacaatgcatatttattccattctggttctgtaggtcagaattctgacactggtctcagtgtgctaaaatcaaggtgtcaatagtgctgtgttcctttctgaggactctagagaatgtgttgctggctctttcaggtagttagcagagttcagttccttgaggttataaactgctggtttttcacagagtccagaaactgcccacatcccttggcttatggctcctttttctccgaagccagcaaaggtaggctgagtttctctcatgcttagaatctctcttgcctcttttctgggcatctctctgactcaagctctggaatgttctttggtttttaagagtttttgtgattacattggaatccactgtgtaaccagggataatcacttcgtttcaagatccctaatcacatctgcagagttccttttgccatataacacattcacaggtgtcagggattaaggaattgacatcctaaggttgatgagttcattatttggcctaccagagctgctgcttcttatttgtttattaataagtaaacagactttatttttcagagtagttttgtatttatgaaaaattgaggagaaagtccagagttcccatacatccttctccaatctaccttcctcctccccagtttttcctgttactaatattttgcgttagtatggtacatttgttagcattgatgaacaaatattgatatattattattaactgaaacccatagtttaacttagagtacactctttgtagtcttcagttctatgagttttgacaactatataatgtcaggtagacacattgcaattataatacagaatagtttcaattccctaatatttcccctctgctctagctagtcatcccttctttcttctcctcaatttctagcaactgctgacctttttattgtcactgtaattgtgcttttcccagaatctcatatagttagaaacaaacagtatgtagtgttttcgaacctgtttctttcacttggcatttaagattcctctatgtattctttgtggctgaattgtttatttctttttatggttgaataatattccatgaaatgtatgcaccccagtttatctattcacctattaaaagacatctcgattgcttccaagttttggcaattatgaacaaagctgctataaatattcatagatgggcttttgtatggacataagttttcaactcatttgggtaaataccaaggagcacaattgctggatcatatggtaggactatttttagctttgtaaagaactgccaagctgccttacaatgtggctgtagcattttgcattcccatcagcaattagtgagagttcctgctgccagcatttgttattatcaatgttttggattttagccattctaataggtgtgccatggtatcttgttttaattttccattttaaaaatgtcatataatgtttaacatcttttcatatgcttacttgacatctgtatacatttttgcacagcctgttcttcaaaaaataaaacaattcacttattttctgaaaaataagtaaatgtaattttatgtgcagattagtcacacatacttgttagaacctacatggggatttcaaaaagacagaatcctgaatcatacaaacctctcccaaatacatcacgaccagctttaaatcaacagcaaagggttgctagaggcaaaagcaggaagattgtgaggaaggctacaaatctgacaaactctacaataatagaagagagcttggcagaagaagatgcatggagcaccaaagaagagagtagcaatgcctggatggctggtgctggaatgtttactgtacacagatctgcaagagaactcaacaggtagtgtggcttctctctagtaagcctgggggcactagctattgcaccagagcagactagagaacacactggctccctggctcatcacttgccacagaagtatatacttacaaagttgatgctgctttatatactgtcatacaaaagctctgtctgaaaagaaaccagagatttggagaacaatacctaaaataggtaacctaaacttaagagcaattactgaaggagacagatggaaatgttaacaaccatcactacataacagcagcactgaaggagagtccattacagtttcttagacatcattttctagtactacagcaataaaagatatgatcataatttaaaagtccaaaagaggaattgaaaaaaaacaccatagatactcggaagttcaggtggaagaaatatatccaaaacagagccaaggtatgaagagtgagaaatcagaaagaagaggaaatataaatgacttggaagacttcttgagaagactttatatatgtgaatttttgcagatactagaaaataaacaagagaatgaaaaacaaaaaataagaaatgaaaaacaaaaaatgtatgtgtcaggagtgatatcagatctgcatctcccgagtaaaagttcgcatggactgaaaggcagaattgatgaagatatacacctcttggcatattttggtaaatcctctaattcaaattttacaaactttcggaagaaaaaaacacaacatttgtggaggaaaaagaagtagactgaacttgaagttcttaactaaaatactgaacactgtaaaacaagtggatagtactacatatttgtagttatattcaaattgagatgaataggctgatgaatcatgtaccttatctgctaagtaagtttttttaattgaaaagatgaaatatatgacagggaaaacatagtgacagtcaattaaaagaactatgcttccaaataaaaaaagctttaagaagtcttcttggagtgggattggggaagcttacatacttaactattcacctctgggcaagtgaaggacagagtgataaaaatcattaggaaggctaaaatgtgaacatttttaacctcaaatatactttttttttttttttttttttgagacagagtcttgctctgtcgcccaggctggagtgcagtggcgcgatctcagctcactgatctccgcctcctgggttcacgccattctcctgcctcagcctcccgagtacctgggactacaggtgccctccaccacgcccggctaattttttgtattttgtttagtaaagacggggtttcaccctgttagccaggatggtctcgatctcctgacctcgagatctgcccgcctcggcctcccaaagtgcaaatacacttttttatatttaagcatggacaccttggttcaattgttatgaaataaagcaaataaacatatcatgaaagatatgattagctatatcagagcatgagtaacaaccagatctagtgacaacgcacacactatcacgagaagagcaagggtgaaatctgatcctataattcaatcacctctcatcagaccccccccaccaacactgggaattacaactcgatatgagatttaggtgggtcacagagccaaaccacatcagggtatttgtctaagaacaacaataacaacaaaattgttggttctgttattaagagaagaatgacaatcgggtagacaagtcatagcctctgccttactggatatgtaagaagcccttttaattaagtaggagaatgataaagagtgccccagttgaaattgtgggggatatagctatagagaaaatacaatgataaaatttaaaaatgaacaataattatgaaagtatatcgaaacagtggtaattaatttaagatagctttcagtgaattatgcacaaacaattaacaactgataaaaactcattattggggaagttctggaaacttcctggaaagccacttggcactatctaatgaagttaaataaggtacaaatcatatttccactgattatttggtcccctgagatataaatcaaataatattatgaagatacatttactccaaagttaatcacagcaataacatacaaaagtgaaaaatttgaaaataaattataattattaaagggagttagttaatagagtaaatacatataaagaagcgattgcaaatatatacatgtacatacatctatgcatatcatttcagatatataaattctaattacagtgtattgttaaacagtacaaactgcatatatgataagacactacagttctttaaaacataaatgtgtatttttatttattaatgaagaatgtaagtctgaaagtgtatgtgccaaaatgttaacaatattcactttctttttttctattttattgtctgatttttaaatttatattatgtttacaaccagaaaatatagatatattcagggtaaaattatgcttatttaacatacttgatataaatactagaagaaatttacaaaaaggggagaaaaatatttttcttgtatttgaaaaatgtttcagaatatttattttgtcctttttttcttttgctacttaaaaaagaatgtcttaaccctaatcttctaagcaataggaataagctattgaaatataggaagacaactattttgataaatcaagcaccttgtatttaaaacaaaattaaataaagataaaaacttttatattatatatttaagtagattttattttatatttaagtagttatacaaagttaaattttcaaaattggtgtctgacagatatctattttttcagaataatcatataattgacgtatatttgataatcacctaaatgttctatgactgaaaatttgaagacacagaaaaatagaatttaaggcccaataattgtattttgaaaggtatagaaaaacatagatctaaaaatcttcttttatttaaaaatattcttaataaatattttatgccttagcctaaaattagtcgatttctcagctcagatgacctacacaacttttttggtctatccccgcatgtgtgtctctttcactgtttacactatactgtattgcattcttttgcaacttacatacaaattttactatgaatatggccataggccctgctttaaggacttccccattgaaaaataacctatgcttaaaaaagaaaacgaagattaaaattttaggtaattattttcttgtttttcattagttttttctaaaataaattttgttgtgtacatttaaggtatacatgaagctgtgggatacacataaagagtaaaaaggtgaccatagtgaagcaaattaacatattcatcatttcacataggaacactttttgtttgtttttgtggcaagagaaactaaaatctaatcatttaggattaatcccatatagggtacaatttttgtttgttcagacgtttctacaatttgcacaggtaatagcttcatctgtttcaaagtcaactctaaaaagagtagacagttaatattttcctgttcatatctgcttccaaaccacctggtttccttccttcctggtgaattcaaattatcctttttttttaaaaaagtaaactttcagagatattttatgcagcaaggaaacaagcgtacatatttttctcctcttttaagaaaacagtattgttcacactgttctgcaccttggtttttaacttaatattcataggaaatcattccatatcaatacccaaaggacttcctcattctttttcataaacacactttatctatgtgagaatgtatcaaatctgtttcaccagatccctaaaaatgacatttagtatgcttccaattatttggaagacatatttgcttccattacaaataatggtacagtaaatagccacataaatagtcatttcccacatatcttagtatatttataagataaatttctggaagcaaactttctgagtcaaaggatacattcttgttattataaggcttagtataaattatctcaaaagacaaaaaataataaactttattattttaaatagaaaaataattactatcatttaccagcatatgacttttatcaatgattgatgcaagataaaggtacacatatttcatagctactcactcagtttcacccttgttttacttcttgcttctttaaaaacagactcttggagtggattttgaaatttatttatacatgtacaaataactgaataatctgatcaaggcttaaaatttagaagaaagtcgagatggaagtatctttcaacaagtcagaaaccttaaattaaataaactatttagactcattgaatctgtaatgtatcatcaaatgatggaaaatagtttgttttggagaggaaagaggaaaggaagcagagtccttttgccagacatgaattcccaagggatatattcattactttgttgcttatacaaggccatagaaatcaacactcctacaacacagatctttgcagcaggctcctgtgaaacattggcttcacaacatttggcagagctcccatcccctgcttatagatcatatcatacaaccagtctttcaattatatttgctgatgtaaaaaataagtgaaacacatgcatttttctttatgttatttttcattcataagaacatttctaaggcatttattattagtatttggttcccgatgttttactaataagaaatcatgttgtatttcatgaagcttctttgattagcaattttatttctattccagggtgtctatgtcacttataagaaagctaaccagatggaatcatctggttatttgtatattaactactgtcagagttttaatagtaaaatgatttccttgcacaatgtggcggtaatagagtcaagctgtggcttaaatagccttcctaatggaggtttcaagagaactgagaggatttataaaaatttactttgtgacatgcctaatacgtgtattatgtgtgtcggtttttccactgcaacagaaagaaaggccaatacatttctaaattgtatattaaatatttataaacttttctaaacgtgtgacataaaaagtatctggtcagttcccttcactataaattcagcttatgttcctatttatggtgctgctggagcaccacagccccgggtctcacactaaatgcttacttgcagatccacctaggtagttctccgtagagggaagagcttcccatgatcttctccacaagcatttctttcaaagccgcgttgcaggagtcacacataattgccagtgttccagataacaaacttcttatttccattacacttagaagggaatacatttatcatcctaaatgatactaagttactaaaggatactgagaacatttatcaccctaaatgatattaagattaagctcctatagcaattttgtagaggtcagtagtaggcatagttaggaatatatatgtatacatttaggtgtatcagtagaaggtttgtgacaatagcagtttgattttagatgatgctgatgtgaatcaggagataataggaagaattgcagtcatgcacacattattttcaaagtcatattctaatgctccaatttcgaaaatagttactagtgtctggtaattctacttttcatttgttatcaaccaacatacatttaaattttacaggattatcagcaacacacaaacacagacatgtacaattagtgtaaaaacaatgttgatggctcctgttaaatcatttgatgttagatcatttcttttcaagtattcttccctactttgacagtttttttgtttttaccaggaaacaacaacaattcactatcaatagcccctttctcctgccattttattcccattttaaggaaacttgcatgggaaggaactgtgtaggtgaaaaacagaggaagaaaaaaaatgaaagaagagagataaggcttaaaaggggcacaaggaagaaggctctaagaatagaagacgaaagagaccaaaaacttcacataaggaaattttctacaatctccagaaagtagcatataactttttatggggggaggggttgcattattttttaacagaaaaattttgaaaattttttaatatgggagaagaaaatactaaaataattctgcaagtctaaaagtaaagaaaatatggattttataaattagtaaaacatcataatttaataccctgaataggaagataatctaacagagaatgtagacattaaaaggaaaacaactaaaataaggaaatggtagaaatgcttggggttaatgaggaagacatttaacaaataggaaataaattctctatgtttaagaaagacataatttgctaaattattcatttatttaaaaccaaacaagattaatttcaagagaaaacacttcaattaatttagataaaatgaatgcatttaaatgtgccaagaattcaaatttcccaagaaagcctataaattcatatggaaagaaagaaaactgtcttgggtttatcttctatcacataacgtgtcaaaggacaaaagagaaattgctacattattgtgagacaaaggtttatggcataaaaattcaaaacaaaaccactttgctcttcccgtgtgaaggtaatcaaatgatactctttagatatgcagatctcagaaaatgtatcatccacaaaaatttcatgaaaaacattccatccacaaagttatattccagtcaactaagattttttttaaaaaatgaaaacaaaggcgtagtataaaattactgtcagagaatattgaaagcagttacatatatatacaaacacaacatataaataatcattttatatgcctacaaatgaaaatccaaaataccagatgtcaacacaaccttgaagctgataaacttaataaactgggaaagacatttaaatacagtaccattttacgtttacataaatgataggcaacagtaattttattgtattatgtaaatatttaaagaaacatatatttaagtacacatttttcttttttttagttgttttatagaatttttttatttccaaaaataacacatcatcaagcaaaaattcacatacatcacggtgtgtaaagacatggttagtaatctgtcattcacactcagataatttcacacccaacctgtaataaatatgcatctatatttatatttcttttcataaatatgtataaaaaattgaaagtggaagtctcaagaataatcttgttggagtttatgttctcaaataacataacaaaataaatgttttaccaacattagtatattggtaggaattccactccaagtgaagtaaggtccaggaatttctcctcagtgatattgaatcaagtttgaaaggccaaattgataactcttctttatgagaagtctcaagagaaatttaaaaatgttgtaaactaaataaaataaaaatatgggagttttcaaaattttgttgtgggatacaacaaaacagtgcttagagaggaatttatagcattgaatgaacacattagaaaaaagaaagatcaacattcaataacctaagcttctgccttggagaagagagggaaagaaagagcaagttaggttaccgaatacagaagaaataatgtgaaaaaacaacagaaatcgatgaaagtcaaaataagaaaaccaaaaactgattctttgaaaagattttaaaaattgataaaaccctagcctggctaaccagacaaaatgtgagaaaaaaatgaaacagaagtctttactccttaaggcatagctagtgcaatgagacaagaaaattaaattcaaagtatatagatttgaaaaaaagaaataaaattttctttatttgtagataaaatgtttacataaaaatcttaaagaattgcacaaaatcacaaacaaacaaaaaaacttggaactaataagtgagtacagcaaggttgcagaaaacaatgttaatataaccaaagttgattactttccaatgtaccagcaatgaataatgggaattttagattacaaacaaaacaaacaaatccaacggtactattaacactagcaccaaaaagggaaatactcagttgcaaagctaacaaagtatgtacaagacctatagtggaaaactattatacaaaattctgatgaaagaaattgtagaagatgaggccaggcgtggtggcttacgcctgtaatcccagcacttcgggaggctgaggtgggtggatctcttgaggcaaggagttcgagaccagcctggctaacatagcaaaactgtttttacaaaaaatacaaaaattagctgggcatggtgatgtgtgtgtgcctgtaatcccagctactcgggaggctgaggcaagagaatcacttgaaccaaggttgcacttagctgagaacacaccactgcactcaagcttgagtgacacagcgacactcaaaaaaaaaagaaaagaaattgtagaagattgaagatgtaattacataaaggttttccacggaggtacctgttcacatttctgaaaacactttatatatgaaatgaacaattaaataggtgatagcagatggtagaagctatgattttctttattggagtaggaagtagtgggggctcgagtgatccatactgttataatttggtggtgtgtcctttccaaatttcatattaatatgtgatctctgtcctctccaatgttagaggtgggcctggtgaaaggatttgggccaacggaggtggatccttcttgaatggcttattgctattgtcatggtaatcagtgactttttgctctatgagtttgcctgagatatggttgtttaaaagagcttggcacctcctccctctctctctttgtctctctcaatatgtgatatgcttgctgccccttcaccttctgccatgattgtaagcttcctgagactttcctaggagcagatgccagcaccatgctcctcgtactgcctgcagaactctaagccaaaataaatttctttcctttatcaattaaccagcctcaagtattcctttagagcaacacaaacagactaacacacatatggtgataaattatggttggataaacgactatgaaccgattttagtttaattagatagctgatttcacatataagtatttatagatatgtgtatatatggtttaatagaatgtactttaaatatttttcaattttctgtatattatgttttgacatcttagaaacctttttggctggggagagactgctcttcccaaggctagccaatttataaagttaacaaagggcttggccagagcatctaattgatagcaaattaaccaatgcagagacatacctcctctagcctgttcacctccggaggccatattcctgtcttaatcatcccaaggcaaaataccaggcaactagagaccacccttagagctcaaagaaagcagaaatcattcaaactagccagtccttactgttcatcttaccctgtcctgtcttgcctcaataaaatcagtgacctaaaccttcctatcactcctgtgtcctgcctcctgaccaccttggtgtccttcccttgttgccttgtgtgacacgccatgtctcctgtttcattgggcttacgagtataataaactttttttctccaagtctcccccgtgtttccttttttggccatatctgacagatcatcccataaataaatacaaaacgtatatatgcatatatttcatcactgtcagctgagaggtcctagaaacaatgacatctcagtagtcatgagtaccctcagctcccagatcgtggtttgtaatacaactttctaataaatgaaaccacggatcttcagagaattggctgattcgataactcgtaggatattaacaagatgagccaggagcatcttatagtgccagaaagtgaggaagtgttcaaaatagataaacacgttaaaaataatgataataaaaataaaaactgcaataactataatatgtcaaaagaccaggagccaactgaaaccgccttcaatggccaaaaatgaaaaaaaaattgagcaataaaataaataaaatgacagtgaattataacccagagtatagagtatatatgtgagtccatactgacagtaatacataaataactgaatatgtaaattaaataaaggaaaatacacaaatctgtgcagaagaattccaagtaacttatgtagttagagcaccttcaagaaggggagtgtaaatccccacttcttacatgcaggctatggatagtaacttccttccaaagagtacaatactcctcatagtggagaaatttcacaaaccctaccttagccacgttatcaagtttaacttcagtaatgataagtcatattgaaaatatgtaccttttatatatcatggcaaaaatgacactttacatctgtggccttcttctaaaaaatatatacaagtttaatttaatcatgagaacaccattagacaaataccaattaaggcagttgctataaaatcctggtcagtacacctcaaaactgtcagtgattctggtaggttggataattgctccgaatattggccatcttcttatcccaggaattttgactataatatcttacatggtaaaagggaccttgtaataaaattaaaataagcattctgagattgacagattattctggattatacaatattttatgtaatcacaagagtccttagacttattatatagcagtgtaatcacaatagttcttttttttgatttcttttgtttttattgaaatggagtctcactctgtcacccaggttggagtgcagtggcgtgatctcagctcactgcaacctctgcctccaggattcaagcgattctcctgcctcagccaccgaagtagctgtgactacaggcatgcacctcaaagtcaggctaatttttgtatttttagcagagacggggtttcaccatgttggtcaggctggtctcaaactcctgacttcaagtgagccaccaaccttggcctcccaaagtgctgggattacaggcgtcatccactgcgcctggcccacaagagttcttatacgagagagacagggtagtcaaagtgagaaataggagatttggcaatggaactagaaattggagtgatgggaagaaggggtcaatgagctgaggattataggcaacctagaggctgggaaatggaaggaatgggagattccaagaggaaatgtccctgctgaaaccttgactttacaccagtgagactaatttccagaagtgaaagtttactttgctgaagttcgtggtagattgttacagcagcaataagaacctaaaacagttataaaactcaagaataccctgagacattgacacaagcaagcagaagctaaggagatgtgaacactgtgtaaagtggtattctggatgagatactgttagagaaaataaggacattaggggtaaaactaaggaaatctgagcaaagggtggatcttaataataattataaacataggttccgtaattttaacaaatgtatcatgctatcattagatgttaataataggggaaactgagtgtgtggtgcatgggaactccggataatcttcataattattttataaatttaaaacttaaaacgaatgaagtgattctaaagcaatatattctgatgaataggatctaaaacaaaaacgactgaatgaacaaattaaccacgaaaaactgaataaaaataataagtttacagtaagagtcaaacattagtaatgtgtcaaaatagacagaatttaatatgcagaaaaacatgagtttttaaaaattataggacaaagtttaagatatcatggatataagctgaaggaaaacaagaagaatttcatttgtgttattaggcaaagaaaataaatgttacagaacttgggattttatataaaatgttttatttaattatattttggagaaagaaaatttaaacttaatgaaatatatttagaaaatgagtaatcaaaacaataaatatcaacattacacatcactcatgacttttaaatgtaaagtcttatgtgcaattttaaactaaattattaaaaatttagataaagcacattatttttaaaacagtagaaatctccaatgtttactaaaaaattagacaaattgctataggttgaattttttttttttttttttttttggaatctggcaaaggactactttgaacaaagttcccagtactaagtgctcttatgggaagtcatttcaaacacttatggaatagatatgttacagaaattgttccagaacaaagatgggaaatatccaaggtcactttgaagctaaaaatctctgataatcaaacctaaaatagatgaactaaaaagaagatcaacaggccatttaactattgtcttttgtgaggatgaatgctgtaccgcttctcagtcttttggttaagatcaagtgaggatgcatgctgtaatatttgtggttgctagaattttaagatgatcctcaaattttccactcacctgctatacacaacacacataatccccaagactgttatgatgaattgtaccctcataattagctaatgttatatggcacaaatgtttaaatatagattatccaggtgttcctgagcacatcacaaaatctctttaaagcagaaagatttttttgttttttgttttttgtttttctggtaatagaaagggaagtcaataatttgaagtatgagaaggatctgactaactgaaaatgaggaagcacacagtaagtgtattagtcagggttctctagagggacagaactaatagatgtatatatgaacgggagtttactaaggagcattgactcacataatgacaaggtaaaggtccacaataggccgtctgcaagctgaggggccaggaagccctcccgagtcccaaaacctcaaaagtagggaaaccaacagtgcagccttcaatctgtggcccaacgcctgagaggccctggcaaaccacaggcgtagctccaagagtccaaaagctgaagaacttagagtcattgttgtagagcaggaagcatccagcacaggagaaagatggaggccagaacactcagccagtctaatcctcccacgttcctctgcctgattttatcctagccacactgacagctgattagattgtgcccaatcagattgacagtgggtctgtctctcctaatccactgactcaaatgttaatctcacccccacagacacactcaggaacaatgctttgcatttttcaatcccatcaagttgacactcagtgttagccatcacagtaaggactctagaagctgaaagtgtctaacagctgacagcaaggaaatagggacttcagtcctacaaatgcaaggaactgaattcaataaacaaaaagaatgaacttggcagagaatttttttccagaccctcaaatgaaagctgagttcagccaacatcttaatttcaaccttgtgatatcctaaagagagaaaacagatgcaaaaattgttaagaacaaagaagtttcatgcagcgtgattaatgagcttggaataattaaccttgatataaagcaaagtataattgcagaaattcactttatattagccatacagtagatatgagcaaattttacagaattgtcatatacatcaaatcctatggtctcaatgcaattaaattagactacattaacaacatgttaataaataaaatcttcacccaactggagattgaatgtttttaaaaacctattttccaataactcatgttataaacaatgaaatgacttgagaactcatcttaaaaaaatttcagcatacaaatgtttggataagaaggaacagttagaactcacaaggttgtatatggaaacaagatgtaaagaaaactctgctgccatggaacccaaatgagaaagtgcggcaactgataatcactcttagaaataatgttgtattgtgcaatatcatcaacaaacttaatgcttttttgccatcttaaaaaattaatttatgatgctttagttcaaataggtcttcagtaatttgtgtttttttccaaaattaatgtatgtttattaaatgggaaacctaaaacccatggctgtaaattgctgtttctgacttgagctgacatttaaatccatacagtatatgagatacatgatctattttctctgaagcatcactgtgttacaggatctttggagtgttggttttctggctggaaaccttggtggccagtgaggcctttgcctgagttcctgtcctgtatccagaaagcatgaggtacacagacaagtggagggtgagcaagaagaggagctttattgagtgttaaaacagctcagaggagacttgcagtgggtagctcctctctgtaggcagttcatcctagccagtgttcagctctcagcagagaagaagccctggagaaggtagctcctttgtgctgctggtcgtcccgacgtctgcccagctccaagcagagaagaggccctggaatgggttgctcctctctgcagctggcagacctgcctctcttcaggtctctgaagctctcagtgaagggtagctcctctctgcagctgatcatcccatctgctcagctctggatattcctggagcttttatgggcctcagaggggagaaagtgcatgccctttggtccatgggtggccatggtcaagcctggaaagggcaccacaagttctcacttcaacagtgggactggcagcccagcccccagccttcaggccctccctggcctgaaggtggggcctcactggggacctgcccccatctgtgcaggaacctgtttgcctcctctgccttcatggtaccagggcttggccagactttgccccaagatcagagcaggtgctgacagcagggaggagctaggcagtgggaacaggcacttctcagcctgcaagggcaggggatccttcctgggcccccaagagtacagggatgcctgagtctgcagccctggtttgggtggctgcagctgcgcccaggaaggcagggctcctgcctgctctgtggagcaggaggcctgggtctggagtcgcagtttgggcagctgcagcggcacccggggagctcctgcactaactcagaaggggcagggttcctccttgtccccagctcctgctggctccatggagcctgcagccccggctgtgattccctgctgtagcaggtgtgatggcagccagtagctgctgccatcaattactcccaggaatctttatggtcaattcagaaacattatttcaatcccagaatacatatgatgattcaaagcaatctcaggcatttactgaagtcctttaatatcacattccaatttctaactcattggatctcatttccattttacaatagtttgcctaaatagttaccatcaggaaatgcttcttcaagcttgatttccatgtacgccccgagctttcttcacagctttgtttcttttgggccagaagatattctttcatattttaatatatttaattttcatcatataagatctacaccatagaatttatttttaaaatttcacaaaatactttttgtcttctacccttacattttttcattcatttgtttttatttcaaagaaaaaaactagaatgtgccaatccttttggacagaagtaacttaagtgcctatttttgtcatactttcttgcaagtcctttagacccttaaaataatttcaaaatttatcctaaaatcctctttggaataaaaattcttgacaatttactaaaatgcgtgttatacccttgatagcggcaagtttccaaatccacgtctgactcttacagccaggtcatttaccaaagcggcccaataacagaggtgtaagaaagtaggggtggttctaggttcatgcctaggcattaactggcatgaacctagaaccatcctggcacttttctctcttctttattttctacctgtttcaggtgggctccttttcctggatttaatttccaagctttatcctctgatctctttttataattgaatcagccactaaagatgacttccaccattttgaaccccagaaactctgtataattttcagttttgctagccacagccacccagtcaagtatttaccaaacatctacaatgtaccagaaatagcaaagatataccacttcagtcgcaagttatgttttgtcatggaaagttcttgtgtgttaatccacggtagcaaaatgcacacacacacacacacacacacacaatattcctaaggtgatgaaagaaagaactgtaaaaccttaaacaaaataataggtatattttaaacaatgttgctggctagaatttccataccaaggagatgtatactctaaaatgtccaggccgggcgcggtggctcacgcctgtaatcccagcactttgggaggccgagacgggaagatcatgaggtcaggagatcgataccatcctggctaacgcggtgaaaccccgtctctactaaaaatacaaaaaaaaattagctgggagtggtggcgggcgcctgtggtcccagctactctggaggctgaggcaggagaatggcgtgaacccaggaggtggagcttgcagtgagccgacatcacgccactgtactccagcctgggtgacagagcgagactccatctcgaacaaaacaaaacaaaccaaaacaacaacaacaaaaaaacaaaaaacaaaaaaatgtccagatacagctcacagaagcttctggtccactattttctttcattacttcagaatcattttgcttcatgttagaaaaactatgagttccaatgaatgatccaaactggtttgctggtggaaatttgctaagactgactttcagagtattttattgactgatattggtataattgggcaagaatagtctagaaaaaattcaccacccttgaacaattttagctctaaaaatatttaaaattctcagtaagacttctgagaggccagagtaaaataatgttataaagctcttacaatgcactaagctaaaattgttctccgtatggataattatacccaattccttgcatttattatgaaagtcaggaagatatttgcctggggttgaaggcatcgctatattattaccctttatcagaactgtggtcacatagttgaatttttttttagtaagacaataaggtaaaaaatcatcttaaaagtcagtgcttgactaaaatttgaggcattttttaataataggaaatccatggctcagcctaagttccagagtctgtttacacagagccagctgatgaaatatactgatgcttttttaaaaattaaatggtgctaataatagatatttttgagccacttcaaagtaaacaaaatacaacagaatcagaccatatatatagttctttccttgttgtagctcatggttttgacaacagcacttcttaatttttttgtctgcctaatctttttttatctagtcaggagcatcgcctctcctgtgaattaggcaaaaagcaaaaatacttacaaatataattcccagtgtcaatattttttcctgtatttctctccttgaagttctttcagcctgctactgtgaaacttactcctagatcattattttcatcctttaattttgacatttccacagaacaaagagttcaattctcatttcccacgaatatgactcaggctattcccacatctgtgctatcacttttcagaaaatagggacctccactttcaatcacaaaaggagaagtttatttttgtccaattcaatacgtattttgagagtttcatccgatagtgagtttcttttttctagaatgctttagggttagttcatcaaatatttcaaccattttagccttcttctcattatctgtttataaatgaggtaaattttaggaaaaacacctgctgatggccatggttttaggctttcaagttaacaacatagagaaagacaccaagccaaaaacatcagtcataaagattatttctcctgatactatttttaatttttaatgaggcaaacatattcatatacatctatacacacatacatatatgcattatataaataagtatacatgtgcatgtgtaatttatatgaaaacagactccttaaatgcatatgatttttaccttggactatttttgaatagagaaaatgaaagtagaaaataggtttagggaaactttcacagtaatcaagacaaagacattattgatttaaaagaattattttcccttttatccttttatccaaaattatagtggacattttagactgagtagaaatattcagtctccccaaagcatattctactgcttaacactggtgcacccactttaattcgtaggtataccaaagaaatacggactttggggtgatagaagggtaataaaaccaagaaatatgcattttccaaagtgacattctgaggcctacattttagttgtttactaaagctctttttccataatatacagcttcaagtgaaagccaacagaatctttaatagcctaaacccagcagtgacttccctatttattttggacaataacaagattgatcaatttttttgccctttaatattgtcaagaaagaaaagaaatatttgatagtaagataacaccttaaacaaaatttgtatccccaactcaacttttttttctaatttttaatttaatttttaatcttgtagtaaagtattacattcctctgtaaaagtataaaaataataaatttttagctcagccatttttcataaagaaaactcacctatgtaactgtcatccacattaaaaatagaatgctattaacaaccagaacacccaagttccctctcaatcactctagcccttgactagcatccactattctgtctttcaaaataccacgttggtttgcttgtcttaaaactatgtaaatagaattatacagtagttttcgtttcatttcttacttccatgaggtgaagtctcaagatctgtacattgttatttcatgtagaaatagtttgttaatttacattactgcatattaatttttatgaattaatatatccattagtgatgaatatttgatatctacgattttatagcttttatgaatattgattttatgaacattcatatgcatgtattgtggtaaacatacatactcatttctttgagtatgtacctagaaagtggaattcctgagtccttcagtatgattttaaagaaattgccagtttttaaaagaggttttaaccaatttttttcttccatcaatactgtatgagtgttccagtggcttcatagcctccttaattttagttttttttttttcattttagtcattctggtggttgtgaaatgatcattcatggtggaggctaatgaatttggctattttttaatatgcatatgaagtattttgctatcttcttcttaaaatgacttattaagtttttttctctttgtcttttgggttgcctgtatttttcctcaatgaatataagagttctttctacaatgtgagtgttgagacttcataggtaatgtataatataaatatgttctcctatttagtggcttgcttttaactcaatggtatcttttcataatcagaagttcttaatcttaatgaaatccactatatctatttgtaattttatgaatagtgatttcgtgtctagtttttaaaattattgcctatctgaaagccaggaaaatattgtcttatatttttctcaaaaatcttgctttatttacttttcacctttaggtgaataacccacttggaactgacatttctttatgtgagttggagtatcatctcattttttttccataagactatccaattaatcctttttatatagctctacagtaccatcttggtcatgaatcaatttgtgatatatgtgtaaatctgttggtggattctattctgcttcattagactatgaatatgccaataccacactgccttgattatttggctttataaacctcaatgtctgagtttcctcaaattttctttcttaacctttctttattagtcttagaattgattattattggccaattgtatttccatgtaaattttataatcaggttatcaatttttacaaaaaacctattggagtttttattaaggtttaattaaaaatgtgaatctgtttttggtgaatggacttctttgcaatgtacatgatatattctatgtttaattattctgcaatttttgaaactaaattacttcatcacattctgaagaggaagtccccataggagtttaaatttcaaattaccttacctaaattagagaccttaaaaatatattgcaaatgaatatacatgagagattgggctttcaggaatcaggactatcatacaagtagaaaggcttttgcattctatttcatagtttatatgagaaatatttggaagctcacataaacatgtaaaattcttttccagttctattgtttagttttattcttatctttgatttaataagtacattaattgtcaatcaaccaccaggattccaaagagatattgagagaagacagaatataggaaaaccattcagctactttccattgtagtgggccctactttttattaaactgtgtaattgaaccgtatatggagacaaaggcaaagttagttatgtcagaatacagagtaatctgtaacacgttaaaaaagaaaaaaggtaactaataaagtttttgaaaactgaaactcctctattcagtccaaatcatagtctcaagatttgaggacaatatttcatgtcaacagattacacaaaagatctctggtatagtagactataaaaaaacagccaagcaagccagttgtaaaaaactggccttttctgaaaactagtatattctctttatctgtttcataatgtatttttaataatattttcattgtacttatttcttgacaaagtctgataatatatgcataaatcatctgttattgaaattgggtattctaattcaacatatcaaccaaaattgcatctttccttttgctaggataaattgggctaaagagatcatttttaggtcaaattttcacttgaaagggaatcaaatgtactttctaattatatttaacattttcttacttactttatttagttcgtcagataaattagatatctgcaggccagctatgaacagacaagaagaacaacgttgctctctttctaaatgatattatttcttttatctcaaccatgaatgtccattgtgaacaataaagcctattattaactgaggaaatattttaagatcgaatacagtaaaatgagcattgttgaatttggacaacataatcatgcaggtaaatgtatgatacctaataatcttattcagtctctgaacttgctcagctatttaggggaacattttatatttctgtatcttaattggcttaccaaaaaggcagattttttcaaaattaggtcttacattaaaaatacacaaatggatttttcttaatgtggtttctgttactaatatacactttaaatattttagataaaaaaaggtctcttccatgctttttggaacaaaatattgggtctcagttatatacttattaaactacttagattaaaatttcttttttgagctgggtgcggtggctcatgcctgtaatcccagcactttgggaggccgaggcgggtggatcacgaggtcaggagaccgagaccatcctggctaacatggtgaaaccccgtcactactaaaaatacaaaaaattagccgggcatggtggcgggcgcctgtagtcccagctactcgggaggttgaggcaggagaatggcgtgaacccgggaggcggagcttgcagtgagccgagatcgcaccactgcagtccagcctgggcaacagagcgagactccgtctcaaaataaaataaaataaaataaaataataaaataaaaaattacttttttgaaaacaaaatacatgttccatactagtaagcatccatgatgcccatatgtctaatgattcttccacatatgggtaagaataaatcacaagattctgaatctccgaaagttcgttttctgacctacttagatcgaaagcacatttagcactttaagcactttttctcaggcctgaaaaatgaacgtatagctataaatcaacacggcatagaggaaatagcagcaaacagggaaccagaggatgtgctgtttggtctagagctgccactcctcacagtagattgtggacacggtgcttaacctccctgaggaggccatgtttgagcggagtattgactgacaaagcggagacagcgaaggtctgtgtaagatgctgaggaactacatcccctgccttctgttcccttcatggctacgtccatgggatgtataggatgtgtagtttttatgcttcattgaattattaatatgctgcttcttttttaaatacacccgttcaattctcagaacatgatattataaataaaagatattggggtcaaatttagagactttgagttattaatcgggttaaaaaacagtacttcaaaattttgtcttactatacactgtatttcttttcttctttttattttgagttctgggatatatgtgcagaacgcgcaggtttgttacataggtataaatgtgccatggtgtgatagtacgacactacaacattttgtttactttaaatgaaagttgtacataagctatccagtgtttgaagaaaattcctatttctatatctcagaaatctcataataaatcttatccttgtacacagcatcatcagtataagggtttgcttacctaaagattcatatatttctttctccttgataatcttgaattctctgaataaccatgaaaatatggcattgagacatttaaggcctgcctctgaaaatatcatcttcttgaggacagaattttttgagaaataatagcttatttaccaaatggaaaattttcacttttattcatcaaacatgtacgttagaaaactattagaagaatgcaaagaagagtgaatagattatgtaattttatttagtgtgcatttgtaaattctatcaatttttaaaaattaattgaaagtgtaaaataacgtaacgatcttaaaatttaggttctcttgtacttaggaaaacctaatgctattccaagtttttaaaacgctaattgaaatttgtggctttttcttttcctccacctaaaaatcccattgaatctgatgacccagcctagatttgcttgtcaagaaactgataatttttaatttttgtgagattaacgagtaatagcagaaaacgtatttatacagttgtatgatgagatataccagcttataaatagttaatttttttattcactaagaaaaatattgttttcctatattcagaatagtggaaatacataatattaaagttataattttaactacattgtaaaaggtacagtaattacatttgccaaaaggtaaaagtggcttcgagaacatttgtgcaattcaagattttcaattctattagctgtattgaaagttctctcaaatcacaaagcagaaattacaaaattggcagaatgactttgattaggtcaagtactttgtagatggggaaagattatagtgataaatccttttgaaatagaacaacctattcagttttactttcaacaagcccttcttacatctcacacgatgatgaactacagaaataaaaaggtaaatgatgttaagacctttgctctcaaaagaaaataacaaaaacaaaacctagagccctttctaaggttaaaatcagctgtctttttacagaattcattttggattttcattctgaagacttccaaccaatagggtagcctttgccagaaattcattatggttgtatacataaatattatttatatgagccaactgtactgtgatcaattttagtaaattatttacatactttcaatgtttatgtttaattgaaatatgccaatgcttttagagtttgttaaattcataaaaatgtatgcatgtatacaagggaacttgactatatcttattaatttaatgaagtttgatataaggcagacgtatttttgacgctagtcaaaaagtgttagttgccgggcgtggtggctcacgcctgtaatcccagcactttgggagaccaaggcgggcagatcacgaggtcaggagatcgagaccatcctggctaaaacggtgaaaccccgtctctactgaaaatacaaaaaattagccaggcgtggtggcgggcgcctgtagtcccagctattcgggaggctgaggcaggagaatggtatgaacccaggaggcggagcttgcagtgagccgagatcgcgccactgcactccagcctggacgacagagcgagactccgtctcaaaaaaaaaaaaaaaaaaaaaaagtgttagttacagaattaataaaactccatatattacatattatattgcacatgtgtatttttaaaaataacttgaagttcctttgaaagcacaattttgttttaaatgcattttggaaaatgcacactgggatgacactccaatcattttaatgaaatttttatttttaaaataaaaaatatgtgttgaatcttgactagatcaatattcactgtataaaaaaaataaattaaagtggctatattatggacccaaataaaaaaggttaatttgaaacagattttgacctgcatattggtaccaccacatgagccaaaagcacaacaccaaggcacagctcactattttatttttttctcaatgtaacaagattttaaaaaataataaaaagatggaaggaactagagtaagagtgggagaatccctttttagtccagtaggatttggtctggcatgcaaaatatttcaattgcttatggtagatagcaattcaaatatttgactataggagttatttacttaaagattgtgaagaaaaaaatgcaaaacccactccaaattttactgatctacagcctggaacttctcacacactttaattttcaaaagaacatatcaaccccacatctcagagtcaacaataggtatctttatcatgaatggcattaaaagggatgatttttttgtgtgtgatctcattatgaactctgtcgtttgaggacagcctcttcatttcttggaatgtataacatgggcaaccagcatttgggatgcatgcactcccaccatctctgttttatatatatatatcttaatcactgcaacattctaattcaggccatgttgatttaaggataaaactagaggctgggcgcggtggctcatacctgtaatccgagcactttgggaggccaaggcgggcggatcacaaggtcaggagatcgagaccatcctggctaacacagtgaaaccccgtctctactaaaaatacaaaaaaaaaattagcctggcgtggtggtgggcacctatggtcccagctactccaaaggctgaggcaggagaatggcatgaacccgggaggcagagctggaagtgagccaagatcacgccactgcactccagcctgggtgacagagactccatctcaaaaaaaaaaaaataaaaataaaacctagaattatatataccctatatggaaatgtagtgggttttgaaagattccaataataagtacaaatatggaattatctatagaaaaacaaatgctgaatgcaatactatgttaatagtagttattcattgatatggtttgcatttgtgtcatcccccaaatctcatgtcagattgtaatccccagtgttggaggagaagcctggtgggaggtgattggattatgggggtggatttccctcttgctgttctcatgatagcgagtaagttcttgggagatctggttggtaaactcccctcttctctctctcttcctcctgctctggccatgtaagacgtgcctgcttctcctttgccttctgccatggttgtgagtttcctgaggcctctccagccgtgcttcctgtagagcttgtgaaaccatgagttaactaaacctcttttcttcatgaattactcagtctcaggtagttcttcataacagtgcaagaatggactaatacattcattataaaggaaatatccaagagccaaatggaagcagactaccaagtaaactgaggtggcaggtttgtgatagcaaccaaaaaaaaaaataacccaacaacctatagtaaccaagctttccatggagaaatggagaacgaataacactgaaatatgtgtgtgctgaacactggtctttgccacttctattggttgacaggacagatcaccccaactctttctgtatattgctctttataagccttcacaacaacaaaagtctgaacacgctcataatataaactagtctgggatttccatgagctaaagatttgaaagattattaaatatagctgtgcttttatttatgagcagctcttgaccctctttttcccctaccatccaaaacctctaataggaaaaagaaaattacatatttcatgtcatgttttcatttacagataacaatcactagatttgccccaagaatatacatctagcttgcattttcgtgatttataaaagcctcatggattttttttttgactagagctatgtcactgatattaaaattggcagtcttaaagggatttcttttatttgacaaaacatattgtgctcaaggttaataatacatttcagcaatgtacatagtgctcttggcagacatgtgctccgtttcatcattttgataggcagatccttcatcatttgataggcagattcttcttcataataagtaaaatcctgccaaaagttaatgctctgaattgctttaaaattcattttaatgtaaatttggatagaacactcctttcttgctatcagactagcaagtcagtgtaagaaaactggttggccggaaaggaagttggtaattttaataggaaactcattacaaaacagtaagtgggataaaatcgcacttccatgtttgttgggaaaatctgaaaagttttgttgcttatggggagagagaaaaaagactactgagaagattatgtctaaaaccaaattccaagccaccttttatcaataaaaacataatactaaatgttgatatttttagcaaaagataacaaagtacaagtattgagattctggaaggacatcacgcaaatgttgttgaaacatatatggattaaaataatcttactgtgctctgttactggagttcattataaatatggtctctaaaagtaatgtttaggttaacccacagttaaaacaatgtataattccaacattttttctctcattaaaaagaaaatttaaattgccctactttgcaaaggttataagagtctcattttgtttggcatcaaaaactgcaagaaaagtctactacaaactaacaaatatttattgggcctttgtgatgtgccagcttcagccagttatgggaaaacagattcaaatatgtttcttgctattatgggtcttaaagtgtacctggagagtaagtcaatgaaagtaggatagcacttcctgctataattgtttgtgtgaatgttttgcataaatttgggggtataggcataaaggaactgacgatagtgactttttcagaaaatttctctataggcagtgtgattcatgaacaatacatagggattatctataccattttaaaaatagaaaggaaggctttttgtttggaatgaccaatagatttgaaataatattacccttaggattatgacaattaaggccatctcacaagcctagagcaaatactaccattggaaataagatggaggaagcaagtaaaaactagatgatgaaataactttggtgcaaagctaattactgtgcaaattattataaatattatagagaatcattaaaagattataatgtcaataaagttttggtcattcttgatgtgccgatttcttcagtggtatattattaaaaggggagacagctgaaatgcttggggcccacaacaaagaaacacatttggatagacagaatggaaaaatttatcacaatggttttccatctctctgtccccctcccaacaccccgctcactagtgagagttacttaagaaagaatacaaaacttgttaatttctaagtatcagaaatagagaagataatcaataacattacaaaaaaatagtttgtagccttaaaactgccatgttttaagtttcataataactgtttcctagtattagccaaagatgtgactaaattgataaaatattaagtaagtataaaaatacttgaaaaggcaaataattatacacacctaaattaaaaacattgagtaagaactaagagatcctgcagaaactgatctgttttggccttataaactctacatatattcttttaagaggagttaaacttccttttgtaaaccctggacaggacatgtgtactatcgcaatgttgtatgcagattagaacatgctgtcaggccttgagttaattgagttgcaacttcccagggaagttgaacctgtcactctgactccaccaacttatctagtgatgcctaacaactcagggctaacaggacaccctggctgaagagttagtgcagtttcctaaagtgtttacacttggtttctcactggaaaatctggctcatcacacatccagaatgtatgaagcaatttagatctacagacaatagccagatgggctgccttgaagaaaaaaagtctcttgtttacagataaagtaaggagagaaatgccgcctaaggccaagtgcccaaaaactgcctgggcaagcttcagggggctaaattcccaaactcaacctgctgtctccagagggtaaatttttgtattggaatgtattatagagttcatgataattgtttgtattctattgaagcaacaactcattttgcatggattaggaagccctttacagagatatgccatgagggaaaaaattgcctttgatataacaaataagcagaattaaccttgaaatgaagattataatacattacagtgctatgtagaaaatatcagagaagtcagaagtaactctgtgtaaagagtaaaaaccttgacaagactaattctttttcatttttttttcctagaatagagatttgtttttatttttcactttaaatgatgtaagtatgaaaataaatctcatttttatatacttaaaatcatacactttatgtcattgaaatgagacaggtacataacaaggtatcttactcttgtttgtttagaaaaaagaaaaacaatagcatcttacaagagcagggataaaataataaatgtcctagatgatgacttggatttgaaaaatattcaaattttatctcgtttcctatataaatctttgaacgtactgctccatatcgaattctacattggtttcttctctttccatttta

SEQ ID NO: 535 - DNA, 40105 bp, Homo sapiens
gacactgggaagaaaacatcccacttcatatatttctggccaggtttctatgattaattttatgctacaagagaaaattccaaagacctgtagtgtcaaagatcacgttgaacagcctagcttttgatgttctttctctttttaagaaatcacatacatgtctccgcatagtctactcagttccagaattatgaatgatgatcagctcttgtgacactatcttaataaattcttcgatttcatactacttttttcaacaagtgtttattagataactatgttattttctgaaatatcctaggtagtgacagaagtatgtgaaataatcaatctttaaattccttacattttaaaaaggtaacaagatatgctaaattgtaaaaacaagtagtgtaatcataggaaatgtatataaagaaagactaaacataatatacatttaaatatccagatcaatggacaaataatgagaaattttagttttactgaagttttctaaatacactccaaagaagatgtaggatttgagacaggtgaagaattctgaaagaggaaaaataagatcaatggcttagcaacaagggtgcttgtgactcatatgtcttgtggagaccagctagtctgaagtgaggccaaaagttgagagttgtgaagagtctagactagcaaaatggaactaaactgccccatggagcttggcacatcatataagggatagaggcgcagacttggtccaataagtaatgaaggtgttgataaaggaaatggcgtggtaaaaacctactttgtgaaatgtaaatttgctgactgtgcaagacgacatgactttggggacactatagttaagaaatcttgtcactttccatatgtgagttcattagagctggggctagggtgaaagcagagaaaatgagaagaaaatgtcaaacaggggagacattaatgcaatgaatttggtggtaacttacataataaaaaagaaagacactacagtccattgtagcattccatatttggtgcctggcatctgatgtttccagtaacagaactggagaaactagggaaagtattactaagtgggaaagacaaggaagtcagtgcctggactaataagataaacttgggggtcctctgagggataaatatcataaaggtgatagtaattatcaatcagaacgaagttaggatggtgatattgatttggaaaagggggcattaaaatggcaattgtaaagtctaagtaagtaggctcaccaagaaaaacacagcagagagagaaaagtagaggacaattgataaatggtttagtcatgttcaccattaggagatggaggcttccctccatccatgtgatgaggatgtcacatcaaagaggggggaatagttggagaggtagggagttttcctaagtaatgtcatggaagtcaaaggaggagggagtgtttgtttgaaaatattggctttttaagtataaagcagaacaagaaaggaaggaaggaaggaaggggaagacaattcctttaagtgagagaagagagttataactcgactcttaatagagctatttagtataatagcaggaacaaaatcataattgcagggtggaagggaagaaaggcaaggtgaagtaatgtaggtagaagataaaaccaacatcattgaaagtgcctatataaaagatgtgacaataattaggagccagaggataaagtggaggctttcccattgcgcctccccaaaagaagagatttctttacatatgtgaaagtaaagtatttaagtggaagtaaagtatttaacttatttgagaagttaggatttaaagcatacatgaagtggtaagatgtgtctcttctccttcaccaggttaacctctctatctggatctttgttagtgcatctttttaaatctctcccaaaacctcgtgtcattaattcttttttttttttttttgaggttttcattctcaagcagctgtctgcactggcttcttgccagtgtctgcaaacacactctggtctccccatccacaagatattttctcttacttgtgctatacctctcagctacaagctctctctttttccctcttatagagttttcttcccttacttttactagagcttcctttgtgttcatagttctgcacgctccacaaacactgctcttgtcaagattattaatgcgccttcattaccagatcaacctgctgatgtctttttccttcttaaaacactgtttctttttggttttatgacaccacactccgggctttcttttatctctcagtattctttgctaattgcctcactgtcctctcttcctctcacttgttctgcaatccaccacgctgctctcgtggctccagctgtcattcttgtgcacttgagtcccaattctggataagggcctacgtctctcctgacttgcagactggatactagatcccacacaaccctctaactcaatgtttctatggctgaagtcatataggatagatattcccaaacctgctttcctcctggtgttctgtatctcaataacagcccactctccgctcagttatccaagccagaaattttgctgttatccttgctctctccttcttcctcttctctcacatcccatctgcgagtaagtcttcttggttttatttcctaaatatctactaaatccatctatgtcatttcaccttgactgccaccatacttattcagggcactataattttggcctaaattgttgtagaaaatcccacaactgatgtctttgctactggtttttgtccttttccacctgtttccttaacatctcttctgcaattcctaaagcagccctaaaatatgagccaagtcttgttatttccctggatggaacacttccgcagctctccactgggctctttataacatacaaatcccttaacatgcctatgtattagctttttaaaagtattaaatactaaaaatattaaatatctgtgtgccagacattgtctaacataaccactgagttcctccaatgaatgtttttgttttgttttgttttgtttttttagatggagtctcaccctgtcgataggctggagtgcagtgatgcaatctcggctcactgcaacctccacctcccaggttaaagctattctcctgcctcaacctcccgagtagctgggactacaggccatgccagctatttttttgtatttttagtagagacagggtttcaccatgttagccaggatggtcttgatctcttgaccttgtgatccgcctgcctcggcctcccaaagtgctgggattataggcattgcgcctggccccatccaataatggtttaaatcaaatcggagttactgcagtgcctctttgtagtctctgctttccacgtccttcctagtaaatccatgcggacttctccgggaaaatctcttattccacctcatgtctgtgcttcagccagattaaatcttttctacatgctctctcttgtgaacatgctcttttttatgcctacacctaatttccatcccacctcactgccttttcttagctaattcttactaaaattttagatcataacttgcatgtcacttacttccggaagctggcactaatatgctaccaattccagcttgcacatcaatgctatgcacttccccaccattcgatatttgccactcaaggcatttatgatattttattataatcacctgtctaccccaatagacggtaagctttctgagatcgttacttgttttgtccacctttgtatctgtcaaggcagtggcctgcagagagtaagtgcctggtgattatcctttgaatgagtgaaggaatgaatggttttgatgtaggtttatgtctatataaggaagataaatgaagaaattcaggtttcaatgctcttatgaggtaagagcgtctgttcagaatgtgagtttggccacaggaaaacgtaaacaaatagaaagaaacatggagttctggagtagccttaatgatcatcaagaagaaatagaattgttgaggtatgtaaggaagccagagtaaaattggatggcaaagactgaacaatgatttctgcacctttctccagagggaactgtgctacagagaaagagctcagaactcagaagttggttgatagaagcccaaggctgagaatcaattcagtgcttagagtggcatgcactagtatgtgtgtgtgtgcctctgtttgtgttggagatagaggtatctgtgaggtggtgtacagcatagaaatgatagtggttgtgaagccaacatatatatatataaccaaacctaaaatttgaatgaaaagagatccactctgctggaataaattagatgatatgtgtgaatgggagatttagaatggctacaggttccacttcacttcactagtgaaaggaaggtattgagagaagagaagcagagcatcaaagaatttatcaaatttagtatttactaatttatctcattgcctgtaatgacagaaaactacttttcacaaatataggtgtttctatccaagtcagaactggtcaataagaaatagttgattcttcactggcaaaattgtgatcaataggatgattggagtttcttaaaaaaaaatgtgaagtccctttccatatttcttttcttgatttcaatcagtgtagaaaacaaacactggaagactcatttccccagggcaactaatttatccatttaatgcactcattttgggatgaatcaataaactctccaagtatttattgatcccctatttttggcacaagatgatgctaagtactgagagtaaacaagaaaaatataaagcatgatctctaccctctcaatctgcagtgtgctcctgtgtcagttaatctgccctgatttcattgtcatttcacttttgtatactaggaacagtgttgtgatggtgttagtcgttaacggtattagtgacaaagacttttactgataatttcttgctatttagctggtcttccataattctttttagagtcatccataactactggctcttttatgtaatcaactgtcttttcatttttttaaataaaatgctaatttgatagcatgttgtaggtgatagtaagcttcttgtgaattttaacatcaatattccctatgctattccgtaaaatgtgctgtttcttacttaaagaaagacctgaattatagtgttttctgaatttgcattgtgatgtattatagctttggttttattaatattccaagtaataaaacctctttagtctaattaaccttttgttccttctgaaagttctacaattacattatcattatttatcattaatttgtacaattattcattaaatcatttatttatcttccttcttaaatatagccattatgtttatgatttagaaatattttccaagtcttacttggattttcctatttatatgtagctaagctttattgaatgaattttaatgactttttctggaatttcataatttaaacatgaaagctacagagccatgatgctacctttcacttatgagctgagattttgtctaaatttagactgagaagtgcaacttctataaccactattgatgtttatgtggaaatattttatttaagccgtgaatcaatgtcacaaaccaaagaagataaatggcagatacatttgttgcaagacaccatcagtgaatctcatagccagtgatgtggttaattcatgaaagaatgaaaataagacaaagtaagaacacctattatttctgcattgataacatcttgcacttttattctaacagataatgctctgcccatcttttctcatagtcaaaatattgtctgtaggaatgcctctttctggattaaagcagtaggcgcttctagaaatcttttgaaacactggagtgactggtctaaaaagccaaggctatactgcctgaaagctatttacaagtgggatagttacccatttgtgcagaaatggttatatgaacctttattaaggttagtggactctgaaaaatcttctgggtttaagtttctattatttgtctaatattttctttgacatttcgaagaattctaacaataaaaattcttagattcaagccttatgtcttccctttccatggacattctgctttgatggctaagtaaaagagacaaatccctatggctgttgatgagcagtgcagtagaaaaatgatttctaatcccactcaaaattttgcaaaatgcaaactgataaacatatgatcacttcaggagcattcaaaatggccacaatcacaggcacgttctctgcaggacctgcctacttttacaatctgaagctatgcagtcatataattggaagcattcccaccagtcccttttgaggcagggaacttaggctgaatatttaatacgagtatccatagagctatagtgaagaatgtggacatgaagataaataatgggaactcttataaaatctgggccatacatatatttttatattgtgcagtagtacatagtagtacatacgtacttacatctgctatgctttgttacttttcctcactttactcttttccccttgtgcatagtactgagttaatattcagtatgcacagctacataattataaatgctaagcaaagtttctagatttatatgctctgcgaacagagcagcataacaaattaaagattataaatcaatttagctatcccaagttggaaacttttaaaaatgtgtttattttttaatcgtttttttctctccaaacatttgaatactttgcctttgatatatgttttgttgtggtggttgtttccccaggaaatatatggaggtattcacaggaagtcaacatttatttgggatccaattgttttagtattatttttttccttagggcactgcctggaaattcagtataaatgttttttaatgcacaaacattgcttatcaacctgtcaatcaaggaatctttgaatagaagaataatgctaatttaattatcatttgtacatattaaaattttgtgtaattttaccttcctgtaacacaaaggacagaaattaagaacccaaacccatgtctaaaatatgaaacttgaaatcttaatgtaattatctatgatgcaaacttatagaagaatttctaattgtcaaaagatgtagaaatctattttaaaaaatagattcctgctaattgacacagtacttagaagaaaaatatatatattcaaaaatacgtattgctaatacatattctaattgccatagtccttagtagaaaaaatatatgttgaaatataatttttaaagtgccaggaatagccttttaaacacattttggcaagtttatgtaaacctcttaagttagatcactttaaatatttctcattttcagaaataaattctgaaccctaaccacatagataaattttctaattagaatttgtggtttgtggatatggagcaaaccatttcatgtgtcaaaatagccgattttagtctcacacaataaagacagataatttgtcctatatttaggttacataattttgccatggatattaaactctttttatgtttttttatttttaatttttgtgggtacatagtaggtgtatatatttatggggtacatgagatgttttgatacagacatgcaatgtgaaataagcacatcatggagaatggggtatccatgccctcaagcatttatcctttcagttacaaacaattcaattacactctaagttattttaaaatgtacaattaatattaactatagtcatcttgttgtgctatcaaatgaaaggacttattcatttctcctatttttttgtacacatttaccatccctacctcccctccagcctcccactacccttctcagcctctggtaaccattcttctaccctctatgtccaatattaaactcttttaaagttcaatttttcaaattattagctctcaaaaaatcagtttgttgggaaacagatttaaaattcaggtgtggactagaatattacagaataaaatacagactacattgcaaggagtaatattagtaagtgtgttttttgaaacttttagttggactgtgtatgtatgtaggttctatttgcaatataatatatataggtaaaatatatacatataagtattcatttttaactgtgaataaaagtgattgactgcaattattctaaagttctatctttttagtatcaatagccaactataatagttgcatattattattagttgtactaatttaagtgaaccattatttactgaataataactgtgcaccaagtaatgtgtgatgcccacatttttatctattactagtccttataattctgtgagatgatagttaaaattttccttgttaaaaattaagaaaataaaacaggccaggcttggtggcttacacttgttatcccaggactttgggaggctgaggcgggcagatcacgagatcaggagttcgagaccagcctggccaacacggtgaaactccatctctattaaaattactaaaattagctgggcatggttgagggtgcctgtaatcccagctactcaggaagctgaggcaggagaatcgcttgaatccaggaagcaaagttgcagtgagtcgagatggtgccactgcactccagcctgggtgacagagctggactcccatcaaaaaaaaaagaaaaagaaaagaaaacataaaacacaactgattagaacttgaaaggttgcaacgaacacactgatataagatttttttatacttgaatttttcaggtctttaaaagatattatttcaaataactgacttcagtgattgagttctggaaattttgagttaaacctagtgttttttatgcagtaattatttggaaatttaatatgctaattggtatgttgaatcatcaaataaaaagagatgaatacactatgaatttctgaaacttatttcaccttagaaccatttaaaaatattatgtcttcagactatgtttactggaacacaccctgagaaatgcttaatttaatcatgtcaatacatgtaactcaaaagagacaaggccttataaagcaaatgtgtataatgtaataatatttgatagtgtttccttgaaatcagactaaactctaatttttctattagcaagactttaaaaataaaagtttttaatatcttcaagttcaagattcaatttaaatgatatactctggcccattttcctagggaacacacttcagtaaatttagaaatagtaaatgcataatgtttactttcccttcacaaaaattgcaatgtaaatttatcattaccatttatgtttttaaaatagtttgcagtggacaattatcagacattgccagcaacctatgtttcttcaagtcacttcatgttgaagttactccttcagtacacaagtacataaaccattactatttattttgttccatctcctttcacagattttaggaataggaaagaatttcaaatctgtttaagctaatgtatggatttcctaagtgagctgaacgcagtggtccttttgcctaccactttacttcaaacattatagcctcttttcctcccactgatggtttacaatacacaagaaatcgtgagaaaaattaaaaattaaaaaaaaaaacggaaagaaaaaacaaagaaaaccaaataaaatacactagaaagcaccatcacaagaggttctgctttaatggtttgcagtgtagcctttaaatctatttttttttttaagaaatgtcctgtgtgtgccataaatggaggaccacagaagggtttctaatttctgccgtggactagcgaggattgactcactgactaggctactgagattcatattctttgctcctatcagcttttctaagtcttgtgcgttgggccctttcttatctgctcaaggttccaatgcacttcccaccaagcttccatgtgagccagctttatcttcagtctcatttttctgtagagttaccaaagctgtctatatctgcagacatatttagtcgggtggccttctgttttccagtgttccttcctaataaatctctctgcctaaagaactggcatgactacagggggacataaggagatgagggtctctcattgtgaactacttgttcttgttcccatggtaggaaaacccttttcttcagtcagagatcaggaggcttcactatccctttcttgaagtgttttcactcctttacggcccaccctcctgggagggcctgggagacacgaatggctcacctgttagaacttcctggacatgcctgcttctgtaatttgcacagagattagtatgcagcactgaaatactagaaaaatagtgtctgttataaatgcaactattgcttctattctctttaccaccacagcgacactggtaagcactttacataattattacatttaagcctaaacacatacttttaaaattggcatgtgcattctccttttttaatgagccaaatgagtgacagaggggttaaatcattttcttggagtaactccagcaaaatttgaacctgaagcaatgtgattctctggcaaggttagccttggtatagaatgaagctcatttggtcactatgaattgatacttaggacagggctcaaaccacatgagctagccttatctgtctcttcattttacaagaacagaattttaatgtctacttaccaaggttgcagggtttgtctctatatattacacaacaaatttaaatagaacctttttctgcaatggcaggttgtggacctgctcagagaacagaatgccctcttgaggatggggagcagggcaagactggcctgcacaagtctaactgactaataattcatgttgggagtatcagcaaaggtggaggaagctaaacacagatctgagggagaaggaattatgggagggtttggcattttgtggagggatttaattcttatatgagtcactgagtaaaacacagagagggagaggctaactaaagaggaagggaaatgaatcaatttggtggtgcagagaaaagaattagaagataaacatggaaaatcagaaggagaaacagtagatggaattagataatcttttgataagtccttggattttttttctaaaattctggaattcacttacatttacaaatatttcaaattaatcaaaataaccattctactattgtcaatgacagagaggcaacacatttacccagcatatattttctggacacgtattgaaccacgtgctagatcaaactacacaggaaaaaaaatcacctcagtttgcttaaagtaaggaaaagagagaacccatatacaaacatgtactcaccatataactctgaggcaacaagcaatttatttgtcattgacactaaatgaactactatataaaaaaaataccctgacaggaactggcttgagaataacaaaccacattctctgaaaatgcagtctacaaacaacttagtttagttgaactaattgaagacgactaacggtgtagttgctctttatcttcaaatgagaattatgtttgaggccaatgaatatcatgatttaaccataaaaatattagctagaatttttattaaatggaaacccataccataaaaacactcatgaaaaatctgaaatggttctattaatatccagcaaagtgaacttaaagacaaagtattaccagaaataagaggcattttataatgctaaaatggtcagttcatcaagaagacatggctgtcctaaatgtgttggtaccttttaatagagtatcaaaataaatgaagcaacaactaacagaaatacttttgatataaacaaatccacaaataaagttagagattttagcactcccctctcagtaattgataggacaatacactaaaaattggtgtggatatagatacagataatattacctaccaactcagtctgcttgaataatcttcctcctatgtgacaataaatacaacaaatccaaaatgcacaaccttctgaagagcacgtgtgcacatccaccaagacatatcacatggcgggtgtaaggcagtgtggcaaaattcctcatcacctgtccttgctccttgtgaattcaccttgtgaatgtctcaggttgcaagtgtcctccactgtcaagctgtccacatgcggaacaatgagaaggagaatggcatgcagggctaaagcatggcacctttccttccacactctcagttgctttctccattgaatcctgaatttttttttttttttttttttgagacagagtctcactctgttgcccaggctggagtgcagtggcgtgatcttggctcactgcaacctccgcctcccgggttcaagcaattctctggcctcagtctcccaagtagctgggactacaggcacacgccaccatgcccagctaattttttgtattttagtagaaacagggttacaccgtgttgcccaggctggtcgcaaactcctgagctcaggcaatccacccctctcggcctcccaaagtgctgggattacaggcatgagccactgcacctggccctgaatcctgaattttatgtacatactttatttgccaggtagtgattttccaccatgattcctttcttcctgaatgtctactctttcctttatgaccaaatttaagtttcagtttactttccacaatgtctacaatccactcttctctctactttgaacatcgtaagcatatactacatattattgtttaactctttcctgcatttatgctttatctcctccactgaattaaaatttttgtgagagcagatgtcacactttgcatttctttggaaatactgcctaactaattgctcaataattgcttgttaaattaacatggcaagtaaaggttgaaagctaccttttgaagttttatagcttcaacttacttttggagacatatttttaaggtgtcttacacatggcctacatattttacaaagacacatgtgctgctaaaagatgaattgagctactattttagatagactttgttgtgaaagtaaacatgcaatggacaggccaggtgtagtggctcatgcccgtaatcccagcactttgggaggctgaggccggtggatcatttgaggtcaggagttcaaaaccagcctggccaacatggtgaaaccctgtctctactaaaaatacaaaaattaaccaggcatggtggtgggtgcctgccagttactcaggaagctaaggcaggagaatcgtttgatcctgggaggcggaggttgcagtatgcagagatagcaccattgcactccagcctgggcaacagagccagattctgtgtcaaacaaaacaaaacaagacaaaacaaatgcagtggacaaaagtcaaatgggaactggaatcagagagataagaattttaaaatactcccaaggtaaacagtactttgaaattgagacgggagagttcctttgacaccttcgcaggacttgcgacaggggtgcagctcgcttactctgccaccaccacgctcaaaccccttgcaggaaggggagcacacaggcgagcgggtgccgggtccggggcgagcacttctgggctccggccccctgataacgtctaggcgagtgtcacaattaatgttcttttagcagttgccatccgtggacagctaagggttcatcagctcagtggagattcggggtgacagccttttaaactctgccctcgtggtacccgggttcttgtccgacatccaggaagattcaggtcacatggacttaaaggatggtgaatgcggatattttattaagaggtggaagtggctgtcagtggaagggaagatgacgagcggatggtgcgggaagaaggtgatctttccccgaagcctggccgtctgcgctgggcttctttccgaagtcgtgtcatcggaagttaagccgcatctatctgtagtctccgatgctcagttgcttcttctcttctcgacattcagctgcttgtctctttgccagctgaggtctggggtttatatgggtacaggacaggtgggcagggtgagccaaaaaagtaacatttaggcgggaaaacagggataactgttctcatttaggacctcgggtccaggcttgagggtggagccctcgccagggacgccgccctcttctacccagtattttcctgcctcctgtctgtatcaaaatgatgcttcgaatttagttttaaaattggcattatcatatcttaaattaaaagtttatcgatatgggtcaccaacacatgttttttaggattatgtttctaggtggcttccactcagtgcctgcagaaaaaaacaaaacaaaataaaaaaaaaacccaaaaaacaaaaacacttgactaggagtctaggttttcagttttaatatcaagtcagtgaataaaaaattgtgagcattatgtcatcatattgctctgagatttttcttattcacctataaaatgagacattatatttatatcacttaaggtaccttataagtctaaagttccatcttagtttacataagagcttcacacttaaagtgtcatagaccaatagcaatggtgtcacctgggagcttcttggaaacacagaatctcatgtcagaccttagctcagatctcatctgtacattaaaattagaaaagcactgttgtagagtgtatatgttaaattgcatcacataaccataaattggatgcatactttttttataataacagagttggtcattaatgtgacctattattattatttgcccagaaagctatatattagcagtctattatttactgagtatataattctcatcttgaattttcccctctcctcttatacatgggaggtatggcattttggtcctcctattttctatctgtatttgcctgcttcagacctagggattttgggggaaattttacacaataggacaaaagcagtacatggacactattgtcttttatggtttcatcccaggactgtagtctctatctcttctgcacattctaagtgaataatagactaaactatactgacatttctttctgaaatgaacaaaatatttggtttaattagtttttcctgttgcattgcttgacattagctataattaatgtgttaaatggtacataagttttcagagtttcttaatagacaacaatcttggaactcaccatttttcttttcttctaggacagatggctgtgttagttacttaatgtcattggtgattttcactatgttatgttaattctctccttgtatggcattactctgtcttgccaatttctaaaaaatgtgactatatgatatttaaaaagtaaaatattcaatcaaatgttccctgatttttctgttaaaattaattattttaaatgaactactcatttcattgagtgaaacagtaaactgattgatggagtgatttgacattatattaacacaggcttgttaatttctcctttaccattctcacaaactaaactgagaaaagtatacttcagcctgcctctatttctgtgttaaaaatcttcatcaatcttaagtaattgacatcttcattattcttcaattataccactttgttcctgtatatccaagtgagtttattttatcacatttctttccactgctaagatcttcctttttcaacaagtccctacttccgtcagttcaagtgcaagtgaatctataacaaggcacattattgtgtcatagaaagctgtaaacatcttagtttagaaagcagaaatattgatttagaattactgttcagtatgccttctcatgaaaatcaaagggctaaagaaagtcaataggctactgtcttcaaatcatccacatatattgcatatttctggattcaacatgcttttttttcctccttgaaagtaagttgtagtgttccctttctatcaggtacagaaggccaaagcctcatttctttgttatttcaatagcttttggggtacaagttgtttttagtcacatggataaattctatagtggtgggtattagtctgttttcacattgctataaagatactacctgagactgggtaatttataaacaaaagtgccttaattgactcacagttccatatggctggcgaggcctctggaaactaacaataatggcagaaggtgaaggggaagcaggcacctttttcacaaggtgacagggagacacagagagaaggtggaagcaccgcttatcaaacagccgtatctcctcagaactcattcagtgtcatgagaacagcaagggggaaatctgcccccatgatccactcaccctccatcaagcccctcctttgactcgtgggaattacaattcgggatgagatttgggtgtggacacagagacaagccatataattccatcccccgcctggcccttcccaaatttcatgtcttttcacaattcaaaaccaatcatgtgttcttaacagtgccccaaagtcttaattcattccagcgttaactcaaaagtccaagtccaaagtctcatctgagacaaggcaaatcccttctgccgataagcctgtaaaatcaaaagcaagttagttacttccaagatacaatgagggtgtaggaattaggtaagtgttcccattacaaataacccaactgggcagtcattaaacctgaaagcttccaaatctcctttgactctatgtctcacatccaggtcatgctgatgcaagaggtgggctcccatgcccttgggcagctctgcccctgtggttctccagggtacaacccctgtggctgctttctcaggctggcattgagtgcctgtgacttttccaggcatatggtgcaagctattggtggatctatctttctggggcctgcaggatagtggccttcttctcacagtctactaggcagtgccacagtggagattatgtgtggggcctccaaccctacatttcccttccacactgccctaacagaggctctccatgagggttctaaccctgtggcagatttctgcccggacatccaggcatttcctggacatcttccttttccaggaggtttgggaacctctacctagatttcatttcctctgagatctaggcagaggttcccaaagctcaactcttgtcttctgtgtacccaaaggcccaacaccatgtggaagccccaaggcttgcactctctgaagtaacggcaagtgtggtactttggccccttttaaccatggctggatttggagcacctgggatgcagggcaccaactcctgaagctgcagagagcagtatggctctgggcccagctcatgaattcatttttcccccctgggcctttgggtctgggatgggagggactgcctcagagaagacctctgacctgaaatgaagatattttctccattctcttggctattaacatttggttcctctttattcatgcaaatttctgcagccctcttcaattcctctccagaaaatgggattttcttttctactgcaatgtcaggctgcaaatttttgaaacctttatgctcggcttcccttttaaacataagctccaattttaaatcatctctttgtgaatgcatattactgaatgctttcagaataagacaggtcacctcttgaatgctttgctgcttagaatttttttctgccagataccctaaactatgtctctcaagtcaaaagttccacagataattaggggtaaaattttgccagtctctttgctaaagcatagcatgtgtgactcttattccagttcccaataagttcctcatctccatctgagaccacctcaatctggacttcattgtctatatcactattagcattttggtcaaagccatttaacaagtctctaggaagttccaaactttcccacatggtcttatcttcttctgagccctccaaactgatccaacctctgcctgttccaaagtcccttccacatttttatgttatctttatagcagtatccaactcttgatactagttttctgtattactcagttctcacactgctgtaaacatactacctgagacttggtactttataaagaaaagaggtttaattaactcacagttttacatctctggtgtttaagcctcaggaaacttacaatcatgatggaagcaaaaggaaagcaaggtatgtcttacatggtggcaggagagaaagagcatgcagaggaaactgccactttttaaaactatcagatcttgtaagaactcactcactatcaggagaatagcaagggggaaaactgcccctgggatccaatcacctcctaccagatccctcctcaacaatagggattacaatttgagatgagatttgggtggggacacagagccaaacaacaacatggtgtattctgagattctagtgcaactattacctgagcaatgcacactttagccaatatgtagtatttttattcctccctttgttgagctcccaaagtccactatatccttctgtatatctttgagtcctcatagcttagctcccatgtataaatgacaacttacagtgtttggttttccattcctgagttatttcacttagaatgatggcctccagctccatccaagttgctgcaatatttgtttctttttatggctggctaggtagtatttcatggtgtatatataccacattttctttaactacttattggtcaatgagcagttaggttgaaattgtgaattgtgctgctataaacatgtgtgttcttgtgtctttttcgtataatggctttcttttcctttgagtagacagccaatagtgggattgttagatcaaatggtagatgtacttttagttctttaaataatctccatactgttttcatagaggttacactaatttacattcccatcagcatgaaagtgttcccttcccaccacatccatgccaacatgaattgttcttcaactttttaattatggccattcttgtgagagtaaggtaatatcttattgtggtttcaatttgcatttccctgatggttagtgatgctgagcatcttttcatatgtttgttggccatttgtatgtcttcttttgagaattgtctatttacgtcctttgcccaccaaaagaacatggtactgatttacgaaataggcagacaaatggaacagaatagagaacctagaaataaagccacatacttacagccaactgttcttcaacaaagcaaacaaaaacataaattgggaaaggacactctattcaataaattgtactgtgaaaacaggcaagccacatgcagaagaatgaaactggatccccatcattcaccttttataaaaatcaactcaggatgatttaataaccaaattaacaatttttttcccaaacttctagctcaagtttggcatcaaagatttaaaatgaaggcctgaaaccataaaaattttcaaagataacagtggaaaaattctggacattggcatggacaaataattcgtgactaagactccaaaagcaaatgcatcaaaaacaataaacaaatgattcctaattaaactaaaagtttctgcagagcaaaataaataatcagcagagtaaacaggcaacccacagaatgggagaaaatatttgcaaactatgtatctgtcaaaagactaatatccagaatctacaaaacactcaaacaaatcagcaagaaaaaaacaagtaatcctttaaaagacttatttttattacctagtctgtcattacataaattaaattgccatcacttactcacagtgtgttattttcacttggactttagagacaagattccacgtaatgagaagtaacaaaaatccaagcatagtctatactgagtgattatctatttctgcattcccaagtgatactataataaatggactttgtctgcatgttatgagctggcttatacataagcatggaagtaaacccatcccaacttataagcaaagatgcaaattttactctccaaacttccataagagagatgcagagagagaaatttctttatgtgggttaatagcatcatctttatcctttgttaaaagttaaaaagcataacagatggataatagacgtcagtgatttcaaatcctgaaaagaacctgctagtcagagaggttcactcagcactcggaaattgatgaatgaagtaatcattctagcagcaattgtcttcagctggtcccattcataggtatcctatttctatcctaatttagatttgcttcagtggctggctagatttttcttttgaagtcactatatattcccatgcggctccattcaaattcaaaacaatcattattaatatcaaatattgggctatagaaattctagaagtactcatcttatgctttatttgaggtactagacatgtcataggatagcataggggaagaactagttattccaactgatactttttaagtatatgcaaattttaaaaatatcctggggaagtgttgagctatttttaaaagcatagaaagattagaggagcacagaaatgtatagaaaaacttctgttgtctgcattttctaaatcacatgaacactttactgagatatgcaaatttgaagtgtattattttgcatggtggctcacagggttgctctctggagcaactcctgtgatcaaagtgaccaacatcaatgcttatgttaatggatctccccacctacaacttgttaaactccatagaattcctccatttcaataacttccacccagtttcattttattgtcctttacgtgctgtcataccttggcccacaccatcacttgaactactttcattccatatcctgtactagaaaattattttataacaatatcatgtacttcattcattctctttcccgcattgaaccagatcttcactgtcattatgaccttcacttcttctataaatgttttttcttatcatctttgagaactcccctagctttatttcttcatttcctggttttcaccatgaatcatttcaacaataattttactaaggacttagaatcaatcccttgtcttctaatagtttgcaatattttacaaatacacgcacaatcttgagtaaacattatctcatatacctcagctatcaaacattgttgtgagtaaaaaagaacaataaatgaatcatcaataaacaactaacaatgtcaattctcataatttaaaaaactggcagcatcttcactttttctcagcattcctgtgacaattagctgagttgatgtttgaaaaagacagaataggctgtgttttccttcatgaacaatctcaaaatgttgctggcttaaaataacaaatgctatagatctcatgctcgttcatgtaggtaggggatggttttgctgacccagggagatggactctgtgccctttaatagtgcgtctgtcacaacaagccttcacggttctctaccacaagtaatggaagcatagcgctgtgaactagagggagaactgaaacttttagtaatcactagaaatagtttctacaatattctgatctttctcatcttttccaaatctaagatctatttcccattctttgccatctcagtagataatgttgctccctatcttattttgcaaacagatgctaaacaacttatcacccaatttctttccaccccacatttccctgtacattcattcatttttttttcttgtttggcattcctataatcgtaaagagtttagaatcagaggcatgcatggttgatgttgaaaaacagagaatggctgttaggaaaatagaactagttcatgaatcacaagagaatgaaaactcatatatcgtaatatgatgaggtcactaacaaaactgtttaggtgagatgtgaaatctgtaatccagggtagtagtaaatgtcagagacattaaagtaattgaaggcagggatatgggaagagtaacaactataatttcaccttcacaacagtaatcagtggccctaaaattgtgtttacagttgttttggattctcggattgggtctaccaacacccattccaaccctttacagagttgaaagatagaaaaccaaattaacaatttttttcccacgacttctagctcgagtttggcatctgattttgattttacctttcagatgcattcccatgatacctggattaggaactgaatcatagagacaggcttggtggaatgtatccactttgttggacaagaccatggaagatgtggcatcatcagcatctttgcattcatcagctcactgtagcagcagcagcagttttaccaaacatggcccacacagtgtggtttaacagtcaggaggaggagcagcagctacctgattgccagctttctaaaggggagatcactaacttcaacagaaaatgaataattgatgaatggggattgtttctaggaactcagtctaatgcagtctccaggctttccaacaactctgtaaactcctaagtccttgtaccaagtgtgtattgggctaaatcagctaacatcatttctattgttaacaactgaacaatgaccaccatcttggttgatagaattggttacatgcaacagaccttcaggaaaatgggaatttggaaaagtctacctcaagtatttggatctgaaggcagtgagaagccaattaacgttcgaagatagggcaggtatgagatgccaaataaaggcaagtcgtttatgaacaaggtaactactgaaacagaccattattggagtctcaaggattagaaaggctgtaagcttcgatggagagctcaacgttagaaagtgaaaagtcagcatttaaaattttccacctaaggtgttagcagagaacttaaagttttccaagatcgacttaaataataccttatattctttaatcttaaagctgatttggcaaaagtcaacttcagagtctgattctgtttattactcaattataacacaaattgaattcattatgttagataaatcatcagagaagaaggagacattagaattaaaatagtgatttgggaatattgagatgacatattaaatcttaccaagccagccggcagaaacagaccatcttgccttctgtgaagggactgggcctgcattgccaaaagacctagttataaatcatgtgtaatagcatcttgcactgggcagccatttctctccatgttttacacctaccagctatcattgctcccagacctttaaccaggtcatcaggctccagggagcaattaaaattcaagcctagagagaaaagttattggcaacagtaaaattgcaaattctttctttcctagtttatctcagagaaaaacaaaactaaactaaacaaaaaaagatagaaagctggaatgtgatataagatcagaagagactgtgttttctaacatgtttttacactgatgggaatgattcaatgaagaaggtaaaaataataatgtatagaaaacagagggacatttcttgaaccccttccttaagtgagcaagaagggataaaatctggaatctaaatacaaggaacctgaaacaaataaatagttcattacaactacaaaggaaggcagagtaagcggcacatgcagatggcaattgtgagctggagagtttgtgattcttttctgatatcttacttttttttttccagtggagcaaggctctcagtggagagtgaagatggaaaaggaaatagtgaaaatttgaaggcaaaaaagatatgaacgagtcatccaggagagtgagagatgagaaaaatggacaagagaaatataagagactttctggcagcagcaagggtcatgaaaaagttagatgactcaaagtactgatgtgtctctctagactttgctcaggtgcatgggtgcaggtgcagaatgggtggagggttagatttaattaggatgggacttttccagttcatcacaatgaagcaagggatcagcaagttatctgagagtgtgtgtaagaaagtgattataaagatgggttagggataagctagaaagagaaacaatgaaaggaatgaagttagtgaggacagggtgagcccagctgattattttggcccagccaaatgatttttttcaattggaacatcacaaggaatggatgagaaaaatagaataaagtgattggagtatgggattcttgaaatttagagtttggaaagtgtgcaattaatgacaatgacaaagtttatgctatgattaagagagggagtgttagagatatagtagaaggcaggatcattggataggaggagatttaaacaatggaggaactatggtattatatttatcatctatgtaaatgtcaaaatcacaggagattatgacagcagtggagttcaaagagtgacagtgaataagaagatacaaattttcaaaaaataaggttgagtgtctgaggggtttataaatgattttcacaaggtgagggaacaggtggtagaatctgaaaacatgagttttaacgtgaggactttaggagggatgaaaggatagcgtgtggttggcagtcaggagtatggagaatctctacagaacctgcaaagtggtgttttgagggatgtgggaaagaaaacaacttttactccacagaaccacattgaaatccacgtctttcaggtagagccaggcgttagagcagaaagccgagggaaacttcaaagaaaataaggaaggtagacagataaaacaacctgaagatatgaggaaggatagaaatacgtgtaaacagagcttagtcaaaacaaggacatgggccttgggaggaagggagaaattggaaattgtaggcttctggatatgcatatcagacaagggtaaaggaaaacaagtgacactcctacctggcttcaaggtcaattgtgtttgtgagacttggggtgatggaagaaggaggtgagggttcttaccatggaagagttttggattccatcttgattcctgcagaggaaagtgtcaaggctaagatgagagtggtattaattaaagaccatctctttcttcttgtttagtttatatttattcatacaccaatttaattaattattttttaatgagacaggttcttactctgtcacccaggctagagtgcagtcgtgcaatcatagctcactgcagcctagaactcctgggctcaaaggatcctcctctctcaaccttcccagtagctggaactacaggcatggaccatcaggtctgtataatttttaaaatttcttgtagcaatggggtctctttctctttcctaggatggtctcaaattcctgtcctcaagcaatcctctctccttggtctccaaaagttctgggattataggcatgagtcagcattccaagatcaattttatcttatttttcctctttcttcaactataatatatgagttgtactggtgctgaatagattcataattaatttagttcataggttatgcaagcccaaggtgaggtcacaccctaaataaggagaaataaatgtcatgaagatatagatgtaacgagtctctgggtcgtccattcattgtgatgatagggcaagtgcctagttggattattttgggtgagaacacattgttattggctggagtaaaaagttcttatgggtaagtcttaaagaaattaaattggaaatgtaagcagagaccagataactaagagcttactgttatttgacaagtagtttggactttattttgatgctcaggaagaatttggaacgatttttcagctacaagatgacacagttattttatttttcaaagaaagactaatctgacaattgtggataaaggatttaaaagagagaaggctagaagcaatgaaactaattgaagtggtaatgcaatggtgcatgtgataggtttgaaagacttatttaagagactggcagtggaacaagagtcagacacagctttgagacatatttacaatgaaggtgtgacaaggattattaactgacggaattagagattacagaagaggaatccaggaagtcctcagatgtctgtcttatgtgactcagtagatgatggtgcctttcagcaagttaggagatacattatgagaagcaaaatgaaggataaaaacaattatttcagtcatatgtaggttgaattgatagtgcataaagattgaattgatagtgcatgaagatatatagatggatacaacttgtaggcagaaatatgagtctaaattttggaaaaatagtctgggtgatgaaagagacttgggaaattttagtttatggatgcatttgaagtaattggtttagacaaaatgcctggagaaagaaagtagaatgcaaaaagagaggaaaaaaaattttttttattaacacaatattaagtagctgtaggaggaaaagaagctaattgaatgagaacaaggaagaatggtgagaaagttaaaaaaaaaaaaaaaaaaagaaccaggaggcatttagaggtgaattattgtttgtgagcatcaaaggcttcctggcaatcgtgctaaataaagactaaaggtgttctttggatttcgtaatcctaccatcagtaatttcaagggcctggtggcgtggatagtgtaaatcagtttgcaataggtagacaactgaatgggaagttaagacaaatacagaaccaccataaacttaggacaattttggctataaaggaaaggaacatgtaatgagaaaagagtcaagaggttttttttaatgatgaaattagagttaagtacatttatatggtaacaaaaaagacagggagaaattaaagatccataatgcaagggaaataattggtggatgaggtctgaacaaaatttaaaggaaataagacttggggtgtatataaagagattagccatgtataagagaagtgaatctttttatttgtgaaagaatgaagaggaaggaagttgataagagtaacaagagaaaaactgagggctaagagaaggaagtatgaccagtctgatagtctgaggatcaagggagaggctcagaaactgagtaaggataaaacataagggaagtgaaggcagcaagtgacagagctttttcacatgcaaatcccaggtttcttctccacctacattctgacataattctggcaacgtcagtgtaattgtaattgacccatcagcacccatccttgtcaaatcttgacttctttatccccagtaacttttataccctctccacctgagcaggcctaagctacatctcattggtctttgtaaacccaaactagctcagtgtgtgacatgaataacctctcaatatacagacataaataataaaatttatgaataaattaattaattttagtatcctattctctgaccttcgcgtacctttaatcaagcaatgaaagaataggggtatgtgaagatcagagaatgggatacggaagttcagcaatgcaaaatgtaggtgcttgcaagagttaactaggcgcatgttagagtcagttagaggggatgtgtaactattggagcaagggaggtcaaagcaaaggtcaacagatagaactactgtgttagaggtgctacctgtccagtgctgaaggtttctagcatgataataacatggaagcaacagtgaactaggtgtctaagactttgaaaaataaataagaaatcttgtgaatagatggaggtgataaagcatatgataaacatcataagtctgagaaacaggtgggtttccttgtctgaaaatttaagttttgaaagtagccatggggcactgggaggaggctgaccacagagtttaggagaatgaccagccaccgctgaatagggtgtctgaggcagtgattccagagggagcctagttcctgacaaagcaaggcggggaatggggatcatactaggaagagattccagtatttgtgtcagaggcatctgaacaagagcaactccatcttgaataggggctgggtaaaatgaggctgagacctactgggctgcattcccagatggttaagcattctaagtcacaggatgagataggaggttggcacaagatacaggtcatgaagaccttgctgataaaataggttgcagtaaagaagtcagccaacaggcacggtggctcacacctgtaatcccagcactttgggaggccaaggcgagcaaatcatgaagtcaagagattgagaccatcctggccaacatgatgaaaccccatctctactaaaaatacaaaaatcagctgggagtggtggcgtgcacctgtagtcccagctactcgggaggctgaggcaggagaatcacttgaacctgggaggcggaggtcgcaatgagccaagattgtgccactgcactgcagcctgggtgacagagtgagactcagtctcaaaaaaaaaaaaaaggaagccagccaaaccccaccaaaaccaagatggcaacaagagtcacctctggtcgtcctgactgctacactcccactagtatcatcacagcttacaaatgccatggaaacgtcaggaagttacactgtatagtttaaaaaggggaggcatgaataatctgcccccaccccttgttgagcatataatcaagaaataaccataaaaatgggcaaccagcagcgctcaggactgttctgtctgtgtggtagccattcttttattcttctactttcttaatgaacttgctttcactttactctgtggaatcgcctcaaattctttcttgcatgagatctctcttggggtctggatcaggaactctttctggtaacatttgaattccagcaaacatagtgaagtctgttgaaagaacaatccacaatgggaagcatcacaggtctacatggagatgaaggtatcagataaataataataatgactggaggaacttccctttcaggtggtgactaaagatggtggggtgagaggtatggcaaggttagctggcctggaagttctgaatgttcctcttgtaaatcaaaactaaaattctaaggaccctccaaccatctgaatggacttcctcctcagccagggctcttttaaaatttgacctgagagtctgtttcaggccatgttgggaaatggggttctcattgtacctctctggcattaacatgaacacagactttaagtctgataagaaacattttataacctattctctctgaagcctactactacctgaaggcttcctctgcaaataagaacttgggtccccacaatcctttatcttaatgtaggcattcctttctgctgatcccaggtctttagacaaactcaaacaattgtcagccagaaaatgtttaaatgtacctatagcctggaagccctccaatttgagttgtcctgtttttctagaccaaactcatgtatttctcaaatgtatttaattgatgtttcatgcctccctaaaatgtgtaaaaccaagctgcaccccgaccaccctgggcacatgttctcaggacctcctgagggctgtgtcatgggccatggtcactcatatgtggctcagaataaatctcttcaaatattttacagagtttcactctttttgtcgacactctgatatattaatagaattgtttttgctgctccaggcagattccacagcgagcttcagcagtagctggatctggatggttctagtgactggcatttagtcaccaactaaggctgtgacttagattcaaagtagaatcccatcaggaagttatgttacttcttgaaaattccttctttgagttttttgaagaggaagtaaaaagccaacacagcataaacacagatttcatcaaatactgttaaattatatgaatgaatcctcttacacactatttttacagagcaggttccagaatttgaaaacatttttctacttagagcaacgcttgtgccagctacttgctaatacctttctaaattaatttgtatttttggttaaggtttataccagttagttggacatatgagatgtttcaatagtataattaccataaatgactttttctttttttttttttttttttttttgagacagagtcttgctctgtcacccaggctggagtgcagtggtttgatctcagctcactgcaagctccgcctcccagattcatgccattctcctgcctcagcctcccgagtaactgggactacaggcaccctccaccacgcccagctaattttttgtatttttagtagagacggggttttaccgtgttagccaggatgctctcgatctcctgacctcgtgatccccccgtctcggcctcccaaagtgctgggattacaggcttgagccacagcgcccggccaaatgactttgttaaaatttttcagtaagtaaacatcattttaatttttaacaattaatattgtaaatatttaatatttaaaaatttcttttattgaaaaataccaaaaagtgggtttatgattaaaaaatataactctaattaatcaatgatgtttggcattatttttaatcttgtaaattcaagtaattctgaaaatcaaaaataattaggtaaaatgttaggaaggtaataaaaatatatgaaaagtagttaattcaagtggaaaactttcattatgtttaaaatgatcacttccagtgttttaagcagaagttaggtttttggtttatattatgaatgtacgactttatgaacatatgtaacatatctgtagatagtttgaagcagtctcacactcaatcccaacaaattaaaacagatgacatagtctccttaatatgctcggtagtgcacataagagaaaacctttggcaaaaggtagttggagtcacccaaagatattctgaaacacctgggtgggacagctgcttccctctggctttgggccttccacaaaaagtcaattatctattaagtcatctgcgttcatttcccaggttaatcaggaaaccatgatcgcccgagggatggcttgcatcatgcacaccaggaagtttgaactgtagccaaccatgcaattaagatgttccagtatagctattattcttggttgaggcaaattccactggcacaggtatttactaggaggaatataccaaattaaaagttaaagaaagaggaaagaaacacgaaacgtggctggcggttaaagacaggttttccttaattaaaacctgagaggcactcctggccgatttcagtcaggagcgctttctctgacagactaagagcatatattggtttaagggcgaggagccttatcagaagtttggaatgttcctgtttgagggagaagttttctggcggggttggaatgtctctgggaggaggcgagcttaccttggggcagccatctttccgccagagcaaagttatcttgagactggcatcttccttgcccgatgcgggttatcttggggctccatgcctctgatccggaaggagtttggaatctttctggttggagatgttatttgtggtttatggtcgtgctgatcttagccattgggctgatgccctttggattcagacgttttttattaaggtgaactttagaatgaggggcttgtccaagatggcgatgctcctgctctgtcaccaaatagttcagatttttactcacagttaacgtttctatagttcatgttttaatttatggtgttttcatcaaatggtttatgttttagttcatgatttttctcagtgttgtgaactcagaaaatgaggtgaagataaaggaaagttcctgtttgttcttcacaactattatttttatgaaatttgagcgctaagggaaacaatttatctttgtgtttattacagttgttccatatttatctagtctaattcccgtcatatttaggctataaaaaagatttgcttacattgtcacttcagtaactcaataatgttttactgaggaaatctccaatttccaccctgaaaaactgcgtgaaaaataatgaaatcacaagaaagttaaaaaacacctaaaaatagactgtggcaatgaagagtatctctaatgcaaaacttcatctgcctgaattaaggagttcttccccgagggtgcagccccagaaggggctcctggccaaggctcacagaggcattcgttggagccccttcacagattttctgtggtagtgagtgtgattggaattgtttatcaattgaaacgctattaagattagggttgtgctccttaataaccaaacctttcaatcatattgattttgttatgctgttttaaaactacacaggtaactaaaattaaaagaattatacctctcaaagcaagtgaaattttaaaatgtgttatatatttatgaagagaaaataaatatgcaggtttttttcagttgtagatagcgccaatgcatttggctataactttcataactacatacaatgaaatagtaagtggaaaaaatcatgaaggagaaaaggataagagattacggtggaccgaaattgcttttgactgccatgtgtgctttataacttttgattatttgcttcctgtgtgtcaactcttggaagtatacatggatcaaggcaagtcaccaaaattttttcccatttccttgggtatagtcactggttcaaagataggcaacttaatcaaaacaggccaatgcattccaatattttgaacttcaggtgatgtggaccttccctctggaactatagtgttagctagataaaaatttgggaccatattgaaaagacttgtgtgcaactagaagcaagcagagatgtgccaaaatgagagtagcacgaagtgtccagaagcctggaggaccagctgaatctttgaggccctggttcatggtagctcttccttgagttctatcagcttttccaaagctttcccagctatggaagccaaggaagtagagctagaacacaaaaaacagatgtggcagatttcttacacatattcatatatttgagtaatatcatcaatgaaataatggaagagtgttatctaaaacaaaaattctcctgaggtgtccattgctagcccacttaattaaattaaaatattgatcattgattcaatacaatcacagaatcgtaaggctggtgggacattcctttgacaactgaaatattattgcaggccctcatggaagatgtccagtaagagtcagtgagcatctgcttactctgttttagtggcatggaactcacaatttcacaaggcagaatattttagtgttttcagatacatcatacatttttttcttatattgagctgaaacatgcagctttgtaatttgatgctaacactattcctggagtaaaaagaatgaggagtctctttcttctggcagacaaaaactttgaaatatttggaagtattctcatattttcttcacataatcacttgtccaggataaacatttccaattgttctaaagatttcttaaatacacagactccagaactggatttaaggtatctcctttgggtaaaatctgccacagacaattgaattattcatttccaattcctagctccagcgatgctgaaaaacttgcacatttgagtatataaaaacttgattaagtgaatggaaaaaatatcattttttttttttagacagaacctcgctttgttgcccagaccggagtgcagtgacgtgatcatggcttactgcagcctcaaactcccaggctcaagggatcctcccaggctcaaggatccctcctgtgagtctctgggaccacaggtgtgcaccactgtgcctggataattttaaaatttttttggtgtagagacaggaacttactatgttgcccaagctggtcttgaactcctgggctcaagtgatcctcccaccttggcctcccaacgtgttgagattacaggcatgagccactgcacccaactaatagttacgttttctgactatataattaatatagactcattggagaaagtttggaaaatcaaaagaagcatctaaaaaggacttgaaatggacagtgctagtcaaataaatatgatttagccaccttacaacttataaaacctttataaccttaacattatcaaaggaaatgctcgaacgttatagctcagcctgctgctctaatgaggaattatagctcagcacaatcctccactatctccaaaatctctttatcacagctacagacatatgaccaacagttctaccataagcttcaccatcaattctttatttcttatttttctttttatcatttaattgctactttacttacttcttttgtcctttataaatattgtactgtgtatacaagtctagattacttttatggatactgagtttcagatatgcaatataccaactaaatcagactggatacttgtgttagttatctgcagcaaatttccccaaaacttagctagcttaaagcaaagaacatttatttctcattcaatttctgtggctcaggaatctgggagcagcttggctgagtggttctggttcaggtctctctggaggtgcagccatgctgtgtcaggtaggactgcagtcttattgcaagcctccactgttgctagagaaagcctttccaagctccctcatgtggctattgtcagatctcagttcctcaatggctatgggcccagggaggcttactttctgaccacttgggcatctgcttacaaaatggcaatttgtttctcccaaaatggccaagatggaaggcaagagcttttataatctacctatgaagtgacatttcatcacttctgtcactattggtcacacaggccaagtctggaaccatgtggaagaggactgctgaagagtgtgaagacccagaggcagagatcactgggggccatcttgaatgctggctactccaatactaaacgaaacaatgatgttcttttttgtatttttttctgtttgattttttttctttttgtagagacacagtcttgttatgttgcctacgctggtctcaaactcctggcgtcaagagattctcccacctcagcctcccaaagtgttgggattacaggcatgaaccaccaaacccagccacaatgatgcttttagctatgctagaagaccaaaaactcatttaaatttattgttctgttatgaaagttagatattaataagtatctcttctgtgatttgaacaataaaagggtcctcctccacacaaaacataatttgttgtcaaaaacataatttgaaaactgacaaataacattagttaacattaaaatattaatttcaaaaacaaaatacattaaaatgtcactatagttcaccaaaaagacatgtgtttctacttattaaatactttcataaccatttatatggtgataatgctctgaaaataacattttatttcttgaatttgacaataattaaaagtaagcaatgcaaaggctgaatctgcaaaaatgcatttttgagcctagattttattatattagtctatagtagaaattaatttattttgttgatctctttaaatatgaggctgatatttactgagtgcctaataagtacttgctctgttaggcaactcacaatgggtacattttctttcatccccaccatgcacaatagaagccaggccagtgaccataaggatacagtgttaggacacactgcttcatcatccagagggcagagaggactcaggcttactttgttaacccataggcaggacttttgtcccctgtcccaattcgttatgattgacagttcatagcctctgacttgatcagttttatgtataaaaaatcttattattcatcattttcttaattccatttaaaataattttgtatctttatggtacaggttgttattttgctggttgcattaatattcaatagaatattacttagttacctataataggataatggtattacataagatctccacagcctagttggagagaaagaagcaaatagcagcatatggtcagtactatttgttaattcaactgatatattttgaggccctactatttgccaagcatcatgctgggctttagaaccagagggctgaaaatggtgaagagtccttgtcttcaatgaacttgcattccagagatcagcagagacccttaacgaaaaactagatccatctacattacaggcagtgcaaagagggatataaacagtgtattaggatacacaataatcagagaaggccattgtagaaggggtaatccttaaaggcatttctgatcaggtcacaccctaaagggtgaatatgagtctgccttgagtagagctagaaaaagacattccaggcagagaatcaccacgataaagttggtgtattcaaaaaacagaagggaggctagtagagttaagtgcaatggacaaagagaagaactaggagagatgagattggagaaataggtggagaatagatgagtgagatagtacacatgagaatgttaacacagtaacattttcatttttaaaaagaaaaaagaaaagaatctcatcgcttatgctatgggtaggaggatccagaatgaaagctgtgagaccagaactattataaagtcgcgtatattattcaggaacataatggaatgaaattcttaactcatcatcgatagtctggggagtatcagggaggacatgtctgtgttaaacactgagggatcagccttgctgagaagagtggggatggcagagggagcagccagcacaaagggctgaaagtaggaagtattgaggcaaatttcaagaactgcgagtaagtcatcatggctttaagttcgaggtgtatttcagaataccaagaaataacacggaaaatttagatgagggtgagctcataaacagatctggatgctgatctatggaacgcaaactttaaaaaggatggaaatccagtgtagggacataatcagagttcagtcttggaaaatgattgtgattaaaataagcatagtgaattgcaaggtatcaagactacagaggaaagaaaaatactagaaggctctctcattcatccagttagatagaagatgaagatctggccacaaaaacaggagatgagttccagagttattcaggaagaactgacaggagtgtaagctccttagaatgtgagcttcataaagacaaagactgttgatgttttattcactactttatctccatagctagaagagtgcctggcacttaaaagaagcttagtaaaatatttgtggaatgcatctatgaatggatgagttggtgacaaattagggaggctacatttttattctttaaataaatatgtattaatcactgactatgtgtcaagaaatgttccaggcactggaaatacagtgttgaaaagatacacatgtccatcagtctatatctatctatctatctatctatctatctatctatctatctatctattatctatctatctatctaatctatctatctatctatctgtctatctctatcctatcttctatcacccatccatccatccatctgtccgtccattcatccatccatgtatctatttatccatccacacttctgttccctttctacatatcattttatttatctatctttttgtaaaacagtcattatttaaaaccgaaactatttcttacagacactgaagagagaagatagaaggaatctttggaaatgcaaattgaaacctacaactgaaaaatagagtcttagtttatttgtgtaacaaaatccatgggaaattagaaggtatcctggacattgaaaacctcacagatcacatgagaagcagagtgaaggagaatataaaaaattggatgcaaaaaagaaaagcaccttgtgagaaatttctgctgttcaggtgtttgaagagcttttacaatcaggaatagctaatatttgatttttaagtttagttttttttgcattttttgtacctaagccctctttgaaaacctctagatagaagctgctatatgtagatttctttgtgagagattgggattgtaatccacatgtaaattagcaggatacacacacaagagagtgaaccacaagaagtgaaatctaacatccagacttaacagtgactaataaaaaaaattccaaatttgcaaatatcttgtggagagtgatggaatttccaaacaaacaacaaacaaaaccagaaacacacctatgttaggatttttttctaactgtagttaattctcaccagacaaattaatttcagctaatatttacattacatattttagtttttcctctagctaaatgattatatcttctggaatgtaagacactgcatgcatttatatgtatgtgtaatgggtatcagtgatgagttcaagagattgacatgaagaagagagggaggttctttgtccagtaggttctagtggctcttaataaaaacatagactcgtactggcttccaaaatgcagatacaaccacaactctgcagcaggcaaggctgcaccaaaccagccaagattcaaggatccagtcctatccagacataatccagggataattgctttcacgtttctttcccaaagtcttgcacttttataccactcccttaaattaaactcctattgtaaaccataataactccagtagagctgacgcaatagcagtctttatgggcagacacctgcaaacatccatttaaagttgcttttttagctgccataagtacttgttgaagacatttggaagtgtagttttgcacttgagatggtgttgaaaatacaatagcaaatctgccaaaagcaagaagaggcaataataaggctggttcaaaagagctccctgaaattctgagtggatcattagactaattgagtggatattggactaatgcctttgacaacacctacaagacctactccgtttgcttacagataattacaaagtgagggagaaaacaggcgtatccatcccattgcctttggcaagtcttcctcaaactataaggtatgcgtaagattactctagagcgtgtgtaggttacaggatgctgggcccctccccagatgatctaattgaataaatccaggatggggcacagagatatgcatttcaacaagtattccaggttgtttctgatacagtcgttatagggaaacaatagcagtcagtaagatttaagaaatctacagggtaaatgtatttttttcccaaaacacttcctttattagcccacagatgcttgaaaattcttcaaggttggacagatcctatcaactcttaattagagatgaaggaccatccagtaatttccagatctaatgagatataaatgtcttaggggttgtgaagaatgtgtgtgctctaaaagtaaagaggctgcctttgttaataattggcactaaaatccctgaaaccataatgactagaatacgggaagaaaagggttgtcttttctctacaccattgccaacacttgttagctttcatcttttttataatggccattctaacaggtgtgaggtgtatctcattgtgtttttaatttgcgtttttctgatgattagtgatgttgagcatcttttcatgtctgtgttggccatttgtatgtcttctttggaaaagtttattcggatcctttgtcattttttgatttgttttctctgctattgagttgtatgagtttcttataatatttggcatattcattgcttatcagatatagtttgcaaatattttctcctgttccattggttgccttttctttgtgttgatggtttcgcttgttgtgtagaagtattttggtttgacatagttctagcagttttaagatttctcacatctaatccagttccttgaatagtgtgtgttcatcaagtacttgttaacatattgatggctttgaagagtttactaatcaatgatgaagacctgataccctttcaaagatttaaatgtcagagacaagaaaatgtaatatgggcgtaaaataataaagttgattgaaatgctacagaacgctttctcacaattgtaaaaatatgactgttgtgcaaattccttgatagatcacaaaacaaagaactctacaccttagttttcaaagtccttcatgttctgaacacttaacttttccaaacatatctcagattgctcccgatttgtatgcctgagttctaattcacatgtc

SEQ ID NO: 536 - DNA, 20001 bp, Homo sapiens
gagggcttctctgttgattttgttcctgcttactctaaatttactattactcgaaggatactgatttcaaattccatgtagccatatagtgcttgaacactttgacagtcactaagtcatattgctctatgtactttgatttttttcataggtcctttaataaattatcttctctacctctggaaacattcaatagtctccataattaattcagagtctaaaagtcatccatattacataaagtgattgacatatcttaagggaataactagacaaaaaataaggtacatgtaaatgataacatatgaaaaagtatgatttgtatgccaagatatgatttattagaaataaaatagatgaaaatagttttacccaaattgaaaaacatcaagctttaaaatactatacataatgtgtgtgtgcatgtgtgtgtgtgtgtgtgtgtgtttgtgtgtgtgtgtgtgcgtgtgtgtgtgtatgataagaaatccggaagcaaagaaaagttgttaagaatatttggtatagaattggaagagataacgtatctcatgtagaataagaagcactgatgaatgatctatcaaagccagtaagcatgagtttttgttccagctattcatgataattttctttcataagtatactgccagttgctcaaggaaaataaatatggctgaaagttgctctatgtatagcttatgggtctctagcagtcagactcgtagctaagaggttggcatccatagaacagatttcttaggggttgatgatcataggtcaggtagctcagtggctgacggccatagggaagggagttcagttgttgacagctatcagattggtaacttggaagatggcagttgaaaggctgtctacaggattctgaataataagaactggaactatgggatgagataggaagacagctagttccttgatgggatatggactcatcggaaacaatcgaagagtagacagaagggccgcaggcaccacaccctcaccacatgacttgtgacagttgtcatggcacgtgagctccacagctcaccttagttatgcagagagcactgggtgaggtgacaggaacctggtggggattccaaagggagtgagagctgtagttttcaaagcagaaattgccgttaagacatagtggagacagaagatcaagccttgattaaattgcagagagcaggttgctgaagtgtagttgttgtctatgtgacctatcgtttctatataccctgaatgctgggtgttggtttcctctatagccaatatataggctatagaggaaatcatttgtatgacatcttactagaattttacttaatcgcctaccaagcagtcctcccaccaccgtataaaatatatattatcaatatcacatccttcaaataactgtcattccaaagtcaatctggtcttccttgcttaatctttcttacagtataggtaaactgcttctttagaaatcatgttcctttgtcagtcttgacaattccttgaactcactgctaaaaagccacagatggatctccataattggagagaatttctttatggccactttttttttcccacagaaccaaactatctatatattaacatttaaaagtattagtgagatatttttagaagagctaaataatgaaaattcttaatttggaaactgaaccttattttgcattcttctgagacataacctagatccaaaacctaattcatctctggaaaatttgacatcattttcaagtgtgtctttccaatgaagaatgttggcctcaaaagctttgacaagctttgctaagatccacacccaatgagcatataagtcactgttctatattttgtgagcaagaaactgaaggtgttagcacacatgttttgataggtgctgtgtaagaaagaggccatcttgccttggatgcttgctaggtaaatctcagcatgatattgcaaatatgaagagaatgcttatgtttgtaacctgtttctatattactattttccaaggaatatattcctgtacataaaagattttgaaataattcatgtttttctaattagtttgctaagagaggccgtttaatttacaatgaagttttttttccaaaggtacactttttggttgattatttggattcagaatgtatttatacatggaaaggaagtgaaaattcctagactagtcttccccagagaaacatatttttagcctagtaacataaatgaactctacaactcaattttgaccacattaggataaatggatcttactacttccttgaggggtttcatttgaagggactacttagattatggcacctctgaaaatctgcttttggtagtacacattgcggtgggaaaatagtagatcttatctagaacagcattcctcctcctagttctcagtgtgagagtcatctttttcaatggtgaaggaacaagagctgacatttatggttcaagcaaatgtagccagaactcatgatttggagtgccaaatctagttataaagctctcaacataaatttcctatgtttcatttttcttgactataaagtgaaataaaatgggcacattaaacaccatttcaccagtatctttaatgatttaattttttaaatgtatatgaaaggctctgagcattatccacttagcataccctggatgaagcggcttatgcaaattagtctgactgagacatgaggcacagcgtattagtcagggttctctagagggacagaactaataggatagatgtatatatgaaagggagtttagtaaggagaattgactcacaggattgcaaggtgaagtcccacgataggccgtctgcaagctgaggagcaaagaagccaaatagtggctcagtccgagtcccaaaacctcaaaagtagggaagccgacagtacagccttcagtctgtagccaaaggcccgcgagctcctggcacaccactggtgtaagtccaagagtctaaaagctgaagaacttggagtctgatgttcgagagcaggaagcatccagcgtgtgaggaagttgaaggccgggagactcagcaagtctgctcattccaccttcttctgcctgctatttctagcagtgctggcagcaaattggatggtgcccatccagattgagggtgggtctgcccctcctcgtccattgactcaaatgtgaatctcctctggcaacacccagaaacacccagatacacccagaggcaataactttcatccttcaatccaatcaagttgacatttactattagccatcacacacagcaatcatggccaacatagaattgactgagctggttttctagattgctgtcacatgctgcctttttcaactcagcttgtggaaaagggcaaaccttcccccacagaggagagacatttcttagttgagggtacatgagtagctgaactttcttgctcaaagcctttaaatctctcatggctcatttatgcaaattcagtaattagataaagtcttttccctatttgagacaacaggaaacttccacactagtgttgagtatatatcagttcctgtgtatgcatattcaacagtcatatttatatgaatcccaatgatattggtagcactataaataccttttatgatctttggataaattggaaatcaagtaagtcaggttgtaattatttttgttgagtgtcttataactagcaacatacttcaccatccttgccttgaagagtggaacatttatttttaaagtttggccaactgaccattaaatttaaaaaatggataccagaggcaacatatctttcctaatcctgcaaagagatgttctctaatgatttaggaccctcaaaccaattaagttctcacatacccacaaaagttcaagtgtcttcatgattcacgaggacttatcctttatatttatcaatagccaacaattgaattgtgctattgtgtgagtggattgattagccatggttagatccccatcatcagatacccatgacataactaactgggcattactgtacataaggcctgtttttcctttttttgattcagttagtatacaagtctatatttagtgaagtatataatgctgatttacctccaatatactatattttcaagtacatgtatggacaaaaatgccacaagcgtcaaaagaatggaaatgttactatctttcccctgaggctataaaaacataaaaacaaacaaacaaacaaaaacaaccgaattatttgtagctccaactgccttctaaacctcggtctacttacaaggaggttgatttgttattttgggaacatgggttggtgcagatgtctaagtttggaagtaagatttagagagtgctgaacttttttacattcgagaatgagaagattttggagctcccagaattaatccgaatgtgagataactggagacaaaagaacacaggggctgaaagagttatgctatatgcactgttatatggccccactatttgaataatctttagagtaacattattgattcatttcttttggaaaatagtaaagggctatgtacagcttctgggtggatgatgagataactaaccagaatagaatcagttaacactgggccataatacccagggaattagtagaaatggcaagatggcataggatttcacagatcatggaaatggtagggatcagagtcaattatagccaaggatgaaaggaggacacaattctgcctcattttctagccctatctgtatttcatatcatgaaattataaagctaggggagatcacagtaaatcacttggttttctcattttatttagaatttgtttctctttatgtcattaggatagtttctgtttctgcattttgaaatttattaatattctcttctgcagtgtctaaccttctgttaaagccatttattgtattttccacctcactcattttagtttttatctctgtaattgtgatttgagtctttgtttatatcttccatttctctaacatgaacaaaattttctctagcttcttaaatatataaatacagttatattaattgtttgaatgtcctttcctaacaattctatcatctgcataatttctgattagttgtggttgatttattttctccctattataggtcttatttctctgtttattttcccgcttgttaacttttgattgaatgccagatattatgatttaacattttgtgtgtgttgtatatttttgtattcttataaaaactcctgtgatttgttctggaacacagataatttactcagaaacagcttgatccttttgagtcttgcttgtaagcatcattaggtagaactaaagcagcatttaatataggataattttagccccaggactgaaagaaaacccttcctagttttataccagttttctactctgtctgttgagaatataaactattctcagccatctttgggctccaattatctctcttctaattcttttgggtgtccctacactaagcttcatgcagtgtactgatggttatgactcagtgaaggctttgatgtatcctctgtagatccctgcaaccctctttctattcagttctcacaactgtctttcatggaataccgtgatttatttgcctattatccaaagtcctgaaaacccatgttttagatatttatctagttacagtattacttcagatggaagaataatcttgtctctgcaactccatcttgtctggaagcaagtccaaatcatctcgtttgaatctctgttttcgtacagataaatatccaataaataaagaaaatcaatttaccatagtttttgaaaataattaaatacagactgcgtattttgtagagtcatagagatagtttttcttactctaaagatcttgtttgtgttcaacaatcaacattcctattttatgttaatccactgtcttcacttatggttgttttgagtatgaagatcagtttcttaggatagctttcaagcaaaagaaataagttatgcttcactttaggccaacaagccccacttctttattctcatatatatataaaagttctcaagaaatttctttgttttttttaattgtcgttattgttgttgttttagaaaaatagggagcaatgttctaccaagagactctcaaaggatgactctggaaaggaaagtaatatctcagctatcaaatatttaattccctactaacgcaatcaaaaatgatattgtcattgcataattcttcatatatattgcatggtcagctatgtcttggatgtagctttttctcttctttttcataaatatttttattcaatgatatgtcaaacatgatatcataataattaccaaagtggataaagcattatgaaatataagtttactatgaagaatattttgatgagtctttaagcaacaccttcctaaggccaaaggctcaatgaatctgcaagggtttgtgatgtctaaaacattatctcctcacacggaatatatacacatatatatattcctcacaagaaatatacaggatgaaactagagatcttcttctagaaaaaaggagtgttcaacaacaaaatgaaacaaaagtatgaggtttgttaaaaagacacaagagccaactaatgtagctcttaatggtcaaagctggaaaaatttgagcaaaaaaaccacaggtaatattagattataacctaatgtattgtatttatgcatttatactgatataaataaataattgtataaacagaaagtagaagagaataagcgaatattcgaatgcagaaggactccaagtaatatacacagatactccttaaggaggtaaagaatgattcccacttaatatgaactgcacacagtggatttcttccaaaaaatacagtatgaaaagggggggaaaatgagtaacttcacagcggaatcttgatgaacactactgcagcaaagtgatcgaggttaacaccaatagtgattagtcatgttgatggcatatgctcttgatgtggaattttacctcgctggtctttctcctgcaaacctagaattctattctaatcctgagaaagatatcggccaaatctacattgggaacaatctgtaaaattcctgactgacactctttaaaaatgtcaagggcatcaaacacaaggaatatctgaggaactatcacagacaaaaatagcctaaagagacatgacaattaaacgtaatgtactatctcaagtgggatcctagaacataaaaaagacattagttaaaaactaaagaagtgtgaatgaagtatggacgttagttcataataataaatcaacattggttcattaattgtgacaaatatgaataccaatgcatgctgtcattaataggagaaaccaggtgcaggatatatggaactaggtattatcttcatgacttttctgcaaatataaaacagcttaaaataaagaatttatttataatgcaaacaataggttaaattctttactaatgaaaaatcaaagagatttgtttattttacatcttcatcagcttattccaaagctactgaggcttaacttttgtcaaataagctaacatttaattataattcacattttggtaccattcaggtactatttataatgcactttctcatatttcacctcatttaatttttgtgacaagtgtctgagtcaggaaggcaggtttgttttactgatgagaagataaatttaaaattttactcaatttatccacgtcacagaattattaacaagcacagctgagattataagtcagctcttgtgatagcttacctagcatttttttttttttttttttgagatgaagtctggctctgtcgtccaggctggagtgcggtggcgcgatctcagctcactgcaacctctgcctcccgggttcacgccattctcctgcctcagcctcccaagtagctgggactacaggcgcccaccactacgcccggctaatttttttgtatttttagtagagacggggtttcaccatgttagccaggatggtctcgatctcctgacttcgtgatccgcccgcctcggcctcccaaagtgctgggattacaggtgtgagccaccgctctcagcccttacctagcatttctttgtatcccccttaagaaaaaccatgccattgttaaaaaggaaaatatcttttcctttgactatagtcatagagcaaaaagcatattactatgctgttttttgaatgctatatagcactattgtagcctataaaacaatgatgataatatactttcctaagtgacttcctcatgtataactttactctccctctggtaataagaactgggcaattgattgtacctttttttcttctactttatttctcaggaaatgaagtaaagacaatgggcttcatggtgagaaactttgttattacggtcctgacatatcaccaggcagtattcaagggaagaagaatttaacatttgtgacagttcagtagctctatttctgatgaatgaacaacagctgtaaataggcctttggtaggtgttttcaaagtctttatgagttttggaggctatttacttaaaaagcacacaattttctaattgtaacaggttatagaaaactaatactttaccagaaaatctaaataggcctattgtgacatcactatatactaaatcacgtgactaatttaccagtaagagtaaataaagcactgaggaaaatttaaccccctgcacacattgtatacttctctatacattgcatttgtattttacctcctagaattcatacattttttagtaactggtacaatacattaattttaggacaccatcttgtaaataatgagcacaatttttctagttgcagaagagttgatggaatttcaacagatattaattaattatgaggaatttgcacatacatttaattcgagaatcactaacggctcttccacacctatatcccaccatgtttgcttagtagttttatgcttttaatcacagtggtcacttgaaaattcatcagcaagattacacaattttaattactttccatctttgagagccataaaaaggtagcataaaccctaagtacagtcttaactgggactctgtgaaccactgttgaatgaggtttattcccttctagacttagtcccatgaaagtctcaaaataaggatttgagtgggtttagtcagagtaatttataaatgataagaaagccttaggcctggcacagtggctcatgcctattattccagtgctttgggaggtagaggttggaggatcacttgaagccaggagtctgagatcagcccaggcaacatagtgagatcatgtctcttaaaaattattaaaaattagcagcacatggtggtgcatacctgcgattttagctactagtcaacggctgcctcaatattaggaggcaggaggatctcttgagcccaggagtttgaggcaggaagatctcttgagtgcaggagtttgaggttatagtgaattatgattgtgccactgcacttttactccagcctgggtaacagactgagaccctgtctcaaaaaagaaaaaaagaaaaaagaaaaagatttaggaagagaaacatccagaagaatccagagtaaatattacaacgcactatctggcacacttttgaaagttgatgaacacttgctgagtgaatcaatgaagaagtcagcaaatcactcaagttacatttataattctttatcaagcagctagagctctctcattaattaaaagcatcataattccactagaattaataaataaatattaacaaaagtcacatttttagtacctgaggaagcacatttattaggtgttaaagcaagtcttctctcacctggtggaagacacacaaacaaaacctgagggactgtgctggccaggagaatcttgaaacaactggtacaaaaagaaagagttttatttggaagagttttttaagaagtgatatatggcaagctatatttagcaagaaatctcaatcctaatattgattctgcttagccaaacttactggaaggtaaatgccaggtcctccagagagagcacaagctttagaaatcaccagaagcatagctcagagatctgaagttagctgacaataaggttagcggttggcatctgctatgcatctagtcaatggctggcgacaacagaagacataggtcaaagggaagccactatcagacatatagttcaagatctagtagatacaagagaagtgggtcagtggatggaagctgttaatcaggaatcttggtatgtggtgtgtgttggtggatgccctgaactacagacacaggaagtggcaggaacaaagtgagtttcttggcagagtctggacacaggacaatcagtagaagggccgcaatagatttgacagttgctgaacgcacatttggctggctggcagctggtgggtttgttactgttctcctggcagttgtccaggacccaggttggaaactactaagtaagcagagggcacctctttagctcactcttctagagcagagaaaaacaaatcaggaaaaaagaatgtagcaataactcctcaaagagcaggagctctcatttccaaagcagcagtagctgaaacacatgagttaacaaagtgagtttcagaagatgtatagaagctttttcaaatgtgctcatcaccttctaagcaaatttcttatatatcctcactgctttctggcagttccgtatactcactcacttctgtcttcctgagattctcttacctgatgtcattcccttaatagtttgttcggatgtccatgaaaatgccctccagctttcttgtataattttactcataattttaaatgtcgcagctattaaccttcattcttttcattttgtccaggaaatgttcagaatcataactagctgagatggaattccttctttagaatatggtgcaagaaagaggggaacataagtgctcttttccacaggtggtggatacaacatgccaaagaataggttagtggcttgcaaaacaaagatgacttctcattcttgaaggtttcacagttctttttgtcagcaaaaagagaaaaaatgtatacaatgtggtgggctttttataaactaaactcttcaaaataaaatattatcatttattctaagattctatccagattgtatctccatataaattcacccatttaaataacatactaggccgggtgtggtggctcacacctgtaatcccagcactttgggaggccaaggtgggcagatcacctgaggtcaggagtttgagaccagcctggccaacataatgaaaccccatccctaccaaaaacacaaaaattagctgggcatggtggcgggtgcctgtaattccagctactcgagaggccgaggcaggagaattgtttgaacctggaaggcagatgtttcagtgagcagaaattgcaccattgcattccagcctgggcgacaagagcgaatctttatctcaaaaacaaaaacaaacaaacaaaaactagcatgtaaaattcaaattaattggaaccctacctgaggtgaattggattccaaagtcctgagagattttgcaaatgtttttatagacccttgtgagaactagaaaatttactaagatttgtttggagggtgctcttacatctggtttattctgatttagtttattatttcattaaacaaaatctaacctattcaaataacaatatatttaaaagatttttgatacatgtgtccaaatccacacttggactacagtgatgagtatctggttccccacctcctcaacaccactaagtattgttagcatatttattttgactgtttgatgtgaaaaatagtgtttagttattgagctaataagtattcattagatgactggtgaggctttctattttggtatatttgtattgattatttagcttcctagttgtggatctttattgtcagttttaatatcactcagtaaatgtatctttcattttaaaaagagatatttttcttaaaaaaacagaagaaaatgaacattttcagaaagagtagttttgatggattctgtattgtcaaattaacctttgctttgaaaaatacggtgaatttttagaaaaaaaaaaagccgattcctggcctgtcacttagaggctcatatttagagagttggaattggacccaataacttgatttactttgaggatacatttacaaagcctggttagaaatccactggatgagaaaattccacagacatttgacaattatcaaagtctctgattagtatgtctatataaaattaaaacaaactcattgcattccaaaagatctaagatagaaacaattttccatcgaaccttcttggggaaagctcttatgcaactttcaccaaatattttattttgcagaactcccctgacagacttatatcaaattgctttgacatttgatagatagattagattatagagtgacacattggattaaaggtttagtagtgtgtggcttccatgtgccaaagcattaacatagtaatatttctaaattgcttgtttatagatgtagaagattcagtaaaatgagtgtccattttactgtccagtaaactgtggaccattcacagtccacagctaaaaatgaactgtggtcagcacttagaataatgcttagtatataacagcaactcaaaagtatttgttgattaaattatgccgaatgatgtgtttgaagatgtaattttaaataatggtattcagctgtgtttcagcaaacatagtatgagactaaccccgaggaaattttttttctttcaagatttctctctccctgtcttgctttttcttcttcatttttgccatctcttcacactactgggaaggaaatagaaagcattttgttctcctcacagtttcaccctaataataaatagagtaatgaagtataggtctcttcatgggaaacaaggcaacaagtatgctttaaaatacagcagtctctttaccctgtggttgagaaagttctgtaatcaattcataaatttgtgttacagatatttcttataggccatcatcacctccagagattcagctcatgctgacttaacaataccagatatttatcgaccaataagaatttcataaagaaaatggaaagtgctcttctgttttaatggagaatgaaggctcatccatacaactgtccctagagcaaacaggaacagacagcgtgttacgtgcgggccgcataacatttccttgtgtggtctttttttttccactgtattgttacatctgataattgtctatattgggagccagaggtagatagcacttgtatatggaattaaaaggaacagaaaaagtgaaaaggcagcaaaatattgtgtttttttgtgtgtatcctctgaatttgcctctgaagtcattggccttgactgcctaggtaaggctaaattactccttggaaggttctataaaaaatttcttattaagtacactacatttttttaggtcatggaaataaaatgattttgacatttgcaataatgctctgatttgagtttagaagaaaacatagcctgcaattgatttcactaactggagtgtgacctatattgcaaaccctatatccttcctttaatttttaaataattaattgctaagacatacaaatactaaaaaaatttgattgtttcttcagagaatagtaatgtcttttgtctttttctttggatgaaaaaataagataatagcagaggaaatacaaagctaaaacacctgtgatccagcacaactgtcagttagaaaagtacaagtcaatgtccatagtcagctgattaaagttaagcaggtgcatcaaaaatgatgacaggtacttgtgcataagaaagtacgagcttccataattgaacttgattgctcgatatcttcatgtgggcctatttcatagaatcattttaatgtgaatgtttctgttataaaagggatatgttatgttttgctaaataattgtatctacatgttgtaatagaactggtcaatatagatataattaagaaggccaaccataatttattcaatattgtattagttcacaggaataattttaaaaacttgacactttattgactgttctgcaatgaggcattaagtaataatatggtgtttattattaacttcatatttagataaacttaacatgggctttaaagaatttactgaagaggattaaatacatttttgaggggccacactcaattatttgattagattagattactacagaaagtagctttgtattcattttctaatactgaaaagttctggcatttagttgaaagatccgtatatcaaatgtccaatctgcagtccccttcctttggattcaagtaaagaacctgtatctgaatgacatggtcaatactatactgtctatacagaatggctgttcctcagttcacccttgttgggatatgaactttgaagatttccttttagtttatcctatagcctctcactagtagcactttttgtatatggcacatgatataggtgcctcgtgtgcagtaaattgcccgctcatgttgtcccggaggcctagatgtcacgtaaagggcattcacctacttgaaaaagttattgctttccatagtataaaattactggagtatgcataggacatgaaaactttcagtaatctgtgggatttttcctaattaatgctatctatcaagataattgttacacacctcagagtataaatagccacatattgtattttaaaagtagatctctagtttcattgccagatatctctcagcacaaactagattagtatgagaacaacctgcttttgttttaatgcacaaaccaaactttgaacatctgcattccaagtacaaaaaaagtccattgtaaatatgtcagcaagaattaatatcattaatgacatgcttatttgatcaagggaatacattaaaatataaagagtaatttcctatgaaaaaaaagtaataagaccagtaaaaaggaacagaaatgtccaaaaaatttgagagaagaaaagtgcttggaacttgaataaggtcacaaacatttaactactgtcattgtgatatatgtcagaaaagttatagaactaagaaagttttatgttatgtatttcctttaaagcttgcaatcaggtttactctgatatcttaatatctgttttggtaatttgttaaggtttaaaaggtgagtaaaatgtttacaaggtattggctgaggaactttgtgttggaagttaataaacatcagtgtcaaattggaaagattttgcatatttatattgcaaggaaaaagtcactaggctttcttacttgattaggaagggcacttccatatgtcatctctatgatttgaagtggactatacttctcccttctattggtttaagaattacacacactgtatattcttctaccacgtaataacttagaaggatttattgaaaagttcaaaatatgctgtttttgtttttattccattgatgaaataaatgcatgaatgggagtaacagaatatattaacacatctagagaaaaatattgttgcttatccctgcatagctgctggtacatcacagatagcaacaacaaaaatccataaccagtactatgatttggatgtcttctccataactcatgttgaaatttaactgccattgtgatgatcttggcaagtggaacctctaagtggtgattaagtggcagagtcttcataaatcctgttatttcatgagtggtttagactcctgggaatgagttccccaggataccctttctctgtctcacaggctcctttgttctctctcatcatgtgatatcttccaccatgttttcacacagcaaggggatccttatcagatgcaaaccctctatctggaatttccagactccatagctaagaactgataaaaatttctattgtctataatttgcccagtgtgtagtattctgttacagcaatagaaaatggactaggactaccagccaaaatcttaggtcagaaactaaagtgactccagtgagacattagatgaataactaattaacaactcctaaaaattataattgcaagctttaaaaaaataatcttatgaaagaataagtcttgttatgtaacatggaccacttggatcttactgtctcagcaagatgctataattcttagtaagcaaaaattaaatactcatctttaattagaagtctatcttgttgaacttactctacttttggaaaacaaccaatgattgctaaatacctttcagacataactatttgaggtgaccctgttggtggcaaagggtctaatgtattgaacatattggcaaactctctgatactgctctttcttcactcaataccatctagctgcactgggttccttttattctgcattctccccaagttcctgcctttgatcttgttctccatgtctaaaaccgttgactgcagggcactctccttttaatatttctagatatgattcaaatgaaatttttgttaaagccaaaatatcccaaccttgttaaaattaaccagctcccctctttttataatataatttgtatcccctttatactgttttatatactctaatattatcatatttctttatcaatatttatgatttattttttgtcattcccccagattgagttgtttattattgtatttccagaacatagaagagggcttggcatacgatagaaattccttattattgactgagcgcttatgtatgctgaaattacttcgaaggataaaaatgcgtttatcaaatgatacgatgaatcactgactgaattatcaatctgaaatgtttaagtagattctcccaaccgtttcagggaacataatccaaaaaaaaaaaaaaaaagcaaagaaaatgactggtttaatgatttaaatgataagtggaacaatgagtaagtaatcatgtcactgcatatgttttaaatatttcactccatgcttttcttgcatgcatggcttctgacaaggagtctattgtaattcttgtcccagtttctctatagataaggtatttttcccctggctttttcttttctaaagatttcacatcatttttgtttatctgaagtatgaatatgatatgcctaggtataataatctttttgttttattctaaaatgctgcttggtgttctctgagcttcctgagtatgtggtttggtgtttatcattaaaatttgaaagttctccatcattactgcctcaaaaccttatttcttctccttttgacattcaagttaagagtatattatatgttttgaattgttccatagttttggatgtcctcttctgtgtttttgtgtttgttgttgttgtttttctgtttttttaatctttgcatttcagtttggggcgtttctattggcttagcttcaagttcactgattctgcgcttcaccatgactagtctactaatgagaccattaaaataattattcgtttatgttgcagtaatttttatttctagtttaattcattctttaaatttctatctccctgcttccattgtccatctgtctttatatgttattatatctacttttcccattagaactctaaatgtattaatcagagttattttaagttgtgtctgatgattccaatgtctgtgtcatatttgagtctgatgtggatgcttgcttttactttggaggctgtgctttcattgccttttggtgtgtctcttaacttttttgttgaaagtcacttgtgctatattcagtagtaggaactgaggcaaattggcatttaatgttagatttgaaatgattctggctagaagttgggctgtgtttaatacctgctgtagttgtaggtgtcagaggcttcagatttctctattatccttaatttttgtctaccctcttggctttcagctgacctaagtactcctccttagagacgatctgtttcatggagccctttcaactataatccactgttattaaactggagccttgccggtgtggggcgaaagatggaggagaggcgaagcatttcataatcttataattaaacctcagtcttttattggacctgtgtccctgagctgtgagcttcactggtatttctttgtcctccctacttaggtgagccagaaaaggtagtgcaggcatcgtgtggaatgggaaaataccctttccttgagttgaataaggtcctggtaaagtcttttcttcctgaagagtaaggatttatgatggaggaggttctgagcatgcttttctaggattattcctctctttctcttgacagagccattttggcatcatccttggatttcttccatgagaaacctgtgggatccctagaggcaaaaaccatggagtatatgaggtatgaggcatccttaagactgtagcagctaggagggttggatacacatgctggtacacactcagcctccagaaattcctcaaatttatgatttaagtgttcctaccagatgatggcttcagcagcttttgctctaggaaagcatactccagatgtgactctagactcacctgcctccccagattttggagtggaatttggccctccagacttagctctttgatgggttcaggaaaagtcattgattttcaagttgcccattgttttcttgttgtaagacaatattggtgactcttaagctccttacgggttggaattgaaaccagaaatccatacattccttgagtcatcatccccaatggcatcactttcattaatttctggaaaaattctctaagcaaaaatatagtttcagtggagaatgaaattaatgtttatactggcaagtgactattcagagttaagtttagaaagaagactcagaatccaaattctaccctcaaaatatctgaataatctgttagactaactctgttttcatttttcttatgtatgactgatttaaagactctaataattattaaggtatatgtttacttttacctcaacccatttcaatcaagataaagaagaagatgattctgtgtgtctttcttatgtatttggtatgtggagtctcatgttgaaattaaggaaaagtagtgatgcttcacaattgcttttgatggagacttacgctttcttgattaaagttcagttgaaaagggcaatgtattatttgtccttatggtttgacaaaatgacgtcagcttttataaaatccagtttgaaaatgactacatccagaaggttaatcacaaggaacacaatggtacctgaatattaataaagaaatatttaaattttgtgaaaagaggagcctaaagacctaccctccacttaccttactcatgggaataaaacctatacaactagaagtcaaaacttatcagatagtacattgccctgtaatttgcttaaataaataaatcttcatattacacttgtaatgtagtttactgtggagaaacacagactttgagaaaacttaaaaataaatctcagacaagtaatttacaatctctatgactgtggctaaattatgaacaattagagctactgcgctggatattaaagaaattaaattaataaaatactaaatcagacatagatggcaatagacaagtatcaaaggtggactaaggtatagctattagcaggtcctgtctagtcacgggataattgatacagaactttccttaattcctagcgcttggacttgtaagctgtggggaaatgagaagcaaacatttgtttcccccagactcaggaaagatagcgtaaaacaaaactccaaaggaaaaaatgtgaatttctcatcaccatccaatcaaaatgcaatctactgtcattcaaatcaataaacatttacagagagcctagtcatggtactgccacaaaagcagcatttgaagggctcaaagtgtagaggagagtttataaatgcaaataatga

SEQ ID NO: 537 - DNA, 20001 bp, Homo sapiens
gagggacccctacctcatctaggaagaggaaccctgagcaggaaagtgagttagagagttcaggattgaaccaacccaggtatcctgggtgcacaccttaatgcgcccctcagtaagagaggcagagcatttggcttgttcataacgtagtctctggtctgaggctgcctgagttcaaatctcacgtctgccatttgctcatctgctaaaaggcaaatgactttttgtattggtcagctattgctgcaatagtgctgtgtaacaaaccaccccaaaattcagtagttctcaacaacaagcatttcttcttaggtttacaggtccctaggtcaattgcagtttgagtggactgggctgaatatcacctcaatactgatcttgtctttatttaaatttttgacattttgttccttatggattttttgcattaatttttattttaaaaatattacataagtctgtgaaccgtggctcccacctgtaaacccagcactttgggaggccaaggcaggaggatggcttgaggccaggggttcaagaccagcctaggcaacatggagaaaccccatctctgcaaaaatcacaaaaatttagccaagtgtggtggcacatgcctgtggtcccagctacttgggaggctgagatgggggaatcacttgaactcaggaggttgaggctgcagtgagctatggtcatgccactgcactccagcctgggcaacagagtgagaccctgtctcaaaaaattgtatctatctatctatctatctatctatctatctatattaatgatagcactaaatatcattaatttataatgataatatataaataataataataattacaataatatataaatagaattataattataatataaattaatataaatataatacaatatataataaaaattataattatatataaatattaacagtagcattatatatatatatataaaaaacatgaaaatattattcaccttgattcctgggggtttttgtgggtgagggggcatctgaagtattgtgcttaaggtaattgcctcccttgcctcaccctagttctggctgtggctcctccgtatcttctccatgactcagcgtcctcatttgtaaaataggaataatcacaccacctcactggatggttatgagaactaaatgacttattacttgtgaaacatttagaatggtgcctggcacatcataagcaccagccataatgatttctgtgtcactgaggctccttgcaggtgcacctgggggtgagcagcattcccactggggcccccaccctggtcagcatggactcttccatttcttcatcctggactctcagtgaggaccacacaaggtggacaccaaagcacttggcgatttgtcacatggggtacagacgtcggtcatcaggatcatttgacacatgttcaatatcgggttttaagacacagcccctacattctttggcgtgcctcccatcaagaggtggagtctatgcccctccccttgatcagggcaagatgctgattgctttgaccaatggtgtgcactggagtaatgctctgtgacttctagggccaggtcagaaaaggtcacacagctctgcctggttttcttagggtgttctgtcactgtcaggatgctcctgctaagaacccagctgctgtgctgtgagaagcccatttcatgaggagaggccatgtgggggtgctcaggacacagtcccagctgcatccagcccgaaggccaggcacggtggtgcaggagcctccagccccagccatgggcatcctctagacagagcagagcagagattagccattcctgatgtgcgtgggccaaatccctgaccacagaatctgacagcaggataaagtggttgttttatgctactaaatttggggtggttaagcagcaacataatcagaacattcaccaaagccttcttcattgtcagagtctcaggacacagaaatgattcagacagtctctgctccacgaagaaccaaaagcagcccctgaactgtccattgcaatataatctgtctgtgctataataggtgctgtgaaagctcgaggaggagcctctaaccgagccagggtgaggttctggactgacctccctgggtggggagatgatgctggagttgaatataacagataaataaaggctaaccagaagaatgagggaggatgtttctgaatggagtgggcaagggactagaggcaagacagtgcctactggaagttcaatgtagctggagcacagagggcaaatgcctactggtcctggaaatactggagatatccagctgccacaggacttttgcacatgctgttctctgcctggacagtgcttccttttgggaccatgctggcttacttgctcacttcattcctatctcagctcaatgtcacctactcagagaagcatcccctgacctctcaacctaaaattactccctaatccatccctctccccccttctccctgccttctctttcctcaaagtattgatcatcatttgacggttttggttttgtttttttttttttcgctcttgtggtccaagctggagtacaacagcacaacattagctcactgcaacctccatctcccgggttcaagtgattctccagcctcgcttcccgagtagctgggattacaggcgtgtgcctccatgtccagctaattcttttatttttaatagagacggagtctcactatgttggccaggctggtctcgaactcctgacctcaggtgatccacccgccttggcctctcaaagtgttgggattacaggcgtgagccattgtgcctggctcatcacttgacttcttataatgtgtttatgatatgtttcttctgctaaaatgtgaatgacaggagactaagacacacttctcccagcatagcgtagtgcctggcagacagtaggtcttagataaatatatcaggagttggatggatgaatgaagggagaggcatatcagatacaccttttggaagccccctctggctgcagtgagtgggttggaagggtgtttgaaaggaggccgggagagggggtttcagttatccaggtgggagccgatggcatgagtctctctggagagccaacatgaggatgatgaggggtcgggtttgaggtgggagacagaagagctggaatctcccaggtggagggcgtcgcattgggtggggaggcaaaggtggggctcgggattgccatgtgcgaagccggtggatggtgatgccgcccactcaactggggctccaagaggagagagtgcacatcggaaggcctcctgcggtgagcatcaaggagatgagtcacatctgtgttatgtggcatttgaggctcccaggggcccttcaagtgcaattgcctgacaggagcctggctgtaagggtctgaagctgaggagagaaggctgaccagagtgaaaatctggggttccatcagccatggagagggtggccactaggccatacagcgagaggaggaccaggaggaacgccgtgacttagggaaaggcagaggggggagggatggaggaagaaaggagagacggacagaagacaagttggtggggtcatggaagccgagggtaggggaaggtttgagaagaaataaatggtctccgatatcaaaagctgccaagaagcaggttgaagggtgtcgactaggcccgtgacgggaaggtcactggaggcttggagcccaggctgtggagacaggctatgttgcatgggaagaggagggggtggtgaacaaattccaagagcattcttttctttctttaaaaaaaaatttcaggccgggcatggtcgctcacacctgtaatcccagcactttgggaggctgaggcaggtgaatcacctgaggtcaggagttcgagaccagcctgaccaacctggagaaaccctgtctctacgaaatatacaaaattagccaggcgtggtggtccatgcctataatcccagctactcaggaggctgaggcagaggaatctcttgaacccgggaggcggaggttgtggtgagccaagatcgcaccattgcactccagcctgggcaacgagagcaaaactctgtctcaaaaacaaacaaacaaacaaacaaacaaacaaatttcaataagggccagatgcagtggcacacacctgtaatcccagcactttgggaggccgaggcgggtggaacacttgaggccaggagttcgagaccagcctggccaacatggtgaaaccccatttccactaaaaatacaaaaattagccagatgtggtggcacacacctataatcccagctacttgggagtctgaggcatgagaatcgcttgaacccaggaggcagaggttgcagtgagcccagatcaaggcactgcactccagcctggatgacagagcaagactctgtctcaaaaaacaaaaacaaacaaacaaaaaaacccaggaaatttcaataagcataattgtaaaactgaaagaggaacatgaggcaaaatagaagggaatgaggtgttctagaagggtggctgttagtattatcatcattctttaagagggagagacttcaactcactgaaatgctgatgagaaagatccggaagagaaggaggaggatgctttggggagaaggaaggggtgattgctggagaggggactctggagacagaggaagtgctgggacccaggcgcaggcagacgggtgtgaccatcaggagagatgatgatctgcaaggagaaggctgggagaggagactgcagtggactgagctgagcctgggctgcggggaagcctttgtcctgccgtcctaggctcttggcttcccggtgtgttgcctgttggagacagagcttgggccccaagagaggacgttctcagctctctagtgtttttatgagaaattaaacttgaattcgaaaagcccaaatcaattttatctcaaatgagaggaagtgaacagagacaaaggctttggtccagaaaggcggggagtggaattcataggacatttaatattcactccacaaacacagagctctctctgggccctggcggctctgggtgctggaggcagatgaataaatttctcaaggaatctggggggcaggagggaaacagacagacattgcaattaaggaatgtaattgctaacatgaataggaaagtttctcagaggaggtaacaattctagctgcctctaaaggatttatagagttttaccaggaaacactcctagaagtgaagaatcatattattctacttaatataagtgtaattttacttaatataaaagcccttagctcggtaccaacataccatcagctttcaatatcattgagctattaaaatattattattatttattattattattttcaagacagggtcttgctctgtcgcccaggctggagtgcagtggcacaatcatggctcactgcagtctcgacctcctgcgcccagatgatcccctcccaccccgcctcagccccccatgtagctgggattataggcatgcgctaccacgcctggttaatttttgttttatttgtagagatgcagttttgccgtgtagcccaggctggtctcaaacttctgggtgcaagtgatccacccacctcagcctcccaaagtgttgggattacaggcgtgagccaccgcacctgtatcccaatttttttctgatacttacaattactgtgagcccttgacattcacatgaaataagacaagatctctaagaatctcacgctgggaaatactgtcttctgcataaactatccctctttaaaaggagcaaagcgcaactgaaatgttaagctactatcttggacatttaatgactataagaacagaaccaaagccatttccacagttattaacacattggaggcctgaagcctccaatctcacttgagctgttctttgctggctccagaggctcttgagctgcgtggggaatcacttttcctggtttccactgagagcagcatatggtgggctcacttggaccaaagattcaagccagggccaagttcaactctccactctttaatccactccttgctcctacttttcagactaaaagccaacacattcccagataccttcatctttctctccattattagcactagcaattggagttcttctgaggtcattttccagaaagaagctgtgtttattgccaggtcatcagctggcctcactcactagctcagttccacgctgacatttttgccccagcaaaattacaaattagtaccagccacggacctttggattatttgaaacgacccaaaactgcatgttaaattcttgaatgtcaaggatttcctgggctttccagtctctaccactcctgaactcaagctttaagtcacctaatgtcccattaccacttaacacacatgcacacatcatgtgcacaaagccacgtgcatgcatgctcacacagacacatgcattggtacatgtgtatataaaaatgcacatgaacacacaggcatgtgccatgcacatgtacacatgtacatatatgcacccccatacatgctcaatgcatgaacacattcatgcatagtatgcacgcacatatctaccctctgtcatcacacatgcttacacgcatataatgcatacacacaaatgcacaacaccatacacacagacgtacacatgcatttacagccatgcacacacacggacatacaaatgcttgcacacacatgtgtataagcacacacaacatgcatgcatacagaggcacagcaggcacaggcttgcccacacactctgccaagaacaagtcaggaggaggaggaaggtagacacatcattcttctccctctagttcaaatgacttctcttccttggcacaaacttttgttttgatatcttttgttatttttttagatcgcaaagacatgggatggaaaccaaatccctggggtttccagatggaagatgtggtttctaacaacgcatctacttaggcaaactggaatagcaaaagaatctggaggcctcttggagtgtttgtgatatctgcagcacccctccaacttctcctccccctctcacccgcctaccccaccacagggaggcaatgcagggctggacgccctgctcttgctgctaactgcagctctgccatcttttcactgtgtgaactcaatcaatcccctccccatctctggtccttccagatttgatggggagtggatagaccgaggttcagttatccccatacacagatgaagaaatcgtggctgcaataggtgaagagggcctcctgaaggtcatacaaccagaacccacatgttgcagcttcctcccagtgcccatcgctacggggcttctcgtgcttgaatgtgcatatgaatctccctggggtcttgttaaagtgcagactctgattcaataggtctgaggtggacttaagcttctttctaacaagcttcagttttaagattctttctggctgggtgcggtgggcccatgcctggaatcccagcactctgggaggcggaggcgggcggatcacctgaggtcaggagtttgagaccagcttagccaacacggtgaaacaccgtttcaactaaaaatgcaaaatattagccaggcatggtggtgcgcacctgtagtcccagctactcaggaggctgaggcacgagaatcgcttgaacctgggaggcagaggctgtagtgagccaagatcgtgccattgcactccagcttgggcaacaagagtaaaactccgtctcaaaaaaaaaaaaagattctttctgacaagctccaaggtgatgctgatgctgctggtctgtgagtatacttttactagaaaattatgtcactcagaccaggcaccgtggctcacgcttgtaatcccagcactttgagaggctgaggcgggcggatcacgaggtcatgagtttgagaccagcctggccaacttggtgaaaccccatctctactaaaaatacaaaaattagccaggtgtggtggtgcatgcctgtaattccagctactcaggaggctgaggcaggagaatcgcttgaacccaggaggcggaggttgcggtgagccaagattgtgccattgcactccagcctgggtgacagagcaagactcgtctaaaaaaaaaaaaaaaaagaaaaaaagaaagttatatcactcttccatggtttttaaaaaggtgtaatggggctgaggtttgactctcctgcacagctccccactcccctggctgggacagtgatgacagcatcttgtgtcctccctttctctttggttctaggcccctggtgcgacccacctccccttcctgagccatttcctcacctatcccacctttggagctgaggatgctcagtgggatggagatctgattccgcacgctccgagtgccttgctacctggatgcctaggacacatcccttctcctcctgaagcctcagtttccccatctgtacagagagtgggttagatttgtcctcagaactggctgcacctcagaagcacaggcagagtttttacgaagtaccctggccaggatgccactcagattttatttcattggatgggggtgaggcccagacgtggatatttttaaaaagctgcccaggtgatgccaacggggtgccagggttgagaagcacagatctggtgatcgctaaaggtcagcccagcgccgactgtcagagtgtgtggtcccatggccaggtctgcacactgacaccatgctgtcctatgcagcgctcagaagcagattggaaaagtctcaaaaagatctcagtgcagctattagacaaggtcacgcgccccctcatgggaaacggctcttgagttgatgatcaggatacagaccctggcagagagctgaactttcttttctgctgactgacacatgatgaatactttaattaaagactcaaccccacacatcaatcatcagcagacctcccccaccaatgtgccctcccacgggagggctggaaaagctgtctctgtgtgccaggtgggacaaggggagggtgcacccaggctgccgctgagcgctgggagttaacctgacatcatgtccaaacagggggcccgattagcaggaggacccttggctgcctcacagcagagacagacccatgaaaagattttcttgaagccagccggttgtacgtctgtacagtccagaggtttccatagcgacccgtctcttcctaaggctgacaatgggctccagcaccaggggaaggctttcaacgtcctgaggatcccagcccgaaatggatgggctgagcctgtctaatcttggctccactggtccctcgaggcacgtcctttcagaaaggacactgaacaggcggcagccccgcccccactgagccctcagaggatgggaaagcaatctttaggatgacagcagttagcgggtacctctccgtggtccctctccaccaattagggcggtggataagcagctgtaccctgaagttagaccacccaggattcaaatcccggctctgccacctgggtaactatgggcaagtgacttgatagctgcctgcctcagtctccccaactgtgaaatagggataataatactatcctcttcataggactcttttgaggattacctgagttcattaagggaagtccttactacagaatccggcacattgctctcattttttacagcccaatagtcatagatcatgagacggtctcagtccccaggctagaagggctatgccaggcccccagtctctccactgcccagggcggtgtttctgaggcttgacctggaggatttttagtcaccccaatgtccagtgcaccctccatctgtgcaccaggatctctgagggtgggacccaggcatctctttttggaaaactttgcaggtagtttcaatgcttaaccaaagttaagaacaatggaaatctgtcagcttttgtgcctgtaaggtttatttggcctgagtcgtgagaccccatggagctcctgcagcctgtgtggaatcaggggagggaggagtggacacaaacaatatttgcacagtactaggcaccctttgtgtgctcattcattcattcattccacacaagcacttatgcacttacaatgtgcccatgctgtgccgatagccaggaatgagacagaggggccccgccccatggcacttactgacccgtaggggaggcagacatttatggtttatcacacaaacacgctggcaatgataagaaccacacagagcagctgaagtggtcaggtggcttcccattccaggtgagatctggaggttgcggggcagttagcaagtgggagagagctgcatgcggggaaggtgggaggcgttgcaggaaaggtgagggagacacagctgagctgtggtgctggccagctggggccttgcgccttatccgggcactgtgacggccactaacaggttttaagtaccggaatgacatgatcggatttgtaatttaactagatccttctgactgctgttgggggaacagactgtcaacctcacaacagcactgtcagctgagtattagacaaatgatgaacctgggcccagggagctgagtcactcatcagagacgtgtggctagcaagcaacagaggccaggcccatcccaggcccctgctctcagatctgggttctttgcaccccctcccctggctgtgtccatctctctctctgctccccgtttcgtccccattatctcaggatcgactccaaactccctgtgagacaatacgatcatccacattggatgacagcctttctcaaagcctctgtgagcacaagtcttcattctttagggatcactctgattttgagaagcagccaaaggctttccaagccaaacttggcaggataaggtaggtgattatattagtcacctattgctatgtcacaaattgccccaaaacttagtggcttaaaacaacaataaaccttaattctttcacacatttctgtgtgtcaggaattgggagcagctgagctgcatagtctagttctggtctctcctctttcccaatgcctcagtttccccaattataaaccaaggtgcttgaaccggaccctaatatccctcttaaccttggtgcttccagaaaaggtttgattctcccactcttgccaattcctcttcctccttaggcggtgggcccaggctcacagagaactgcaggtcattagccaaactttttttttcttccacaaagagcttcggcctatagctgggcgctttctacctacctgctgcaaagggccggaggtgaaaccctgaacctgagatgaggtcagagcaaaaacccaaaatgtcatcccccaagactcctgagctgtggcggggtgcactgagaatgggttgcagacttccttgtggtccgctgcggggccactaactgctctgaagtgtctttgccctgagttctctgaaacactgagcacctaagggagagcaggcacgcggcagatgggtgacagcagccaggcacacctgccgcactccgatccctcctggctaggggctaggcatcttggaacgcttacgaacggggtcttcagctctgcagcccccaatctcaagacagctggctctgttctgcccatcaggtcctgaacccggaggcaggacctgaaataccccaaggcagggactcacatccactgacctgctgtgtatctgggattaactggagtctggaagacaacggggagcctccagctcacccccaaaatgaaagacagctcctggggagcttatcatttagtaggacagatggatagttgccaaataaccacgcaggtaaagggaccatcacaagtctagcaagggctatgaggagcacagtggagctggctgttagtggagggcccctggcgaggcctcctggggaagggatggttcagctgagcttacatcacaggcaaaaataaaatagggaaaagaatatccaccctccaagggcccatttaacttagcaagggagaaatggggcagggagattaatggaaagaaggaatttggtggccgtgcagcagggtcctgagcgtcagcggcccgtcatcccagtgttcctgggaggccagcactgggaggcactggcatcccagccagcagccagggtcaggattctagccaaagagacctgtcagggccttggcaccaccttggagggactgcaccgttccgctatccattgctcctggaagtggcattaccctgcctcctggctggtgccggcccctctgagcctcagccttgctgctgcttccctggctgcatcagatgcaagtggaacagcaacaggccggcacccccagggctgtgttcggcccctccgagagtctgccctctgtggagtggagtccggctaggaccgtcttggccgcatgctgaaagcagcccccaacccctctgacctaccagcaacccacccaccagcacgtggttgcagcctgcttcttgggtctccctgttcttggtgcttcacccacccaaggcaggtcatatctctcccggagccagaccttccaaaggcttcccacttcacccaaacaaacccaagatccttccccaggcctccgaggcaccggcacatctctggcctcatctgctactcctcaacccagacctccttgctgtgcctccaactcacaggtacaggcagccacagggccttggtacctgctttccccaatgacttttcttccaaatacacacgcggcttcatctgtcacttcctccacatctctgcttaaatcccgtctattcaaagagggcttcttagctactccatccaaaataacccctcgggcactctttactccccctctctgcttttcttctttatagcatctattgcattatatatatatatgaaataaaaattttatttattatttgtgtctcccctagaatgtaaatctcaaagctcagaacactggttttgttcactgctatatgcccagtgccggccagatgcggtggctcacgcctgtaatcccagcactttgggagaccaaggcgggcagatcatctgaggtcaggagttcgagaccagcttggtgaacatggtgaaaccctgtctctactaaaaatacaaaaattagccaggcatggtggtccacatctgtaatcccagctacccgagaggctgaggcaggagaatcacttgaacccaggaggtggagtttgcagtgagccgagatcatgccactgcactccagcctgggcaacagagcgagactcagtctcaaaaataaataaataaataaataaccccagtgtctatagcatggcctgacgtataggaggccctcagaaaatatttgttgaatgaacaaatgaatcaagcacaaattaggttgtcaaaatacagaatggatgggggagaatgctatgattgccaaaattgtgccgagttgttgggtggcaaatgtttgttgaatgactatatgaatatatattgactgggggtgccataggaagagtgctcctgctgggtacatgtcccagctctgccactgatgagataggcctgtcataggcctattcatgcctatctccttttgaggtcttgatcttcatctgtgtaatatgagagaattgtgttaatatcaggtcatttttttttccattttttaaagcagctttgaggtgaaaacacacatggcaacccaatggataaagcggaggtggtggtgttgaaggcaggaatcttagaaccctgtccatttggactcctttctttccctcctcccctgtgccccaaggtggttggaaaggccccttctgagaacggttgaactcccctggactcacagttccctaaatcctggtagtaaattgcatctttgtttagcaactattcatcaccagctctgtcagttgatgttgacttgactgcgtgactttattttcccccaaaatgtgggcccgtgtgacaacgtgatggattccagtggaggctttaagaggcgttgcaagttcctcctaccaccttgcactcctgccctgggccctgggatgagagacacgtggaccaggcctgactctggccacagcccgcactagagcttgtggcagcagttccccctgccactggcacacaacctgaggaagaaataaagatttattgctgcaagaaactgagattgaggttgtttcttatgcagcataacctggtgaaaacgagtacgagcccctctagctttgctgtgcctgcagcttaagtctggagggggctgttggcattattcacagagtataggaacccaaatttggaatttcttttgtcaaattttcagctgtttccttagcttgtgatcttccccttaaaatacttctccaccttaccttaatcagagatctcaaactggtggttcctggctacttgtaactcgaagtcatgccttgttgggctccaattaattaattaattaattcaacttactatctgcctatccacttacacgtgaatacagatgattgcacaattgtagttttctgagtggccattcagaaaaatctccttttcagtaaatgctaataaggtacctactctgccagggctgcatagatgaaaaaataaaagtggtccctgactcgttgaaatttaagctattacactcagggtatgaaaagagtctgtcataaataaaccaccatcaacaacatttaaaaaaaaacccatcttcatctcgaattcgaaaagccacccatcatttctacttagtgaggctggataatttctgaaattaacggatgcttatagcatacccaagaaaagcatttttgcaacaacagaaccttttatctggcttacaggcagctaaaaacatcccaacccatccttcttagctgtctttactgagactaattttcacaaacatcgttttgaaaaggagccgtagtgtgccaaagcaggaagcgcgtgccccggattcaggcacgccgtggggccaggtgtcctcgggaaactggttctctgagcctcactttcttcatctgcaaggtgggctgtgtgaacagagggggctgggtcagaggacctcttattatcttagggctctttggctgaatgcagaatttcttttctttctttcttttttcttttgttttcttttctttttggagacagagtcttgctctgttgcccaggctggagtgcaatggtgtgatctcggctcactacaacctccacctctccggttcaagcaattctcctgccttagcctcccaagtagctgggattacaggtgtatgccaccacactcagctaattttttgtatttttagtagaggtgggatttcgccatgttggccaggcagatctcgaactcctgacatgacctcaggtgatctacctgccttggcctcccaaagtgttgggattacaggcgtgagccactgcacctggccgaacgcaaaatttcaaaagtgtgttcctgcccatctgctaggttcaagttgttactgcctttggggtccggggtctcggaggagtgatcccaaagaatgtcccctctccccagctccaaaatcaagatggcctgagggtcccctcccagcccctcaagcccaggattctgagccaggttctctaccatcccctgcccccagctttccctctctgaacccacctggctccttgcttgccagccccagtgccttcttgctggttctcaaacacatcaagtgggtacagccccgggctttgcacgcagcatgccctcctcccagaatgtgctggccctgattgtccatgtggctccccgctgacttccgtcggggtcctgctcaaatatctcccctggaagaggccttctctgattctcccacctcacgagcagcccagttattccccatttccttcccctgcttggttttccttcatagtattcatcattatctgctctccgccgtctgactgccccccaccagaataaagcagtggtcttgctcatggctgtttccccagcgcctagaacctggcacatagtaggtactcagaggtattttttgaaggaaggattgaataagcaaatatgcagttcaacaaatatggacccttatttgtctgcttcccccaacaaatgtggagaagattccccaaacttcaccctccccggcccctggttttgcccagtagacacccccagccctggaggctttgcgatgcccgccctgctcacaggttgttaaagctggtgcaggtctcagagatccagctgaggaaagggcagaccaaggcctggagtgggtttagagtccattcatcgagctcaggcaggcgcagagctggggccctgagcagctgtcctgatgacaagaaactgagatttcttctcccgcacaggccaccgcagtccactccaagcccccagccatggtcacagctaaactcctgtccctctgacaagatgccgaaggagggcacttcctgtctcaggcctgagtccctctcagcctccagaggggagcagggatggggaggaattggtagttttgagagcctgctaggggctggggctgccacacacagcctcttccacttgtcaccttcaccacagccccgcgcggaaggagccattgtccccattttgtggatgagcaaagtgaggcctggggaatgaagacgctggcccagcttgcacacagagccaggaaatggcccagcaaatcacgtctctgtgttctagtctgttaaaagccatctggtgccgaggaccgcagcctcaggagctccctgccttccccagagagaaagctgtcagtcagcgggggagcccatctcctcctccctcccacaccacccgctggtgtcacatggcattgggagggagcagcacccacgggggtgcctccccctggaggctgtgcagggagacttgggagctgcaccttgtgggtggctggggtttggggggcaggggttgcacacacgttcagggctgtcacgtgttcctactctctgcagcttctctggaggcacgtcagcctgctgggtccgctgtccccagactgggactcctgcagagaagcctccaatgccagaaatggcagggaatctcagagaccatccaggtcagcccccctactttgcctggctcagacaagaataaaatctagagctttgtatgccagaagtggggcaaggatgggatgaggtcagggtcctttagagaacacacatagggcaggtcggttgaggcaaggtctccagtgtcagaccacctgcatccgagtcccggctctctcctcaatggttgaccctggataaatgccttcacctctccaagcctccgtttcctcatctactttaacagatcctagttacggagtgctgctcagggacaggcatggctctgagctctgcacctgtgtgtcatcctccaagcaaccctaggaaggagatactattgtcatccttctttagctctgaggaaactgacgcacagagtggttagctaacctgcccaagggcacacagctgggaagtgatggagccaggatttaattccagacaatgaggctttgggatcctggagctccatcactatttcatctgctgtctactgaggattaaatgaggcaaggagtactaagaacctagaactgtactgagtcagcactcaaacaatcatttttataataatgaggaagaaggtcatggacccccagaaggtctgatgaaaggtaaggaccttcctggtggaagatttcacacacacacacacacacacacacacacacacacacacacaccccaaacactgcctgcaatttcatggggcccctgctccagaagtcaacccatcagtccccctggggaaactctgctcaagtcagccccattatttcctaaggaagggagaggagagggtccacatgtacgttccttcatttgatcctctgaggtcgatccacctcaggtccacatgtactttccttcatttgatcctctgaggtggccattattagcccattgcacagatgagaaaaccaagggcaacggtgaggtcccaggcaagctggtgggcagacgagactttcctgtcctagggggcctgccgccttctccttggctgggtgttacttagtccagaagccatggtaagaaatggcgcccgcagggctcgggcctgtggtacacactcagtgaagatttgttgagtgagtgagtaagagtgagtgagtgggtcagactgggtcgacatggggccaggccatgtccaaggtcagagactcagagctcccctagcccagctcctctccggggtgctcatggctcttcatggggaggcagaggaagaagcaaaggaagagctgtaggaatcctggctttttaaaagctactactccaacccccagacaagaaaatgggggccccaagcctgacttgatgtattcagtcacaccccgggatggcaggagccaggactggaaatcaggtgtactggcacccatgccagagctcaggcagtggtggtcggagggaaggggtgctgaactcgagtcagaacacttgggccacattctgcctgtcattcatgagtgctgtgacttcaggcaaactgcatggccaagtctctatttgcaaaatggtgattgtatctaccttatagtcactgttaaatcaagcagtttgacaattgtctattgaaaattgtttagtggccgggcgcggtggttcacgcctgtaatcccagcactttgggaggccgaggtgggcagatcgtgaggccaggagatggagactgtcctggctaacatggtgaaaccccatctctactaaaaatacaaaaaatcagccgggtgtggtggcatgcgcctatagtcctagctactctggaggctgaggcagaagaatcacttgaatccaggaggcagaggttgcagtgagccaagatcgcaccactgcactccagcctgtgtgacagagcgagactccatctccaaaaaattataataaataaaaataaaagttgtttagcattttctcctcatttgtcaaatgaggataggttaatgtgagaatgtaggaaattccctgatgtaaaacaaatgttctgtaattggtagcttttactattattggcagctattattacaatgttgagcatacaggataggcctctataaatgtcccatgaatgggtggatgaaccaacagacaggctaataagttgtttggcagaccagtgggaagtggggtggagagatggatgaatgggaggaaggtggattgatggatgggtgagtgggaagtcggcaagagggtaggtgggtggatggatagatagaccaattgacaggcagagaggtctgttttggggaagaccaataggtagatgagagagagtgtaagatggacaaatggctggctggatgagtgagaggatggaccaatagtaatcagacagaaagactggtggtttttcagagcatggaaggaaggaaggaaggcgggagggaaggaaggaaggtggatgtgtgggtggatggatggatggctggctggctggatggatggtggatggtgaacagatggaaggaaggaaggtggatggatgggtggatagatggatggatggatgatggatgggtgggtgggtagatagatggatggatggatgctggatggatggatgggtgggtggatggatggatggctggctggatggatggatggtggatggatgggtggatagatggatagatggatggatggatggtggatggatgggtgggtggatggattgatggagagatgaatggatggatggatggatggatggatatgtgagtggaatcattgggtaggtgggtggagagataaatgcatggaccaataagcaggcagatagagaggtgggaggacagaagaccaggatgtggatggatggcagatattccttccccttgaactgaagccagagggatgatggcagcagct

SEQ ID NO: 538 - DNA, 20001 bp, Homo sapiens
tgcactctagcctgggcgacagagcgagactccgtctcaaaaaaaaaaaaaaaaaaaaaaaaaaaaaaaaaaaaaaaacaaaaacaaatctttagagctggggtctcactatgttgcccaggctggtctgaattcctggcctcaggcatcctctcacctcagcctcccaaagcactgggaatacaggagtgaatcgccgtgtgcagcctaacagattttttgttttttgagacagagtttttctcttgttgcccaggctggagtgcaatggtgcgatctcggctcactgcaaccaccgcctcccaggttcaagtgattctccagcctcagactcccaagtagctgggattacagggatgcaccactacacctggctaattttgtatttttagtagagatggggtttctccatgttggtcaggctggtctcgaactcccgacctcaggtgatccacccgcctcggcttcctaaagtgctgggattacaggcgtgagccaccgtgcccagccaacagatatttttaagagatcactttgtctgctgggtggagaatcgttagtagtgggtcaaaaggtgaaggcaggagacagaagtgtgggcacaggtgaaatgcagaggcctgggagggtggaggggccccagaggagccgtctcagggcctgctgctgtgccttcctaggagccagcaggggctccaggccccttagccccacctggagtgtgcaactcatcacccagcttcagacaggtttcttataagaaccaaggaggtccagtgcctgtgtctctaagaatgcttcttctgggggaatatcccgtctctctcaggcactttgcatcttctgagtcttctggccctcacaccctcccaccctcccaccccgttcctggcactcaaaggcacgtggcgctgctcctgtgaacagatgtgcccatgtccttgaggctgacgtgtgcctgtgtgcactgacccacgcagatcaccaaggcgccagggcagcttccagagccacgacaccagggttcaaatcccagcccaacctctttctggctgggtgatcttgtacaagtcctgaacctctctgcacctcagtttcctcattcgtaccacaggggaccggcaccagcacacagcattaccccaggattggacgaattgtcacatctgcaagtctccactggtgttattacgttatcaggcacaaaccccctccagacacctgagcctcccccacaggctcccagtgaggagccatcacatgcccaggccagccgaggggccctcaggcatggggatctgggcaatggcagcaagctgggcggggggtgcagccaggatgacagcagatctgcagggcggggtcctcgccccgggccacctggctggggccgaaggtcacagctgcgtctaactgggccttgagcagctgaagctgtttcagggcttgcagcacctctggggtggccccggccacaccccccagcaggttgtagttctcaccagggtccttggacaggtcatagagcagcgggggctcatgagcagtcagagagctggaggcgtggcaggcagggtctgcagtggtatcactgtgggcagagcctggggagggggccaattctgtgcacagggcaagggcgagaggaggggccagggatctagggctccggggaggggtcagcaggtcggggggagggatccacggggaggggttaccctgggtgaagaagtgagccttgtactttccagtccgcacagcaaaaaccccacggacctcgtctgggtaggacgggtagaagaagagagactgccgagggctctgggggcagagtcaggggtcacggggcggggcaggccccaagcactgcacatacctggggctgccagccctggtgggaggccctggacgtgcaccgcttcttgcccacccaggaacctgagaggtggcgccacttggatgccactcagtgcaggaggcactgaggcacagactctcaggcactgcccacactcaccccaggggaaggccaggacaggggccaaggatctgggatcaggggtcaccggccctaccttgcctgtgcccagcagcagggggctgaggtcaaagccatccaaggtgacattgggcagtggggccccagccagggctgccagggtaggcagcaggtccagggagctggccagctcgtgggtcacgcctgggggcaggaggctggtcagtcactcagttcgccatcaaggttggggtggtggggccagggttccaaggagagggcctgcggactgaccgggagcgatatgacctggccagaaggccaaggcaggctctcggacaccgccctcgtaggtcgttccctttccacaccgcaagagaccggagcagccgcctcgggacatacgcatggtctcaggtctgggacacaggaggcgctcatgagccatggagccacagcctctgagccaccgagggtgaccagtggccccacacctctaagtcacaaagcttgcccggaggtgcccagcatgagcccggcacctcccaggcctaccaagaccagctctctgtgcactgtgtctcctgactacaccttgggcccctgcaacgtggccagcatctcctggcaccccctcacccactatgttcttggcaagcagctgaactgcaaggcctccagggccctggcccgtgacagggccggagcacccagctgccctgctggcatacccattgtctgcagtgaagatgaccagcgtctcttcaagcagccccaggtcccctatggctgtcatcagggtccccacagctgcatccagctccatcagggagtccccaaatggcccgcggcctgaacgctctgcaaagctctgcccactgaactgagggtagtgggtgtgctgggggcaaagactggagttagcactgggtaggggtcacgggcagccagggggttgggccaagatcacttacgtgagaggcatagtacaggaagaaggggcgatcctggcgctgggcgtcggccatgaggtcatgggcgaaagccatgtagcgggcctctagtccgggcagccaggggggctgcgcctccacggacaggttggccaacagtgggatggggaccaggccctggtcacagccaccgtcgcaaggagtggccggcgggaagcaggtcaggttctggcaggggccctgaggcgggcagctgccgtgagggctgggctggcaggtggggctgcgggagcatcaagggctgggggactttgggaggtgggagggtggctgagggcccgggtggttcctacctggtcgtgggagtacgggatgcctagaaatcgatggaagccctgatgggggggcaggaaggccccctcaggccccaccccaaggtgccacttgccggccattcctgtgaggtagcctcgggcagccaggacttcggccacggtcacctcctccaggggcaggcccccccgggagctgggcaccaggacgccagggtacatgcccatccgaaccgggagccggccggtcaggagggcggccctgcgggacaagtcacagagtccctgagacagacagaaatgtggccttccctagagagagagacagacgtttttcccgcccccctgcaatccattgggaggaaagggatggagggtcggggcggggaagaggcgcggccccctctttacctagagggtgtgcacagagacacaggcacgtagaagtctgtgaaccgcagccctcccgccgccagctggtccaggttgggagtggtagagctggggtgcccatagcagcccaggtccccatagccgaggtcgtcggcaaagatcagcacgatgttgggcggacgggcaacggccaggccagcagccagggccaggaggagggaccgcggtgcccccatggacatgggaccgaggggtctgtcccaagagagggagggctacttggctccagcaggctctttccgataccgcagacccaggcgccgcccttccctgagaccccggacccaaatactccccgaccctgacggccgcctcctgaagctccagagggccggggcccgacagtaccgggagaccgcgggctgggacggaactcctccaggaccagggcaccttcagattctcgagcggagatctgatcctcctcgcctagcggtccgggctcagggtcgggggcgtaagtcacttggcgctgaccagcggagtcgggccggggggaaggcgctagagggagcccaggaggagccggtaccgggctgcgggcgcttccgcctcggccccgccccgtgacctgtgacccttgcggggcggggccgggggcggggccgggggcggggccgggggcgggccggggcgaggggcgttgctgcgcgtgctcgctccgaggccgccgtgtgcgcctgaggctgttggctgcggtcttgaaacgggctctgggagcttcctctgcgcggtcggccctggctgaggcgtcccgggctgcgcgcggggctcggcgctgcgcagtgtccggtgtcctctcggtccggagcttctccagaggaggagcggctcgtgcgcccccagacctccggtactgggagactcgggccctcctgtaagagacctgagcgcggagcgttatgggcacccggtgaatgagcaaatggcagggaaaaccgtgcagccccatggactgcgggctcttccttcacgactagcaaaagctttgacaccctttctcctgcgtacgcgtgtctgtgtgcgtgtaagctgtggctgggtgcggggggctgtgtacgtgtctgtgtgtggtgtgtgtggagtgtttgaggcaggtgtgtggtgtttcaggtgtgtgtgcatgtgtggtgtttgaggtgtgtgtgtgtgtttttgtagtgtttgagggatatgtgtgtgtggtgtttgaggtgggtgtgtggtgtttgaggggtgtgtgtgtgtggttgaggggtgtgtttggtgtttgaggggtgtgtgtggttgaggtgtatggtggttgaggtgtgtgtagtgtttgaggcacgtatgtgtgtggtgttgggtgtgtgtggtgttagaggtgtggcgtatgtgtgtttgcggtggttgaggtgtgtgtgtgtgtctggtgtttagggtgtgtctgttgtgtgcgtgtggtggtggaggcgtggtgtggtgtggaatgtgtgtctggggtccagtctggcctgttgcagggttacgctgctggggaaaaactcatctgaggacaacgtgattgggtcctcgctccctcgttgggcagccttggacttaacctttttgatcttgaaggaaaacacaatatgtcacctccaaatatatttccttgacacggttcaagacagttactcagaaggactggaaatagaagaatagctgaaaagctgtcttttgtgggggagatttgcatctgtggagagaatctacactgatgcggccaggcctcctctgaggccctccttgcctgatctgggaagagtaacagtctgacgcctttaaaggcctgaagggaacattcaccatctgttctctctcagggctgctacctgtgaggtttcatctgtagaacaaggccacctttgctagccaggcctcctctgctctccctcctgtaaccggtcttgccactggtcacctgattttccaccataaactgtggccatactttgagcccatgttctttctgtaacctcaagatggtatataagcttccgaaccccattgggaggttggggtcatcactctggttctccctgtgtgcatgaataaatctgtatgccttttttcttactaacctggcttttgtcagttgattttctgtgaactcagaatgcagaaaagtttttctctaggctcctacagttttggtgcagtcggtaggataactaaagtcactctcctgggagcctccgtcaggggaacccaggagccgacaagctggcagaaagaagggtaagaaggtcttagcagccaggctcccggcctctctggaatcttgtcaagccgacggtaaaaatgtctgtttaccttgttttcctcttcaaagttttaatgagagaaatgtatttatgtgattagttttgtattcatattgtttgattgctttttttccccagaaatagtcgtctttcattcttgtctttctgtgtttttctgtcataaagagggtagaacacaggcctaaaacccctgtaaaccccgtcttggggccgtcctgcaggctagtcagttttgcagctctgatcggatgcgtctagttagacagactttgctgtgggtccctgaactgaaaactggatgagattctcctctcttttgatgtccttgaaagcttgagttgtgagcgagtgggaatgatgcaggccaggcagaccccagagtggagcttagccagtgagggttttggctttgcccaggaaagaattcaaagacaagccagaggtagaagaaaacagctttattgaacaggtggcgttagagctctgtgactgctcctgcagagcagggccaccccgtaggctgagagtagcagctcagggcagttttgcagtcacatttatacgcacttttgattgcatgtagattaaaggatggtttatgcagaagtttctagggaaggagtagtcatcattgggtcattgccatggaaaggggtggcaactcctgggtgttgccatggcaatggtaaactgacatggcacagtggcgggcatatctgactgaaagctgctattgccccaaccctgttttagccaatcctcaactgggtcaactaagtcccacctcctacctcaggagcactctcttggcctctgccaatccgaggtagtgactcgcaggtcacattttgtggtcagtctgaaaatggttgggaacccaagacatttaatattttaagcagcaccgtttttgttctgaatgtgtcaagcttttagtttgtcttaagaagtccctgccaggcgagctgtcagagccccggcactgggagtggtggtcaacttgcgggttggtaaaaagagtttaccgacaataggtttgaaaaaggaaagtttggccgggcatagtggctcatgcttgtactctcagcactttggaagtccaaggtgggtggatcacctgaggtcaggagtttgagaccagcctggccaacatggagaaaccctgtctctactgaaagtataaaacttagccaggtgtggtggtgcgtggctgtaatcccagctacttggaaggctgaggcaggagaattgcttgaacctgggaggcggaggttgcagtgagctgagacagagcaagactgtctcaaaaaaaaaaagaaaaaagaaagtttgccgggcacggtggctcacgcctgtaatcccagcactttgggatgctgaggcaggtggatcacctgagggcaggagttcaagaccagcctggccaacatgatgaaaccccatctctactaaaaatacaaaaaattagctgggcatggtgtcgggagcctgtattcccagctacttgggaggctgaggcaggagaatcgcttgaacctgggagatggaggttgtggtgagctgagatcataccattgcactccagcctgggcaacaagagtgaaactccatctcaaaaaaaaaaaaaagaaaaaaaaagaaaagaaagaaagtttattagaatgctgcagaagagtgcaatgaggtgcctcagcaagaggactgagtacgccgggtggatttctccttaagggcatttataggccttaaagtggaggcttaacagtaatttggaccatattagccacgtaagtcatgataaatgattacatttatagtaattttggtgccttaatgtcagcgacggttgtacagtgagtttcgtcatggtattctggagacacatagaaattatagttacttacacgttttttgggggaagaaatctggaaccagatgcctgctttagataatagggaggtttagttacttttgattttccccagataaggagttttgcctcggagggcctgtttgatgtttgatggtcgccaggtggtttttgctctcctcaggcccatccataaggggcttttgtcatcccaatgtttgttgcctggtcagtcctcagaaagcccaatcccaacaggcctaccctgtgttacaggttaatgggtctgtgactggcagcccctgacagattgtgtgttactggaggcactgtatgtacaaacacgttccttaactgtctctgggaacaagagtcttttgctgtctttgcctattcctgggagtgaattttgggggcatcattggaacctcctcttctatgccctctctaaacctggaaaataatcttttgggctttccatgaaggggcttcttggattgagttgctattggaataaatacatcattggaaattctgattgtcaatagccaaaagatgaatcctttacattagaaagatccctaaattaaaaaaaaaaaaagattttagaggtctctcattctaaacaattgccttatttgtatttgtggggagattaaaggaaagacacataataatgttgtggctagccttagaaatcctcttcacaaaattaaagagcaaaaatctgacctgtaacaagttaaaatcctttgtgcgcgcaaaccattgctttggatccctgcaggattcacaatgaagactgctgcatcttggaaactacttaaaattctgtactttcactaccatggcctgggttcaattcccaatagaggaaccagtcccttttggtttgatatttgtgtgacttttgaattctttcttttgttttttttttggagacggagtcttgctctgtcgcccaggctggagtgcagtggcatgatcttggctcactgcaccctctgcctcctgggtttaagcaattctcctgcctcagcctctggagtagctgggattacaggtgtgagccaccacgcccggctgatttttttgtgtgtgtgtatttttagtagagatggggtttcaccatgttggccaggctggtctcgaactcctgacctcgtgatcctcccgccttggcctcccagagtgctgggattacaggtgtgagccaccacgcccagctaattttctttttttttcttttttttttttgtatttttagtagacatggggtttcaccgtgttggccaggctggtctcgaactcctgaccttgtgatccggctgcctcggcctcccaaagtgctgggattaccagcgtgagccacgcacccagccaacttttgactttgtgcggaactcatttgttgttgaccctttccccctccactggcagcttttgatttcctttctttgagctctttggggtggctctggatgtcatcaggactgctttgcgcctctttggagatggcttatgtgtccttggttaagtccatagctttagttaaggcttattggttttggtgagtcacttgggaggtacctttggttttaaaaaaaaaggtctcaaagccatggctatcagctgttggtctcagctaaaatctgataataagatatttgaaaggattttaaaaaagagctctgtggtcagaagttggcttaattaaaaacaggtgagctgatcttcaagccatgtatctacagccttttctgcttttggaccctgtttctgggaatttttttttcaggtgactgaaacccctttaaattgtgtgtttggtccttctgtttggttcctttgttggtataattttgatgagaaaaatgtaaaattgtattggccttttagaaccttaacatttttccaaattggctcctctaaggattgcagtcccatttacttctacccctccgtgctcctccatcccctttgccatctttggtacctaatgaagggatctacaagggacttctgatgacttagagaccccttggggaacgcaaagaaaggtgccacgcgccccgcttttgtcttccttatggggcctgaggagtcgtgggtagcttcctctcgggtctaaagcttggctgtctttggcactgtgtcactggatctctttggctttgggggtaccagggattacgttgcactgtgagacagtgcatgacctgagtgtgtgtgatggccggcaggtcactggcgagggctgcctcacagttttggaggtggctgaaagcagttgtagtgaatggttgttcctgcagtggctgcttgtttctctgcatgtttagatgagaaaggcacaatctgaacacttggagactatggaagcacttggcgtcaaaggctgagactccgtgggctgattgctgtgggtctcccaccagcctcaggggaatgtcttcatagtgaggtacactgtggaaacactgtatggctttgtctcatatatatctctttttagagggaactcagcattcagtgtaaatgtgggatccttgattttaaaagatctagatgctctgccttccagctgcacctgtttttcacatatttaaatattaggtcctccaaactgcaaatgcttttttggccatgttcattaatgagctctgtcctgagcccagtggtctagttcaaaaatggagaataaattaatagccacatatttaaataacattgttgtccttataaaatcctgtggtgaatttctatgactttttgttacctcagcatccatttaaaatcttcctttaacatactaaatcaaagcttaaactttctccctgtggaattgcttgaaccaaggaggcagaggttgcagtgagtcaagatcgtgccgttgcactccaacctgggcgacagagcaagactccgtcttgaaaaaattcagtaaataaaaataatttttttttctctgtgcttcaagatgtaaatttgttgccttgttttctctaaaacttggtaagggctttggccgtgtgagacagataaattttaccttgttccatttacagaggcacaattttaagtatccttttaaactagtgatttttacccgattcgtggctaaaatcttaaaactaaagctataaaatcttgatttgtgtctgtatttttatgtgtacatgcctgtttgtatattatgtacatagtagcaaattgacgtataaataaataagtgctcatgaatgatgtaactaaacccagatgcttttctagttcatgtgactagtaatctttggcaaataaacttagttttaaaattgttgctgctgggtgcagtggctcacacctgtaatcccagcactttgggaggctgaggcgggcaaatcacgaggtcaagagatcgagaccatcctggccaacatggtgaaaccccgtctctactaaaaatacaaaaattagccaggcgtggtggcatgcgcctgtagtcctagctactcaggaggctgaggcaggagaatcacttgaacctgggaggtagaggttgcagtgagccgagactgcactactgcactctagcctgggtgacagagtgagactccatctcaaaaaaaaaaatgatgctaaaattagaatatcttcaaagtcgtcagtcttaaatataattgagacatctttgcttgggcccattggtcggacaggttcagacagtctctgttagatgctttaaggtcataaaatttgcttctgtcatatttctgatacttgcttaatttgtctgtgaacttaggtctttggctttgagcctctacattctggggtcaagacaagtggacatgatgtggcctggagacatctgtgtgtccgcagtacctaagccccatcctccctggcccagctgtaccccccggtcatgctgtttgtctgcagtgcccgagccccgtcctccctagcccagctgtgccccccggccatactgtgtgtctgcagtgcctgagccccgtcctccctagcccagctgtgcgccccagccatgctgtgtgtctgcagtgcccgagcattgtcctctcttgcccagctgtgccccccggtcatgctgtgtgtctgcagtgcccgagcattgtcctccctggcccagctgtgccccccggtcatgctgggaggggttgagtcctccaggcattgtctttgtagtagcccattctcacactgctaataaagacatacctgagactgggtgatttgtaaaggaaagaggtttaattgactcacagttcagcgtggctgggaagcctcaggaaacttacaatcatggcggaagaggaagcaaacacgttcttcacatgaggtcaggaaggaggtgtgcagagcgaagagtggggaagcacctcatgaaaccatgagacctcgtgagaactcactagcacaaaaacagcgtgggggaaccgcccccttcatctaatcacctcccactgggtccctcccacaacacctgtggattttgggaactacagttcaagatgagatttgggtggggacacagccaaaccatatcagtctttaaagctctgtcctttgtcctgggctttgcatctttaataacaattaaaattgcttacttcccatgtttttcactgaaaattaggcttcctaagagttaacattgtaattaatatatgtatttaaaactactagatataagagaaacacttctgtatgcaaagtttataagaaagtaggatgtgtttttggtaaggaaggttataaagaaggcatgagaatgaggtttttgttaaaggaaaagtaattttgtctagttttgatgtttttaaaggttgttttaaattaaaggaataaaaaaatgatagataaaactgaatatatatagaaagtttgagaaacaaagaatggaacaaattttaagaggttattaaaggtttatggaaatcttatgtggtcaaagctgattgagattgaatggatctgtttttaagtttttattaaaattagctttagtattaataatatgctaatgtaaaggtagaatttagttttcatttttgagtaagattttcatgtagtattaataagagacagtaaaagatttttgtttaccttttgagtaaactacaagaaaaggaggagtaggcccggtacggtggttcacacctgtaatcccagcactttgggaggccgaggtgggtggatcacctgaggtcaggcgtttgagactagcctggccaagatggtgaaaccccatctctactaaaaatacaaaaattagccaggcgtggtggcgcctgcctgtagtcccagctactcaggaggccgaggcaggagaatcgcttgaacccgggaggcggaggttgcagtgagctgagattgtgccactgcactccagcctgggcaacaagagtgagactctgtctcacaaaaaaaaaggaggagtagagagtttgcctcatgctgtctttatttatttatttattattttggagacaggatcttgctgtgccacccaggctcatctcgaactcctgagctcaagcagccctcctgccttggtctcccaaagtgcagggattacaggtatgagccaccacgcctggctcaaaattataattattatgttaaattgttgtatgtcacacaaaaaaacaaatctccttgtgaattgcatctgtaaccatcattagtctaagtcatctgtcatccacagtcaattactgttttactttgattctttttaaaaagcagcttataattagctacagttcaagacttgcttcttcctcaaggaaactcatgtaaagtacccagacaagtactttttttttttttttttttttttggtttttggttttttttttttgagaccgatctcgctctgtcgcccaggctggagtgtagtggcgcggtcttggctcactgcaagctccgtctcccgggttcatgccattctcctgccttagcctcctgagtagctggtactacaggcgcccgccaccacacgtggctgattttctttgtatttttagtagagatggggtttcactgtgttagccaggatagtcttgatctcctgagcccacgatccgcccgcctcggcctcccaaagtgctgggattacaggcgtgagccaccatgcccggcctcaagatgcttttaaaagtctaatctgagattccttatgaaaaagttctggcaaagccaactttaaaagaggttgaatggccagtcactattattactgtactttatgcaaataatcaggccaattataataagactaaaacttattttgtaaatcagttgttcttactctgatttgtcttttgtggaaaagggagactggagagagaaaaaatatgttttagaagaaaactatagtatacctgttattagagtccagactgactgttgacacctgttattagagtccggactgactgttgacacctgtcacgagagtccggactgactgttgacacctgtcacaagagtccggactgactgttgacacctgtcattagagtccggactgactgttgacacctgccgtgaggagagtccggactgactgttgacacctgttattagagtccggactgactgttgacacctgttattagagtccggactgactgttgacacctgttattagagtccggactgactgttgacacctgttacgagagtccggactgacttgtttttgagttgttatcatttgcctatagtttgaactgaatcctgcattctttcctagctccaagtctctaaactaatgctttccagtttttctcccatttttctgatttaaaatcactggaaattaaaatggcttttcttgaagccctgcaactgaagctaaattacttataatcttcaggagaaatcatcacagcgacttatgtataaatagcctttgtgcctgttgatatatggactattcagaaagttcacttgaacacccaattagaactacaatccagaaaaatctgtcaaattgccattgcaatctgaagatgctccagatgcctcagattgaggagagctagaaaagctagtctatggatgacaccagacattcaccgttttttttcttctgtttccatagaattgtatcttgttaaagatctgtttgtgtgaattatatacgaggtcccagcccatctgcaatgccacttcttggaataggatacagctgtttaactgagctgatctagtctcaggactaagagacggattcaagaaaatatggcatgatacatatctatttttcagagacagggtctcactcactcacccacaaagtggtgtgatcacagctctctgcagacttgacttcccaggctcaggtcatcctgctgcatcagcctcccaggtagctgggaccacagacacaaactaccatgcctggctaattttttattttttgtagcaatagagtctccctgtgatgcccgggctggtctgaacacctgggctcaagtgctcctcctgcctcagcttcccaaagtgctgagatttacagccatgagccactgtgccctgccaggatgacatttaaatttgtctttttctgcttatcccaatttctttttgcccgcctctgcctgtctcttatctaacaacctctaactcaaatctcttcaaagctatcaactttctttttatatgggcaactttctgaaagtctcaaagtggggactgaaggaaaccaaaatatttcgccccaaaatgtatttccatggctgggcatggtgactcacgcctgtaatcccagcacttcgtgaggccgaggtgggcagatcacctgaggtcaggagtttgagaccaggctggccaacatggcgagaccccgtctctactaaaaatacaaaaattagccaggcatggtggtgcatgcctgtaatcccagggaggctgaagcaggagaatcacttgaacccagtaggtggaggttgcagtgagctgagattgcaccactgcactccagcctgggtgacggagtgagactctgcctcaaaacaaacaaacaacaacaacaaaaatatttccttgacacggttcaagacagttactcagaaggactggaaatagaagaatagctgaaaagctgtcttttgtgggggagatttgcatctgtggagagaatctacactgatgcggccaggcctcctctgaggccctccttgcctgatctgggaagagtaacagtctgacgcctttaaaggcctgaagggaacattcaccatctgttctctctcagggctgctacctgtgaggtttcatctgtagaacaaggccacctttgctagccaggcctcctctgctctccctcctgtaaccggtcttgccactggtcacctgattttccaccataaactgtggccatactttgagcccatgttctttctgtaacctcaagatggtatataagcttccgaaccccattgggaggttggggtcatcactctggttctccctgtgtgcatgaataaatctgtatgccttttctcttactttgtcagttgattttccgtgaatctcctgagggcagagggcaagttttcccttggcctctatagtctccagtttgtttaacagtcaaatggaaatgacagacgcgtactgaacgttgacctaaaagaaagaagctgaagcaacattaacatgagcggagggtttatttgggccaagcttgaggattgcaacctgggagcagagattctatttgccctgaatatacactctgattggcaacagttacagtagtttttcgaaggaaaagaggtggctgggcgcggtggctcacgcttgtaatcccagcactttgggaggccaaggcgggtggatcacttgaggtcaggagttcgagaccagctgggccaacatggcgaaaccctgtctctactaaaaatacaaaaattagccaggtgtggtggcgtgtacctgtaatctcagctacttgggaggttgaggcaggagaattgcttgaacctgggaagtggaggttgcagtgagccgagattgcgccattgcactccagcctgggtgccagagtgagactccgtctcaaaaacaaaacagaaaaaacaaaaacagataacattggctatacattgttctttctttttgagacagagtctcgctgtgttgcccagcctggagtgctcactgtgccctccgcctcccgggctcaagtgatttcctgtgcctcagcctcctgagtagctgggatttaccggtgtgagccatcatacccggcctacattgttcgttgtgtcacaaattccaagaacatgaagataatggtgaggcagctggtctggaacaaagcgtcctgaaacaattgtccccagccatttttgcagaagtgtgggattactgaggccccacactcatccctcttggccgtacaccccgcctagttccgactctgctctgagctacttctttttctcatcagtgtaagagagagccccagagggggcttcggtgaggattttattctgtgtggctgagggccccaaggttgctgtagtaattgggccctgccagggtatccctctccatagcccctgccctgaacagtttccactgcaggtgtccccaggacagctccctcagggtggcccctcctagggtggctccccagggcagctccttgaccttgcgtttctccacaagctcaggttgcccctcggggaggagcaggacctggtctcctgatgggaagcgctttccctggtcactgaccctgcagccagtgggaaggtggacagggctctggaagagcctctggggaccagggtgagggttcaggactcgacttccactgaagcccagctgtgtgtggggagctggcattttcctgaggaaacatgaaagctccaagatagaggccatgtgggagcaaagtttgaagggactcccagagatggggtgggaaggggctgggcttgaggctgctgctgaccttgtggagagcaggaggtgccagtctctgccagcgagccccttgatgttacattccagtgtggtgtctgtgcctgtgtgtggcggggctgggggcaggggtgcgctgctggtgcttccatctggagccagaacagaaagctgctcggtggcccagaaatctttgaacctgtaattggagctatcgcagctggttggcgctgtgaattggagtttaaaaggagacaatcaaaggcactttattctctttcaactggaagctgggaactaccccaggaccggccccttcttcccgagaagagcctgcttagggttgtagtgttacgcaaatggtggccccttccccctgggctctggaggccgctcaggggttgcccacgtgacagctgcctcggcccagccctgacctcccggcctggaggaggggatgtgtgtgctgccagctatgtttgttcaaagccaagctctgcaggccatcctgccttttggagatgtgagttctttttctgcattgacagagccccaattggaggcagcctgctggggttcgggaagtggctctggacgcctggggcattgctaatttgggactaacacccacagtcaggagagggccttgaaatgaggggcatgggtcttgtctttttgcaccttggacaagggatggaagaagcctctgcatggggagggtggggagttgagctgcttcagcgggaacacgtggcctgagtggagggattctgcagcagttcatgagacctgctgacatggggatccaccttaggccccctggtggccttcatcttccccacccctgtgggcctgctccatccttgtcccatcaaccaccttgaggccctctggttggtcccaactctgaaagggctctgctggtcccagctgggcagatacatgacctggccaagggggtggcaggtactgactgggaggttcttgtggaacccactggcagggagaggaaggcaggaggttcccagaaagaggggcagccctttttttttttttttttgagacggagtctcgctgcgtcgtccaggctggctggagtgcagtggcgtgatctcggctcaatgcaagctccgcctcccgggttcacgccattctcctgcctcagcctcctgagtagctgggactacgggagcccgctaccacgcctcgctaattttttaatatttttttagtagagatggggtttcaccgtgttagccggggtggtctcaatctcctgaccttgtgatccgcccacctcggcctcccaaagtgctgggattacaggcgtgagccactgcgcccggcttgggggcacagtcttgagcagatgaggacggaatccactgcccacaagaaccgtggcaggtgtgaggtagctgctgtgtggcaatgaaagcttctctgcttgggcagacggcagctcctgaaccttctccggagcccatctgtgcacttccttgtaaaatccagttttagtaaggacctgatcaccctttatgtaaccacccagtgagttcactttgcccgctgcctgcacagagccgatttatcaagacaggggaattgcaatagagaaagagtaattcacgcagagccggctgtatgggagaccagagttttattattactcaaatcagtctccccgagcattcggggagcagagtttttgagggtaatttggtgagtgggggaaggccagtgagttgagaatgctgattggttgggttggagacaaaatcatggggagccgaagctgtcctcttgtgccgagtcagctgctgggttgaggccacaggatcagatgagccagtttatggatctgggtggtgccaactgatgcatcaagcgcagggtctgcaaatacctcaagcgctgatcttaggagcagtttagggagggtcagaatctgcactgatcttaggagcagtttagggaggatcagaatctgcactgatcttaggagcagtgtagggagggtcagaatctgcactgatcttacttaggagcagtttagggaggatcagaatctgcactgatcttaggagcagtgtagggaggatcagaatctgcactgatcttaggagcagtttagggagggtcagaatctgcactg

SEQ ID NO: 539 - DNA, 71968 bp, Homo sapiens
taatgtttaatttcctttatgtctattattactgacaatgttttatttcatttttattgattaatttcatcttcatgtttattatttgatttcctctgcctttcttacaatcttgttttctttataaatttgcaaattaattttctaagacaaccaccaaaaacaaaaacagttgaaagaacaaaagcagaatataaaaagtaacaaaaagtaaataactatatggaagaaatacatatatattatatatacatataaatgcatataaagaaacataaataaattataaatggaataaattcattagccaaaagacacacgtggtcagaatacctaaggaatataaggaaagttacaggaaaatagaaagtaaaaagatggactaagataaatcaggcaaatgctaaccaaaagaaagttggtttacttatattattatcagggaaaatcgaccttaaattagaataattattcaagataaagaaggtaactacacaatgataagagcttgatttcacggagggaagtttagtaacttaaaatttatatgcatgtgatatgaattcagaggggcagactgcaatacctattctggtaattgatagatcaagcagacaaagcattaggaagggtatagaacatgtgaaaaacaattaacagtcatgatataatgaagatacatagattcctaaaggcaacaaatagagaatactcatttctttgaaacacacatgagatttatgaaaattgactgcaaattatataaaacaaaccttaacttaatttcaaagaatcaaattttctttaaaagcacctgttatctaaaagttatgtgtactctatctctcagaatctgcatctaagggctgagtgaactagccctcatcaccactgcagagaatcttttatctttgaacaaagtgctgcaaaagacagagacagtgtaatccatcattggagtgttgtgatttggacccactacttgtggttgaagttggatggagctatcagtgtaggttctcagagctggaggttggagtcttctgattttagtttccagccataggcctatacctgaaagtcaccactgatttggcagaagcaagttccagaagtcaaagcaggagagtttcaaattgccaccttaactggagtcatattgcaaatctcctatcagagtgaatatcaaattcttactggaccaagatgaacgtgatgattgtcttcatgtcaattggctttcatcacatttgggctaaattctgtcttttctcctttcttcattatacagccaggttcttgaacactgcccaaccatgctacttatgttacagagtaaactcatatcatagctaaatcattcaaggtaagcacttttgttgcagcctgacctttgggctgacatctgacttctttctataccttggatccatctcagcaaagtgactagaatcctgaatctctgattctgtaggtcaagtctcagtgaaattgcagtttctctgaactattggagcctaaaaatggcatacactggggaaactaaggtcaaaatagaaaaaaaaaaaaaaaaaaagaaaacatccaattataagaaaactctaaaatgccactagatttactccttttgttgcaaaggtcattataacttctatggtatttctaccaagcattttcaagtatttcatctattataattgaaagagtatacaatgggaactatgaggttctgttgcattgtaaagcgcaccatgggggatttctgggtggtgtgatgtattcacgatttcataccttctgtaaagaaagtatagatgatgtttacataaatttaaaaatcacatatcacagagtgtgtacaaataacaaaaatgtagcaaatcagttaagtgtttaaaagttatttaagaaaatctgagatcatctcaatacaacatatattaagccccattctgtgctttgttaggcatctgttagtatgaaaaagccagagtttatctgcaagaagcatcaaaaaaaggcctaaaatgaattataacaagttatccattctactgagaacatatataaaaattaattcctctttggaggagagatgggaggtttataaaaacataaagagcaagtgatatttgaattagataataagataaacaactagtgacaatgttagcaggtgtgttcctgtagaaaaaaaaaaaaaaaggtaagaagggagtgcagtatgaaaggtcctacaaacatttgttccttatgttaatgtttggattatacagcacactcacctttcaaaaagttcgtacgtggaccacctcatttgtttctgttgacagctccagacaggtagtcatatgatatcatcattaatacgttacagataaactcaagcacaagtgttctcatgaagcatttaataggacaacaaaagaactgggacaagaaactgctttttgccatcttgaagttcaatgtttttttgccatactccaatcattttacacaattattatttttcctaagaactgtgagaggcaattaatgacaattgttactgatttcattcacatgccacagaattaaatagaaattcagcagtagccctgtagtcaacgagaagtatattttgttcctattgaaagagttcctatattgaaagggaaaataattttatggccataaatataaagttgttgcattttttctggaggtaatattaaagaataattagtccacttgctctttttttctctgttgagttaaaacatatatagataaatgtgtacagatatgagcggtcagatatatgagttctcactaagcgagtacacttgtgtgataagcagttgggtcaaggaacagatgatgaccagctccccagaggtcatcctgtatactgtcttccagtcaccaaggttaatcattattctgacttctcacatcatagattggtttgcctgttttttaactttgtgtgaatggaatcattcactatgtcctctcttttatctagttgctttggctcaacattatatttctgagatttgtttatattgttgcatgtagttgtatgcattcattctcattgctgtataatattctactatgtgaatatattacaggttatttctccttctactataataggcatctattttggactatgaatagtggcattatggatatattgtactatcttttgttttgcctgatttcaaaattatgtagaaaagagcttcattagataagtttaaaaatgtaagccaactttgttacaatttttctgagtagttcagaagaatagaaatagaaatggttaaaaagaagtagatgggagagagaaaacagtttaggagaaaatgaaagagggtaccaccttcattgtgatctctagtatataattaccatgataattatgataatgatggtgatggtgatggtagtagtaagtattgagtatttggcaggtaccagatatcctactaaatgttttatatctgttatctcctttagtcctcaaaatagtctatgggagttttacaataattatacacattttatggaggaaactgaggctgacacatatcaaattacttgcttaaatcacacggctagaaatggatgaaagcagggtttgagttctgcctgttttctctaaatgcaccccactaagcttaaccactatattcttacattgctttttaagatgtagataattttatccctattttacggttgcggaaactggttctggatggtaacttgttcaaggtcacatagataaaaagtggtagaatcagagtatgaaaaaaattaacccaaagtccagatttttgaaagtgctagaacagataagagggaaagtaaagaggaaagatacaggatagaagaaaaaagttatttagcacattcctcagtaagtgttcaaactgtaaaagaaaaataatgaagtattttaaaatggcagagtttaatggagggaatgagttatacaggtgatgcaagaattgataagccgaacagtggacagtgtggcaactagtgataagcattcatggcaaagaactaaaacaaggacaaaatgagcaaatggtatcagatcttagagatgtgggtcacccattggaagctggaaccatagggactaatttggtgtgaaaggatggagagtatcagacgtaaaattatacaaattagatggagaagacccaagaattaacaaaggtgtttctaaggctgtgggagaaatttgggcttgtaggaatctctggcaaagggaaaattattaaaaaacttacctttctagtagagatagtactaaagggaaatagtgaaggacgattaaatgtaaaatgaatccagaagattttgatttctgaaggatgcacatacttcagcctagcacatctcgaaatctagtacatggagattctgttggagggcttgttaaagcaggtagacagtcctgggctcaactctggaaattcttactcactgagtcttggatgggacctcgtattctgcatttctaatgagatccaggtgttgctcataacagttgactcacagaaggtatgttgagtagtactgtttcagcatttaaattcaccacttactgattgagtgagtaaataagtggtaggtcttcagaagatctgatcacctagaagaagatgaatattattatacccaacatatagaatatcaccttctcttctcacagtcacccccatcatacaaacaaaaaggttggcatgcagtagcatttcatttgttcattcagctacagataaatatctctgccagacaaaacattattttgatacaatttgttcccttaaaaatgaaaataaaagtcaatcaaccattatttcaaagtattgtcatgatcatattaaatagttagaaacctaagccagtatggtggttcatgcttgtaatctggcattttgggaggctgaggtaggtagatggtttgagttcaagagttcgagaccagcctgggcaacatggcaacataccatctctacaaaaaaatacaaaaattagctgggcactgtggcacatgcctgaaatcccagctacttgggaggctgaggtgggaggatcacctgagctcccggaggtggaggctgcagtgagccccagtggctccactgctctccagcctccagcctgggcaatggagtaagatcctggctcaaaaacaagacaaaacaaaaaaagttagaaacagcatctttatttttcagattatgaaattgcgaacattatggcatttttattttattaacactgacctaatttctcaatttaggatttgacacacagataggctagtgtagattttcaatgttaatgtaatgccttcttgaaatatattaatgtgaaacttgctaagctttattttgtagtaaatatccatattgttatttttagtgcctccctgttcacagtctccacattatttcctctcctatatacaggcatgaattcgctcatatagataaatacatgctgcccaaccccaacagcctctcagacatacatattttataacttagtaaatcttaatatacacagacactctcctcttttctgagttttcattttcttgatctctccctctcacaggaaggattctaatccctttttccttctagaatgactcattattcataagcattgattgaacttctcttgtcatttggtctaggccctttaaaagatttgaatctattttgcatctgtaactcaggattcagatttcctttccaatttaggatgttattcagctccttaatcatgtgctcctttctagaactagcatccatttgtttcctgttctgtcttctctgagccaaatttctggtttattttatgcttatgcttcagagcacaggcattgaaattttttgcaacacatgtgccatgctggaagtattatcatttaacatggatctatttattttcaagttattatagataatgagaattttttaaaaaaaatagtatatcaccaaatataactattttttatgaaaatgttaaatgccagtttgttttttattttggggagccttgaaaagcttaggaaagtagaagaaagtgggaattgcagcaaatttcatttataaaaagcaatatacaaaatagatgattcagcaaaagaggagataaaaaaggcactcatgtgaaataattttgatctcctccaggtcgctaaaagctacaaggagccacggttcccacacaaagccatacttgaattcttgggagtatggaacctttagaaattattgaattttttcttgtctttaggcaaggacatccctaagccaaattacagacataaccctcttcctaagttaaaattgcctggaagaaaagaccccgcagccttctttgcaatcttcagttcgatatttgggagcactcactcttctttctttttattacccttgcattaattttctgtgcatacgcaagaattttactgactatgccttatgtaatttgtatggttgatgctgagaaatgtatcgccattcatcttctacaaaaaaaaggtgtaatgcagagcagttacacacagtaacataagtacacaattttaaactaagtgtttttgcaggctagattttgtttttcaagaaaccacagaaacaatgtccaagattctcagtgtgaatatttgcatgtttctgaatttttcaactggcttaagagattcagacattacacatgagaatttgctataaaatggcataaataacttcagagttaggaaatacatgataaatttggcagctgtcttgcgggcaatcagcatgctttcctccttaactcttcattattgactaggagaagcagtggacacagtctccgaagttgagagccatttgagaatcagttgagaagtttgagaaccaggtatgtggggtaagttcaaaaccctgtcttaactgctcaagccctgctgtgaaccacatcattttttccttttgtcctttctccagtctgacatggagacctgattgaattctctttagagttgggttgtgaattccatgagtgcaagaactgtatctggccttatacttctgtatgtctatcattgaatatactatctggctcaaagtagaactttgcttaaaaaatgaattaagcaaaagatagaattcaggagctaaggaagcagataaatgcatttacttgactttttagatcaattttcctatatgccagggttttcttttttacaagaatgattaccacatttaaaaaattgagatataatttgtgtactataaaatttatcctttaaaaattcatcatttagtggtttttaattagattcataaaattgtgcaaccatcaccactatctaattcttgaatattttcatcactccaaaaagaaatgccatatccacacacacacacacacacacacacacacacacacacacttttacagctaataaataaattcaggaaactcacaggatgcaagatcaacaccaaagtcaattgtatatttatacacgagacatgaatgccctgagaatgaaattagaaaaacaacttaatttataatgtcataaaaaagtgctcaggaataaattaactaatagtatgtgtgtgtgtgtgtgtgtgtgtgtgtgtgtgtgtgtgtgtatttcgtaagaatttctacatgcaaaataatgtcatttgcaaatagaaatagtttttctttttccttcccaacctagatgatttttatttcttgtttttttgcctaattgcccttgctgaaccttgggtactaggtatagtaaatgtggcaagagatgacatccttttcctattcttgtttgagtaccacctctcaaaaataaaaactacatagatttatacttcccagattgtttggctcattattaaactttcttctcaaccaaacttttaattatgacttctgacaccgagcagtattcatttattagcattgaggggaacgtgataaagttcaaagcatctaacttatcttaaaaactcaactcttactggagaatgagaatacatttttatagagggcaaagcaatacatgttataagagaattacaaggctttcacaagaaggagagaagacattccacgataaatcatcaaaggcactgaaaagaagaaaacacttcatttgggtttagtagaagaggcaggcttaagaatttgtttttaactaaggtaaaaaaatcataaaatatgaagcaggacagcatgaagcatgttttcggacctctgagtaatccaatttgaggaaacttaaattggccttgggaagtagccaaaaataagtgtcaggagtttctgagaaacaattacgcacgtaactgcagtgatcagaaccaaccacttctgcgaagcttacagagaagccatgttttagtagctcctcttggaccttcatgcttttcaccaggcctatgtcggtgggagtgggtgggtaggtgggatagggtctatcataaatcattcttgctactctccatgaaaagactagtggctgaacccaaagatgctcatatccttctaaatgattactgagctgtactgatgggatcatttccattagactacttgaccttctcaatttcaaagtttgtacccactgcttgatgggtcttttacacatgtggctctgccttctgacctaagaaatttgcaggaattctggcagtcttcaggctattgcaatgtgaaattagaagaggtgatgatagctgtaaactccagaagaaaccacgtttcttgagccaactcctctgaaagcttctgtaatgagtacgctgtgtcgcatttaggtcttgctttaggcttgtaggcttgtttattcagggggaacatttttgaaaccccacaaacagacttgaaatccattccttctaagtcaaagctactcttattaatttggtacgtgacatatctgtgtcagacagtcctcatatgtaaacagaaaaactaagtgttagctattagtgttgaaatatatgaacatttgctgtagttttgctgaagcattttaaaatatggaaaggtagaacggttattttccttttggcagtttttcctaagaaaggatcccgcaacatcagttccaagagatgatagagagaaaaagattctgggactgtacacaatctgactgcttttgggatgctcacaatgcacattaaaagagaagaggttctggaaagtcctgcagtgaaggaaccacttaatctagggtttttcaaatgtatttgagcacaaaaactttatttatctaagagccattcacattccgcaggactcattttctgtgaatagatttaggaaactttgttccagaatgaagaacggaataggagttttctttaaaaataacatcatcacacaaacaaaatgcttaaagttcttgagctataaagtatgtgtgcttaatttaattgctgcaaatggttaggaaaatagcttaataaaaaacaatagagcagaagaagtgagaaacaaaaaccacatataatcctcttgcagcctcatcatgctttcctgcatgcccatgttgggcctctttatgagacccagatgacagctctcccctcacccttgttcatgacactgcttgtgctggttctgttcttgctccatggtaaactagacacaaaatgaaatccctcaagatatctccctaaggcttccatatgcatagcataacagtgttcgagaggaatgtgcttgttgattgaagcatttgtggagcacacagagaggcaggtttttaatcacacatcaaacaaacatctatttttttttaattattccaaggcttttagcttgtgtcctcaaaggaggttctttacccttcccttccaggcttccatttcttccacactcagatcctcctggagagctctagaggcctcccctccctaccatattgaaaattctgttctctccttgctactgctccagattcatataccccagttcatctatatacatagaaaaatataaaagaacctctgtttactctgatgttccatgatgcaggtagcaattcggtggttgtctctttctatttaagtaagctttttaggatctcaaccccaatcagcatatcaaagtgtttttttcccaaagagacacagtggtacacccatttagcattctagtgaatgaagttttgtctgttgatttcgtcttaaaaattagaagctaaccatgattttataagtttctactattgctctcctcagttgcctgacaaaaggagcttttacattagcttttaataagatacagttgaaaggttactttaaaatattggtgtctctaagctattttttatttgtttacttattattattattatactttaagttctagggtacacgtgcacaacatgcaggtttgttacatatgtatacatgtgccatgttgttgtgctgcacccattaacttgtcatttacattaggtatatctcctaatgctatccctccccacctcccccaaccccacaacaggccccggtgtgtgatgttccccttctgtgtccatgtgttctcattgttcatttcccacctatgagtgaaaacacgcggtgtttggttttttgtccttgtgatagtttgttgagaatgatggtttccagctccatccatgtccctacaaaggacatgaactcatccttttttatggctgcatagtattccatggggtatatgtgccacgttttcataatccagtctatcattgatggatatttgggtgggttccaagtctttgctattgtgaatagtgctgcaataaacatacatatgcatgtgtctttacagcagcatgatttataatcctttaggtatatacccagtaaagggatggctgggtcaaatggtatttctagttctagatacttgaggaattgccacactgtcttccacaatggttgaactagtttacagtcccaccaaaagtgtaaaagtgttcctatttctgcacatccttttcagcatctgttatttcctgactttttaatgatcaccattctaactggtgtgagatggtatctcattgtggttttgatttgcatttctctgatggccagtgatgatgagcattttttcatgtgtcttttgggtgcataaatgtcttcttttgagaagtgtctgttcatatccctcacctactttttgatagggttgtttgtttttttcttgtaaatttggttgagttctttgtagattctggatattagccctttgtcagatgagtagattgcaaaaattttctcccattgtgtaggttgcctgttcacgctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggtgttttatggttttaggtctaacatttaagtctttaatctatcttgaattaatttttgtataaggtgtaagaaagggttccagtttcagctttctacatatggctagccagttttcccagcaccgtttattaaatagggaatcctttccccatttcttgcttttgtcaggtttgtcaagatcagatggttatagatgtgtggtattatttctgaggactctgttctgttcccttggactatatctctgttttggttactgtagccttgtagtatagtttgaagtcaggtagcatgatgcctccagctttgttcttttggcttaggattgacttggcaatgcgggctcttttttggttccatatgaactttaaagtatttttttccagttctgtgaagaaagtcattggtagcttgatgggggtggcattgaatctataaattaccttgggcagtatggccattttcacgatattgattcttcctacccatgagcatggaatgttcttccatctgtttgtgtcctcttttatttcattgaacagtggtttgtagtcctccttgaagaggtccttcacatcccttgtaagttggattcttaggtattttattctctttgaagcaattgtgaatgtgagctcagtcatgatttggctctctgtttgtctgttattggtgtataagaatgcttgtgatttttgcacattgattttgtatcctgagactttgctgaagttgcttatcagcttaaggagattttgggctgagacgatgaggttttctagatatacaatcatgtcatctgcaaacagggacaatttgacttcctcttttcctaattgaataccctttatttctttctcctgcctgattgcactggccagaacttccaatactatgttgaataggagtggtgagagagggcatccctgtcttgttccagttttcaaagggaatgcttccagttttgtccattcagtatgatattggctgtgggtctgtcataaatagctcttattattttgagatacatcccatcaatacctaatttatcgagagtttttagcgtgaagggctgttgaattttgtcaaaggccttttctgcatctattgagataattgtgtggtttttgtcattggttctgtttataggctggattacatttattgatttgcgtatgttgaaccagccttgcatcccagggatgaagcccacttgatcgtagtggataagcttttgatgtgctgctggattcggtttgccagtattttattgaggatttttgcattgatgttcatcagggatattggtctaaaattctctttttttgttgtgtgtctgcaggctttggtatcaggatgatgctggcctcataaaatgagttcaggaggattccctctttttctattgattggaatagtttcagaaggaatggtaccagctcctccttgtacctctggtagaatttggctgtgaatccatctggtcctggactttttttggttggtaagctattaattattgcctcaatttcagatcctattatcggtctattcagagattcaacttcttcctggtttagtcttgggagcgtatatgtgtacaggaatttttccattttttttagattttgtggtttatttgcgtagaagtgtttatagtattctctgatggtagtttgtatttctgtgggatcagtggtgatatcccctttatcattttttattgcgtctatttgattcttctctcttttcttctttatgagtcttgctagtggtatatcaattttgttgatcttttcaaaaaatcacctcctggattctttgattttttgagggtttttttgtgtctctattgccttcagttctgctctgattttagttatttcttgccttctgctagcttctgaatgtgtttgctcttgcttctctagttcttttaattgtgatgttagggtgccaattttagatatttcctgctttctcttgtgggcatttagtgctataaatttccctctacacactgctttaaatgtgtcccagagattctggtacattgtgtctttgttctgaatggtttcaaagaacatctttatttctgccttcattttgttatgtacccagtagtcattcaggagcaggttgttcagtttccatgtagttgagcagttttgagtgagtttttaaatcctgagtcctagtttgattgcactgtggtctgagggacagtttgttataatttctgatcttttacatttgctgaggagtgcgttacttccaactatgtggtcagttttggaataagtgcgatatggtgcggagaagaatgtatattctgttgatttggggtggagagttctgtagatgtctattaggtccacttggtgcagagctgagttcaattcctggatatctttgttaactttctgtctcgttgatctgtctaatgttgacagtggggtgtaaagtctcccgttattattgtgtgggagtcaatgtctctttgtaagtctctaaggacttgctttatgaatctgggtgctcctgtattgggtgcatatatatttaggatagttagctcttcttgttgaattgatccctttttcattatgtaatggccttctttgtctcttttgatctttgtgggtttaaagtctgttttatcagagactaggattgcaatccctgcctttttttattttctacttgcttggtagatcttcctccatccctttattttgagcctatgtgtgtctctgcatgtgagataggtctcctgaatacagcacactgatgggtcttgagtctttatccaatttgccagtctgtgtcttttaattggagcatttagtccatttacatttaaggttaatattgttatgtgtgaatttgatcctgtcattgtgatgttagctggttattttgctcgttagttcatgcagtttcctcctagcctcgatggtctttacaatttgccatgtttttgcagtgggtggtaccagttgttcctttctatgtttagtgcttccttcaggagctcttttagggcaggcctggtggtgacaaaatctctcagcatttgcttgtctgtaaagtattttatttctccttcacttatgaagcttagtttggctagacatgaaattctgggttgaaaattcttttctttaagaatgttgaatattggcccccactctcctctggcttgtagagtttctgccaagagatctgctgttagtctgatgggcttccctttgtgggtaacccgacctttctctctggctgcccttaacattttttccttcatttcaactttgttgaatctgacaattatgtgtcttggagttgctcttctcaaggagtatctttgtggtgttctctgtatttcctgaatttgagtgttggcctgccttgaggttggggaagtcctcccggataatatcctgcagagtgttttccaacttggttccattctcccgatcactttcaggtacaccaatcagacatagatttcatcttttcacatagtcccatatttcttggaggctttgcttgtttctttttactcttttttctctaaacttctcttcttgcttcatttcattcatttgatcttcaatcactgataccttttcttccagttgatcgaatcggctactgaagcttgtgcattcgtcacatagttctcatgccatggttttcagcttcatcaggtctttaaggacttctctatactggttattctggttagccatttgtctaatcttttttcaaggtttttagcttctttgcaatgggttcaaacttcctcctttagctcggagaagtttgattgtctgaagccttcttctctcaacttgtcaaagtcattctccatccagctttgttccattgctggtgaggagctgcgttcctttggagtgggagaggtgctctgatttttagaattttcagcttttgtgctctgttttttccccatctttgtggttttatctacttttggtctttgatgatggtgacatacagatggggttttggtgtggatgtcctttctttttgttagttttccttctaacagacaggaccctcagctgcaggtctgtcggagtttgctggaggtccactccagaccccgtttgcctgggtatcagcagtggaggctgcagaactgtgaatattgctgaacagcaaatgttgctatctgatggttcctctggaagttgtgtcttagaggggtacccgaccctgtgaggtgtcagtctgcccctactggggggtgcctctcagttaggctacttgggggtcagggacccacttgaggaggcagtctgtccgttctcagatctcaaactccgtagaaccactgctgtcttcaaagctgtcagatagggacatttaagtctgcagaggtttctgctgccttttgtttgactatgccctgcccccagaggtagagtctacagaggcaggcaggcctccttgagctgcggttggctccacccagttcaagcttcctggccactttgtttacctactcaagcctcagcaatggcaggcgcccctcccccagcctcgctgccaccttgcagtttgatctcagactgctgtgttagcaatgagcgaggctccgtgggtgtggtaccctccgagccaagcacgggatataatctcctggtgtgccatttgctaagaccattggaaaggtgtagtattatggtgggagtgacccaattttccaggtgccatctgtcacagcttcacttgactaggaaagggaattccctgaccccctgtgcttcctgggtgaggcgatgcctcaccctgcttctgctcttgctcagtgcactgcacccactgtcctgcacccactgtccgacaagccccagtgagatgaaccgggtacctcagttggaaatgcagaaatcacctgtcttctgcgttgctcatgctgggagctgtagactggagttgttcctattcggccatcttggaaccttttttctctctaagctattttgtagtaaaactttgataaacagaagaatccctagggaatctcctttgggactttactgacacgtgtccttgtaacaaagtttgtccaaagcaattctgagccaagtctctaacaaatatttgaattttgacacctccatttctttctcccggtaggcagtggtcaactgagcatcacaaaatgcagagatcaagcaagctagaacaatcctattaaaaattaggagcctcatcaaaatgctcattagaataaacggctcatcactagtatctgagttccttctatccttgaaattaccatgaaaaccacaataaaatgcttacataaagtaaaaataatgtcatatcctcttagatatatgtccccgaatgagagttctataattatatatttctctgtatagcacctattcatttaaaacactatctagtctattgatattttcttactaaataatcttccacagccatgcctaatcaatatttctggcatgaaaacaaggatgtttttggatttataacttttatttatcagaagttatatcaacattcctttaacaggaatgagaataatgacatgatcaaatattgttttcttcatttcttgatttctttttattttcatggcataccttgtttattatttcatccctaaacaatgagatctgctgcaccctagaccagctgaattagcaccatttatgaacttgcaggaaaccaaactgcagtgacagcaggtttagcaaagctgcctttaaaaatggaaagtgactttaaaaatggcataaagaaggcatgacacaaatgtgaattgagacatatcttcactagagacttgcataagtatttaaatttcctgtttccagatgtcaaattggtaatatattctcttcaaaattgtattataattaccacatgtgtcagtcactcttggcagctggtgtgtaggtacactgtgtttggatctaacttctcataaatatatggtgtgaatagtttttcattacttggagactgagtgagttttttaaaacctgtccagttttccttttcagaaaacttactgggggtggataaagaatgggagctcttttggagcatattgatggactggataatgttttaattgtataggtgctatgtaggagtcgtttataaatgtatacacctcataaaatacatcagggctgtatgtccaaatgctagatgaatattagatacattatctttttttaaaaaaaatctttctctccttatattcccagtgactttttaaaaaatgctaatttcatgatttttttgtcctgagattcattacctgtgcattcacactttcccatgtacaaacaagaaaatacatttcagaacacctcgggaaaatacattataacgtatttctcaatgtgaaaatagaaaaacaaatgttttttcactatttcacttaggatgtagatgtgataggtacctgtccttgtgtcaggaccacagagttcatttcttactgctgtaaactgggttggcatgggattgagtagctttatgtaaatgattttcccagggtttccactttccaatgtatgacatagctaaataaattaatttgttaggtttttcttagaactaactaatattagaaacaccctctactatttatttcctaaagcccaatttacttttttctccttccttatgaaggaaggaagggcagccctatagccacatggttcttacacaataagaattcttccctcgcatcaagcatggtccgcctcttgaatgttatctcaccgtgtatgtattttgtttcccaatttatttatagaaaacgtaaattctgacctctaggattatttcctgaccacagccttccacttgtgcccttagagttaacaacggaccttattctttcagtattgggcctcatcccccctatttagttatatatgaagagcctgtgctggggctatttcctgggaggaaaaacaacaacaacaaaaaatgtgtgcaaaccacttctccacaatgtttgtcacaaagtctcagctaaaatggtttggattgggtcatgggtcaagtgtatgttgcaattttgtagtcaaactccctgattttttaatttcttacctccaagttatcacagctcatgcctcttactttttgctccccttcatccaaagtagatttttattgctatgcagttaggattatatacctcagtgatggttggttagctaaaagttgcatgatactgtagaaaaagttcagatttagggctagaaaatctgtcatctcatctataaaatgaaaataatggcaacaatagtaacacctaacttacaaggtagttgtaaggaatcaaaaggaattgctacataatcgtgaaagcaattgttggtggtagaattctaaactcactttaatttctgttcacctcacttccttcttttaaatggcaacaactatgatattcctgtgatctctaccattttagcacctcctcatttcccatcacaccgtaaaaatataaaaatgttgccctttctctttccagacaagttccattactcccaacattgggtggtgaaggtaacttttcaggtctttatgtacaggatggtaatgacaaaatctagaattgacatgaggtacagggagataaaaatattgaagatcatatcttgttatggaaagaacataagatttagaaccagacagacctgggtgtgaagactgtctctactatgcgctagcttgctatgtgacctaagacttgctatgtaacctcccttaacctgtttcctccctggccacaatggagaataagttccatttgtaaagtagcacattggacaatcatcccatggtagatgctattattcacattcatggagtgtctctataaaaagtttgtcaaaagcttttattagctttgtcatgtgagggggtattccagcctggagtgttataaaggcaacagatggccttttagagctctcatacttaatacacgcattcctgaagagtcctagtcacagataatttcctcagggccaatgtgaagtgacaatccagctaacacttcagagtgtgatgtttcatttttggagggcatataaaccagcattttctgctgggcgcggtggctcatgcctgtaatcctaccactttgggaggccgaggcgggtggatcacgaggtcaggagatcgagaccatcctggctaacacagtgaaaccccgtctctactaaaaatacaaaaaattaaccgggcatggtggcgggcacctgtagtcccagctactcgggaggctgaggcaggagaatggcgtgaacctgggaggcggagcttgcagtgagccgagatggtgccactgcactccagcctgggcaacagagcgtgactccgtctcaaaaaaaaaaaaaaaaaaagaaaaaccctgcattttcctcaccaaagaaatataggtagccacattaggatttagaaatcatgtatggcaagaatttggcagcagagatgcttttcctggaactcttcaaatactttactttgcccaagaacagataaaaaggacctaaatctatctagttacagatgacttaccagttactgaatacctactattagcagaatggatacatttctaaaatttgaaactgaacagcttgatgtagcttttaagaaatttaacattttttttaaatttattgtttattattattttttgagacggagtctcactctgtcgcccaggctggagtgcagtgtcgccatcttggctcactgcaagctctgcctcccaggttcacgccattctcctgcctcagcctcccgagtagttgggactacaggcacccgccaagaaatttaacattcttttatgatgcattaataggtatgaaattattcagaacaaaagcacaatttagttttctgttcttagaagaaaacaaaattttgttcacttggaggcatctcaacttacaaggaactaggtaagttgttttgcttccatattagagtggagaaaattgatgtgaagtagaggttagctaaataaactagattttattaatcttgtaaaattagccttccattttagccttccggagtcaagtagctatcaaaagctgaagtttgaggattctgtgtgggtgagcctgaatttagggaagggcttcagcccttatgtaagatgaaagctctctttgagtaatcaaggataagctcagtcatggttctgagaaggtgtgtcagagattggtggaagcctgaacttcagaaagtatccagttgatgagggctcataccaggaccatcctatactaagctcatagtgcaactaagctcagatgttacttgctgatttggggtaatgctcagaggatgttggctgtcttggttacagttggaccgggaaggacaggacactaagtatgtatatgttcaacctcagggactccatctgagcaggcaaaggagaagagcagctgttgaaaatcctaatgaggcaattagtggcaagacaccttttgagacatttaaaaaggagttgtatgatcatgaagtttggctttagagaagtgattgtcgtatttaggagcatttggacaagatgggtattacgacactgttcaactatatttcatgattccattatcaatatccatgttagcctgaatctattgatgcattttatttgcctttacatttttccctttatcctgaggactttgccaattttttgagacaaatcctttcctaagcatatagtggtaggagaatctccttctccttttttccctttagagaaatgcaaaatgacctacaagacttggcaagcacatggtttccagcacgaggtaaattcaaagagattttgtgaacagtaaaattcagccagctgggaatgaagaacaatatactttaaagaatgcccggaagtcaaatagagaaggagggaaaaatggaatggtttgttgatctctttggtacacaggctgtgctcagaatagatatcatgagggctgtaggtctgagaagataaggctgctttccttttattgagcagttctattgtgaaagcaaggtcaaaaatactaataaaacagcaaaaacctgagtccaatagtatagattacaagggcctgttcctggatgctaattaatgttatcacaggagatggctaaaatgagaatattacctactagtaaattaacaggatatgctgaaacataccacaagggaggaactgcctatgctaatatcgtataaaagagattgctgctggcaagtggtccatggtaaagagttttctacattatgtataaactcgaggaattatgacttaaagtatgcaatgaatctttaattgggagaaatcatttgtacacgataaaagtacgatgggaaacccatgtgtcctttttaattatctataacgaatgctgattgtgagccatttgaaaagaatatgttgcactaaatcactatgccataatcaagttagctcagcaacgtatgcacatacatttgttatagaagtcaacaggttatttctattctcagtcatctttgactgcggtctaattgttagctggagttacatggaaattaaactaggttgattctttcctggaagccaataaaatcactctatctcaatgatttcacaagtgagatctaacttatttttaattgtgaattgaagttttcttagatttttctcaatagtagagagagaaggtcttgataagacagagaaagtgaaaaaataccccccagattgtggaaaaagagttaaaaaaaatatatatatgcatatatatatatgtatatatataaaggttgatacagcagttcctagattgtgtctcagacctgaagcactaaagtagattgaagtaaatttactgatatctttcaatggtcataacctataggacccatggaatagtaattttaaaaagaaggtaataagcatgtacctttccatcatcttctcattctctcagattccaaatctgtgaggcaatatttttcctagttttttcctctgttttgtttttgtaccttatgtgacaaactggtctaccagattctatatattcttttgttgttgtttaaatgttctctcttcattccttctgtcattatccttgatcgtgtagtttttatcagtcattaaacctctctcttgacaattttggtcagcagctgccattcttgatcttaaccaaacttctttatagcattcctattgatcattctcacccgaccttatgacttctatacctacaagctcctacttttcctctcattttttccccaactcttgacttcctatataggaacatctatatttttttgcctactttaaaaatattggatttctttatgaatctcagtctctccctcttctatagctacacagttttcctgattaggaagtaagctcccaaaatcctatgatatatcttcagttatctgaaggagattgatatttcctaaatcattatctctagatcaaattcattttctgaccttaatactggcttacaattaggttagcttggtcagtccgcagacatctcaaactccacttgtctaaaacaaaacacatcatcttgtctccattttgcgtagtctcagttccagagctgagtggctccatgctctacacagttccccagaacccaaatctcaaagtcatgtataagcccttcctcctgttaccttgaacatccaattattttgcattcttttgattttgcacttcctaaatatgtcttgaattcttccatttctccccttctccctaaaatactatatctcacctagattctaataagtagaacagcctcctatttattatgctccaaacttgaccgaactcaaagtattcacactgcagtgatcttccttaaatacaattttagaatatgtcattgccctgcttaaaatctttcagtggatccccaacacctttaagttcactaacattgattgcaatcccttcgttttctgtcttttttatattccatagtgtattcttttgcttctttctttccctaaaatacactcaccctgaatgtcttaaaatgttccaaacatttgatatctgttccattgtgcatactccttcctgtgcctagaacactctaccctgtttctcctttcctttctcgccactctttgcctgattaattcctggtcttctgttctcagctcttgtgttatccttctaatctcgatgacttaatatttcctctatgtgaaccctgtgattattcactgtatgctatattataattttccgctcattgatatatctcctctaatagattttaaagttactgagaccagggaatgtgcctttccgctttttcttcagtgtctagattagttatcagtaaatatttattaaatgagtaaataaaagcagagtccaaagtatctcagtttccaaattccatgcatactactgtactagaatttcacctaccatatcgactcatccacactttcaactgaaatttagagtttatttgcaatatgactctacctcccaaatcctactgactccccaccacttcctcacttgacataaaaagtattgaagtagctaatctgccataataactaagaacatgaactctttaagttgtcaggtttcttattattttttaatgttgctattggcataataccctctattaaaaatattttattgtgatacatataatacataagattatgaataatatataggtacataataaagcaaaatccaatgtatcaactactttgcttaaaaaatagaatattagcaacatctttcaagacattgtgggcctctcccagattataattcacttcttccctccttaaatataaccgctgacctgaatgtaatatttattgttctcttgctatactttaagttttaaatatttaagcatgaatcttaagccatacattctttagtattttatctttggcctttttaggaataaaaacattaagtgtatttctttgttctttttttcttcactgttatgtttctgaaattcacccatacagtagttatgtttcatttattttcattgccatataattcaatttaaatatatgtatgtattaatgtattctttattattgaattgaggatgtttgtttttaggcccatgaaggagattgttctaattttcctttcttacaattttattttcttgttttggtgtgtgttatgttcaccttataaagtgagttggagaatatttctattttctctttctgccttgaagaaagaaattttctgttcctcaaatgtttcgttgagtttatctctaaaaccatgtaagtctggaagtctcatttgggatagttttctactgaagattcaattattttatgattacaggactaatttagattctttattataccttgagttcgtttttgtaatctcttacaagtttaatatttagtatttttactatgctttagtgccaaatatttttatttataaagctatttattctttgacattagattctattatttaaaagttttgtttttaatttacaaatgcacaggccttaagaatcaactttgttaactttattcagaatgttttactttgcagtcagagaatatagtcatttgtgatatcttttgttttaatttaagatttactttgtggttaggtatatgtatgaaatatgacttattttaatcaatgatgcatcaatggttaaaccttctgttgtgtacattattaatgtcaaccttgttcattttgttatttaatttaaattaactttttcttgtatttgtgccagttatttcttcgtatattttgactgcgttattatgctcatacatatatagaattttttttaccaaaaaattaaacctcttattaatgtatgtcttctttacctctagtaatttttgctttcatttctattttctttcatggcagttgagcaaaaataagacattttcttgttattagctcagcatgtttcttttgttattttaatatcgacctcggttcgtaggggttttagaacccttctgggttctaaactacagataattttttaaaatcacagactgaaaatatttgtattttaactggagatattagatcattttgtttttattttgattacaaattttaaaaaaatctaaactattgtttgtgcttttcatttattctttttattctcttgtattttaagattgaatgagttttgttttaacagtagtcataattattatttaatatcttttctatacagtttatacattagtggtcacagtagaaattttaacatgcagtttttttaaatcattaccctcttctcttcctctgccctcaagtaggccctgtgtctgttgttcccttctttgtgtccatatgtactcattgtttaggtcccacttacaaatgagaacatgtgtatttggttttctgttcctgtgttagtttgctaaggataatgacctccagctccatctatgttcctgcaaaggatatgatctcattttttttatgactgcatagtattccacggtgtatatgtaccacattttctttatccagtctatccttaatggacatttaggatgtttccgtgtctctgctattatgaatagtgttgtgataaacatatgcgtgcatgtgtcttttggtagaatgatttatacacttttggatgtatacccaataatggaattgctggattgaatggtaattctgctttgagttctctgagaaattggcaaactgctttccacaatggctgaactaatttacattcccactagtggtgtataagcattcccttttatctgcaacttatcaggtactgtatttattacctgggtgatgaaataatctgtacaccaaacccctgtgacatacaatttacctatataacaaacttgcacgtgtatccttaacctaaaataaaagttaaaaaaataaatattaacatgcacatttcacatacaaaaggtggacctttgaggtgattctctctctgaggtacatcctttatcatttctttaaggaaggatctatttgtgaaaagcttactcgatgattttcatctctgttttaaactgtcttcattttatcttttttctcaaaaaatatatattgaagggtatatagctctagattttacattgaggatattattctgctgttttttttaaacatctagtatgttgtctgtggccaaattgccagttatttgtttactgttctatcattttgcttgcatttaatgtattttatttccttaggattctgtagttctcttatggtgtaaatacttgtggattttttttttaatttatactgtttgacagtctctgtggtttcttaatctgaatatttgtgactttcatccattaagaaaaatctctcttcattcatctcctcaaatattttccatctcttctgtctctatatatttagacatatggcatacttaaccactctatcctccttatctcccagcttctcttgtttccatcattttgctttctgtaatattcttttaacatgtttatttctgtctttcagtgcactagtaacctgttaatttgtgtttaatttactctttatccaattcgttgaatttttacactctcttttaagaaatctgcttgtttctttttcaaattaaagtacttgtgtttgattgcttgtatgtctttaaattcctttttataatgtttctttttaaaataatataatataaacatatttactgttttatatctgataactttgagtctatagtttgtgtggtctaattcatttatttgggtattaatttttcattgcaagatttttttcttcatgttatcagtataattattttgagggctggtcaaagtatggtcctccagagaaagttatcctttatttctgccaggttcctagaggcactaccactgagaatcgctccaacttaaatttatttccttctttggatagcctgagtaacccaagttgtatgcatactggcctttcaccagcacgtagctagaaattttcaggaaaagttttcttttggccaaaagctaaagtaagcaagtattcccacttctttctctttcttcaaaacagtctgcctcaccctgaagatgctgaggttatcactttttgggagtcctggttttatgtatttatgtgggtgtatttgatttaagcttccattatattcaggacccccaaatttgactttgactcctagtatataagtgaccttagattggcacatgcctccagggaaaatgccagattcagtggtagcttgcttctatggatattctctttcttgaactttttaataagccatgcaactttggttatgcaatcaattcatttaaaacctctaagtctggtgactctttgccttttaatgaaggagagttacagtaggtgaccttctattttatggcattgctcaaatattttttcacttactttatgtatgattttcaacaaccttcaaactatatattttaggtgtgggttagttggtgatcttaatggtaaaaagaggaagtcggcataccacactttgtgaagagttctctggggacttcactgaaggggctggccccatggaagagagttccaatgcttcttcctgaaatgaagtttacttgcaactctgtcatctataaacaaattccgtatgctgatgatagctaatgtgttgcttctcccagaaaacatcttgcatattaaaaaagttactttaagataatcattcaaagaagagacttaaaatgtaaaactgccaggtagtcctgcaaaacttttatgcagagaaaatttattttatgtcactcaaattaagattacgaggtaaagccagttcatagatatcagtattgaggtagagatgccaatatgctttcatctgtggccaatagactttgacctagtttttctagaacaggtgtaggcagctttattcattcagctatctccaggaattagtgaccatagttaataggatcatcaaaaataaaccgcggtattggcacataaaagaaaacttaaaataaattgaactaaagaattaccattataatcatttcattattctttctttatagaccttgagtaaatgaaaatgcttcttttgctccataaagataagcaatttcactccccaacctgaataggatgacactgatgaacagctgtgaatgaatcaagtgcagggtaaatatacaaggcagcaaatgatttttaagctcaacagcccatgaacagtaactgtaattaaactcaataaagaacaagaaaagagaaaagatgtagggtgaaaaaaaataacaacagcaaaatagcctgtaaagattgaaggaaaccagcagagcaccagagaattgctgaagccactttgctttgtgttcatcataactgatcattttgtgtcaaatatccttttctttccccaaggaatagaaaggctaaattcatggtcaatacgtccttggatatatttactggattttggagtgtataacaaatgactaggagaaataaagcacactcaaatttttttcctctctccctctctccctccctctctctctctctttctctctctcggtatcattttaacaggcaattttctgcagttcatggaaacacaggatctgaaaatgtcttgactaggatggtttataatttcctatgtttgttcctagcttctgtgtattcaacccatttgactcggacattatttatctattgtttttctcgctggtctcattttttgtcttcttgtcattctttgtgggatgggcctgatagttcactgatgctcttataaaacctgaccgttgtattttctagatgcaacatttagagcatattgagaaatcgcaagaaatatatacacacagcagtgtgatttgttccataagagggcaaggaactagaaggttatcatgccaatttaagtagtcacgtctgtcttattaataggaaagaaaaataatcctttttttttttttttttgagacggtgtctcattctgtcacccaggctggagtgcagtggcaccatcttggctcactgcaacctctgcttcccaggttcaagctattctcctgcctcagcccccaagtagctgggattacaggcgcattccacaaggctcatctaatttttgtattttcagtagagacagggtttcgccatgttggccaggctagtctcaaactcatgacctcaggtgatccacctgcctcggcctcccaaagtgctggaaaaatcctttcatgtttctgatttctccctcaaaaagcatctttcccaatgtaaacttgatcaatttcaggaagctataatagtccagttgcaactaatgaaggatgttagaaagatgtgaacaaaaatcaaatcaatgcaatgcaaggggtgatgaccctattttgttcataagcaatgggaaataaaacctacttctctcttttgtgaagtgaatcaaataaattgaataaagccattttgaattaaccaatgataatctctttctgatgtggccatgacattaacagaaatgataaaaaaaaaaaaaagggattcaatccaaattgaaaactgcttgaaccaatgagtattttgttgtcactgaattttctgcttggcgagaggatggcactcaactttgcagtatactaagtaatcaccatagatatttgtgaaggttttgtcataattttggagacatgatgcaacaaaaagggtcagggttcttagaacccatggctctagattcaaattcccatggaatctatataactctagccattgtcatttacaatagctgagatttctgttgcaaaaataaagataatagtaactaggataattctgaaagagggtgcaagatcatatatatatatatatatatatatatatatatataaaatcatacatagactatgcaagattatatggagtttatatatagcatattatacatatagcacatatcaggaactcaataagtggtaaaaccaagccttactcccttttcctacttgcaggctaacaataaaagctaatgttaattaaatacatcttatatgccaaataattcacctttatttcacgtattgctcagcatagttattataatcattttaaatattatactactttgctttgaatttcttatgctgcattcacttttgctataaagtagcttgtccacagatgcactgctatgaagtgccagaggaattagaactcagatttgtctgattttaggacccatgttcttaaccacactaaaacttctctgcttctctaacatactgaaaagagacagaaggtttgcttcagcaaaatcactcttttcattactacacaaggtgcttacctgattcctggactccatggatgacctcctggctctaagcaaatctactgctctgtattagttttttattattgtctaacaacttaccacaaaactgcatgccttaaaataacacatatttaccatttcacagattctgtcctccaagaatcttggcctggcttatttgtgtccttggctttataatttttcagaatcccaaaatcaaggcattggctcagggtctgcagtctcatctgaagactcaactgggaaagaatctgtttccaagcttacttattgcttgttggcagcattaagttcctagttagctaatggactgagggcctcagatcctcattagctgttggtgagaagctactgttatgaactgaattgtgtccccttacatttatatgttgaaggcctaaccctcaaggtaactgtatttgaaatagggcctttaaggaagtaattaaggttaaatgagataataaaggtagaaatctaatcaaataggactggagttcttaaaaggaggggaaggccagagatatatttctctccatgtgcacaccaatgagaggctatataagggcaaaggccatatgcccatctgcaacccaaggagagaggcttcaccagaaaccaactctacagacaccttgatcttggacttctggtttccagacctgtaagaaaataaatttctgttatttaatctacccagtctgtggtattctgttatggcagcctgagaagactaacacagcttcccttagctttctgccatgtagacctctccaacatggcagttggcttcattaaagcatgccagctgagaaagcaatagtgaatctgttagcaagacagaagtcataatattggaaaccaataacagaagtgacatctcctccaggttatctcattctgttggttaaaagcaagttaatcaaaaggagatttcacaagcctgggaataccaggaggtaaagatcatttgggccaccttagaagctgcctaccacactccctgactcttaagaggcatgcatgaacttgtttctcactttggacctcatggttaatggtaacgcttgagtgctaactaggtttcctgtccatctgattatgctattactcggtctttgtttgattatttggaattactttgtgaggttatagggatacccttcccagcagtctcttccttgagttcaaatgcaaagcaaaatagagttctgtctaccaagaggattccttttcacccatcttacacattttcctgcttgagggcttgaacttggaaaagcaatgtttaaacatgtctttcatctcctctttttcttaactttctcttttttttctccacaatctgtcaggactggaaatagcttatcctcagttttcttcctgtttggaaaagaattccactctgtaaagctgtacggtcatgttgacaagggttaccactttatattttaaataaaagaaagatgataagaacatgaatgcaaactatttttatagacaaactctagtttgcacggttgactttctggagactttaaaatttaatagtagttggaaaaaaagaatcttaactgtagtcatgctgtaattgctgtagtaccctcctggcacttccctaacccctggccttgaagtagaaccatgccttggggcaataaagaaaaaaatatgtataaggaaatataaagagtaaaaagcacataaatattttaaaaatattatttgttgcaagggtttttttttttaagtagagaaggacgaaaagatttataacctaaagaatttgtctaattattctttgtacacaaagcttttctctaacaaaactggtatatgtgcaaggcacagtttggagcaaagccaaagcactcgaattctggcaatatagcagtacatctgttcccaggctaatagaaagacttgtgaaatcataatttcatatttgaatcaatcacagtttcttaatcagtgattaggaaaaggagtgtcaggattttagtgacactatttcagaaagtgtcagagtacatggcctttcaggccacatggatatgagccagaaccaccagggtgcccattacctaaaacattaacagtcactttggaagcacagatgctggggcacctgaccaactcaaactgcattgcctttgtgtctgctttcttatagagacagaggcagactatgcatgcattggcctgcagtctcagagggagttggaagatttttttgccaagaaacagaatcgaaatgaaaattatatcttagaaaggtctttggaggatttatattaggaacctgatcttttcactatctactaagtttataatctcattacctgactcaaagcatccagcattttgttgaacctctggagcacaattaggaaatgtcccttggggcctgagttattagtgaccatgacatacagatctgtgcaacaaagatcagaaattatgaatctagttatactatagcatgggaacgtcacatatattattattctgtgtttgcatccatgattgcaaaactcaataaaatagaattgtctttcctaggatttcaagaacacatctgtgtgctatttcagactgtgccaactatgtcatacacacatgcatttttttcaaccattcaagattcaacagaaatttactgagtagttactacattttaggaactattgagggtagcaaaaacttaggtgcattatgtactggatggtgattccagcataacaataatagagattttcttcttcttccttcaaaacacgatttcctacaaggtaagttcattaaaccttgagcaaattatttgccaagaaagaaaagaagacctctaataatggaatattttctagtagcagagtttataaaattatataatgttagttaacgaggcagatatttctacaaaaaattatctgatcttacaacatcttagaattggaaaagattttaaaaaccatttagtttatctctttagaaggcagaattcagtagactatatgaaattcaatgagaaggattaggcttattttgtttagtttcaaggtattcatttggcccagaattgacacagttgaaacaaaatcatctttgatctattatttcccatccaaaagtattttcctctatgcccacaaaaaaagattagaaggtaggagggaaaaaagcaatacaatggggcaaagtaagacctcacctgatataacaacatacaaaggaaagacattttggcaaatgttatccaaagatagccatcatcagtccctttccttcttatgtgcacatgttgcctttcacataaaagggcatattaaaaggtgtatccccttcccatagatggagagtaggcttagtgacttgcttgaataatagatcttggtgaaaatgatgtctgggacttcccaggtcaagtcatgagatgctttaaaacttctgctttgttggcaagctcttggaagacttgctcatggattctagctcaggccaggtgcagtggctcacatctgtaatcagcactttgggaggccgaggtgggcagatcacctgaagtcaggagtctgagaccagcctggtcaacatgacaaaaccccatctccactaaaaaaaaaaaaaaaaaaggattcttgctcttgaaattcaaacaccatgcttgcagaagaagcccaagtcacatatagagagcatgtgtacttttcatacttaagtgcctaactaaacatccaaacagcagccaacatcaactaggtcagttttcaggtaattccagtaccagcatcatttgacaaacaccacatgaaatatcccaagcaagaaatgctacattgaggccagtcaacccagagaacctcagaatataatgagatgttgttttaagccactaaattttgatgttgttatgtagtcccagctgtgtacattctaggcctaatcaataacttaggattaaatcagaaggtttagtccttctcatggagtctcacagaatctattgaacattgctctccgagaagctaaactaggtgattcttaaagtctctttcaactctaagattcttttaataaatatgattttctgtagaaatattataatatcagaataaatgaccactggtcttgaggtttagatttgttgccgaggtgtcaaatgtttaaaaatgtaattaattgtaattgaaaaccttttctcaaatttaacaaaatatttctaataaatataaataccccaacactctgcctagaccccaaacaccataccatgtatcatttatgtacagcaagaatatgaaatcatggtttctagtataatgaaaggcaaatttggacattgagcaaaattattgtatgtagtcaacagtttttattcattttccctttcctataaagcccagaattctgaaagccagaatatcagtgttttatatctctgtagctcttgactcaccatcttctttattctgacatacttgcttcttactgtttttaaagaaagcagcatatataggatactttgtattcagagctggattaaaatctcagttgtgaaacacagttgtatgatttttaagtaaaatgctttttaaacttcttttgacatcatggttttcatctacagtaggaattaaaaattctgtctccaatgcattttgttaattctgatttttagtttgttatcaataaagctgtttatcatcttataaaaagtgagcattatggtaagactatggagtgaatgagactgccaatccaactggaaataacatgatctttttaatgtatccctcaaagactccatctcattatattatcacttgtcactgatgtcttgctaaattttcttcgctttacctacttgtctttctcttcatagcattctgcccaaattctagaatcagctagcattactggctgaattaataaccattttaccttctgaaagctttgcctatgattattttttccacctctatgttatcgggaatttatatgttgcttaggccagaataggtgctcaatgagtatttttagaataagtgaatgagatgcaagtgtgatagagacatgactaaatgacctatttgttactcattgtgaattagatgagataatttattaaataattccggttctaattctagcacatagttgaagatgtcagaaggtattcgtttccttattgactctttagttccttttaaatgaatgctgttgtttctatttaagaaattacagcaataaagaaaaagttttgggaaaaagagacttcctggtacttctaaaatataccatctggggagtcacctaatttcttatgggatggaaaaaacttctcacagggcaacagtgtttagttttctaggcaaaatgattctgtgaatacagtattctatgattccgtatcccttttgccacttttgcttgcattcactggtaatcttcagaatagtgagtattgttcaaattctagaatatttttcctcaggaaaagacaacaattatataacagcatggcattcccaatttttggaataaaatactgaaaaataatttaaactgcatcttcttagcgtagttattccattttaatttctattatcaggatacttgaagaacttcactgtgagatcaagctggtattgtgggtggttgttggaggccgaaagagcgagggttgtgatcaacttggtgtaccactggaggctatatgaataaacagcaaactgtttgtcataaatgcagaatgctggcaaactgacaaactgcatctgccacccagaaggaatgctgagggcagtcacacccccaagcgcagtgtttcttgcaattaggtacatctgaagccttttagtaataatatgaacctgttatcaattaagcagctgaccaatcattacctcctcctccctgctcttgctacccaataaacagaaagggctgtggaagctcaggggctgcttttgatcactagaagcagggagctctcttcttcttgcccggttccccctccctttaaaacagtttcttttgtcttaagttttcatttctatgttcgtccctttgttcagtctcgtagtgacctagtcacagtctcaagtagtaacaataataactgtcgtaatgtcatctcaagtagtaacagtagtaactgtcacagtgatggtctcaaatagtaactcttgcagtgaagatctcaagtaaccgtggcagtctgccacaggtggtggttaagatcttttgtttttaggcacagagatttcggcaggagatggtctttctttcttgttctctctctccctctctctttttttttcagccatagtttgtttctggtagaatctttgccttcagagaaattgtgttcccccataccagagttccatctcaaaaaaattagattcaactgtgcttctggaatctttgccaaagacacagaaagatttttgttagctagtgtcttttggatttagatcttctcctttgacttttaaattttctcctttgattcactactgtccttgcacagctttggaaatgatccaaggtagcttgcaaaagtgcaaaaaaaaatgataaactgaatgattatatgtaactttgccgtttttcctttcatagcaccattaaagactcagacacggggaattcagtgggacttgctgggaaaaatatgctatttcctatgtttggcaactaatactggttggtcatttttgttagcacatatttagcctgatagcagtttatagacagaaatgggatgggcacacatgtccttgctgttttagcagatccacccaataagcctacttatgatacaacactcagcactttcaggatttttctcttagactttgtcttaatatattattgatgaatttgaggcaatcatttcacaagcttgtactagataagaattctgtcatctaggaagagactctttgaagaaatcggccctagaatatttattttacaacacagaaaaactctaaatattagcattatgtttaatgttcctttgcagcctctaatcccttgagccagcttactcccataaacagctgtagggaagtctagatgagactggtatacaatgaattttagaaaaagaattgtacagacccccctccaaagaaaacaaatattattcatgtagaacaggactgctgttcaataaagattactgaagcagaaaataagcaaggactcagcattttttgaaactagctgatatgtgtactgtatgctttcattatcacaaagaaagagaaaaggttatttccatttttgcagagtactaacctctttacctctggcccacatcaagcttggaaaatagaaaaatcaatttataaagataaacataaacccttttatcttttctctattgggctgagccagtgagatggaatgaatagcattatatatatacatatatgtgtgtgtgtatatatatatatacacacatatatatatacacacacatatatatacacatacacacacacacacaaacacacactatccttaagttacacaatgtgtacatgaattttctatctaacttaaaatgcatgtatgtcagaaatatacatgtaagactgatatatgaccatgtctataaaattcatactttgtaatgtttataaactaacatctatctggaatgttgtcggtaaacatcaccattttttcttggcaacatgttgcatttctgcccctggaactctacaggcatgacaacactttctgaaaagcaatgagaaatgcacacgtgaaagtgctataaacctggcagatcaaataaagacaataaaactaatgcgaaggtgctagaaaggtaactgggttttgagttttctgtattttcccttccacaaaagagtcagcgtactgtattctaagatgctttgaattgaagcacagcatttttctttcctttctggataaactgtgattgccattttcttttttctaaatcaaacctttcttaggctcatttgaaaaatttgttctggcaagaactgcctcccttttcaataatagggggcaacatttttatagagctttccacggcctctgcatgagtaaaattttttgtaaaaatatttttatgaaagtatataaaatacacaaagggaagaaatatacctcttgatgacagagagaagagtaaaggagagactgtggactctttttctttgctcactctgcaaagttaagtaggtcctgctcgcacacaaatagctaaataaatgaaatattttcctttacatactcccattatttatcagggtattgcatacagaagtaacactgcaagtagccaatatacgatacaactcaggaaacactgaaatctccacatatgtgtaagttaatccatctgaccctataacttaaggctaaggagaacattggcttttgtctgcataagaaaagaaatattggagagcatatgaattatggttctatctgtgtgtcttacccttcccaataaacagatatttactgaacatttatgtgccaggcagtgtgttaagtgtggtgatcacaatagtgagtagaaggaatttgatctttgctttcaggaagcttacaaacaatgatagtatcttactttgagggattataaccctattagaactctaacaggcaacaaaaagtggaaagattttataattttaatgtgcactcatgtcaacttacagcttgtcaaagataaatgaagctgaacactagtaagaacagattttaatcagtaataactattgcagtagggaaatgagtccagcatgaactgaactcaactttgacttgtatagaggtaaatgcatatcttgaaaggaaaattaaggagtagaaagtgggtcgagtaggggcttagcagagttagggaagtgaaaaatgacacaggatcgatcagtgtagatgccattagaaaagcaatatctaccagctggcaataatcaaggacaggattcatcttttcacaaagaatggaacacagaggccccagtcggcatcctcaagtgttggctagaacaaacagtaaaaattttttggcagccttgagttttcttagcaggcaatttaagggtggttactaggatcgtattagggaggtggtcttgagctgttagaaactgtgttagggtttactcgagtctttgtaggccaaagttgaggcttagttgagaagagggctcaaagaagtctggctggagtttggtcaaggagagaatctttgtcaaactttgcgtgtaagagagggcacctttctcagttttcagctgaacaaaagtagataaattagcacctctctgagtcccagttttctcatctgtacagaaaggctagtggtatctacctagaggattattctgaggaaaatgtcatcatgtatttgaaaatttaggattatttcttgatggaaaaatttgtggatgttttatgtatttccctgcctttctgctctgccagtggtagtctgtagggcatttttccttttaagcataaccaaaggcagaaacaaatactcaagaaaacatttgccctaaggtctaaataaaaagaaatgaatgtaaggttgcaaagtaagtttttctatctcaaaggctacataacaatgagcctgagagaaggagaagacaagatgaatgtctctgagtgatctgactccttcatgagggaagggtgaaaataatcttttgtcagaaggctaagggaaaaacatggaaggaacgcagggctcctgagctatcctccaatatgggatgcttcctccatttcccgcagacaacactaccatgcacctgtcttagatgcctgtgaattccctttaactgagggtggcagaatgaaatgttttgttttgttttgttttgaaaaatgaagacatgaaaagaaaagaactctcatctcttaaccaagacagaatttagaatttctatataaactgaggcaataaggccatacaacaaatgttataactaaattactgaatacatagtaaaatataattaatgtgttaatattgtttcagactagtgtgtttctctgcttccccacccctaactcagtcaacattctgtgcacttgtttaccccaatccttcacaagtcaagtatgaccaggagcacagttcgcaaatatgctgcttgttcttccctgttgaggacatctgccatgtttgctcttcactgtggcagcaatgttctcacatgaatgggccacagcatgggtgagccatttggtgcttcccttctcagtgatcatggaggtatgtggaacattcaatttagcagtagccatccctgcctcttacagagactgctaacatgaacagatggacctttctacaacccaggtggccgccctatacagatacagcttaaaagaattcttcttggaaatggttgtgccttgctttctgtgaaactcagtttcaggtgggaaactgcttcaatccaaaagacaaaaccttccaaaagcactggtatctagtcacattgatttctcttttttctgaggacagaaccaccatctgttttatgtcacaagtatcatatgagagaaaagagtatacaaaaggaaaaaatatgtatctatatatatacatacaaacacacagtctatttatgcgtagtttaaatacccagaggtttcagtcgtcatcaaaatactgttatttgccattctctttgattcggcctctgttttacgaagcgcctttagaaatttgtgctcatttgaaaagtcttattcttatgaggtctaagcttaaatatcttgtgtttcttccttaaagagagacaagggtggggaagagagttacaacgttcaatcaagaaatatttcgtagacaaaaatatttcaaaaaaaattcagactttggactcctcagcatgggttggtccgaataaagcacaaagcttttgtttgcttctatttgccaactcacataaggacttggtaatgacattctttcaaacccatctggtgatttagccaggactgttgaaaagcttcagttaaaattctgaagaagagatataaactgtgctgtcataggacactgtcagctagttcctttttttttttctgcacacttttgggcagaacttatataataaaacttggtagaaaacagttctttaaaaagtagctttattattgcttaaactggataatctcactttctgtcttttgctttcaggtcttattccagccctaaaacagacttgtagagcttagattagtcctttcagagataaaattaaatgtagggcagggctggaattgtatatacaaataatgttatgggattctgtaattgagcttcctctgagtttcatcttaaaacagaagaaataacataatagtccaataaaacaaatgataaagaatgagctacagtgcttttctctccaaacttccagattggagaacccatagtgctggtatagttgttaatctggccgtgttccacaccagctttgggactttggaaatatcaattcttcttcctagtctttattgttgaattatgtgattcataaagttcataaatatgaggaaggaatttaagtaacgcaatacttagaggaaaaaaaaatcagttgatcctgaaatctgaagatcttagctcttcaagtcataagtttaagattgacaccagtatggagaaggatctctcaggttaacaaatttaaatggatattaaaattttaatttttacttaaagaatcatttttttactacaaaactttcattctccaatactctccatacttttggatgatttttacttttactttaagatcaattattggatgtctataatttatttcttttcaactaggctgataattctttgagatcagaaggcaaagcacatttatctttatattctcagcaagtagtactgtacaacagggcctctgtatctgtgggttctgcatccatggattcacccaaacatagattgaaaatatttggaaacaaaaggatgattgtgtccgaacagaacatgtacagactcgttttcttctttttattattccttaaacaatacaacaattattgacatagcacttttattgtattaggcattataagtaatctagagataaagcgtattggaggatgtgcataggctgtatgcgaatactataccactttatatcagggacttgagcatctgcaaattttgttttctgcagggggtcctgaaaccaatccttcgtggatacccagggacaattctatctggtaggtagtaagggcacaatatttatttaattcaaccatccacagatgtttgtggaaacaatttgttcacaagacgtagtgggaataaaggcaatgcaagacagaggccatccttaaaataacttacagaataaaacacagcaagattttattaaaataccatgaaacaattatctgaacctgtttatggttttggcattttcattgttcttctgactctgtccttatttagatcttcttttaatatttaataatgctacatgtgctgttcatgagatagccttttggtgttcccttttttctattatttactgcatctctatgctttcatgaaccagtttcttcataccacttcctttgtgccatcttgacttgtccctgacttgccatactttattaactcccttctttatgctttttcatttatctacttgtctattcttctctccttatctctatttctctccacatccctcctcacaccaaatattgcattttgaaaactatttctgaaattatttctttgtgtaagaaaatcagcagttaaaccaaacactagatgttaaggaaaatgcattaatcatagtaacctctttgttagattgaaggcttcacgaataactgttctacctgagtaatttagtaaggtaattagaagtctctgggtttaagatttcagattgccacttcattttccatttcctgataccctttgttcatctctgctagtctgctgcttccggccacctgctccagttttataaagcctacatcttctactcctttcaggtgcatacatttctgatttctaaacaagtaactcttttttcttattttcataatcataactttttcagatttatgtccttgcaatggactgaattgtgtccagtccacaaattcatatattgaaggcttaacccacaatttgacttagtatttggagatagggccgttaggagataattttgatgaaatgaggtcacaagagtggggtcctaatccacataaaaagacccttataaaaagaggaagagacatcagagctctctttctctgccatatggggacacaagaagtcgactatctgcaatccagaagagccctcaacagaaactgacccttggatttgccagaccaagaaactatgagaaaatatatttctgttgtttaagttatccagtagatggtattttgttattgcagcctgagctgaccagtgcagttattttttctgaattttctgactaactactttgtaatttgtatctctttggaataaggttgttgtggcactttcccctcattttaaaaatatttgaaaattaattctcatctggagattagttgcccttgagtaagtttattgccctttctctgatgcagaggttggaggctatattaatatgcagagtccttagttcacttacagtatgtcatcacttgtgctactcaatttaatttcatctgaaatgaaattggtgaatatccttccaaactctcgtgaaacaattttagcggagatgaattaagttgagtaacatacacacaacagagttactgagataggacacagaaaggacaacagtctggccttcccacagagacaataattgactttcaaagtaggttcctgtatttctcttttcgtaagttcctcctgagtattttaatggataattggttgcaaatgataatagtaatgagtcttagtctatttgtgttcctatagaagaatatcacaggctgggtaatttataaagaaaaaagatttatttggctcagggttctgcagattctacaagaagcatggcatcagcatctgcctctggtgaggggttcaggctgcttccactcatggcggaaggtgaagggaatctggtctgtgtagagatcacatgataagagagaaagcaaaagagagagggaggaggtgccaggctcattttaacaaccagctgtcatgggaacgaatagaatgagaactccgtcattaccacgaggactgcaccaagtcactcatgacagatccacctccatgaccgaaacatttcccattaggtctcacctgctacattggggatcaaatttcaacatgaagtttgcaggacaaacatccaaactatggcaacaagttaatattcattggtgcttattatttgacaagcactgttaaatgctttaaaagcagtacaatatacaattcttctaataattcgatgtgagccacattgataatattattactagtcccattttataaatgaggaaggtgagccataaaaaggttttgtaattttctctaactcacacaattaacaaatgacagagctgggatttgaccctcatgagtctgactccagagtctatcattttaatcactgtcttaaatagcgaacaattttcacttaatgccagcttaaacaaaatatttcaatcaggtataatgctactatagaccttttctccgtgtttcatggtaaaatataaaatataacaagcggctgttttgacataaacaataaatacatcttcaattgatgctgttaaggttagaagtgcacaagaagaaactaaagctgccaagtcacaactagctaagctgccacaggtttctttcaaaggaacaagccagtttgtccacagtgctagtttttctggcataatgattgactgctagatgccagcattaaaacaggctgaggagaatggtgtgagtttttactgatatcattcttctccattccaaggagggcaatctcttttcctttgaaagacaatgcaaagcttccactcatttctatgtcctatttccaatttactttcaatgtctctgttgattgaaaaagtaaacataatctttgaagtttagtaagtgtaattttgtttctttcactgtgaagtgtttcctaatgaaagcagaaagaatataagttttgcatctttcagaaaatgcaactttccaaacttggaacagctttcttacaaagctacgtacttccttccagattactttcccttctattatttctttgcagaaaagaaaaaaattattttcacagaaatttctgtttgattacaatttgctgatcacattgtatttgccaaatgcagtgctaaatggatgaggcactggttttcagtgaatcacagccagtttgaactttacttccatcacttcctagttgaaagctcttggatattttacctaatctctctctgaacctgtgatttatcatttctaaaatggactgaaagaccttcttttaagtttgctgccaaatgaaacaagatatgggtaaagatctgggcacatagcaggaattcagtaaatgtcatttatttttctccgccctcccatgccctatgctattgagatattttacggtaaaaaatacaaaattgtctaatgttaacatgtgaaaaataaatgatgattctcatttagtcagaccagaaagatatatattcaaaacaaatgagttttctacaaaattgcaattaggaaatattcattctctctgcacatttgaccaaaaaagtagccattcccattatatacataaaatgtaaaaatatacatgttagtataagaattgcaaaattggcttttaaaaagctgagctaaagcaattttttcactgactatataaagacacatttcatccagaagagttacataaggcaagcaccattttctggttgtatacccaaagcaatttctcttctttttcttctcaagaaaatttttctgttttccctgctgctgtagcctagctgcaatgttttaatagcccattcagttcttagaggatttcatcatattccagttgacaccagctgttctgaggagtcctaagggctcactttgattcccaatacataacctgagttcggcaagtctagtttaacattgtccacatcaatgtaagaattaaaaggaatctgagggtgttaaatcaaaaatagttttcacttaggcaaggagctgaagatgaaatgaaggctaaagggttgtatgcttttccagaagatcagtgaatcccacaacagagcacttgtgtcacatagaatccttatcgagcaagttatctacccaaggggaaaagtgctacaagtttccattaggaagattcatttgctatttgttaagttgctggaattttcagccttctcagtgaaacttttagctggttaaatacatggcatactggaaaaagctgaaaaaaagtaaggctcaaaatttctagttaagttttttaacctctcctctcactcataatgttattttgactcagttttctcatctgtaaactggccaaactaaaatcagtccttcctactatagccctatgagtatcaaaagagatagtaaatgagataaagaatgtgaatgagttaaaagagttgtaaggtattttacaaatatgggttgtacaatggttttcatacaataacgtaagttttgcattcaggtaaatgtggaggagaaaaaaaaatctatgcctgaggaataagtgtgtgagaaaaataatataaggtacattaagagtgtgatgaatagaagagtgtatgtcaatgtatacatggaagagatgaagttaatcagtaacgtcaagactggactttgaggtatctgaatgctagatgagataactggattctatactgtagatgacagggtatcatgcagtgcttttgagcaaagaataggaagactaaaacttggtaatgaaactgtggaagcttagaagattgatgacagggagtaagcctggctccagagttcaggtggtaaataatagtaatcattcagggatagataaatgatgatttatattatgattttggtactaaggatgaaaagaggtaggtgagatatattctaaaagaaaaccatcccatgttttggtcaactttgaactaggagcctatacatcctgttcaccactgtatttcaatacctcaatcaatactcaacacatctgtactcaatgactaataatgaatggttgtttaataatgaattagaatggaagtgaggacatgaagagaacaaaagaagatcctgagatgctcatcttgagtgatccagaaaaatagtggtataactgataatctgtacagttagtcagtaattttgaaagagaaactagctttaggaaaaggacagttcaatattatgcacaattacagtttgcatatcaataagacatcaagatagagctgttaagaaagtggttgaaggtgccaaatagaagaggcctgagagagaaatttgagatttgagatgtaaagaacatttggtgagatgatagatggagtccacaaaaatcttttccagatgcttggaattcacacacatgtactcacacagaaggttggcagagatctttaagtaacttgaataaaactagttcctgctcctgccctagacctacctagatcttgtgaaaatgccttgaaaagaaatgcagtgctgacctcagactttcttgaggagatgatcaaaggggattacatttgtctacggataatagaacttcctcaaaaacttgttttcatccatctctttcccaagccccgcatagcccaatcatagttccagtttctttcccctttctcatatgctcttctcctgacaacattttcagttctgaggccttttctctttttctccttccctactgccccctcccaaactctatgactcttctttagtttttcagcattacaaagaatagcaccaagtttggtgccacaaaggatcctttttctttatacaaatgaaagagtgagagagttgtaaatatttacagttcaatactgtttttcttgtcatgatttaaaattctacagtggcactttgaccctgctctatgctgtggtaagaacaaaaagaaaacaatgcgaagaccattcaaagttcagagctttctcaagaaaaatggctttgttttgaagccaaagcatcatgcatgatgttctttagtaaaacacaaataatatgaccgctttatcttcaagaactctttcttaatctcacctctagtttctgaaattctggaattaacatctaatgttgtaatggctacaggtaatgctattattttctgcctcaattcaaacccatacccgacagctccaactcttcaagatagctaatgattatgacaagtgaataaatatcaataaatcaataaaatataagcaatacataaattattagggacttttttgagggactcacttttcattgtttggagctaccagggtctggtgctaagaagttcattgtcaccccagagtcactgtcaccccagagtcattgtcaccccagagtcattgtcaccccagagacactgtcaccccagagtcattgtcaccccagagacactgtcaccccagagtcactgtcaccccagagacactgtcaccccagactgtcaccccagactcactgtcaccccagagtcactgtcaccccagagtcattgtcaccccagagtcattgtcacctcagagtcattgtcaccccagagtcattgtcaccccagagtcattgtcacctcagtcattgtcaccccagagtcattgtcaccccagagtcattgtcaccccagagacattgtcaccccagagtcattgtcaccccagagacactgtcaccccagagtcattgtcaccccagagtcattgtcaccccagagacattgtcaccccagagacactgtcaccccagactcactgtcaccccagagtcattgtcaccccagacattgtcaccccagagacactgtcaccccaaactcactgtcaccccagtcattgtcaccccagagtcattgtcaccccagactcactgtcaccccagtcattgtcaccccagagtcattgtcaccccagagacattgtcaccccagagtcattgtcaccccacagacattgtcaccccacagacattgtcaccccagagacattgtcacgccagagtcattgtcaccccagagacactgtcaccccagagtcattgtcaccccagagtcactgtcaccccagagtcactgtcaccccagagtcactgtcacccaagtcattgtcaccccagagtcattgtcaccccagagacattgtcaccccagagacattgtcaccccagagtcattgtcaccccagagacactgtcaccccagagtcactgtcaccccagagtcactgtcaccccagagacactgtcaccccagagtcactgtcaccccagagtcactgtcaccccagagacatggtcaccccagagtcattgtcaccccagagacattgtcaccccagagtcattgtcatcccagagacattgtcaccccagagtcactgtcaccccagagtcactgtcacctcagtcattgtcaccccagagtcattgtcaccccagagtcattgtcaccccagagtcagtcattgtcaccccagagtcattgtcaccccagagtcattgtcaccccagagtctttgtcacctcagagtcattgtcaccccagagtcattgtcaccccagagtcactgtcaccccagaggagtcattgtcaccccagagtcagtcattgtcaccccagagtcattgtcaccccagagttgttcattgtcaccccagagtcattgtcaccccagagtcattgtcaccccagagtcagtcattgtcaccccagagtcattgtcaccccagagtcattcattgtcaccccagagtcattgtcacccgagtcattgtcagctcagagtcattgtcaccccagagtcattgtcaccccagagtcattgtcaccccattgtcaccccagagtcattgtcacctcagagtcattgtcactccagagtcattgtcacctcagagtcaatgtcaccccagagtcatcgtcaccccagagacattgtcaccccagagtcattgtcaccccagagacattgtcaccccagagtcattgtcaccccagagtcagtgctttgacctttgattcaggagttcttcccttcctccctccctcccttattcccttccttccttccttccttcctctttctttccctctctctctcattcttccttcaatgttatcattgtcatttgcggtctgaaatttccttttaaaaataaaagtaagtgcatataataaaatgtatagtattataaaagaaaatcaattctatttaaatacagttataaaaatattttaacagcttgtcatatactaacatatatacttctttattagcacattaaataagatttagcagtgggtatgaaaatataattttgaagtcagcaatgtaatattttgagatacctacaatgattgtaaagtaataggaaacatttgtgactttaattgatgacaaagacaaagatactcttttactccaatgttattatttttgccaatatttataattacaggacatgctatatattgaatataggttattaaaaatttggatacatttttctcccatttaaattgatgagttagatgcaaagaatcacagagactgcaggataagaatcctactaggttttatttcttggctactttctcaaagctggggactagagcattgacaactacagtattatcaagaatgatgggatgcttgttgagtgagaccttgacagaagctatcataagctaggacctatgtctgctagtcatttaaattatttctatggtaacaaatgacgggtagtgagatcaatacttctactttgatcatactgatttttttttttttttttggtttgtgtaatctggaaaggagacaataagatgtttaagactgggactatttctttagcagctttagactgacatatgtttatttcatcttacccagcaaaactgttgaaataaattatgaggcacaagaagtgctgagtgattttggtgcaacatggcaaactgaggcaactggttattgtgaattgcacataggtgggcttgaatcatggctttctgtatcctttggaaaattgctttacacctctcaatgtatcatagtttttaatttctggactagagacaatattcacttgctaaggttgacaaatatctaaaattctacctagagtttgtagcatagtgctcagtacttaaaaggcactgatgtattattattattgttcaagtttatacaactagttacctaacaaacacttatgagttctcactgtgtgtcaatcactatgccaaacatcagattacttcattgtctcaacaaacttgtgaaataaaatctataattatcattcaattgcatatgagtagtttgagatttctagatgtaaaataatttgcttaaatttaagctgcatacatttaagagtcatagaaactggaagccatcttccccaaggtgagtcatagaaccagatttccttttccccaaagccagtcataaaatcttaaaatattactctttttctctgccctatttgtgtaaaaactgtctataaagaaaatatttgacctactttgtttgactacagctcatacgaccctcattccagagagggtgctgctccacactcagaaggaaggaatgccacaaagagaggccaagaagaatctagacagataagccttgctgggttttcctattcagtccattagtattagatgatacactttttgtccaatcatatttctaaatggctttccatacttcactgaacctaagcataagaacggagagtgtctcctatacgtctgggtcttcattctgaaggctgccatatatacatgttacataagtttgtatgccttttctccagttaatctgcctttcacaactttacttgtcagtaaatcttcagagggccaaacataagctctctgttgacccctacagagcccatgttcttagattccaacttccattccctattcccacacagacacataaaatatatcttaccagctacatttgtggcaggtcatttgtgtcacaaggtgacagaattggaaattcttctcttaatgcaccatagtttaagtctttataagttccaacactatactccaaaagcacttatttcaatataagattattctgtatttgaacttcctcttttgtgcttatgttaatggcagtcttttatttatttatttatttttgtaatttagttttgaagctcatcccacaaatgaattccatttcctaaaaatgtatgaacaggctgttcttttggctattgacattccattttggatttcacaaaaggctttaaacacaatcacttttacaagcctgtgatgcaaagcaagtgcctgcctaatgttattaagcagccaaagggcaggtaaattggctctgttttctaaaaatgactttcatttctatctagaacatgattgcacattgtcatatagcacaacgaatagtcaagcactgaaaagataagctttaaaatagaatataaattcttaaaccagaaaggccatggttttgtaaaaaataaaaataaaaaagtacctgtctgaagcatctttctagcacagcactgaaaagaactttgcatgtctctcaggcgttttccactttttaaagctaggttaattgcagtgttacttttatttaacaatttcctttgagtagatttttgagcttaaaaaatagtgactgatctgggaaatgaaaaactatgacaaagaaagctcggctagagctagaggccataaatgttgttcaatagaatctttcatattttacacaacctataattgatgagtgataaaaatcaagaaaggttcttacaatggtacaaagtcactattttaaaaaatagctaaaacctattgctatttttaaaaatcctagttctttatattctatgagaaaactactatgattccacagcttcagaaagaaaacctattcattaatcacaaagccaaatgttttagaggaatgtagaaaaaatgtagtttttaacaaagactttaaaaattacaattatttcccttgactgttatttatcaaaccaaaatggcaatgcaatttaacagattttaaaattattttagaagctaaaatggacatattcatgattcaaatggttacattacttgtggctatagtgtactagagaaaagtcattgggaataatcaggataatcaaataatataaaatttgatttattgatcgttttgtcagttcagtgagtacaaccagtacatttattaatgaacatcctaagaaagggtcactgggcctgggaaaagcttctgttcatttttgcatttgtttgtttaatctgttttgatatttgatagagtcctagagaaaactagataacttccagtctcctcaaagttggggaaaatctgtgtgatgtcccttgtctaccacatcttagtctgccagttgctctaatggttgtcaaaaaacagtttgaggtatctacgtctcagtcctggcaggactgggggtaaccttcttatcatgagctgagaaaataactcattcatttatgtacttattcattcaaaaaataatcatggggcaacttctgtgtgtttgcttttctggaacttcgtagtatgggagaatggcaaacagaattaatcaaaaagtaaaataaagtataaagcaaaaatttcaacaaggactataaagatagatgaatgatgctattgaagtatggaggactgacttggaggacagcctcaattcactctcagctcctatatccatgcactttgggatgtatctttgcagctcttcctaataagaggtaaatttatttatacactctgaatctgtgcagaccttgtgactttctttggccaacagaaagtgacagaagtgacatcacaacagttctgaacctagacctcaagaggcctgtgagtttcctctttctgttcctctgccctcatcatgagaacatgcctaggacacctctactggataaaagagatatgtagaacaaggtggagtcagcccagttgtcccaacaaaggctctgacacacgagagaactcagagaagatcagcaaaactgcttaggtaactcacagctgaccacagatacataaatgtgtccagccaagctcctctctggtcagtagaatgtgccactgaggttccattattgtttcttatgcagctctagtatgcaaatacataacagactttggaatatttgttgagttcaggcacagctttactggggaaggtattcttcattcttatgtaaagaacgtttttagaaagactgaagattaacaaagaaaatgaaaggagaaaagaacattgaaggtagataaaaacagaggtaaaaaaaactattggcaacatttataaggaggctggggtggcaggcagaaaagttggaggtgaaggttgcagttgtaagacttcgtaaaccattttgaattattttgtctttaatctgaaaataatgaaaagactttgaagggttttaagcagagacagaacatgagtaagatgcatttggctacaaggacagaacattggtaaaagaatggcttcccaggagaaaacaagaagaaagtggtgggttatttttagtttaggacagtgaatcaagtcatcagcctaaacttaaatcatcatcataagtttatgatgggtcttcatatctttgtcctaaattaccttcagtccaccttgtgaggctgcatggtatagttaaaaaaacaacaacataggttatggagttaaacataactgagttttacttctgcctcctcccagttatgagctttacttctttagtttgcttgaaaaagtaaaattccccctttccagcatacctctacatggatcctccaaattgctaatttatttattcattcatgatcactctctgtctcctatctgtgctccttttgcctcccagataatgtaatattttattcttttgtaaactataaagtatacaaaggcattagttttaattaccttggctcgagccacacctcctctataaagccattcctgattattcccaatgacttttctctagtacactatagcttgttcctaccatctaattagcgctttaaagtgatggtcagcaaggatgcttgtggctgcaaatatcaaataactttattaaagttacttaagtaatgcagtctttttaatatctcttaaggacaacatggaagtagatagattcaggctggatcaatgccttcaaagctttaagttaatatctctgttatcttcatgaccttgtcttttgggttgcaaaatgtctgaaacttcctctgaggttctgttggccaaaattgggtcatatgcaaaacccacagatcaatatttggcaaaggaaaatggaatttcccagactggcttcgtttctccattactcaacttctcagctagacattgaaggtatgttggaagtaaatgactattgggtacgcagccaacagtgactgctgctcgtggcttaatgatcattcatgttctgattcatctacctgggtgcttctctagatttttaacatccagataaggcaatttcccacagctctctgaacatacgctgatttctttccctgtaccttagcacatgcaattttttcatgtggaatgccaacatttttcttattctatttgcctaaagaaagatttgactttttaagccctatacaatcatcacttcttctgtaaagccttcattgaatcccatacctaggtacatatataatcacttctttctttgtattagttgtgtttttgtatatacctgcattattgtacatattgtactgcattaggatttacttctttgtctgtccatgcttcagcatccccatctgtgggtataacccattgtctttgtcgaaattctctgttatttatcctgaagtctagcacaattcaaagcatttggggtagtgttaggcgatgaaaaacttgtcaggacataattttccattgacagatatttaaatagcaaacagggtgtattagttcattttcatgctgctaataaagacatacctgagactggggaatttacaaaagaaaaaggtttaatggacttacagttccacatggctgcagaggcctcacaatcatggtggaaggcaaagaggagcaagtcacatcttatgtggatggatgctggcagggaagaagagagagagaacttgtgcagggaaactcccatttttgaaaccatcagatttcatgagatttattcattatcatgagaacagcatgggaaatacccacccccatgattcaattacctcacactgggttcctcccatgacatgtggaaatagtgggagttacaattcaagatgaaatttgggtggggacacagccaaactatatcattccaccccagcccctccaaatctcatgtctttacatttcaaaaccaatcataccttcccaacagtcacccaaagtcttaactcatttcaggattaactcaaaagttcacagttcaaagtctcatctgaaataaggcaagtcccttccacctataagactgtaaagttaaagcaagttagttacttcctagatacaatgtgggtacaggcattgggtaaatacagccattccaaataggagaaattggccaaaacaaaggggctacaggccccatgcaagtccaaaatctagcgaggcagtcaaatcttaaagttccaaaatgatctcctttgattccatgtctcacatccaggtcacagtgatgcaagaggtgggctactatggccttgagcagctccacccctgtgactttgcagggtatagcccccctcctggctgctttcactggctggcattgtgtgtctgcggcttttccagctgcacagtgcaagctgttggtggatctaccattctggggtctggaggatggtggccctcttctcacagctctattaggcagtgtcccattagggactctgtgtgaggatccaacccacattttccttctgcattgccctagtggaggtcctccatgagagccccaaccctgcagcaaatttcttcctggacatccaggcacttccatacatcctctgaaatataggcagaggttccaaaaccccaattcttgacttcttgcactagcaggttcaataccacttggaggctgtcaaggcttggggcttgaaccctctgaagccacagcccaagctctacattagcctctttcagccacagctggagtggctgggacacaggcaccaagttcctaggctgcacagagcagagagaaccttggcccagcccacaaatccatttttgtctcctaaacctctctgcctgtgatgggagtgtttgccccaaaggtctctgagatgccctggagacattttccccattgtcttggtgattaacatttggctcctcattacttatgcaaatttctgcagccagcttgaatttccccaaagaaaatggggttttcttttctatcacattgtcaggctgcaaattgtccaaacttttatgctctgtttcccttttaaaactgaatgcctttaacagcacctaagtcacctcttcaatgctttgttgcttagaaatgtcttccagagatatcctaaattatctctctcaaattcaaagttccacaaatctctagggcagaggcaaaatgccaccagtctctttgctgaaatataacaagagtcacctttgctccagttcccaacaaattcctcatctccatttgagagatgcctcagcctggatttcattgtccatatcattaacagcattctggtcaaagccattcaacaagtctctagggagttccaaactttcccacatttttctttctttttctaagccctccaaactgttccaaccctgcctgttacccagttccaagttctcttccacattttcaggtatctttccagcagtgccccactctactggtaccaatttactgtattagtttgttttcacactgctaataaagacatacctgagactgggcagtttacaaaagaaagagatttaatggactttcactttcacagggctggggaggcctcacaatcatggtggaagtcaaggaggagcaagtcacatcttacatggatgatggcaggcaaaacgagagagagagcttgtgcagggaaactccaatttttaaaactgtcagatctcacaagacttattcattatcataagaacagcatgggaaagacctgcccccatgattcaattacctaccactgggttcctgccacaacatgtgggaactgtggaagttgcaattcaagatgagatttgggtggggaaacagccaaaccatatcatagggaaagcaagccaactacataaaataacaaaatggatgatgtgcttccacatcataggggtgggaggcatatatgaaaaacacctggatacatcatgatgacctatgacatacacttctggctaggaaacatggggccttctgggcatagcaggatggttgagaaagaactttattattccacaagagtaatagcaatttggatatttgagttggcctctgtgttattgaggagttaggtcttcaggggaaaaaagaagccttagaggaaggcaataagacagggccaaagttggggcaagccctgtgcattccctttgggaagagtaaccaatgatataaaaaatgatgattaatgtaagttgttttctgtatcattcacccttaatctaaactttcattaaaaacacacttcacacaacagctgtgacagtgggagtaaatcaagagtcgcataatgtggggagccttatgtgaagtgaagttggaaggaaagaatcaagaaatcacagccaccattacatagtttgtagatggccctctcacagagcagcagtattttaaacagaatctcttaaatttatctaatagctaatataataaagttagtatagaatgtgctatagttaggtatagaaatgtgctatatctttccatattttgttctgggttgtggtggggaggttgttggacagagaaaaagaaaagaaatacaaaagtagagcaacttaatataaagctaagggaaacacaaaatagaatttagatgctcagattcaatttccctcacttatcctcaggattactctaaagcaccaccaacactgccaccaccactcccaacaacaacaacaataaaacttcatttcccctttaccctgatgatgcttttgtcttagaccaaaaattattaatattttacaggtttacaaaacataccaatgccaattatgaaatactctaaacttataccaacatatcagttatttaaaaactcaccttctgtcaccaaacccttagagcctagtgaataataattttctcagagggaattgcatgtggaagccaaagagatgtgatgtgtattacccacaatttgttggctacattagtaactttccagccttgaaatcctgtggctgaggatgctgtaaaataggtaaacgataaatgtcagggttggtgggcactttacagtctttggaatcaaattttcttatttgaaaaacaaaactaacaatatgagtgaattctgagtcttactgtgaatggggcaacttgtcttttcaaaatgaatattacactatttggcaaaaaggctctggaaaagagaacacactacatacactgtcttaaaggcagagagacatgcagggatatagcacagcactgctcaaactggcctgtagagcagggccaatttgtgatctgtttgctaatggtctgtagcatggtaagcacagactttgggagtaatcctttagaaacttttgtagcaatttgttaatgttgagtctaagaatgaaataaaaataggtttgcagttttatgaccttattctttttttttttttagttgatcattcttgggtgtttctggcagagggggatttggcagggtcataggacaatagtggagggaaggtcagcagataaacaagtgaacaaaggtctctggttttcctaggcagaggactctgcggccttctgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagcacagaacaaaatgaaaagtctcccacgtctacttctttctacacagacacagcaaccatccgatttctcaatcttttccccacctttcccccttttctattccacaaaaccgccattgtcatcatggcccgttctcaatgagctgttgggaacacctcccagacggggtggtggctgggcagaggggctcctctcttcccagtaggggcggccgggcagaggcgcccccccacctcccagatggggcagctggccgggcggggggctgacccccccacctccctcccggacggggtggctggccgggcggggggctgaccccccacctccctcccggacggggtggctggccgggcggggggctgatcccccacctccctcccggacggggcggctggccaggcgggggctgacccccacctccctcccggacggggtggctgctgggcggagacactcctcacttcccagacggggtggctgccgggcggaggggctcctcacttctcagacggggcggctgccaggtggagggtctactcacttctcagacggggtggccgggcagagacgctcctcacctcccagacggggtcgcggctgggcagaggcactcctcacatcccagacggggcggtggggcagaggctctccccacatctcagatgatgggtggccggacagagacgctcctcacttcctagatgtgatggcggccgggaagaggcgctcctcacttcctagatgggatggcggccgggcagagacgctcctcactttccagactgggcagccaggcagaggggctcctcacatcccagacgatgggcggccgggcagagacgctcctcacttcccagatggggtggcagccgggcagaggctgcaatcttggcactttgggaggccaaggcaggcagctgggaggtggaggttgtagcgagcgagatcaggccactgcactccagcctgggcaccattgagcactgatgaaggagactccgtctgcaatcccggcacctcgggaggccgaggctggcggatcactcgcggttaggagctggagaccagcccagccaacacagcgaaaccccgtctccaccaaaaaaatatgaaaaccagtcaggcgtggccgcgcttgcctgcaatcgcaggcactcagcaggctgaggcaggagaatcaggcagggaggttgcagtgagccgagatggcagcagtacagtccagcttcggctcggcatgagagggagactgtggaaagagagggagagggagaccgtggggagagggagagggagcaaccttattctttatttcatctagtaattcacttttattttattgtgttttataaaagtccatgacagattgaaaagatagatagaaggatagacagaatgatagagagatagaactagttcttcttcaccacagcttgagaagcaccactctagcaggcatgcatcaccattttccttgggtaatatgaagccatgtcactcctcagttccaatttatttatttttattctaagcttactaaaaaccataaaacattaaaagaaccttaagtcccatgattcctctttggctggttcaactgaacaaatgaagacaaaagatagggaccactttgaggaggaaggatgttctgtagggagaaactagcaagaggataaaagaatagacccatcaatggaagaaaatgagaaaaaaaaaaaaaaacccacaaggactatgtcttactctcatgtacaacctcagcagctagcatagacctggcacatagttggcacatggtaaatacttgttgaattaaagtaattctaagtgtcattattgtggaaaaatgatgaaaaatgaagcaaaattcaatatatcagaatctgtatttcttaaggaaagtatttaaatgtaaaagcctagcaaaactaaaaagaatttattttaaataagctaaggcctattagggttctgacatttatgttactggatgttgatattgttttctacattgctgtgattgtacagttttggaggaagagtcagtataattagaagagctcttattcctcaacttcctaattttcctcctgtaaatgagagaaatataacagggtatcagcaacctgacaaggttgcaagcaattgtttcatgttggtgccagcttcagaaaccctttatgatgaatgcatcaccagcccttcaaagtcatttttgatttatgtataattttaaagtaatatgtatggtcctattgagaaagtttaaaatacataataatttaaagaatgaaatagaaattatctctaatttcaagcataacactaatgtttttaatattttgatgtattttttatcagtttttcataaatatgaaaggcaaacattaagtcccatagaaaatttgttcttatgtaaaattatctcgtcaatttctgagatagtgggtcctaacaaatgggcaagtttttaaactattctaccaacacttcctgatctataaaatgggcatgataatagggacttaaaacaaaggttatcatgaagattatcgagttaatatctgtatgacacttaaaagaactagttacgtatactgagtgctgtatattttgtattttttttttggaatggagaatcttttgatgctatctcttgcattcctaaaaacaatataaagtggtgggagagtggtgtctggtgtgagcctgatgatgttaaatttctttgcataagaaaagaggtgagaaattgagacactcacagggaaaatctagcctattactgtccatgtgaaaaataatgcaagccacatatcaacttttaaattttctagtaaccatagtaaaaagtaaaaagaaacagataacattaattttaataatatattttatttaaaccaatatatcaacaatattataattgcaataaaaatcataggatattttatattattttatttgtactaaatatccaaaatctgataaaatgaagccagttcactcctcagtcccaattttattctaaactccaaattttggttttgttttgcctttacagtttcttgcagttaattttatataagtatttatgtgagctatgatttatggagatagttcatgttgaacatgcagcatatttgttttattcgatggcctaatttcaagtgcatagcagccacaagtggctgagtgagagctatcataccgcacagattgtaggacttgtaggacaagagccaggacagactcagtgcctgtaatggtgcaagggaacaaggtagagaaaaggttctttgatgagcagaaggtagacatcagggtgaacaatggagaatttcagaggacaatcatgttttctgtgtgtacccattaccccactcacaacacacacacattttaatgaatctttagttaaatatccatgtatcaataaatttctggtgaattaaatttttttttttttggaaaagcaggaaaatgttaaatcccatcccaaggctttttagccacaagtatatttgtgagatgtaaacatgtaaaaacctactgcatataatactcataggctttgattttggcttaggtgttgtctttatagtttcctgtcgttaatcttataaaactatttatgtgagctatcattaagtatgcaattcttcatgttgagcatgtagcatatttgtatttttattgttacaatgacattaaacaaacaccctcatgaataagtctgtgtgctcatctctgattatttccttaggctggattctgggaagtgaacttatggaatcaaaggttatgcaaacatgtaagtttcttgccatatgtcttcaaatttattctcataagatacacagtgtatgccaggattcagtttagacactatattccttaaataatgacatttttgatggaagaaaatggcatattattcatattattgctgttgttattgttttcagtttcaagtgtgaatatttatgttgaacatttctccttggtcttgttggtccaattttttcttttgaattgcttgtttatatcttgtgcctgcaggccatgtcattactttttcatcagactcctaggattccctgttccatctagccaagtgggtatgcagagaggtaatgtgatgaggaggccctgctgccgggcctcagagatctcactaccggatggtagtcatgataaaacatactgcagttacaatcagttaaatctgagtaagcaactaagctaacctttggaataaattcatatacccccgaggtctgtctgctataatagcactactaaaaagcagacaaatactttgagttttataatttaagctttgccatccccttagaagaggtttgactttatgaaatatatctgtctgcaaacagccttggggcctgtgtgctccttttgcatttaaccagctattaaaaatccctcagaagctgtgacctgtataggttcaatctgctttggctagtaaatcagttaggctggaagttccctacaatttttttaaaagacattggagatactaaaaataattcttctgtctttgtagaggtgaggaaaataattcaaaagtggttcaaacatagtcagaatctgtccatcataactaatcactctttcctgccaaaatacacttactcatttataccataaatatttgcatgcctgctctgttccatgtagtatattaaaaaatggagccaactataaattagacatttcttatcctgaagaaaccaagtttggtgaaataaagaaaaaatcataaataaatgcaatattaggtgatagatgctacagtagagttgtggtcaggaactatacgatcatagaggaaaagaataaccacgtggattgaaaaaaaaaaccttaaaagaaagttgatatttgagctgaattttgggatatgggttgaagtacccccagcaaaaaggaggaaagagaagggtagatcttacggaaaagaaacaaggaatcccctccctacccactgccagtgaagggtatattagagaattttaaataggaaagtgatggtaatcagaacacatgagcctttttctatgtctcttctgggtttctatcactacccaactgtgatggttaatagtgagtatcaacttgattggactggaggatgcaaagtattgatcctgggtgtatctgtgagggtgctgccaaaggagattaacatttgagtcagtggactgaggaaggcagaaacacccttaatctgctgggcaccatctaatgagctgccagtgaatataaagcaggtagagaaagatgaaaaagcaagactgacctagcctcccagcttacatctttctcccatgctggatgcttcctgccctggaacactggactccaatttcttcagttttgagacttagactggctctccttgctcctcaagcttgtagacagcctattgtgggaccttgtgatcatgtaagtgaataaactctctctctctctctctctctctctctctctctctctatatatatatatatatatatatatatatatatatatacatcctattattctctacctctagagaaccctgactaatacagattttggtaccaggagtggttctagagaaacagagtattacagatggatttctttcattggttttggggtttctggagttggctgcttaatatgattagacctaaaactgctaaggactctgtttctaatagtatggagaacactaatagtgcttggcatgaactgtttagagagttatgcaaaacaaatgcatttgacactcctgattcactgctcatgagagggaaggagtttagtgactctatacataatacctttgaccgtatgtggagaaccgaggaatgcaatgaagctggttggttgttcctaagttcagtggacaaagtgatgaaagaaaatgatgaacttagggattctgtctcctggcttcagaagtagatgatgaccctcaaatctgctaagatttccctgagttagtcttatctcctgtagagaaagagctgaaattgtggaaaaacagacaaaaactcttatcatgtgagtggctgacctgcaatgaaaggtgcatgcacagcctcgccaggtgtctactgttaaagtgagggcattgattggaaaagaatgacaccctgcgacttgaaataggggtgtgtgggaggaccctgatgaagctggggacattaagtttataaactctgatgaaccttttttccagaaggaacagcttccccaaccccaagagtggcaacatcccctctccaacccatgctgccatcagcctttccacctttgtctgaggagataaaccctgcgctgcctgaagcaacagtgatggcctcctctgaggcagttgccaggcaaaatgatgttgattctcctcaggaggattcccaacacccctgtttgcctttagacctataactagactaaagtctaggaggaaatactaatggcaggtacagttcctgtttctgcagctggtcacgtggttgtagctgctattgatgactaccttcttctactacccattctgtattccctttgccttcagcaaacacctcagcaggtcatgatttttttcctggtggagtaacccaaaccttcattcttgagggatctggaccatttgtagccctgcgtggattgggctgttgtagtttcccattgaccttaatcacagggcatggttattaccatgatgccctaatggatctcctgtattccatgcacactcttcattacttctgttatggagtagtagactgattttatcttgatagtccaggtcaatcaccccagccaacactttaactcccttcttagcatgttgacttaaaggtaggagcccaaagtccaggtggcgatcttaacttccagtttaatggaataattgacgtgtctcttggtggcagcattccaacctctggaactaagacctctaggccagcagaatgtaatgtcgtgggaacaggaagcacaaattttgctaatggatcactaggaataatggtgagtggtgccacttccacttccaccccttgattcccaaacctttgaatcctggctatgggagaaacagtaccatatattgaacgctgatacagagaatacatggccttctggagaactttgccccagccctggaaagtattgtcacttagttggcattgtgattgtgatttcaaaaggccactccaccgttccatcaatccagctgctttgggatgatggggaacgtggtaagaacagtgaattccatgagcatgagcccactgctgcacttcttcttttttttttttttttttttttttggctttaatctgcctttgtacatgtttatttatttatttatttactttttattatactttaagttttagggtacatgtgcgcaacgtgcaggtttgttacatatgtatacatgtgccatgttggtgtgctgcacccagtaactcatcatttaacattaggtatatctccaaatgctatccctcccccctccccccaaccccacaacaggcccaggtgtgtgatgttccacttcctgtgtccatgtgttctcattgttcaattcccacctgtgaatgagaacatgtggtgtttttttttttgtccttgcgatagtttgctgagagtgatggtttccagcttcatccatgtccctacaaaggacatgaactcatcattttttatggctgcatagtaatccatggtgtatatgtgccacattttcttaatccagtctatcattgttggacatttgggttggttccaggtctttgctattgtgaataatgccgcaataaacatacgtgtgcatgtgtctttatagcagcgtgatttataatcctttgggtatatacccagtaatgggatggctgggtcaaatggtatttctagttctagatccctgaggaatcaccacactgacttccacaatggttgaactagtttacagtcccactaacagtgtaaaactgttcctatttctccacatcctctccagcacctgttgtttcctgactttttaatgattgccactctaactggtatgagatggtatctcattgtggttttgatttgcatttctctgatggccagtgatgatgagcattttttcatgtgtcttttgtttgcataaatgtcttcttttgagaagtgtctgttcatatccttcacctactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttattttaattagatcccatttgtcaattttggcttttgttgccattgcttttggtgttttagtcatgaagtccttgcccatgcctatgtcctgaatggtattgcctaggttttcttctagggtttttatggttttgggtctaacatttaagtctttaattcatcttgaattaatttttgtataaggtgtaaggaagggatccagtttcagctttctacatatggctagccagttttcccagcaccatttattaaatagggaatcatttccccatttcttgtttttgtcaggtttgtcaaagatcagatggttgtagatatgcggcattatttctgagggctctgttctgttccattggtctatgtctctgttttggtaccagtaccatgctgttttggttactgtagccttgtagtatagtttgaagtcaggtagcatgatgcctccagctttgttcttttggcttaggattgacttggcaatgtgggctcttttttggttccatatgaactttatagtagtttattccaattctgggaagaaagtcattggtagcttgatggggatggtattgaatctgtaaattatcttgggcagtgtggccattttcacgatattgattctgctgcacttctttagccataaagtgagtgcctttgtcagaagaaatgatgtgtgtagtaccatgacggtggataaggcattcagtgagtccaggggtggtagtcttggcagaagcattgtgtgcaggatgggcaaacccatatcaaaagtaagtgtctattcccgtgagaacaaacctttaccctttccatgatggaagaggtccaatataatcaacctgtcaccaggtagctggctgatcaccctgaggaatggtgccatattgagggctcagtgttgatctctgctgctggcaaactgggcactcagcagtggccgtagccaggccatccttggtgtgtggaagtgcatgttgctgagcccatgcataacctccatccctaccactatggccactttgttcatggacccattgggctatgacaagggtagctggggaaagaggctgaatggtgtccactaaacgagtcattctatccatttgattattaaaatcctcatctactcaggtcacccattggtgagtactcacatggtatacaaatatcttcacagtttttgaccactcagagaggcccatccacatacctcttccccaaatttctttgtcaccaattgtccaatcatacttcttccaagtccctgaccatccagccaaaccattggctggagcccatgaatcagtatataatcacacatctggccatttctccttcaatgcaaagtgcacagccaggtgcccttctcgaagttctgcccactgggaagatttcccttcatgactatccttcagtgaagtcctaggaaaaggcttgtagtgctgcagctgtccactttcgtgtggtatctgcatatgatgcagaagcatctgtgaaacatgccccagtcttctcttactctgtcagctgatcatagggaactccccatgaggccatcagtgcaggctggaggataggaggcaggattgcaggagtggagaccaggggcatttgagccacttcctcatgtaacttacttgtgccttcgggacctgtttgagtccaaacacgtatctaccactttcatttgatgatggaatgctgctgtccatgacccattttatggctagatgggtcagaaagcatccagttcatgataggcagttcaggtcgcatggtgacttgatgacctctagtcaaacgttcagtttccaccaaagcccaataataggccaagtgctgtctcacaaaaggagagtagttatctgcacaagacagcagggccttggtccaaaatcctagaggcctctgctgtgattcacctatgggggccttccaaaggctccaaactgcatccctatctgccactgacacctcaagcaccattggatctactgggtcatatggcccaagtggcagagcagctcacacagcagcctggacctgttacagagccttctcctgttctggatcccactcaaaactggcagcctttcagg

SEQ ID NO: 540 - DNA, 155084 bp, Homo sapiens
ggcctattcttagaaggtatcctgtgacagagttgggtggcttcttggtaatccatagctttttattttgccagccagtcttgtattcattttttaggactgctgtaacaaattaccacaaacagtgtagctaacaacaacagaaaactttttttctcacagttctagagatcagaagtctggaatcagagtgtcagcagtgctgtgcttcctctaaacgttctaagaaagaatctttccttaccacctccagcttctgcagacgccaggtgttccttggcttgtagcaatacaatgtctatctgttttcaccgtcactttcatgccttatcctcttctctacgtgtctgtttcccttataaaaatacctgttaccagatttagggcccacctggataatccaacatgattttatctggagaccttaagtacatttgagaagacttttttccaaataacgtcaaatttcatgttccacgaagtggtgaacatatctttgccaccctctgacccactacaaaccctcacactgtgagagcgtgtattaatctgttctcacactgctatgaagaaatacccaagcctgggtaatttataaaagaaataggtttagttgactcacagttctgcatggctggggaggtctcaggaaacttacaatcatggcagaaggcaaaggagaagcaggcaccttcttcacagggtgcaggacggagtgagtgcaagcaggagaaaggccagacgcttataaaaccatcagatctcataagactcactaattatcacgagaacagcatgagggaaactacccccatgatcgaattacctccacctggtcccgcccttgacacgcggggattagaggattactattcaaggtgagatttgggtgggacagagccaaaccacatcagagggtttcccagagaaagagcttagatttgtagcaatgcttctgtaatttcacatgcatctcttcctcacagagcatgcaggcatgtggaccatagctccagactacttagaattactgcttcttctcagcctttagatcgcaaagctgaatgtaagctgccatagcagatgtcgccttctggggttatgttttgctcgggagttgtccctctgcaatatgatttttacctctcctcaaaagcctgttagaaaaatctttgtctgaattccaaaaaaaaaaaaaaaaaaaaaaaagactttcaaattcttttccattaagctcctgggccctcgaaaaccagaaaataaaggaaatacatatacgtaaatataaaaaatatgtatttaaggaaacgtttataccaatttatatataataaatattttatataaatatatgtgtatgcatatatatatacatatatatagtgtgtgtgtgtatataaatgtatatatacaataaaatataagggcattgttgccaaacctcacagattggcttctccaagtctgtgctctaatccatccgtgatacccagttacctgtcatacatttcagaagctaagcaggaagcaggtaaaagtcatgctgattttcttgtatcaaataatgataagacaaacctcaaaatatcttctgaatgtcttgctctcaagatacataactgtgaaaactgatgtactaaggaataaaatctgaagtcttttctttaagctatttgtcagtaaaacatttatcttgtgattttcataaagttcttttggatcaggatggaaaaaatattgtagttccatatctgatctctcatctccctcaatccaactaatgacttcatctttcttctctttctgtacttactcttacattaagaaagaagcttgggcttgtatcaaatgatgattaaagatcaataaatgagaccacaaaacctgggtcataggagtttgtaaaatatgggcaggaataagtagggtttgatcttgtcacccattgtgtcatgttacgacttgaattatacttaatttttacttagggtactcagagcatggaaacccagggtcagcatgggtctgagagaaatagaccttggaacctgagctctagctatgagtggaattgtcatacaattagaacaccacccatgccccatcatttcagcagcaggaacttgaatgaagtggggcactgcagaggcaaggataccatcagccttggttaaacagttctaaactacatccctgtgtataatgtatatggtggtgtgctgctgctggcttataccagctcatgcattttcaagaaatttgtgagtcagttaaacaccacaattaaaaataaatttatataagcttgcaattaaataaattatattgaaaacaaaggcaataaatactcaaaactaatcatttcctaattatttcattaccctttactagttcacttgtataagaaaaatctctaaaggctcaggatttattttatttcaccactaagggctccatgtcacatggcacaggaaaacagagtcaactcctacatgtctcaaaggcagatttaagaatccatggatattctgcaataggtacatttaattcatctgtaattttctccttcaaagtactgatggaatttttctctgaccctaatatccaaattttgggtctttttgctatcatattatatgagagacacaaggaggaataagagaaagaataaagggagtagtggaagcatgtgaaatagaaaatcttgcctctgtagataccaagtccttgtcatcctgctctagcagcccttctcacccaggtggttaagcatgaagcccctcttctaattcatcttttgtaagaaaatcaaaactcagaagccctgtgtctaacaaattaggttagatgttattttaagtatgtcaagtacaattcatttccagctaagggaaatcaactacttcactggagcaagttatgcttttcttagattcacctaattacattaaactgtcacagggtcgaatactctgctaactgggaccctcatcaggtagcagacagaatgcactttgggtcatatgttttatgactgaacttactttaatcatcaagctaaactgtaaaagattgtaagtgtctagtagagcatatactattggtggccagccccgaactctttgcccaactcttccttgctgaccaagtcatgattatgtttgaatgttcaccttcctccagttggcaatgtgcctaggaaggtgaccccatctcctacttagaggtaaatcttaatacatccaaatctagcacaatctcattccccttcttagtgactgggtatgtgacacatttgttgccaatgagagatcctctaaaggcacccaggaagggttttcccatggtttaaaggacacacaccagaaaaaatgactcctctactttccctggacattcttacttcctcatagggtactttgtactggagtagctggattgtgaccatgacagaaggcatgaaggcaaggctgataaattgagaatatctgaactgcttcattatccatctctggaactgccctacccaaggctttcttattatttaaaataataagcatctttattgttcatgcaagcaattctcagtgtgctgtccccacatgataagcaccagcatcacctggaagctttctagaaatacagagcctcagggactatgtcagagtcgagtcagaacctctggggaaggcacccagaaatctatgatttaataagccccttggtgtttctggtgcattttcaagtttgagaaccaccggtttaagccattggataacacctggcaatggggctttgaatttatttgagaggtactgaagaattcatggataatttttaatagaaaacaacataatatgtcttgcaggtgatctataggagctactctccaaatgtcagttaatagttggtgaccatgagcaaatcacttaacatctttttgtcctggttgtattataaaatgaggtgatggtagctcctaggctatgtagggaaattgttagcatcctatactaaagacaaatgatatatacaccaattatctcgtttgatgcttttatgttttttctcttggctagatactaaaatgttctattacatctattgtgattatctaaactaccaattatacagtgaggaatgataattactaaaatactctgccctcttgttttacttcagaactaaggtgaagtgaaaagctggcatgcagtttctaagaaattttcaggcagagcactggagaaaatgtatgaaacactcataattaaaatgcttaaaaagataggctttcagaatataggagacaggtgaggatatagagtccagctttaaacttgcccacacataatatattgaaataacataggacccctttcattttggtaataaatggaccaatcaatgttctacaaagaatgctagtaaggttgacatgtgcacagagaaaaataagataatataatagatacgacttggatgctaattgaggttacatccctttcttcattgattttaaattatattcagctgtatagttaaccaatgacaaaaaaattatcaaaaataacaagtatttagcacataccaaacaatcaatgagaaagtacacatagattcaccaaactgtatgaatttgtgattagaggtctaacaggatgaaaatcagcttgtaacagtagcttaactatagcaaaacctaacttttgccacagcttcttttgatttattctatttatagaaacataattatgacattgctgtcatacaggccacattgcaagatctaccattttctcttccaggttgtctttcctatgcaacatggtttctaagtgtagtgtaataatccattcatcttcattcagatcaagggaagaggcagtcagtgtaaggtgtttgagcactgggtctggagctagacttcctgggttccccacctcatggtgtaatagggatatgtgtaaagttcttaggatagtacctggcacagtaagtgctcaacttatgttaattcagtaatattagagagtggttttagtctctctccttatgagagtgtattgaaattaccagaagatctatttctttcaaactataatctattgaaaactaaaaacctattactcaggaattttgaaaaacaccagtagggcacatggctatcctttctccacagccccacaacacacagacactccccttctcctcttgcaaatcattattagactgagctgctgttactgttccgcatgttttctgtcacaggagataatatgaatttgattttaggctttattaggtcaaattttgctttatttgccatgtatccttaacacttaggagagtgtttaaaaaataaaatgttattatatgaatgagtgtgacatactctctttagcttctagactacaatttggccttcagactattcccgggtgttttttgttgtttttttattttaggtacagaaatgccttgcagaacactttttttccttgtgtaacacttccttggaacataatccaaaatagcgttaccaaggcaaatgatcatctctaggattcttacctcatattgccaaactgctatgtataaccattgagttcattcatagtccttctagcagtgcataagtatacatgcttccgttatcaacagtagaaggatattttcattttgccaaattaataaatgtaaattctggttatggttcccaagtttgggagtataatttctaagggtacctctggagcaactggaaaaaaatcatttgccctcagaattggtctggcacaatcagggcactttgttagtgggtttagttgctttgtagccttttgaaacttaaattcctttcattgctaataaaactagatacttatgtccacatatccacataatgcatatggacactggattggaaagatacgccttaaatacactaaatttggagcctgagatgtaagtagacgttagtttccaaggctgttgtaacagattaccacaagctgggtggtttacaacagaagtgtattctctcactatcccggatgtgaaaaaaatctcaaatcaagtatctccagggcaacacaccttccaaaggccctagaggagaatctttccttacttcttccaccttctggtggctccaggtatgccttggcctgtggctgcataattccaatttctgcctccattttcacatgccggtctcctcttcatctattatcgttctgtatttttcttatagagacacttgtcattgaatttaggacccacttggataatccagaatgatctcatatacagcttcttaattacatctgcaaataactttttttcaaataatgtcatattcacgtgttccagggattaggatatggacatattttgggaagaccccattcaatccattacaatatagatgtatgttaaattagagaaataagataaaataaaacagggactctgcacagacccacttgtcaaaatatggtgccatgaacctagcagtatgctaaactcaattctaggtaattaagatttgaaggggaaaattttaaggcaaaacagtctatatagatctgtattattcctgtcaagcctaacacagagaggcttcaaaatagtgcattttacaacagtagacaaaaaaataatatctgagagatcggatcttcttaatctggaaatcagtaagctctttaaagtcttgaatacaaacataattttgaattctccatgaggaaaacaggttatccaccctgatttgggaaatgctcaaaatgaatataatctacaaaaaagattttagattaacatttggcagttattaagctaccaactcccaggcaattccaccccacaccaccgtccccaacctccaacccttctaaattctgctttgtgatgctggagatctcacactacatttctcctttggtctttgctaaataactggtgtggcctctgtctgcacgacaggatactgaatggatgattaattaatagttcttttatttatttgttcaacaaacatgacttgaggccttctgcatgtttgtaacatcatagccactataacacaaagatgaaaacaatagtccaggaactgaaagtctcctggaagcctactgagaggctgagtgaaatgctactgccctttctctcacaataacaaacgtaaaagacccaagatgttcctttttatcccttcaattattttccttctatttcaaaatagtctgcaaaacctgttttgtttttcaaaatactgattaacatatgctattaactacaattgtactctgatctttacctgtgtttctttagttgacatttaagcctttactttaaacctaaaggttcaatttgttagctcatttatcatctgtttttttttttcttactagatgaaaaacaattctactaagtgcccacagatacctttggaagggccaaccctgtatatctccaactctgccgtcaaactttcccaaagatatggaaatggatgccacaatcaatcacagggttgaaaccagtgcttcagaagtaaatctagttttcaaactgttacttctgaaactatggactcttgctggaagttaggtcagtgtcaattattcttattcccaaattgggcacattttagaaactctcaattaataagaggtaatgctgagacaatgtcacagaaataacttgtgttcacttatttatttaaaatttttttcaacttttaatttagattcagggggtgcatgtttgttcaggtttcttacataggtatattgtaacatgccgaggtttggagtatgaatgatctcatcaaccaggcactgagcatagtacctaatggcttcaatccttgccccactctctccctcccgttcagtagtttctagtttctattgttgccatctttatatctccgagtacccaatgctgaatttgatttgctagtatttttttgagagttttggtgtctatgttaataagagatactggtctgtagttgtctttttttgttacgtattcacttattttaagggcagtagggtatcttcaaattaactgtagaataaaaacaacataagggagaggcagagcttccagaatgacagaataaggagctcagtggagactgtccctagcaaaacaatttaactggtaaagattatatttttaaaaaatgatttgaatctggaaattgtcttaagggaatacatcaaatggagaaacatttatttatgaaattcactaaatcttgttaaaaataatgagtttgtgccacttacatcatgattcactctcctatagccctccccacccagctctattacagatctttccctcagacactctactccaggcaggtagaatccagaagtaggtggattacttcagccactaaacaaacaaatgactaagcaaacaaaacaactagtcctgggagaatcagtatacagagatgccacaatatgttatctaaaatgtctaaaatgttcagttttcaactaaaaatgttaagacatgtaaagataaaaaatatatcccatacacagaggggaaaagacaggcaataaaagctacctttgaagaagtccagatagtaaacttaccagccaaagactttaaagaaaccatgatatagatgttcaaaaaactaaatgaaatcatgcttaaaaaagtaaaaaagctattatgacagcgtttcatcaaataaggaagattcataaaaattatctaaaaagaggaagacagaaaaatacatctccctcccccaaccaaaaaaaatgactggaggggcttagtacatatgaattggcaaaacaaaaaaatttaggaaacttgaagatagatcaatagagattatgtcatctaaagaacagagagaaagaaatatgaaaaaagaagatgattggagtctcaaagaaataatggatgccatataaacaaaccaacatatgtataatgtgtgggacaggagagagaaaggaaaaaaatttcaaagaaataaagactggaatttttcaaaatttgattaaaaaaaaaaaacactaacctacacattcaaaaagcttaataaattcctagtagagaaaatgcagagattcacatctagatactccatatttataatgttgaaagtcaaagttaaagcaaatgtcttgaaagcagtaagataaaaatgactcactgcataaaagaggaatctcaataagaatataatacaattcggatttgtgtccccacccatagctcatgctgaattggaggaaggtcctgatgggaggtaactggattaaaacggaagacttaccccttgctgttctcatgatagtgagttctcatgagatctgatggtttaaaagtgtgcagaacttccctgtctgttccgtctttctctcctgctccaccttggtaagtgcttgctttcccgtcactcttctgacatgattgtaagtttcctgaggcctcccagccatgctttctgttaagcctgcagaactgtgagtcacttaaatctgttttcttcataaatcatccagtctcaagtagttctttatagcagttaagaatggaccaatacagaaaattggtaccagtaaagaggacactgctataaaggtacctgaaaatgtacaagtgactttggaactgggtaacaggcagaggctggaacagtttggaggcatgagaagaagacaggaagatgtggggaagttcagaacttcctagagacttgttgaatggttttgaccaaaatgctgatagtcatatggataatttagtccaggctgaggtgctcagatggagatgaggagcttactgggaactggagtgaaggtcactcttggtacactttggcaaagaaactggcagcattgtgcccctgccatagagatctgtggaactttgaacttgagagagatgatttagtgtacttggcagaaaaaaaatttctaagcagcaaagcattcaagatgtgacctggctgtttctaaaactgtatgctgatatgtgtgaagaaagagatatctgaaattggaacttatatttaaaagggaagcagagcataaaagtttggaaaatttgtagcctgatcatgcagtagaaaataaaaacccattttctggggagaaattcaagccagctgcagtaatttgcataagtaaagaggaaccaaatgttaatgaccaagacaatggggaaaacgtctccaggacatttcagagaccttcacagcaactcctcccatcacaggcccagaggcctaggagggaaaaatggatttgtgggctaggcctggggctcagctgctctgtgcagtctcaggtcatggagccctgtgttccagccccagccatgcctaaaaggagccaaggtacaacttgggctgtggcttcatgaggtgcacgctccaagatttggtggctttcacctgatgttggtcctgtgggtacacagaaggcaagagttgaggtttgggaacctctgcctagatttcaaaggatgtatgcaaatgcttggatgttcaggcagaagtcaactgcaggggtggagccttcacagagagcctctactagggcagtacagagggcaaatctgggattggagcccccatacagagtccccactggggcactgcctagaagagttgtgagaagagggccaccatcctccaaaccctagaatggtagatccaccaacagcttgcactgttgcaccatgcacctggaaaagccacaggcactccatgccagcctgtgaaaacagttgtggggatggtaccctgcatatccacagaggtgaagctccccaacgccttgggagctcaccactttcatcagcattccctggatctaagatacggagtcaaaggagattattttggagctttaagatttaatgactgccctgctgggttttggacttttgaacttgcatgggacctgtagctcctcagtttgtgccaatttctaccatttggaatgggagtatttacccagtgcctgtactcccattgtatcttgggagtaaataacttgatttttgttttacaggctcataggcagaagggactgccttgtctcaggcgagactttggatgtagacctttgagttaatactgaaatgagttaagacctagagactgttgagaagagatatttgtattttgcaataaaagaaaggcatgagatttggcaggggacagggaggaattatgtggtttggatttgtgtcccttcccaaatctcatgtcaaattggaggaggggtctggtgggaggtgattgaatcatgggggcatatttctcctttgctgttctcatgatagtgagttctcatgacatctgatggtttaaaagtatgtggcattccccacttcactctctttctctctctctctctcctgccacaccatggtaaggcatgcttgcttccccttcacccttttaacaagattgtaagtttcttgaggcttcccagccatgcttccttttaaacctgcagaactgtcagtcaattagacctcttttcttcataaattacccagtctcaggtagttctttacagcaatatgaaaatggactcatagagaacataagctaacttctcatcagaaacaatgaaaatgatgccaaacaatgaaaactcaaatctacataaagaaatgaagggaaccacagagggtaaataagattaatattaacaaaaagaaagtggagggaaagaatctgtaaaagagtaaagtttctctatttaaatggaactaagtcaatgtaaatattaagtagattgcaatatgttaaaaatgtctattataaaccctagtgcaaccactaagaaaataactcaacaaagtataaagaatcattaataggaattatgatattatactataaaatatgaacttaatataaaagaagatagttctcaaatcactaatctaatcatcccccttaatttgagaaaaaaagaactaaacccaaagctagtagaagggacacaataatacagaacatgtatatattaaatagagaatagaaaaaaatcaataaaaccaaagcttttttctttgaaaaggtcaacaaaattgactaatctttaactagattgacaaagatagagagagaaaagattcaagtaactacattgagaatgaaaaaagatatgttaattactattaagcttatagaaacaaaaattatatatacagtatactataaaaaatttgtcagctaattagataacctataagaaatagacaaatttctagaaatatgcaaataaccaatactgactcaagaagaaatagaacatatggatagacatataggtaaaaagattgaattagaaatcaaaacactttccacccaaaaaatgtcaggaccagctgacatcactgaacaattctactaaatgtttgaagaaggtttcatactaactcttcacaatctcttccaaaattaaaagggaagggaacacttccaacggattctatgagataccatagaattctctagaattcatagaatcgtagaatttattctatgataccaagtttgtcatggtaatatataaaaaatacattatcttgatttaaaaatcacaaggaaagaaaactgtagatcgatattctttataagtatcgataaaaaatgctatcaacaaaatgctatcaaaccaaaccttgcaacatatcaaaaccgtgtatataccatgatcaagtggcactttattccaggagtgcaagtttggtttagcatttcaataaattaatgtaacataccatgttaatagaatgtacgagaaaaataacataattatctcaacagatgtagaaaaaacgtttagcaaaactcaacaattctttcataatagcaatctcaacaaactagaaatagaaggaacaccttcagctttatgaagctcatcaaccaaaaactcactgcaaacatcatacttattggtaaaaagctgaatgctttgccctaaaaatcagtagcaagaatgtccactattggtacttcaacaattgtactaaaagttctcgtcagaacagtggcacaatcttggctcactgcaacctctgcctctcaagttcaagtgattctcctgcctcagcctcccaagtagctgggattacaggctcctgccatcatgcccagctaatttttacattttttgtagaggcagggtttcaccatgttggccaggctggtatcaaactcctgacctcaagtgattcatccaccttggcctcccaaagtgctgggattataggcatgaaccaccacacctagcaaaaaaaaaaggtattcatattggaagaagtaaaattatcttaattatttctaattttggataataattttgtatatcgaaaatccttagatgtagaaagaataatccattttttaaaattgaaataaataagtttggcaaggtttcaggattcaagaacaatatacaaaaatgaattgtatatctatataatagcaattaacattttgaaatacgaagttagaaaaacaattacatttacaatagtatcaaaaagaatacaaaagtaaagcttcaaataaaattaacaaaataagtttaatgcttttatgtggaaaaccacaaaacatttctgaaagacctaaataaattgaaagtcatctaatattaaagattcagaagattcaatattgttaaggtggcaatactacccaaattgatctataaattcaccacaatccctgtaaacatccaagttggattattgtttagaaattgataagctgatcctaaaatttacatggaaatacatgagactccaaatagccaaaacaatgttgaaatagaaaaaaaaaacctggaggactgcaaaacttactataaaggtacagtaatcaagattctgtagtactggcataagaatagacacacacatcagtggaatagaattgagagtacagatgtagacagacccttacatcatatatgaccaactggttattgacaagagtttggtgacaaacagggaaaaaaatagccttctcaataaatggtactagaaaaatttgatattcatatgaaaagaaaatctaaagttggatgctctcactctgtataataaaaattaactcaaaatgaatcacgaacctaaattaagagctaaaattataaaattcttacaacataacaataaatgtttatgacctcgggttaggtattggttggttagctacaacagcaaaagtacaagcaacaaaagaaaaaagtagattaaatctccttggccaaaactaaaaacttttgtgcttcaaaagacaccaccaggaaagtgaaaaggcaatccacaaggttatggactgaatatttgtgtttccccaaaatccatatattgaaacctaattccccaatgtcataatatttgagggtgaggctttggggaggtaattaggtcttgaagtaagtaatgagggtagagccctcatgaatgggattagtgttcttataagaagagacacaagaaagataatttctctttctctctctctctgtcttccatgtgaggattcaacaagaaggcaccccctacaaaccaggaaaacagccctcacaagccccttgatcttggacttcccagcctccagaattgtaaaaaaaataaatgattggttttttaagccaccaagtctatggtatttgttataacagccctggctgactaagacacacagaataggagaaaatgtttgcaaatcatatctgatacgcaacttgggtccagaataaagaactctgacaactgaatagtaaaataacaaattttaaaatgggcagagaatgtgcatagacatgtctccaaagaagatatgcaaatagccaataggcacatgaaaagatgctcaacatcattggctatcagttaaataaaaataaaagccatgataataccatttcacacccactaggatagatatagtaaaaaagacataactgctggcaagcatgtgaaaaaactgaaaccctcatatactgatggtgggactgtaaaatggtgccaatgctttgataaactgaatggcaatttatcaatactgaaaatagagctatgatatgacccagaaattacactcctaggattcccaagagcaataagaacatacatccactcaaaattaagaaatagaatgtaacatatccacacaatgaaatatttttaggcaataagaatggagtagcaatatatgctacaacatgaatgcgccttgaaaatatcatggtatgtgagagaagccagttataaaagaccacatattgtatgattccatttctatgaaatgtttataataggcaaatctgtagaattagaaagtagattcatggttatttggggccagaagtggggtggtgttggggaaaattagaaatgactgctaacaggcacagcatttctctctgagggagcaaaagtgctctaaaagtataatgtggggttgtacaactgtgtgagtgtaggaaaaagtactcaattgtattctttaaatggattaattataatttatatcaattacttcttaaatagatctattatgaaaaataatagaacattccgctggaaatcattttggcctacttgagttcaatgtattcatttaagtttggggaaaactgagactggcaagtcacgtaacatgtctgaagtcacacagctagaaatgagtaaagctgggaatggaatccaactaataaaaatggtaattatatttactgagataccattagatatctgcactacttgtgcctcctgagacactcctccacaattattggaggcctcccactatctctgcctttggaactacctccaggatctgcactcctgaacctatttcctaatctcaccaagctggactgctagtcctttgctcaaagtcagttattgcccctctgcctttccttttgggtttcttattatctgttttcttcccaagcccatatttacctggcatcttacaagcctcagctttccctttgttctacatttcacagctttccaggatcaagtccttgctcttcagtggtaccagtgccacccctggaatcccacccttggtcagagctcataatagagttcagacattatgagctaagtaccaggttgtcttgtttttagaaaaaagtctataaggcaagtatcttctggccattttggagaatgttgaagtttagaaagactaaataatttgccaagggtcattttgacagaaaatggtagagcagggaaatgacctgtctgattctgttctcctttctcctgtgcagacaacctggaggtcttatgctcccgtttattgtttttactatattcatgggttataggatctgatagttttctgttgctgctataacaaattatccactaacatacaggtttaacacaacataaatttgttatcttacagttctgtgtctcagaaatctgatgcaaatcccactgggccaaatcaagtgtcgccaaagctgcattccttctctaggtctaaagaagaatccatttccttgcctttttagcttttagaggctgcatgcattccttggcttacagtacctctccatcttcaaagccagtcatagctagtcaagcctttctcaaatttcattcctctgacattggttccttttctgcctccctccccttaatagattaaagacctattagattatattgagcacacatggataatccagattaatatctctctattaaagtcagctgattagcaagcgtgtcccttcttgctgtgtaaggtaacatattcacaggtttgataaataagggacatctttgggggccattatcctgcccattatgtaggatgagaatggctattcactagaacagtgtagtaatctcaagtatccttccccagccctccttattttaccattccataccctaactatttccttcatcctccattaggatctgccctttgacacatctaatggattgcttcatgtccaaacatttttctcattcatccttgcatcacaattcatgttgtcttcctcattcatttggatttccacatatccctggctcaatggatagtctaagttgaactcaaacgtttatgttggataatagtataataaattactcctacaagaaaatgctgatattttaatatggcccctaccccatgctttattgcaaaagaagtagagtcaatccttcagggattctctggatatacttggaaagctcaggtttcaaatcagatctaacttttgtttaaatctgccagagtgctcaggggctgtatcagttaaggtttttgttgtggtttcaagtgacagaattgaatttgatagtcattttcatgctgtggccaagcaaaagaaaaaattaattttaaaaaatacaataattagagttgaaatagagcaaaataagaaaagaaagaagtatagaaggatcttgttaagacatttctattagaaaaaaacttgaaaatgtcagagtttttttgtttgttttgttttattttttatgttactcccctcaagagaaagactatcaaagtaattagctggccaagtttagcttcctgtctttccttggctctactatggcaacgaaggaaaagatctggcaaggaataaactaatggattgtaggacatttctttagtttcatttgtgagaaaatagggattaaaggcgttatctctcagggttcaaccagaaaagaagaaccaataggaggtatagattaatagatgtatatgtaatgcaagaaattggccagcttggtgagattaggaaataggttcaggagtgcagatcctggaggtagttccaaaggcagagatagtgggaggcctccaataattgtggaggagtgtctcaggaggcacaagtagtgcagatatctaatggtatctcagtaaatataattaccatttttattagttggattccattcccagctttactcatttctagctgtgtgacttcagacatgttacgtgacttgccagtctcagttttccccaaacttaaatgaattattgagggctggctaagtaagttcaaactctgcagaccatcaggaagggaggctggaactctcaatacaggctggagctgcaagccatgggcagaatttctgagggaagcctcagctctgctcttaatgcctttcactgattgaatcacaccaacccaaactgtcaagcataatttcttcacttaaagtaaactgattatgtactttaatcccatctacaaaatggcttcacaacacttaaattagtgcttgattaaataactgaaaactgtagcctagccaagctgatacagcaaaaagagcatcacagaagaggagtagcagaacaggtcatctcagtttatagactcatcgaaaactgttcacaatgtaggagagataattcaccagaacaaaataatgggagaatattggaaaggggtaatatactctggaaagccaaaagcaatgcccctaaagagactggagagattggcaagagaggttcttgcagagtaagtggacagtctaagatggtaagagggctttttttacctgtctggatctttctatcaaattgccttctgcatgtgtccatccgatgagctactactctgtgaggcaccatagtccttcttgttatctttcatctctgtaatgcagagtaactttgatgtggtaagtaatttaggattatcaggtacaggagagtttagttggaaaaaatattttgaaggcatagatgcctatgggaaccctcaaattacaacatatgggcagctactgttttagcctatggtcaagtgtggccttagtgataggatcactaagatatatcaaccttctagtaacaacatgcccacagggactgagagaaatttactacactcaaggaaaacaactcattgccatcagcacaaaacaaacttaagatggaaaacatgataaacatgaagtcaaaactttaagagatatatctgtcaaataatacatccaattgatgtctaaattcctcaggatttctgaaaacacagaggttaaagttgagctggagcctctcctttgtctgttccaccacctgaattgttggggtttttttccttaccattcattttgcaaatttgtataagctctccctttcttggttacctaacatctttcccaccttcattccctctataaataccatttctgcagcatcttcaaaagcttatctcctctccacagctgtctgttcaaagttgagagtctgacactgatttaaccagcttgaattgctctgaaataaatttctcagggtagagaccaattgcttaagcattgtcaatagctgaatataacgttggtgcttcataaacacagaatgaacataaataacagaaaatctaaaatagagtattaacttctgtattttgtacaattaaaatttgatgttggggattgaactatggaacccccccaaaatttatcagtaagtgggtgctgtcttctgttatataggagacagatttttacaaatggaaaggcggggatcctttcagcattatatgaatgcacaggaatactgactttttattccactgcgcctagactctccatagaagagaatattagctgttcacaattattctttcccctgtggcctccctctgggtagaaaagacttctcaattctattgactttgaacttgcccatgtgatttcatttggctaacgaactgtaagtggatgtggcttgaacagaggtcttaaatgtgcttgcatgtattgctttggcctctagaggtacggaattttatgagttcagaatgaaactgtcatgtttccagaatgaggagacctgtggaaaaaatctggactcattcacagcctaaaacgagtccgtctaaccccaaccgaccctagtcaagcccaacagggtcacagctgactctcagatgtgaaagcaggaaataaatgtttattattataaaccactgagattaaagggtggctttttacatagtataatcagaatgataataagtaatatattcccagatcctcaaataatttcaatgagaagaaatgaaacattaggaaatattgagagtctaaagaaaagtttgctcctacattatacttcctggaatctctcaggtcaatttcatcccacagatgagatctcagaaatgtgatgagtctgtagttctttttttcaagcattttttgtaataaggcaccttggacgtatgcccaaccaatgtgtaatgattagtctacccacaggtataaatgaatacctctggaggaaacacaaattattcattgtggtataacttggttctaagacaatcccctagggaatcacattccctgtattcatgcacttgtgtagtcccttcctacattaaatgaagaaatgaagcacatgtgacactttgtgacttctgaagctgttataagaagccctgaggccgggcgtggtggctcacacctagaatcccagcactttgagaggtcaaggcaggcagattgcctgagtccaggagtttgagatcagcctgggcaacatggcaaaactctacctatagaaaaaaatacaaaaattagctaagcatggtggtgcacacctgtggtcccagctacttgggaagctgagatgggatgagcacttgtgcccaggaggcagaggtcacagtgagccaaaataacaccattgcattccagcctgggcaacaaattgagaccctgtctcaaaaaaaaaaaaaaaaaaaaaaagcagttttaagtctcttccttggtctcttagagcactcactcttggaatcctgagctgctctgtgagtagtctgactatcctgctgaagagaccatatgaagaaggcctggagccctatggagaaagagagagaccaagctgagaacagcctttcagctgtctctcccaagccaccagacaaatgagacctcagacaaatggaacctctgtgaactgtccaagaccatcccaactgccccaccctgcccaaattcttgatttatggctcatgggcataataaaatgggctttgttttaagccactggatttaggatagtttgtaacacaacaatagagacctggaagcttcatttacatgatttaccaaagtgacataactagttataacaacaggcaacatttattaatattgtcaaatgtatgctatgcaccatgtatcattatttaatttcttcctcacattgaaaatagtactaatgaaatgcagatgatacaatttttcagccttatgaaggtgtgaaattgatatgcatttggcagaacccatacttagaatttttcaatttcgatcttttcctggactagcattatgaggtacagtactctctctctctctctttctctctctctctctcaaaatgctggacagtgacagcaagccattctgcctttcgctttcaatacagtgatatgcccagtgagggcccggaagctccacacccatttccccatatttcatcctatgcgcctctttttctgtgtcccttcaataacctttctaataagctggtaaacataaagtaagtaaattacattagatattcaacactgtattataaaataggctttgcattagattattttgcccacctgtaggttaatgtaagtgttcttagcatgtctgaggcaggctaggcttacgccatgatgttcagtagattaggtgtattaaatccattttagacttaggatattttcaacttatggtaagttcatcaggatataaaccccatcataaatcgaggagcatccatatgtaacatcattattgctgttgagcaggtgagaacgtttagacatagagatattaattaaattgcccaaagtcagatgggtggtaaagtagtggaaccaagatctaatctaagtatcgctccaagccccaatctcttaaccatactaattaaaagttaggagaaacccaggatctggtttcctagggcagtgctcatttacttcagcccatctgcagcaaccaggcagtcagtttaaagccttttgataaatcgtacaacattggcatttgtatgaagaaacaggcaggaaattaaattacacctattaaagtaaaggctgatttagaccagtggaaagtctggcccatgcagtcttttaggtgttggaaaaggaacagaaggccaaaataatttatgttaaaaaaaattgccaagagccataaaaacctgagtattcacaacaaagacaactactatctgccaattcaagaaaagctagcagaattaagtaaaaggataaagcaaataacttttcctctctaggtggacttgtctttacgggcctgattcagttggatatgaaattggattatgtaggtgactaaggttttcacaagggtgttccctcaaacataactgtctttatggccaacaaataaccaaaaaattttctagtcatttataaaaaatgtgaatccaagaagagtatgagggaaaggaatctaaataatatggaaatgataaatgtcttctattggctgtggctggtagcaggagatctgattattatcagcaagtggccttgacaaaagggcctctgaacctgggtgctaaacaattttaggcagcctcaaatcagtggtataagctattgtttgaaggtgactatcaaatatatgaaataataggtctatcaaaagcatagttaggaatgtcttcagttctatcaatcaaacaaaccaatttgaggaacaatctgcaaaataactggttcgtactcctcaaaaatgttaaggtgataaaagtcaaagaataactaagaaactataatagaccaaaaaagactaaagggacatgacaaccaaatgctacatgatattctggaatgaatcctggaccagaaaagggaaattatttgttcccgtttgcttaaaaggacagtaagaaaactagtaaatttggtttatcaaatactatagataatacggtatcaattgtaatttcctgattttggttgtgattttgattatactataattgtttgtaggaaatacatattgaagtatttaggtaaagggatattatacttgcaactttctctgacatgattcagaaaaaaaatactccatctggaatttatttttgtacataatatcagataagagcctaatattactttttatatgcataggatgtaagtccagcacagcttattaaataattcatccttttgtactaaattataatattgcctttgtcttgtattatcatatataactaagatctatttttaatctttattttaatcatgcatctactttccattcctttgccaatatcatagtgacatgattgactttatggtatgttttaattcttggaagacaagatctaccctacttttcttttctctacacccccttttatgtatatataatgtatatatatgcatataatacataactattcacatatacatgaaatatttatatatgtacattgtatatatatttaaatatacatatttatgtgtatatatacattgtgcatatttatgtatgtacttatatgtatgcaagtttgtatgtacatatatgggtgtagatacatattgtatatatttgcgtagatatattgcatatacataaacacatatatatgaaagtatatgtgtattgctacagtaaatcattttcccccatattttttaaattgctctatgcatggttgctcctctttattccattttttataattttgctttctcgcctttttccatagactcttgagggatctaaccagtatttcaatctttccaaaaatgacaatatccttcccagtattttgtttccccccccattattttcatttttactttattaattccctattcctgctctctggtttattttttctttcttaatgttttaaaattgataagttaaattccgatgtggagaaataggaacgcttttatactgttggtgggagtgtaaattagttcaaccattgtggaagacagtgtagcgattcttcaaggatctagaaccagaaatatcatttgacccagcaatcccattactgggtatatacccaaaggattataaatcattctactataaagacacatgcacacgtatgttaattgcggcactattcacaatagcaaagacttggaaccaacccaaatgcccatcaatgatagacgggataaagaaaatgtggcacatatacaccatggaatactatgcggccataaaaaagaggatgagttcatgtcctttgcagggatatggatgatgctggaaaccatcattctcagcaaactaacacaagaacagaaaaccaaacaccgcatgttctcactcataagtgggagctgaactatgagaacacacggacacagggaagggaacatcacacactagggcctgttggggggttgggggctaggggaggatagcattaggagaaatacctaatgtagatgatgggttgatgggtggcgcaaaccaccatggcatgtgtatacctatgtaataaacctgcatgttctgtacatgtatcccagaacctaaagagtaataaaaaaaataaataaataaatggcaaaattttatataaaaaataataatttttatttttattccttaatattaaaggcattcaaggccacactcagttgctctccgtacagctttggctgtgtcatgtggttccaatttgcattgctttctgtacagcgattttctttcaattccaagtttcattcaatggttatctagaaatatatttggaattattacatatttagtatgtgggggttatcttcatgccatttattcctaatttctaatatttttttcattcattgtataatattccttgcagcatgatcagaagagatggcctggaaaaaaaaacacttttttatgtgcaaaatttatttgtggccaagtacatgattaattttcgtatatatttcatggctagtaaagtatatttttggaacacataaaaagtctcctcttattaattgtactattttttgtgtagttacttaatattgtatacaagttatacatgcacaattcaaaaagaggtgtactgaagtaactgttgtatttgtacttttatcaagttctcacaattctaacagtttcactttacgtctactaaaagctgttgggttgttcggtgcatactagttcctggctggtatatgtctttcataactctgcttttcatcattatccttccatgacctatttagtgcttttaacctagaattctgtgttgtctgatactacctttgcctttcatgctttctttcttctttgcattttcttagcattgctctttattgttttaatcattttaagtgtctttttttcctgtaattaacattaactgtcttttttaaaggcagtttgacacatttaactggagaattcagctttcaaatttagtgcaatcactggcacatgacatgttatactttcccctttcatcgtttattttatattattgttcgtccttttttctgacttatttttctagttgattattattgctatttggtctttaccttatgcctgtttgtaaattctgccaatagattttttaattttttaacgattatctattttctttgttcataccaaaaacttatttctctacaattgtttgacataaaaataaaaactatttcccccaatgagatgttctatttcctatctttttccacctgtccatacagttacaggtttagcatacagtagtggtctgagggaggtatgttccaagcccccagtggatttctgaaaccacagatagtatctaaccagattaccgtaaactggaacacacttctgttcatgtcttccacccataaatttcttgtcttttccatcttaactaagcactcatcacacattgtggccataatttttgcagtttgaagtgagacagcaaaactagaacaaatttctttttcttcttcacaatttcacaaatggaagatttgttcttacaattgatctcaacaacctccgcctatgatttttttctttccttgttaaatcagagagttcacctatttacttaaaagaagtactttacgacttctctttggcatgttggaattgtcaagtttcctgcactttaggaccatttttaagtaaaataagggttatttgaacacaagcactgcaaaactaccaaagtccacttgataactcaggcggctcctaagtgactaatgggtgggaagtgtctacagtgcggacaaagggacaattcacgtcctgggtgggacagagctggacagtgtgagatttcatcacactactcagaaaggcaggcaacttaaaacttatgagttgtttattgctggaatttttcatttaataattctggaccacagttgactgtgggtaactgaaactgcagaaagcaaaaccgtgggtaaggggaacctactgtatatgcatttctctagagcatcctcccccaatgttgagaaagaatttgaaatgatttacttcccttatcttttttccccacctcaatcgtaggagttactaaaaaaaatttagtaattttaaatctaaactattacatgaatttttattgcagtgtgtctcttctctttatttatacttttatcatagtatatttagcatttatataacatatactcaaatactctatattatgatccattcatgtctaagtaaacacaaaaacagcatttatctaccattcattgttctcagtttctacaccatttcacatttccctggcttgatttcttatttctcctttacttgttcacttagaatctcttctagaccattgtgttttcctgaaaaatatactctatgaattattataaaatattaatagaataatttgaccttccagatgaattacagttttgcaaagtaagagagtctcaggttgaaatcctttacactgcgttgtcgtgaagaactataccactgtatccctgactcctatattgcagattcaaactaggaaaatagtctaaatctcttctcttatttgtgaccttttctttctggctggaaggttataagaatttctttttgttcttaaaattccagaattttccaagtatactcatgtatattttatctcatcaatattccctagccctcacaatatgccctttcattccatgacttgggtctttgatctcagagaaattgtattcctaaattatatgtgcattttgatgtccaagatctgtcctccgtgtctcttatttttggtcataatttctctctttatatttttgttctttattttaaaaaaatttagcccagttaatttcctgggtcatcaatttattctcaactctgatcattctttccttcaattaaaccaaaaactcttgcacgaaacttgtttttaattccagaaattttactcttatattgccttgaatgtttttttatttttaagctgtcatttggctcctctgttctgactgatcttcatatctctagcttctggtcatttttaatattgtttttccatggagtctaaaggtttgattgctggagaccactatgccctgtaaagagaggaagctaagtattctctactccataagtctctgccagtgcaccaaaaactaattctttgcctaatccctagcctactttcactctctctgcctgagaagcagggaggacttcatccacccatcaatttctttttggcctcctaagcaccagtgagaccagccatacacccatggacaatgttgaccatctatcaggaagggggtccacacattgctgaggcccatggtttccacaggactttcaattttcaatcctccctgcaattccttctgatggtctttgggttatcatctatccataaaggcaaaaaaaaaagaaaaaagaaaataaaactccattctcctttgacccaccctaactcctgcagaattcaaatcttactagcaaatagcttcctctgagccccagcaagcttattattcaagaaagacagattagaaataaaataaaaagaaaaggagtcataagtttcccaaaacaccccttttctttacagtttttaaatttttcctcatattttatcttgttcgatccttacattatgcagtaaaggttcaaaccctgaaattacaggctcaaggttatttccacattttagaaaactgtaataaacagaaaaacaacacttagattgaccttgcttagacatacatggtcacattccaacataaacatgctcatgtttcaaagcctgcaaataatcattatatccttccaaatttttaagaacatgatctccaaagggaggaatatctgagatatggataataaagaatggaacagctcacatggtctggggctgtgggctcagcgccattaacatatgctctcctaacaggactgtaccaatgcatagtcactgtcagcttttctgagcttcttgtttgcaccaagcacagctggaagtacagatgtaggaagcacaccggcaggctggaaaaggatcaagacaggtaccgataaggctcttttcctttagatcttaaaaggaagatgtacgtccttttccaaactccaaatgacatctaaaaaaccttcggtcaacacagtgttaggaaaaacatgtgttaactttttattcatttatttttcagttacagactacatgctaaaattcaaatgtgactgttgtgtactctccatgtaaaaaaattaacaggaactatacttcctctgacacaataaaactttagtcatttttacaacgctccaatgtgtgaacaagtatgagaactagactagacaaccctttcttttcgacatatatctctcactgtagtcttgaatggtataataactcttattcttttacttccctttttcccttagccacttcatgctcagagttatcaccctggagaattgccactgcatgcccaggttataacttggatgctgatgacagcttaaaggggaatgcctcttatcagttcgtattttaaaatttcccgccctttgttctcacaggagccctcattaaccagttctgggtctgcacagtcctgtagaaaacacatctttcaagtttatgggcagaatactacaggctggtgctttcactaagtagccctctctaatcacttttataacttattgtcccatcagcaagcaaagcttaagataaactgcaacctctgatatggttacaacaaatccagcttgcaaaagtgcctcctctcttttcaggaaattccattcaacagtggtacaggcaatcatccatccatcttccttgacttttttctttccatttcttcttaagcagtggatacagtcacagatttgaaatcaaggagactcaagtcttcccttttctatttaccatctctaaactagagtttcttataccgatgcctactccctgggtaatcaggtatgcaaagagctcaatacatttcctggcatatattaggtgttcaataagaggtggatttttatagtagaaggctctgggatcaaggatgtataactcttcacaggaaggaagaatggaaagatgagggatggaaggacggaaggaaggaaggaagtctggtttattaaaaatgaagccacagttcagaaacgtttacagttctgtagtactgcctcagacttttcgcagcattctttgtgccaccactctagataactttaataaaccagtcagggaaaatgcctttggcagttgtataaaaaatatttttgtctattttgtggagatgatttttgccaaattgagttggtttgtaaatacatagcttagtactaccaaggcatgtcttccttctgggacagtcatgacacaaaatattcctttctaggataggcctggtgttacaactcatcttttataacacaaacacaaactccttgattagactctctcttatatccaacaacatctctcctcatccccattagccaaaaagcaatagaaaatgctgatgatagcaacaaatattactttaatatttaggagttcttggtctccgaggaatttgagatctgacatatagaaatcactcagtaactatttacgggaaggagggaggaacggagggagggagagaaagagggatggatggatggccgaaaagggtttgaaatcatctgggatagcaatgatctttttctcagtgctacttgcacagtggccacactctccaacattgccctatatttttctcagattttttaggatatacctactctaagttcaatggaaacaaactcaactgtaggatatcacacacactgaacattatggcaagaattagtactgtggaaagaagtataacactaataataagtataatactaatgataataataacaacaataatacaaggtgcaactaaaattaattttatacttaacatccgacagtcactttcctaattcccttacttaggaaagggcttttattttaactttcttattcccttttttgcagtttgggaaaatagaagcccagagagaattaagttactcacccaaggttaccagctagacagtagtggctggcatttgaacctaaatcagtctgacaatggaacccacactcatattcatcatactgtcattttgtagtcatcacaacatatcaaccctcaacttcttgatgctctgacagctatcactgaaaataagcaatatgactgtatttattagtaaaagctaacccgaatttttctcctgcttctactggtaataaaacatggtaataagtccaagacatggttgtgagcccaggtataaaatcctaacattgctacatgatctccaatcctcccttctacctttaacacactaagattccatgtaatcaaagatcagtgtggaaggtctatgttgatgaatcatgatgttaaaataaaatttaaccataaacaagaagaaaataacaatatgaaaaatacatgatgttagtaaaaaatctttttaccttaggagatggaagccctgtgtacaatgtgctgtgtgtacatttcccagattttaactatgcttgctgtgctttatttatgagccataaaacagtaatccataagtgaagaatgaaacactcatagtgctgtttaatgtgatatttacactcttagaatcagatgcccttttgtcatcataatggggcatattatgaaaaaaaagggaagtaaagactgaagagatttacaggcagaattaccaaaagtgctctgcaagaggctgaaaatcactatcagattaattgtaataataattaaaaatctctaaaaagctatgattattcactgaaaagaacgagtatgctacataatttctttttcagcaagaatggacgacaaaatttgaagaaaaacaaaaagtagggggacaaaacaacagaaaagggaggaaggaagatggaaaaaggagccagaagaagcagcaaagagtggaagatgacaaaagaggaaagagaagaaggaagggtgaagaagaggaagaaaaaaggaggagatggaggacagaagtggcgaaggaagatggagagagagagagaaaggaaaagaaagaaccttccttttggccatggatatagaactcacatttgcagctatttcttcagctccagtgttccttcatgcagattacaactaaatctgagataaaatgaatcttaatgtttccccaatgttcaaccttcttacagatgttaagataccatcagagagggctacactatttaaaatttagagagaagggaaaaaatataaaaatgcacacatgcatacacacatttataccttatatttgacaagaaaagaatttccataactttatcccaagctgccgtcactgtgaaattatccatcatctatgaggtcatgaaaaaaggcagggattgtcaaattttctcatctcaagttatttcttcagatatcagctttgtaacacagagcttctccataactgtaaattaagatgtgtcagtagcatccaaaacaaatgtgaaatatttgcttttgagatatctctttgcatttcaaggagagagcatagaagtgctctttctctctatatctcactgctccaataagacatagaagaatcccttgtagaaaaaaactagcaatagtgtcatcatttatttaagagtaagcacattaatttttttttttttttttttttttttttttgagatggagtctccgtctgtcacccaggctggagtgcagtggcccgatctcggctcactgcaagctccacctccccggttcatgccattctcctgcctcagcctcctgagtagagcacattaattttctttttgggaactgatgccagcaggagttagctcagtgaaggtaagaaataagttatgagggcaacaggaagataacacagcaagagggcaatttaggatcttaaatatttaaaagtatatgatttgaaaaatcatacaagatgtttttaatcctaagttcatgtctaccagaagcaagtatttctaagcatattgttctattcttcttctccagatgaattatttttatgattaactaagtatattcatatatttattccttaaacaaatgtggtttagggatctacaatacagatcaaagctataaatgtgataaaccaaatataattctcctagataattcatatacaagggagggacaaaatttaagaaactacatactaagaagaataacagctaatgtttgtgggtatttacaatatgtcaggcaagtaggcactattttattatccccattttaagaataagaaaactgtgtctaagagaaagtaactgtttccaaatttgtaaattctattttaaaaattggcacataaactctaatctttcacctgtactttcaactgctgtgctactatatatttatgtaaaagatttttattatcagagaacaatcaagcattatgtgtgtttagataatagagagaaatttgcagctggaaggaccagaaaagatttcatggaagaagtagcatttaagccaagtaagtttcagttctttgaagatggagcaccatgtaaatcattccaagtgaagcaattctatctacctcgtgtttttagaattactctactggggctgggcaaggtggctcatgcctgtaatcccagcactttgggaggccaaggtgggcagatcacttgaggtcaggagtttgagaccagcctggccaacatagtgaaacgctgtctctactaaaagtacaaaaattagcagggtgccgtggtgggcacctgtaatcccaactactcaggaggctgagtcatgagaatcacttaaacccaggagactgatattgcagtgagccgagatcacatcaaaagcctgtcaaaaaaaaaaaaaaaaaaaaaaaaaaaaaaaaaaaaaaaaaccacctctattggtataggaactcctgtcatttcctctaagaagtgtgtatcagaatcatctataatgaacatcgatgttcatttagaaattggggcttgtagctttctctcctttatcctcccctgccaacatccctgagcagaaaatcacatctcatggtgagtccctatggctgataggaacactcaggtgtgctgggcctgtgaggaggagtgctgccatagctatgcaaagtggaccagaacagagaattgagtgaagctgaagagaccatggcagagaggcaagcacaggatagtggcaggaaatttcagctgttaaacatccactccagcaatgccaagcatattaatcatcccaacaattcctaagtaggcattgttttccgtgcaacatatgggatcatgcagaatctgaaatggaatttgcccaggcttacacagagagtgagaggatttgaatcaagatgggtcaaacaccaatacccagggcttgtacctcaacagactgtggtgtcagttgcctccctactgtcctcactccaaccacagtctctgtcaggtttttataacaagggaaggtgaaaaagcaaacacatgtttgctgtttgaaagagtatgtctgtcttacttgcagaatggcccggtagaattattttgtcaaaaatatactaccagtctccagctttagataaattataaaataatactactaataatcaagtccattctaaaattgagaaaggaaattaatgaactagaggagatagaaaggatcataaatgcagtcagtgggcaaaatatttagtggcaaatacttagggctagcctaagaaaacctcacacccttctggactttattctctaagaacagtcaagattcactcaagaaagcataactgcaatagaataaggagtttatcataggaattagaccgtaagcaagtgtcagggggtctggaggaggaaagctccaaaaaatgagaaattcactcaccagccatgttgtgggtgaaaatgttcagacttcagagatctggaaccttagcatgttcacattctacagtaagaaagtgaatgaggctggttctacagaaggtttctgtttgcaatgagttcatagcaaactgtctctgagtgggatggggtcacagttggtcaaagagccttccacataaagcagagttggactttcaacagaatgaattgcaattgcccctctctctgtctctcaccatctctaaccaccaaagcccttcagagtttgatatacgctgctctgtttcacttttgctttacaaactctcacaccaattctaatctaacaccatcccggcaggggttgtggaaaatgtagtaccaagagagctagggcaacaatggggaagaggccagcaaagtatgtacagcctatggaacaaatccatcccacctcctgtttttgtaagcaaagcttaccgaaacacagctatgcttatttacttatgtattttctgtggcttcttccatgctagaacaacagagttgaatagtggcaacaagaccagaaggcttacaaaacctaaaatgtatattctatgaccctttacaacaacaaatttgttgaccctacaacagaataacccaggagaaccttcatcacatttgtaatcatttattcagtgacagaattcccatttaaatagtaagcagaactcttattgcccatctctaagtccagagcttgggtcatagaagtactcagtaaatgtctcttagatcacaagtcaattgaggtatctattagacttgggctctgacttgaagtggtaggaatctgaacaggaacccccttggggtaggcacagttaaagtctaagcaagtggtcaacatggaggaattctgcccagatagaagagctccacccctctccagggatcgggaacaggacgctagccctttgaaagagcaactggtggtggcaaaatagaaccccaatcaaaaagagataaggatgctaaacatctataaggatgctatagagaaaaaaaaagttcttgttgataaggtgacacttgatcagagacctgcaggcagtgagggataaagccatgcaaatacctggagatgaagcattctgggcagagggaccaacatgtgcaaataatataagaagcaacttgtttggcaaattcagaaataacctatttctttaaatattgatgctaggctttaattttgagatagacatacttgatgtacttgcctaaagttagaattatgtccagatttgggggggagagtaaggagatattggttaaatggctataggcttagaaattgggcaatgcccaatatactaaaactagaatttatttgcatagaatttctaaccaaaatgcaaatttattcatttatttttaatttaatttgattttaagttccaggatatatgtgcaggatgtgcaggtttgttatataggtaaatgtgtgccacggtggtttgctacacccatcaacccatcatctaggtattaagccccacatgcatgagctatttatcctgatattctccctccccacacacctgccacccccaaacaggccccagtgtgtgttgttcccctccctgtgctctcatttttcagctcccacttataagtaagaacatgtggtgtttgcttttctgttcctatgttagtttgctgaggctaatggcttccagctccatccgtgtccctgcaaaggacatgatctcattcctttttatggctgcatagtattccatgtgtatatgtaccatattttctttatccagtctatcattgctgggcatttgggttgattccatgtcttggctattgtgaatagtgctgcaatgaacatacacgtgcatgtatctttataacagaatgatttatattcctttgggtatatacccagtaatgggattgctgggtcaggtggtatttctggttctaggtctttgaggaatcaccacactaacttccacaatggttgaatttctttacattccctccaacagtgtaaaagtgttcctatttctccgtagcctcacaagcatctgttgtttcttgagattttaataatcaccattccaaatgtcatgagatgctgtctcattatggttttcatgtgcatttctctgatgatcagtgatgttgagctttttttcatatgtttattggccgcataaatgtcttctatttagaagtgtctgttcacgttctttacccactttttaatggggttgtttttttctggtaaatttaagttccttgtagaccctggatattagacctttgtcagatggatagattgcaaaaatgtcatccctttctgtaggctatctgttcactcttatgagagtttcttttgctgtgcagaagctctttagtttaattggatcctaaattttgcttttgttgcaattgtcttgattttttcatcatgaaatctttgcctgtacctattgtctagattttcttccatggtttttatagctttaggttttacatccatcttgaattaagcctttaatccatcttgagttaatttttgtataaggggtaaggaagtgatccagtttcaattttctgcatatggctagccagttttcccagcaccatttattaaatagcttgtttcatcaggtttgttgaagattagatggttgtagatgtgattcttatttctgatatctctattccattccattgctctatgtgtctgtttttgtaccagtaccatgctgtttcgattactctagctttgttgtacattaatagtttgaagttgggtagcatgatgcctccagctttgttctttttgcttaggattgtcttgactatatgggctctttttgggttctatatgaattttaaagtagttttttctaattctgtgaagaatgtcaatagtagtttagtgggaagagcattgaatctataaattactttgggcagtatggccatttttatgatattgagtcttgctatcaatgagcatggaatatttttccatttgtttatgtactctcttacttctttgagcagtggtttgcagttctccttgaaggggtccttcacttctcttgttagttgtattcctaggtattttattctctttgtagcaattgtgagtaggagttcattcatgatttggctctctgcttgtctattgtttgtgtataggaatgcctgtgatttttgcaccttgattttgtatcctgataatttgctgaagttgttcatcagcttaagaagcttttgggctaagacgatggagttttctagatataggatcatgtcatctgcaaacagagacaggttgatttcctctcttcctatttgataccctttttttctttcccttgcctgagtgccctggccagaatttccaatactgtgttgaatatgagtggtgagagagggcatccttgtcttgtgctagttttcaaggggaatgcttccagcttttgcccattcagtatgatataagctgtgggtttggcataaatggctcttatcattttgaggtacgttccatcaacacctagtttatttagagtttttaatggaaggatgttgaattttattgaaggccttttctacatttatttaaataatcatgtggtttttccctttatttctgtttatgtgatgaagtatgtttattgatttgcctatgttaaaccagccttgcagcctggggatgaagccgacttgattgtggtggataagctttctgatgtgctggattcagtttgccagtattttattgaggatttttgcattgatattcatcagtgatactggcctaaagttttctttttatgttgtatctctgccaggttttggtattagaatgatgctggcctcaaaaaatgagttaaggaggagtctttccttttcattatttggactacttttaattattttgaatagtttcagaagaaatggtttatagtattctctgatggttgtttgtatttctgcggagtcaatggtgatttcccctttatcgttttttattgtttctatatgattcctctctcttttttcttctttattagtctagctagcagtctatctattttattaattttctcaaaaacccaggtcctggattcattgattttttgaagagtttttcgtgtctctatctccttcaattccactctgatcttggttatttcttgtcttctgctagctttggggtttattttggggtttgttttctcttagttttagttgtgatgttatggtgtcgatttgagatatttctagctttttgatgtgggaatttagtgctataaagttccctgttaacactgatttagctgtgtcccagagattctagcatgttgtctcttttttcttattggtttcaaagaacttctttatttctgccttaattttttatttacccaggagtcattcaggaacaggttgttaaatttccatgtagttgtgtgctttgagtgaatttcttaatcttgagttctaatataattgtgctgtggtctgagatactgttataatttcagctctcccacatttgctaaatagtgttttacttccaattatgtgataatttttagagtaagtgccatgtggtgccaagaagaatgtatatgctgtctttttggttgcagagttctgtagatatctatcaggttcacttgatccagagctgagttcaagtcctgaaaaaccttgttaattttctgtctcaatgatctctctaatattgacaatgggttgttaaagtctcccactattattgtgtgggagtttaagtctctctgtgggtctctaagaacttgttttatgaatctgggtgctcctatattgggtgtatatatatttagaatagttagctcttcttgttgagttgatttctttaccattatgtaatgcccttctttgtcttttttcatctttattggcttaagtttgttttttcagaaagtaggactgcaaccccttcttttgtctgcttcccgtttgcttggtaaattttcctccatccctttactttgagcctatgtgtgtctttgcacatgagatggttctcttgaatacagcacactgatgggtcaagactctttacccagcttgctatcctgtgtcttttatttggagcatttagcccatttacatttaaggttaatattgttatatgtgaatttgatcctgtcatcatgatgctagctggttattttgcagacttgatatagatgcttcacagtgtcattgctctttgtacttcagtgtgtttttgcaggggctggtaacagtttttcctttccatatttagtgcttcctttaggagttcttgtaaggcagggctagtggtgatgaattcctccagcatttctttgtctgaaaaggatttcatttctccttcacttatgaagcttagtttagctggatatgaaattctgggttgaaaaatgttatctttaagaatattgaatattggccccaatctcttctggcttgtagggtttctgctgagaggtacgctgttagtctgatgggcttctctttgtaggtgacctggcctttctctctggctgcccttaacatttttttcttcatttcaaccttggagagtctgaagattatgtgtatggggttgatcttctcatggagtatcttactggggttctctggatttcctgaatttgaatgttgggctgtcttgctaggttggggaagttctcttggatggtatcctgaagtatgtttcccaacttggttccatccaccccgtctctttcagatatcccagtcagtcttagatttggtctctttacacagtcccatagttctcaaaggttttgttcattcctttttattcctttttctctaatcttgtctgcctgtctcatttcagcaagatagtcttcaggctctgaaattcttttctctgcttggtctatttggttattgatacttgtggttgcactgtgtagttctcgtgttgtgtttttcagctccatcaggtcatttatgttcctctctaaactggttattctggttaacagctcctgtgatgttttatcatagttcttggcttctttgtactgggttagaacatgttcctttagctcaatgaaattcattattacccaacttctgaagcctacttctatgaatgcaactgtcttagcctctgcccagtactgtgcccttgttaaagaggtgttgcaatcatttggaggagaagaggcactctggctttttgagttttcagcattttttcatggattcttttccatttttgtgagtttattgagcttcagtctttgatgctgctgacctttggatggggttttttaagagactttttttgatgctgctgttgttgctttctgtttgtttttcttccaacagtcaggcctctcttccatagggctgctgctctttgctgggggtccactctagacccgagtcacctgggtccctcccacacctggaggtgtcaccagtggaggctgaagaacagcaaaaatgaatacatgctccttcctcttggatctctttcccagaggggcacagacctgatgccagtggaaactcttctgcataaggtggctggtgaccagtgttggggggtgtctcacccagtcaagaggcaagagatctggggccatcttaacaaagcactctggccgctcctttgtggaagcggtatgctgtgctgggggatatcccagtagtccagactgcctggattcctcagagtccacaaggggaaagactaattctgctgatcctagaagactgcagctgcgcctcccccaaggggctcagtcccagagagatcagagttctgtccctaaacccctggctgcagttgctgaaattcctgcagggaggccctgtccagtgaggggggatgggtcagggtccagcctaaagagacagtctggccatgacctgtcacagtctctgtgctgtgctgtgctgtgctgtggggaattcctcttgggtctaaactgtacagtctccctggcactggcaggagaaaaacagcaaactggagctgcagtgatggttgctgcccctccacctagagtttgcaaatttcttatatacctaaaagatcaagtctagctaccttatcactcttattttaaataattatcaggtgcttacaatatgtcaagcactttccagctgccaaatgcttggaagggctgctctaagctccttgagggcaggaagcctcatatccatgtatatttcttagtgagaaattgcacatcttctcttaaaataaaagtataccctttcgtacattctgtatactagggcatatgaagtaattttatttgtgtttagtatgtggtttaacaaaaatctctaacatcattttttttttgtttatactttgatctcagatcattaccacttgagtggcaaattgataagttttctggattcctctgagatgacaaaagggcatccaggcagtctgataggagtttatagcacgccttagtttaataagctattaaattacactgctctcagtcaaagcagtgtaccacaaaacctgaacaaacatgagcaatgctcaggagccttaacctgtttgggggagtgccccccccaaaaaaaaatactggaatatttgatacaccttcaccaggttgtcaacagcacttccaataactctgacctgacccataaagcacattgaactacaaattgcctttggtcccttcaaaaatccagaagacacaaagtgatatcttcaaaacattatcacctaaattttaaaatgtgattgccacctccagcataaattgcttatacaatattcgatctattcaataaacactcagagagcacctaaaatatactaggctctgttttaagtgctttaaaatattaacttatttaatccttacaaaaatcctttaagtattgttacatactcattttatatatgaggaaactgaggcatgaggagaccaagtagttgcccaggcttacatagccaaacagtatctgaactggaatttgaactcaagaagcctcactcttcattaagattctctaagatgaatcacttggtggcttttccgatctttttattttttcttctgactccagttgttgaagtttggggagggggtagtatctagagggaaaactagaaggggaataagaggaagggattttacagtaatttttcctgagtataaaattcatatttattcatggcagaaatggcaaattatagaaacaatatagaaaataaaaaaccactgttttagataattatcattaatattttgttgtgaaatcattcaggtttttttctgcatatgtgcaaacaaatgtgggtttcagagacttggtatctttttgattttgtccattttatatcagggacattaacatcattattaaatattcttttgaacattatttccagtggctacatagcttgaattcacaaggatatgtcataatgtattttcttgttgagtatttatattatttccatattttgtctttttaagttataaataccaccacaataaatgtttgagcccatctctgcttatttcttcaaaatatgtctccaggaatgaaattactgggtcaaaggatatacaagcttttaaggcttatgataaactccttaataaattgccttccagaaaggctgtagcaatttggaagaaaaggataattattttctcaagcctcaagctttttctttagatggggtcacattccatctaagagacatcccaagacagatacccatgggaaatatacttccacgcaattctcttttgcatatcgtctctctagagtgaatcaaattatcttttattctatggtgacaaactgtaaacagtgcaaaatagaacaaagtgggaggtggagagacagcacctgtacaggctgggttctgcatagttagggcttatggtttagaaaagcgataacttaattgtcattagccatctccactttccaaagtaatttacattcattcatttgggattttctacatcgatttctataggatccaggaaggttaactagacctacagtgctgcaggggtaggaaagaaaactgatgtggggaactttttgcacttgtcaggactgattcttctgacgggcagccctgcttagcaacagctggtcgtggtcatctgagacagcaactccggaattacaattttccaattcttaaagagaagtaagaaatttggtattttgtgcagtcttccggtttttaaatattggcaatgaattcaattcaaaaaatgttgccctaaatataggacatattgttattaatttacctctttagaaatcattccatcttactgtactcccttagtcttataccagaatcttcgaagtagtcaaaggagtagctatagaagagcagctttgtactagcactctacctaggaagaaactggtacaggtacttggaggctctgccacctgtcttcctcccaggtattgattatttagatgaaatggcctaaaaagggtagcaggctcaactgagtgacaggagaaactaactttaaagaaccccattaccacccataggtttatgaatgactgccacttttaacctatctaggtatagctgaaacttcctaggacaaagacccatattatctgtgacatgctgctgccacctagtccatgacagccatggcgaagagcctgtaccatgatctattttaatatctcttgacctatttttatattccagcactaaaaagttaaactgctaacttaccaagcctgagcatgccattttccaataaaatacatttttacaagaagctttctatcccagttccgttttatgggatagtttccattgtacagaggtactgactgatcttcagaaagttgagaaatggaaagagtctttaatgcgttgtagcccagaggtgatccttaactactgacagcttggaaatcatttgcactcccagtgtgtgcagtctccgatcttaactcccccttttgtgggaatggcattatgtgggttataaaaacaaacacaacacttaacaaagctactaacattagtgctcaggaaaaagtgaacacattgatttcaattcttggccataagaattctttccttagcactcttccagatcattattcactccactcacttctccattacaagaatacccttcagatattgagctgtctagcttccagaaaatgtagggcagtagactttttactgtgacaattactaccctgttttattcacatttctttgggcttgtctaaaagtctcacaatactgattgagggaagagagtaaaattgatgtgatgtaacacaaaactagttcatcaaaatggaaagctactatttcagtccattttctgctgctataacagaataccacagatgggatacattatttaaaaaataaatttatttggctcatggttttggatcctaggaagttcaagggcatggctgtggcatctgctcggcacctggtaagggccttcctgctgcatcatcccacagtggaagacagaagagcaagagggcacatatgccagagaaagcagacagagagagaaggagagagagagcatgagagagaatgagagagatatcaaacttgcactcaggcccttttataattaacagtaatccattcatgaagctggagccctcattatctaaacacctcccattagaccccacttcacaacactgttgccgtgagaattaagtttttaacacatgctttttggggtacatattcaagccatagcaactgctgaatgcaaattatctggtattggtttctttaaacaaaaggatttaattacttgaaaaagataagctttatctatttttaaatttttgctaataaaactcaaagaaacgaagaacaattcaagcctttcttgtggttttaaccatactttgttttgcagaagttcaaaatgattgatattatctgtcccagtcctattcagtgttaggagaaaagttgtaagtgatggcaacagataagaagcttaagaaggacacctccagcaaaattctcaaataaaggggtcataagactcatcttgaaatggaaaaacaaccatatgggccccaagtgaatatccaaaacaaagaaatgtttaagaaatgttttacacatttctggcagcatcttcaattgcctgtaaaatatctaattattaaaccactgtttccattgtaaccataaaggacaggagagacaatagaactattatgtaccctttgtttcctcttccactagcagaaacactgatgaaaaattatcatcaacaaaataggcagctgtcagagtggagagtaaatcaaattgccatatggttccgacccaccatgtggccctcgattgaggaaaatgtatcctggcccacacaaaaagaggttgctcagtgggtgtacagtgctcttcagctcccatttagaaatgacccatttcatttgcttgcatctcactcctcaaactgccttcccactttcatttcattcctaagaaacgagctattacttcaccttagcccaaggcaccatcatctcttgcctcttctagagcaactgtgttgtcttcttcattctcatctctgcagaccatacacagagaaaccaggaagttttcttagatttttaaattgagatgaaattcacataacatcaaataaacgatttgaagtatacagtcaaatggtatttaggacatttatatcttgcacaccatcaattctaaaacattttcttcaccccagaaggaaacctagtaccccatagcagtaattccccatttcttcttccctgacccctggcaaccgctagtctgctttctgtccatatggatttacctactctagatattccatataaatgaaatgataaaatgttaccttttgtatctggttgttttcactcagcatattttcaaagttcatctatgttgcagcatgaatctgtacttcatgattttttatggttgaatgatattccattgtatgtatataccacattttgtttatcccttcatcagttgatggaaatttgggttctttctgcctgttgacaattatgaatagagctataaatatgtttttatatatctgttttgaattcttttgagttatacctgagagtggaattgctgggtcatagggtttagcttttgaggaaatgccagttttccacagcagctaaatgttgttttcactagcactgtacaaagataccaatttctccacatcctcactgatccttttttattattattacggccacaaaaatctttttatagctgtagctcagatgatgtaactcccctccaggggtttcacatcatttagaataaaattcagagttcttatcatgcccacaggccctgagcgatcagggatattcttccctcactcttctcatctctcatgacttgttttctttctcactccaagccagcaacattatcctgcctgtcaatcctcaaaagcaccaagcctgctcccatctcagggtctctgcacttgctgttgcctctctctggaaagtcctcaaagatctctgcattctacttccttattaaagcttcagctcaaataacatatctcctaaaatgtttggtctgaacataccatgtagcacaaacccacagcataagcctgggttccctaaaaaataaaatgagaatcaagagctacatgctaaaaagtatcgggaagggaagtaaaatcctagaaaagagaatgagcataatagggatgtgggataattagtaaaagagaatatatgccaggggttgcgttattgagtggcccacaatttctcaagaaaaaaaaacacctagttacttgatctcacagaagtccccagaagagctacatgaaattatgtggtctcctaacagtttgtcagtgtagggctcagtagagaaagagtgagcaatttatctcctagcttcttccaatacccaacttgtcattattgaagtctatccccaaagttttttggggttttttggcgttttttaaattgtggtaaaacacacatggaataaaatttaaccactttaagtgtgcagtttatttgggttaaacacattcacattgttatgtaatcaatctccagaagttttttgtcttgcaaaactaaaactctatacacattaaggaacaattccccacttccccctctccccagccactggaaaccaccattctactttccgtctctatgcatttgactactctagaaacctcatgtaaatttaatcacacagtatttttctttctatgactggcttatttcacttagtataatgtcctctgggttcatctaaggtgtcacatgtagtgagatttccttccttttaaggctgagaaattttccactataggtagtggaattttccacattttgagaaattttccacattttgtctgttcataggtggacatttgggttccttctacctcttggctattgtgaataatgctgctgcaaacacaggtgtgcaaatatctctttgagacccattctcaattattttttatacataccagaaacagaattgctagatcatatgataattctatttttaattttttgagaaatcaccataatgttttccatagaagatgcacaattttacattcctaccaacagtgcataagtgttccaatttctacacatccttgccaagagttattttgtggggtttttttaatagtagttattctaatgggtgtgaaatccaacaacattttaactcccccacacttccagtttgtgtaaagcagctgtttcaggaagcttctgaataagtctaagacttcaagcatacattccaggtaaggcatggagagggggcctctcctcttaaagtggcatcatgtatgggggtctccttagatggtgatggtggcgatggtagatttataaccctggggatgatacaagcaatcattaggtccagctgagtcaaagaagcaaggtaagtaatcaacaccagagtaagtatgcaggtaggtaatgctaggcagatccaagatcgtgtttcaactgggtctaatatatccatttactttgctttattgcttcagtgtatttaccattatctaaaactagatgtttgaacatatatgtttattttcttcttgttcatctctcctaaaatatgtaagtttcatgaaggcagagaatttatcttgttatccctgtattttcaatgcctagaataattcctgatacctactagggaaatacaaaaatatttatagactgaaaattaataatttatctagctttattttgtcttatatccaaattcccccaaatctttgtccacgagttatgtctaagagactgggttgcaaggcttccacttccaattaatattagagaaacatgaaagactattaaaggaaaacatatatgtatctatctatatctatagatagatacagagagatataaatatatagatatatatattctacagaatagaatatagttctaacacagttctatagaactatatattctaatacgtaattgtttattttaaaatttatcatctgtttcttcctgtcagaatgcaagcctatattaaggaatgtatattgttcattgctccatccctagtacaagagatattctctattgagaatgccaacatttattatttttttatttttttgatcatggccattctcgcaggcatgaggtggtattgcattgtggatttgattttcatttccctgatcattaatgattttgagcattttttcatatgtttgttgcccatttctgtatcctcttttgagaactgtctattcatgttcttagcccactttttgatgggattgtttgttttgtttttgatgattggtttgagttccttgtaaattctggatattagtcctttggtggaggtatagattgtgaagattttctcccactctatgggttgtctgtttactctgctgattatttcttttgctgtgcagaagctttttggtttaattaagtcccatctatttatctttgtctttgttgcatttgcttttggtttcttggtcatgaatctatgcctaagccattgtctagaaaagtttttccaatgttatcttctagaattttttttcctttttttaatttttattttaagttcaggggtacatgtgcaggtttgttacaaacataaactcatgtcattgggttttgttatacagattatttcatcatccaggtatttaagcccagtccccattagttatctttcctgatcctctccctcctcccaccctctatcctccaataggcctcagtgtatgctttttccctctatgtgttctcatcatttgacttccacttataagtgagaacatgcagtgtttggttttctgttcctggattagcttgctaaggatatggcctccagctccatccatgcccctgcaaagtgcatgatctcgttcttttttctggctgcatagtactccacagtgtacatataccacattttctgtatccagtctgccattgatgggcatttaggttaattccatgtctttgctattgtgaatagtgctgcaatgaacatacacatgtctttatttttttaattttttaattttttattttttattatactttaagtttcagggtacacgtgcacaatgtgcaggttagttacatacgtatacatgtgccatgttggtgtgctgcacccattaacttgtcatttaacattaggtatatctcctaatgctatccctcccctctcccccaaccccacaacaggccccggtgtgtgatgttccccttcctgtggtttatattcctttgggtatattacccagtaatgggattgctgggttgaatggtatttctgtctttaggtgtttgtcttccacaatggtcgaactaatttacactcccatcaacagtgtataagtgttcccttttccccacaacctcaccagcatctgtcatttttggactttttactaatagccattctgactggtgtgagatgggatctcattgtggtttgatttgcgtttctctaatgatcagtgacttaagagtttttttcacatgaatgttggccacatgaatgtcttctttgaaaagtgtctgttcatgtcctttgccaaattcttaatggggtgatttgtttttttcttgtaaatttgtttaagttctttttaaaattattatacattaatttctggggtacatgtgcagaacatgcaggtttgttacataggtatacatgtgccatgatggtttgctgcagccatcaacccgtcatctacattaggtatttctcctaatgctatccctcccctggcctcccaccccatgacaggtcttggtgtgtgatattcccctccctgtgcccatgtgttctcattgttcaactcccacttatgcgtgagaacatgcggtgtttggttttctgtttttgtgttagtttgctgagaataatggtttccagctttatcagtgtccctccaaaggacgtgaactcatcctttttaatggctgcatagtgatccatggtgtatatgtgccacattttctttatccagtctatcattgatgggcatttgggttggttccaagactttgctattgtgaacagtgctgcaataaacatacatgtgcatgtgtctttatagaagaatcatttaaaatcctttgggtatatacccagtaatgggatggctgggtcaaatggtatttctggttctatatccttgaggaatcgccacactgtcttccaaaatgctgaattaatttacactcccaccaacagtgtgaaagtattcctatttctccacatcctctccagcatctgttgtttcctgactttttaatgattgtcattctaactgtcatgagatggtatctcattgtggttttgatttgcatttctctaatgaccagtggtgatgagaattttttcatatatcttttggctgcataaatgtcttcttttgagaattgtctgttcatatccttcacccactttttgatggggttttttgttttttttcttgtaaatttgtttaagttctttgtagattctagatattatcactttggatggatagattgcaaaaattctggatggatagattgcaaaaattttctcctattctgtagtttgtctgtttactctgatgatagtttcttttgctgtgcagaagatcttcagcttaattagatcccatttgcctattttgactttttgtttaccattgcttttggtgtctcagtcatgaagtctttgcccatgcctatggcctgaatgctattgcctaggttttcttctagggtttttatggttttacgtcttatgttaaaatctttaatccatcttgagttaatttttgtatcaggtgtaaagaagggatccagttttagctttctgcatatggctagccagttttcctgacaccatttattaaatagggaaccctttccctattgcttttgtccagtttgtcaaagatcagatggttgtagatgtgtggtgttatttatgagggctctgttctgttcctttggtctatatatctgctttggtaccagtaccatgctgttttgcttaccatagccttgtaatatagtttgaagtcaggtattgtgatgcctccaatgttgttctttttgcttaggattgtcttgtctatgcaggatcttttttggttctgtatgaaatttaaggtagttttttccaattctgtgaataaagtcaatggtagcttgatggggatagcattgaatctataaattactttgggcagtatgaccattgtcacaatattgattgttcctatttatgagcatggaatatttttccatttgtttgtgtcctctcttatttccttgagcagtggtttgtagttctccttgaagaggtccttcacatcccttataagttgtattcccaggtattttattctctttgtagcaactgtgaatgggagttcactcatgatttggctctctgtctgttattggtatatagaaatgcttctgatttttgcacatcaattttgtatcctgagactttgctgaagttgtttatcagcttaaggagattttgggctgagatgatggggttttctaaatatacaatgatgtcatctgtaaacagagacaatttgacttcctcttttccaaattgaataccctttctttctttctcttgcctgatagtcctagccagaacttccaataccatgttgaataggagttgtgagagagggcatccttgtctttgccagttttcaaagggaatgtttccagtttttgttcattcagtatgatattagctgtgggtttctcataaatagatcttattgttttgagatacattccatcaatacctagtttgttgagagtttttagcatgaagggctgttgaattttgacgaatgccttttctgcatcaattgagataatcatgtggtttttgtcactggttctgtttatgtgattgattacatttattgatttgcatatgttgaatgagccttgcatcccagggatgaagccgacttggtcgtggtggataagctttttgatgtgctgatggattcattttgccagtattttattgaggattttcgcatcaatgttcatcagggatattagcctaaaattttcttctttggttgtgtctttgccaggttttggtatcaggatgatgctgtcctcataaaatgagttagggaggagtccctctttttctattgtttggagtagtttcagaaggaatggtacaagctcctcatacctctggtagaatcaggctgtgaatccgtctggtcccggcctttttttggttggtaggctattcatttttgcctcattttcagaactagttattggtctattcagggattcgacttcctggtttagacttgggagggtgtatgtgtccaggaatttatccatttctctagtttatttgcatagaggtgtttatagtattctctgatagtagtttgtatttctgtgggatcagcagtgatatcccctttatcattttttattacgtctatttgattcttctctctttgcttctttattagtctgtctagtggtctttcaattttgttgatattttcaaaaaaccagctcctggattcattaattttttgaagtattttttgtgtctctgtctccttcagttccctgtgatcttagttatttcttgtcttctgctagcttttgaattggtttgctcttccttctttagttctttttgttgtgttgttagggtaccaattttttgtatttcctgctttctcttgtgggcatttagtgctataaattttcttctacacactgctttaaatgtgtcccagagattctcataggttgtgtctttcttctcattggtttcaaataacttatttatttctgccttcatttaattatttacccaggagtcattcaggagcaggttgttcagtttccatgtacttgtgtggttttgagtgagtttctaaatccttagttctaatttgtttgcactgtggtctgagagactgttatgatttccattcttttgcatttgttgaggaatgttttacttccaattatgtggtcaattttagaataagtgtgatgtggtgctgagaagaatgtatattctcttgatttggggtggagagttctgtagatgcctattaggactgcttggtccagagctgagttcaagccctggatatccttgttaattttctgtcttgttgatctgtctagtgttgacagttgtgtgttaaattctcccattattattgtgtgggagtccaagtctctttgtaggtctctaagaacttgctttatgaatctgggtgctcttgtattgggtgcatatatacttagcatagttagctcttcttgttgcattgatcccattaccgttatgtaatgcccttctttgtctcttttgagctttgttggtttaaagtctattttatcagagacaaggattgcaacctctgcttttttttttttttttttttttttgctttccatccctttttttccctccatccctttattttgagcctatctgtgtctttgcatgagagatgggtctcctgaatacagcacactgatgggtcttgactctttatccaacttgccagtctgtatcttttaattggggcatttagcccattttcttttaagtttaatattgttatgtgtgaatttgatgctgtcattatgatgctagctcattattttccccattagttgatcgctttcttcatagtgttgatggtctttacaatttggtatgttttagcagtggctggtaccagtcattcttttccatgtttattgcttccttcaggagttcttgtaaggcaggcctggtgttgacaaaatctctcagcatttgcttggctgtaaaggactttatttctccttcacttatgaagcttaagttggctggatatgaaattctgggttgaaaattcttttctttaacaatgttgaatattggccccgactctcttctggcttgtagggtttctgcagagaaatctgctattagtctgatgggcttccctttgtgggcaacctgacctttctctcttgctgcccttaacattttttccttcatttcaactttgatgaatctgatgattatgtgtcttgggttgctcttcttgagaaatatctttgttgtgttctctgtatttcttgaatttgaatgttggcctgccttgctaggttggggaagttctcctgaagagtgttttccaacttggttccattctccccatcaaacatatatttggtacaccaatcaaacgtatatttggtcttttcatatagtcccatatttcttggaggctttgttcacttcttctcactgtttttttctctaatcttgtcttctccttttatttcattgagtttatcttcaatctcttatatcctttcttccacttgatcgatttgggtattaatacttgtgtatgcttcacaaagttcttgtgctgtgcttttcagctccataagatcatatatattcttctctaaactggttatactagttagcaattcctctaaccttttttcaagcatcttagcttccttgcattgggttagaatatactcctttagctcagaggagtttgttattacccaccttctaaagcctatttctgtcaattcatcaaactcattatctgtcccattttgttcccttgctggagaggagttgtgatcccctggaggagaagaggcgttctggtttttggagttttcagcttttttatgctggtttctccccatcttcatggatttatctacctttggtctttgatgttggtgagcttcagatggggttactgaatagacatcctttttgttgatgttgctactaatcctttctgattgttagttttccttctaacaggcctctcttctgcaggtctgctggagtatgctggaggtccacttcagaacctatttgcctaggtatcaccagtggaggctgcagaatagcaaagattgctgtctgttccttcctctggaagcttcatcccagaggggcacttggcagatgccggcaagagctttcctgtatgaggtgtctgtcggcccctactgggggttgtctcccagtcaggatacatgggggtcagggacccacttgaggaggcagcttgtcccttatcagagctcaaacgctgtgctgggagagccactgctctcttaagagctgtcaggcagggacgtttaggtctgcttaagctgccccacagccaccccttcccccaggtgctctgtcccagggagatgggggttttatctatatgttccttactggggttgctgcctttttttcagagatgccctgcccggagaggagaaaatctagagaggctgtctggccacagtggccttactgagctgcagtgggctccatccattttgaagttctaggagcctttgtttacactgtgagggtaaaaccgcctactcaagtctcagcaaaggtggacgcccctcctcccaccaagctcgagcatcccaggtcaatctcagactgctgctgtgctggcagcaagaatttcaagccagtgaatcttagcttgatgggctccatgggggtggcacccaccaagccaggcaccggagaggatctcatggtttgctggttgcaaagactgtgggaaaagcatagtatctgggctggagtgcactgttgctcccagcaccgtctcttacagcttcccttggctaggaaagtgaaatcccctgatcccttgtgctttctgggtgaggtgatgtccccaccctgctttggctcaccctccatgggctgcacccactgtccaaccagtcccaatgagatgaactgggtacctcagttggaaatgcagaaatcacctgagttctgcatcgatctcactgggagctacagaccagagctgttcctattcagccatcttgccagcacctcttctagaacttttatggtttcagatcttagatttaagtcttcaatccatcttgagttgatttttgtataagatgagcgaagaggatccagcttcattattctacacgaggcttgccaattatcccagtatcatttggtgaatagggtgtcctttccccactttatgtttttgtttgcttttttgaagatcaattgacagtaagtatttgggtttatttctgggttcccaattctgttccattggtctatatgcctatttatgtaccaataccattctgttttggtgactatggccttacagtatagttttaagttgggcaatgtaatgcttccagatttgttctttttccttattcttgctttggctatgtaggctcttttttggttccatatgaattttaggatttttttttctaactctgtgaagaatgatggtggtatttttataagaattgttttgaatttgtagattgcttttggcagtatggtcatttttacaatattgattctactcattcatgagcatgggatgtgtttccatttgtttgtgtcatctatgattttgttcagcagtgttttgtagttttccttgtagaggttttttgtttttgtttttttttacctcctttgttaagtacatttctaagtattttcttttgtgtatttatttttattttttgcagctgttgtaaaggggttgagttctcgatttcattcaaaccttggtcactgttggtatatagcagagctactgatttgtgtacatcaattttgtatcctgaaattttgctgaacttttaaaagaccttattggctagatttcagatggcttcaggctggttctaccatatggctctcctcaaacccacaagcaaagttcctacaccctttgcccagagaagctcagagcacagactgatccaaagctagccacagcaactctactggcaaagcagctaatgatcagacgccagtcctctaggggaaatcccatctcaaaatctccatggtcccgatgaagtgcttttcactagagatactcccaacaccctttccccttggtgaatggcagaaatcactacacagctttaccaaagaaattctcttcaccaaatcctgcaaaaatcctcaacagcctaattcttgtattaccctttttgaatgaaggtatttaagagctatgaaacttctctttcctttgaaaatttgtatcttcgtttggtaactcacattagaaatgcctattgattataccttgattcttcaactgaaacttccagtttcagaaagataaagatgataatacatattaccctaatttttttcttaaaaattttattggaacaatttttgttttcttgtgcctctggttaataagtaacagaaactttttgtttccttgacattgtgatgcaaggaaaaaatctcggaggaaagaaaggagataaatataggctacaaatcaataaaaacttattatttcaatgcagtagaagagtgggaaattgtatagggtcacgtctctgaggtattgttcatacagaatgttgcaaagagcatgtagctctttaattcaggctttctaaacacaagttttgaaagaaggaaggctttcttcttttcaatgtttaggtgcagaggctgtatggtggcaagtgaggaggaagcataatatctcctaattcgtaaattgtacttagttttgttgtttttaatttttgtgggcacatagtaggtgtatatatttgtggggtaaatgagatgttttgatacaggcatgcaatgtgaaaaaagcacatgaagaatggggtatccatcccctcaagcattaatccattgagctgcagacactccaactacactctaagatattttaaaatgtgcagttaagttattattgactatagtcaccttgttgtgctagcaaatactaggtcttattcattcttcctatttttatgtagccattaaccatcctcacctctcccccaggtccccactacccttcccagcctctggtaaccatccttctactctatatctatatctctatgagttcaattgttttgatttgtagatcccacaaataagtgagaacatgcaatgtttttctttctgtgcctggcttatttcacttaacataatgatctccaattccattcgtgttgttgcaaatgactcaatctcattcttttttgtggatgaatagtaaccccctgtgaatatgtaccagattttctttactcattcatctgttgatggatacttaggttgcttccaaatctcggctattgtaaataatgctgcaacaaacataggagtgcagatatctctttgatatactgctttccattcttttgggtatatacgcagcagtgggattactggatcacatggtagctcaatttttattgttttgagaaacctccaaactgctctccatagtggttgttaatttacattttcaccagcagggtatgaggtttcccttttccctgcatctttggcagtttttgttattgcctgtcttttggatacaacccattttaacttaggtaagatggtatttcattgtagttttgattttcatttctctgatgatcaataatgttgaacactttttaatatacctgtttgccatttgtatgtcttcttttgagaaacatctatttaaatcttttggagatcttttgatcagatcatttgatttattcctgtagagttgttagggtttcttatattccagtctttaatcctgtgtgagatggatagtttacaaatattttctcccatttagggaattgtctcttcactttgttgattgtatcctttgttgtacagaagcttttttccttgatgctatctcatttgcccattttttctttggttgcctgggttggtggggtaaccctgtgctcaatgtgctcaaaaaacttttgcccacatcaatgtcctggagattttccccaatgattgtttgtagtagtttcatgctgttaaggtcttagattgaagtctttaatctatttttatttgatttttgtatacagtaagagataggggtctagtctcattcttctgcatatagatatccagtttttcattactttatccagcaccatttattgaagaaaccgtattttccccagtgtatgttcttggcacctttgtcaaaaatgagttcattgtaggtgtgtggatttgtttctgggttctctattctgttccattcctctatatatatgtctgtttttatgccagtaccatgctgttttggttactatagctctgtagtataatttgaggtcaggtaatatgattcctcaagatttgttatttttgcttagcatagttttggctattctgagtctttgtggttccatataaattttagaattgttttctatatttctatgaagaatgtcattggtattttgatagggattatcttgaatctgtagattgctttgggttgtatgcacattttatcaatattgattcctccaattcatgaacatgaaattttttttttggtgtcctcttcaatttcccttatcagagttttatagtttttattacagagatctttcatttctttggttaattactaggtacttaattttatgtgtgactattgtaactgggatttctttatattactttttcagattgtttgctgttggcatctagaaatactacttatttttgtatgttgattttgtatcccacaacctaactgaatttgtttatcaattctaatagttttcttgtggagcctttcagtttttttaaatacaagatcatatcatctgcaaaaaggataataatttggcttcttcctttccaatttggatgccctttatatctttctgttgttggaatgctcgaggtaggacttccagtattaggttgaatatcactggtgaaagtgaacatccttgttgtgttccagatcttagaggaaaggctttccatttttccccactcattatgatactagctgtgggtatgtcatatacagtttttattatgttgaggtatgtttcttctatccccaattttttgagggttttcatcatgaatggatgttgaatttttaattaaagcttgattttgtcaaattctttttggattttgtcaaatttaaaaattcaaactgttttccatagtggttgacactcctccccagatgcccgtggtggtggcatggcgccgtatcctgcctgggctctggcctctgctctggcctccttcttgctctatctgccccgtttctgagaagcctagcggcttcttagtccggcccatctcttaatcagatgattagagtttatcctatagagttatttgtgctccttgtgtattctggtaattaatcccttctcagatgggtagtttgcaaatattttctcccattttatgggttattatttcactgtgttgattgtgtcctctgctgtacagaagctatttaacttgatgtgatctcatttatccatttttgctttggttgcctgtgcttgtgttgcactactcaagaaatttttgcctagaccaatgtcctggagatttttcccaatgttttcttgtggtagttttatagtttaaagtattagacttaagtctttaatctattttgatttgattttgtatacggcaagagataggggtctagtgtcattcttgtgcatagggatatccagtttttctggaaccatctattgaagagactgttttttccccagtgtgtgttctgggaacctttgtcaaaaatgagttaactgcaggtgtgtggatttgtatctgggttctctattccagtgaccctcaacctttttggtactagaaactgattttgtggaagacaatttttccatggaccggggtgggggtggaatggttttggaatgaaattgttccacctcagataatcaggcattagatagattctcctaaggagcacgcaacctagatcccttgcatgctcaattcacagtacggctcacactcctatgagaatctaatgccaccactgatctgataaaaggtggagctcaggcaggaatgctcacctgcctgcagctcacctcctgctgcatggcccagttcctaacaggccacagaccaatgccagtttatgacccgggagttaaagggctctctctgttatgctccattgctctatgtgtctgtttttatggcagtaccatgctgttgtgattactatagctttataatataatttgaaatcaggtaatgtgattcctcaagatttgttcattttgttgagagttttaatcataaagggatgctggattttgttgaatgatttttatgcatctattgagatgaccatgtaatttttgtttttaattctatttatgtggtgtatcgcatttattgatgttataatatatatgtggtgtatcacatttattggtatgtgttgatatatgttgatatttgctaatatatgtcgatatgtgttgatatatgtttatgtggtatatcacattatattgatattaatgttaaaccatccctgcgtacctggtataaaacccacttgatcgtggtggattatctttttgatatgtttttggattttgttagctagtattttgttaaggattttagcatctgtgttcatcagagatattggtctgtaattttcttcatcagagatattggtctgtaatgacctttcttggttttagcattagggtgatataggcttcactgaatgactcagggaaggctccctctttctttatcttgtggaatagtgtctatagaattggtaccaattcttctgtgagtgtctggtagaattctgctgtgactccatctggtcctggacttttctgtgttggtaacttttttatcacagtttcaatctcactgcttgttattggtctcttcatggtatctaattcttcctgatttaaactagaagtgtggtatctttccaggaatttatccacctcttctacgttttccagtttatacacataaaggtgcattggcatacaagggacacacctcaatataataaaagccatccatgacaaacccacagccattgtaatactgaatgtggaaaagttgaaatcattccccctgagaactagaacaagacaaggatgcccactctaaccactcctcttcaaaattgtactggaaatccaagccaaagcaatcccacaagagaaagaaataaggggcatccaaattggtaaagaggaagtcaaactgttgctgtttgctgatatgattgttaacctggaaaaccctaaagacttttccagaaagctcctagaactgataaattcagtagtttccagataaaaaattaatgtacacaaatcagtagctcttctatacactaagagtgacaaagctgagaaccaaatcaagaactcaaggtcttttacagtagctgcaaaaataaaataaaataaaataaaataccaaggaatatacctaaccaaggaggtgaaagatctctacaaagaaaactacaaaacactgctgaaaggaataatagatgacacaaacaaatggaaacacatcccatgctcatggatgcatagaatcaatattgtgaaaataaccatactgccaaaagcaatctacaaattcaatgcagttaccatcaaaataccaccatcattcctcacagaattagaaaaaaaatagaaaatttataggaaaccaaaaaagagccagcatagtcaaagcaagactaagcaaaaagaacaaatctggaggcatcacactacctgatttcaaattatactataaggccatggtcaccaaaacagcatggcactagtataaaaacagggacacagaccaatggaacagaatagaaaactcaagaataaatccaaatatttacagccaattgatctttgacaaaacaaacaaaaacataaagtggggaaaggacacccttttcaacaaatggtgcagggatcactgggaagccacatgtagaagaatgaaactagatcctcatctctcaccttatacaaaaatcaactcaagatgaattaaggacttaaatctaagacctgaaactataaaaattctagattataacattggaaaaacttttctagacattgacttaggcaaggaattcatgaccaagaatctaaaagcaaatgcaataaaaacaaagataaattgctgagacttagttaaactacaaagcttttgcacagcaaagggaacagtcagcagaacaaacagacaacccacagagtgggaaaaagtattcacaatctatacacctgacaaaggactaatgtccagaatctacaatgaactcaaacaaaccaacaagaaaaaaaaaaaaatccaaaagtgggctaaggaaattaatacacaattctcaaaagaagatatacaagtggctaatgaacatatgaaaaaatgatcaacatcactaatgatcagggaaatgcaaatcgaaaccacaatgtgataccaccttactcctgcaagaatggccataatcaaaaaatagtagatgttggcatgaatgcagtgaacagggaacacttctacactgctggtggacatgtaaactagtacagcccctattgaaaacagtgtggagattccttaaggaactaaaagtagaattaccatttgatccaacaatcccactactgggtacctacacagaggaaatgaagtcatacaaaaaagatacttgtatacacatgtttatagaagcacgattcacagttgtaaaaacgtggaaccaacccaaaagcccatcaatcaacgagtaaagaaattgtggagatatatatataaatatatacatatatgatggaatactactcagccacaaaaaggaattaatggcattcgcagtgaccagcatgagactggggactattattgtaagtgaagtaacttaggaatggaaaaccaaacataatatgttctcgcttataagtgggagctaagctataaggatgcaaaagaataagaatgacacaatggactttggggacgcaggaggaaagggtgggaaaggcgtgagggacaaaaaactacaaacagggtgcagtgtatacagctcgggtgatgcatgcaccaaagtctcacaaatcactgaagaacttactcatgtaaccaaacactacctgttccccaataacctatggaaaataaataaataaataaataaataaataaataaataaaagatttattctttttgcttaggatagctttggctattccgagtcttgtgtggtttcatataaactttaggattgttttctctatttctgtgcagaatattattaatattttgatagagattgcattgagtctgcagattgctttgagtagtatgaacattttaacaatattgattcttccaattcatgaacatgggatatcttcacattttttggtgtcctcttcaatttctttcatcagtgttttatagttttcattatagagatcgtttacttctttcattaattcctaggtatttaattttatgtgtggctattgtaattatgattactttttatttctttgtcagattgttcactgttggcatacagaaaggctacttttttttgtatgttgattttgtatcctgcaactttactaaattgcttatcagttctagtatgtttttggtggaatcttgaagtttttctaaatatgagatcatgttatctgcaaacaaggataatttgaattcttccttccaatttggatgccctttatttctttctcctgtctgattgctctagctaggactttcagtactatgttgaataatagtgggaaaaagtgggcatccttgtcatgttgcaaatcttagaggattggctttcaatttttctccattcagtatgatactagttgtgggtctgtcatatatgtcttttattatattgaggcatgttccttctatccccggtttttttaggttttttatcatgaaggatgttgaactttatcaaatgctttttcagtatcaattgaaatgacaaaatgatttttatccttcattctactgatatgatgtatcacattgattaagttgcacatgtagaatgatccttgcatcccagggataaattccacttggtcatgaagaatgatctttttaatatattgttgaattctatttgttggtattatgattcatatttttgcataaatattcatcagagatattggtcagtagttttctttttttgatatgtctttctctagttttggtatcagggtaatactggtcctgttgaatgagtttggaagtattttcttctctattttttggcacagtttaggtagaattggtattagttcttattcaaatgtctagtaaaattcaacagtgaagccatggtgtcccagtctgttccttggtaggagactttattatggctatgatctcattatttgttaatggtctgttcaggttttggatttcttcatggtccgatcctagtacttgtatgtgtctaggaatttgcccatttcctccaggtttttaaatttattggtctatagttgctcataggagccactaatgatcctttgaatttcttcagtatcagttgtaatgtctcttctttcatctctgattttatttatttaggccttctctggtttttttttcttagttaatctggctaaaaattcaccgattttgtttaagttttcaacaaacaatcttttggtgtcattgatcttttgtattattttcttatttaaattttatttatttccactataatctttactatttccttcattctactaattttaggtttggtttgctcttgcttttctagttcttgaagatgcatttttaaattgtttatttgaagtttgttctctttgctaatgtaggcacttatagctatcagcttctctcttactactgtttttgcagtattccagaggtttgggtatgatgtgtcattatcatttttttcaagaaatttttatatttccttcttaatttctcgatttacccactggtcattcaggaatatgttgtttaattttcatgtatttgaatagtttccaaaattcctctttttaatttctagttttattccactgtggtcagagaagacacttcatgttatttcaattttttgaatgttttaagacttgttttgtgacctaacacatgatacatgatgtatctttgagaatgatctgtgtgctgagaggagaatgtatattctgtagcttttggatgaaatgttctgtaaatatgtattagaatcacttgttctgtagtgcacattaagtctgatgcttcttagatgattttctgtctgtaaaatctgtccaatgctgaaagtagggtgttgaagtctccagctattattgtactggtacctgtgttagtctgttttcatgtgctgataaagacataccccagactgggtaatgtataaagaaaaagaggtttaatagactcacagctacacatggctggggaggggcctcacaatcatggcagaaggttaaaggcacattttatatggctgcagaaaagggagagaactagtgcagggaaactccccattataaaaccataagatctcataagacttattcactatattgagagcagcatgggaaagacctgcccccatgattcaattacctcccactgggtccctcccattacacatgggaattgtggaagctacaattcaagatgagatttgggtggggacacagtgaaactatatcagggtctgtctctctctttagcacgaataacatttgctttatataactaggcactccagtgttgggtgcatatatatttaaaattgttatatgctcttgctaaattgattcctttattattagagacattctttgtctctttttatagtttttgtcttgaaatctattttgtcttataaaagtatagctacttctgctcttttttggtttccattggcatagaatatatctttttccattttttttttcaatctatctgtgtttttataggtaaggtatggttcctgtaggcaacagatttatgggtcttgcatttttattcagccagtctatgtctaaatggaatgtttaatccatttatatttaatgttattactgataactgaggacttactcctccaattttgttacttgttttctggttgttttgtggtcttctcttccttatttctctccttcctgtcttcctttagtgaggctgatcttctctaatgatataatttagtttcttgcttttaatattttatgtatctgttgtatattatttggtttgaggttatcataaggcttgcaaatactattttataacctatcattttagcaaagagaaaagtaatgaaaactctacaatttatcttcaccaccccactttttaacttttcattatttctatttttattttattttactgtctatgtcttgaaaatttgttgtggttattggttttgattggttcattttttagtgtctctacttagcataagggtagtttatacaccacaattacagtgttatcatattctggggtgttttgtctacttcctatttccagtgagttttcttaggtaattatttttgctcattaacatcctttctttaagattgaaaaaatccctttagcatttcttgtaagacaggtctggtgttgataaaatccctcagcttttgactgcctgggaaagtcttcatttttccttcatattttaaggatattttccctggatatactattctaggggaagggtttttcttcagcaatttaaatatgtcatgccactctctcctggcctctaaggtttccactgaaaagtctgctaccagatgtatttgaacttcactctatattatttgttttttttttctcttgtttctcttaggatcctttctttatccctgacttttgggagtttgattattaaatgcatagaggtagtcttttgtgagtttaatctacttgatgttctataaccttcttgtacttaggtattgctatcttcctgtaggtttgggaagttctgtcactatgcctttgaatatactttctatatctatctctttctccacctcctcttaaaggccaataacttttagatttgcccatttgaggctattttctagaacctgtaggaatgcttcattgttttttatttttcatcttttgtccctctgactgtgtattttcaaatagcctgtcttgatgctcactaattctttctgctgcttgatcacgtctgctattaaaagactccaatgcattattcagtgtgtcaacaacatttttcagctccagaatttctgcttgattctttttggttatttcaatctcttagttaaatttgtctgattgaattctgaatttctcctttgtctttcctcaagacacttattttgaattgcatgtctgaaaggtcacataattctgtttctccaggactggtccctggtgccttatttagtttgtttgataaggtcatgttttcctgaattgttgtgacacctgagaatgtttgtctgtgtctgggcattggagagttaggtatttattgtagtcttcactgtcggggcttgtttattcccatccttctcaggaagacatttcagatatttgaaaggacttgggtgttgtgatctaagctgtgtctgctttatggggcaaaccaagcccagtaacactggttcttgcagacttgtaaagatacagccttgatggtcttgaatgaatatggaagaattacctggattactagacagagagaccgttgttcttttcccatactttctcccaaacaaacggagtttgtctctttgttctgagccacctagatctgggagtttagtgacacaagtgcccctgttcacaccactaagactgtgttgggtcagactagacaccagcacagcactggatcttgtccaagtcctgccacaaccattctctggttactgcctatgtttgctgaagggcctggggctctacaatcatcatatggtaaagccacccagtgctatgtccttcccttcagggtgccaagttttcctaggccctgtgcaggtccagaggtgccatccagagtcagtgactagagtgaaaaaccttagaaatccccctggtgctccattgtattgtggctgagctggcactcaaccacaagatgctgtccttcccactcttccctcccctttccaaaggaagaggagcttcacctgtagccacttccaccacaggtcacaagaagtactgccagacgaccactaatgttcccttaaggctcttaagtcagcttgtggtgaatgttgcctggcctgggactcaccttcagggcagtggctcctctttggcccagggcagatccagaaatgctatccaaggaccaaaccctagaattgagaacctcaagagcccatatgatgctctaccttcctgtggctgagctggtacctaaggtacaagacaaagcccacttttcttttatcccacttttctcaagcagtagccttgccttatagccaccacagctgtaaatgtgctgagtctcacctgaagccatcaagtttcagagtctcacctaaggccctcgacatagtacctggttatcggggtgggctcgaaaaccattcttttatgtccttataggagataacaaaagacacacagaaataaggaggaaaaaaagtgatgtgaagatagagacagagactacggtgatgcatctatacgccaaggaatgccaaggattgctaacaaccaccagaagatagaagagaggcatggagtcgttcttcttcagtgcctccagaaaaaaacaatcttgctgacactttgatttttgacttctgatctcctgaattgtgaaagactaaatttctgttagcttaagccaccaagctgtgataattcgtcatggaaattgcagaaaactaatgtataaagaatattagaaaatagtctgaaattaatgaaaatgacaaaatgtatgaagtacagctaaaacagtcgttagaaggaaatatattgctataaaagcctatacttttttaaaagtgaagaaaattctcaaatcaactatctaattttctaccttaagattctggaaaaaggagagcatgcaaaaaagagagaatgaaatgcaaagcaaataggagaaaagaaataataagaactagaatgaaaattaattaaatagagaatagacaaactgagaaaaatcaatgaaactaaaattggttcttttaaaataacaacagtgctgaaaaacctttagcaagactaatgagaaagacagagagagaaagagcatattcaaatgactagaataataaagtaaaaaggggatattaccgtcaattttacagaaatatacaggatcataaagaaataccataatcaattgcatgctaataagttaaacaactttgacgaaatggacaaattcctaaaggagacaaactaccaaaactgactcaagaaaaagtaacaatctgaacagacttgtaataagtaaaaagattgaataagtaaccaaaaatacctcctacaaagcaaagttcaggccaagatgacttcactgatgaattctaccaaaaattcaaataattaacaccaatccttcagaaacgcttccaaaaaaaaaaaatacaagaggagggaacaatttccaactttattctgaggtcagtattacctgatatccaacccagaaaaaggcatcacaagaaaagaaagatacacaccaatgtctcctataaacagatatattttaaaagtctcaaccaaataccataaatcaaatccaaaaacttatcaagaggattgcacattatgaccgtgagggattcatcccaagaatgcaaagttaaggtaacaaccaataatcaatttatgtaatacatgacatcaatagaatacatgacaaagatgttatcatcccaatagacaacaaaagtatttgacaaacttcaacactcatctatgattttaaaaaaattcaacaaaataagaatagaaggcaatttctttaactttactaatgacatctattaagaaaatacacagctagcatcatatttagtgatgaaagactgaatgtttccccccaagatcagaaatgatacagcatgtctgttattgcaacttctactcagcattgtactagaggttctatccagggcaattaggcaaggaaataaaataaagaacatccagattggaaaggaagacatgcaactattgctattgctcttaatacagaaaatctaaatacagaaacctaggaaaagataattctatggaatctactaaaaaactattataactaattaagaagctcagcaagtttgcaggatataagattaccatataaaaatgaactgattgtctatacgataataataaacaaagtgaaatcaaaattaagaaaataattccacttaccaatagcatcaagaagaataaaataattagaaataaatttaacaaaggaataatactcctgtgaaaactacaaaatacttttgaaataaattttaaaagacataaataactgggaggacattccacgttcatggatcaaaaaacttttttaagatgtcaataatccccaaatttatctacagatacaatgcaattcttatcaaaatcccagttggcttctttccggaaattgtcaaactgatatctgacaatttatatgaaaatttatatgaaaattcaagggatgcaggatagcctaaacaatcttgaagaaaaagaataaagttatttgcctccatttaagcctcaatgcattttccattccttcttaaagtattgcagtttagattaatcaacacaattttacagatttagatcacttggaacatcctaaacaggaaacctcaaagtaaatcatgtccaaacacatcgtaatcaaactgctgaaaatgaagtcagccagaaaacagccagagaaaataacacattatataaaaaggaacaattcaaatgactacagattgctcaagagatgccagaaaacaattgcatcagttttctattcctatataacaaattgccacaaatttgtgacttaacacaaatgtatcatcttacagttctgtagctaaaggtccaacacagctaactaggctaaaatcaaagtgttttcagggctgtatttctttttggaggctttagggggaaacctcttttcttgtattttttagcctctacagattgcccacatatttgggatcatggctcctttcctccagtttcaaagccagcaacaatgcatctctctgtcattcttctgtggtcacatctccctctaatcacagctggaaaagattgtttgctttgagggaggcttgtgatttgattgagcccacctagataatccaggctaatctttccacctcactgtccacttaatcacatctgcaaagtccctttgcccagtgaagtaacattcacaggttccagggattagaacaggaacctttttgagggactataattctctctattgcaacaatgaaataccagttttaaagtacagaaaaacctgtctcaagagaatgagaagataagccacagacttggagaaagtattggcaaaggacatatctgataaaggactactgcacaaaatatattttttaaactcttaaaatttaacaaaaggaaaatgaaaaatcatattaaaaatgggcaaaatatctgaacacttgcatcaccaaagaaagaaaagaatatgtgcagatgttcaatgtcatgtcataaagaaacggaattaaaacaataacataccattaaatccctattagaatagccaaaatccaaaacactgacaacactaaatactggcaaggatgtgggacaacagtaactcattcatttctagtggaaatacaaaatggaatggccaatttagaggacaatttggcagtttcttataaaactaccataggatccagcaattgcacttcttagcatttacccaaaggagtgtaaaattgtgtccacacaaaaacctgcacatggatgtttatagcagctttattcataattaccaaaacttgaaagcaaccaaaatgtccatcagtaggtgaaagaatgagtaaactgtaacaccttcagacagtgaaatattattcagcactaaaaagaaatgagccatcaagtcatgaaaggagatggaggaatgaatattactaagtgaaagaagccaatcttaaaaggttacataccttatgattacaactatatgacattcagaaaaatacaaaactatggaaacagtaaaaagttgagtggtggccaggaattgggagagggaggggtgaaggggccgagcataaaggatttttagggcaattaaattaccattgtaatactatagtgatagatacatgacattataaatttgcccaagcccatagaatgtacaagaccaagagtgaactctaatgtaacctagaggctttgtatgataatgatgtgtcaatgtaggtttatcaattttaatgaatgtgccactgtgatgtgagatgttgctagtggggaggctatgagtgtgtaggagagagaacatatgggaactctattttctgttcaatttctctgtgaacttaaacctcctctacaaaattaagtctattaagaaaaaactgttaacccggaattgcatgtttaggaaaaatttcctcaggaatgaggaaaaaataataaaagcaatacagcttgaaaagaaagaaataaaatggactctatttgcaaatgacatgattgttcacatagaaaatctcgagaaagctaaaataacactcttgtaactaataaatgagttttcacatgataaaagcacaatatacgaacaccaattacatgtctacacaccatcaatgaataaattaaaagtgaaattttaaaaatacaactttcaatagctacaaaaatataatatatatttgcaagtttaacaaaatatatgggggatctgtatgttgaaaactataaaatgccgattagaatttgttgtggatattgacaagttgattctaaaatttatatacaaaagcaaagaaagtagaagccaaaataaattttttaatgaataaaaatgttataggatttcctctacttgatttcaagacttactataaaactacagaactcaaaaagatgtcacattggtaaaagaatagacacagaaataaacaaaacagactagagggtccagaaataagcccacacaaatacggtcaaataattttcatcaaaggtgcaaagtcaattcagagaaaaagcagtcttttcaacaacaaaaagaaactactggaataattgggcatctatatgtcccacaccttatacaaaaattaactcaaaatacattatagactgaaatataaaacataaaaatataaaactttagggaaaaataggttttcatgacactggcttcaaaaaagatcctgagatacaacatcaaatgcacaatccataaaagaaaaaaactaataaattggatgtcatcaaaattaaaaactttcattctgtgaaagacacttctaaaagagtgaaaagaaaagctacagagaaaagatttgcaaatctgacaaagaatatgctaacagaatataaaaagaactctcaaaactcagtaattttaatgaacggtaaaaagtcggcaaaatgattaaccaacatctcaccaaagaagatgcacaagtgaaaaataagtatatgaaaagatgcccaacactatacctgcattaaggaaatgctaattgaatccacaacgagataccgcttcacgactattaaaatagctagggaaaaaaaactgacaataccaaagaccggtgagaaatcagaactgggattctcatacattcctggaggaatataaaattttacagccacattaacacacagtttaacaatttcttgtaacattagacaaataattgccatataacttaacaatctcactgctaggtatttaccctagaaaaaataaaatattatgttcacacaaaaacctgtgtgaatatttacatcaacattttgcagtcaccccaaactgaaagcaatacaaatgtctgtcagcagagaaatggatgaaccattgtacatccatacaatggaatacaactcagcaataaaagaaacaagctatcacatagaacagcacagttgaatctcaaatgcattatgccaagcaaaagaagccagattcctaagggcgtatgctttattataccatctatgtgacattctagaaaaggcaaaaccatagggatggggaacaaagcagtggtgtctagggtttgggagtaagcggcactacaagggaatgatgtgaggtgatggaactgttctgcatcctaactatatggtagtagttacacaactctacatatttgtcaaaactcatagaattgtacatcaataaaagtatattttaatgtatgtaaataaaaaataaacattggcaaaaaagagaccatgaatggcttttcttcaataagtttgcagttgtatcataataggttggtgccaaaacatttgagacatttatttatttcattgcaataatgcaacataatttttttttgagacagagtcttgctctatcgcccaggctggagtgcagtggcgcgatctcagctcactgcaagctccgtctcccaggttcaagcaattctctgcctcagcctcccgagtagctgggattacaggtgcccaccacatcgcccggctaattttttgtatttttagtagagacggggtttcaccatcttggccaggctgatcttgaactcctgaccttgtaatccacccacctcagcctcccaaagtgctgggattacaggtgtgaggcaccccgcccggccaatgcaacataattttacggctcctatgattttgattcctattaaacaaatatcaaaatgtcatctgtttctaccagttgtgtgctgtaaatatacacacataatgtataccagtacacatacttacatacgcacacacacaccacacacacacacacacacacacacaaattccttaatgttatctacatggtactatacaatcttgttcttacctctctagtctcatcttttgccttgctttatttacttaagtaaggtattcacttcatagcatactgtattccatgctgctccattgaaatttcagtttcttaaggaccacttcttagttaagtaatccccatctttttttttttttttttttttttgctgtactctgtgtcttttctttaggggctcattacaagtgtgattaattacaattgttgtgattatttcttggatgcttctcccccttctccacttattcaatgttagatctatgatggtagagactgtttgtgctgggaactagcacaaagcctggctgataatagataatcaaaactccgttaaataaatggataaatgacaaattgattcaatacttatctcacaggctcttttgtctgcagttcactgatgatgaaagtgttttattcatgggggccaaaagcaagttaaaaaaaattttaagtgaaatacagatgcctaatctcaaaaatggcaccaaacacaccaggggtgctgtgactctctgggttcagaaacttcttgtactcttaaaaattattaaagacctcagataacttttatgtgggctatatctatcactatttaattaaaaattaaaactgatcattttatttttatatattctattaaaggtaaaaccacatgtgttaacataaataacattattttaaattatatagtgaaaagtgacattgctttaaatttttgtaaattcctttaatgtctggtttgatagaagacacctggattctctacctgcttctgtggtcattgtgttgttacaaatccattatacacatgagtgaatgagaacgataaagataactaatgcatgtcttagaaacattatgaaaataattttgattcacagactctcaaaaagatccctaaatcacattttgaaaatcactgattcaaaaaaatccaagaaaatgcttcatgtagaaaaatatatatattttacaatggaaatatcactgtctattgactgagtacatatttatacccaaatcataatttgaaatgaaaataacatttaagctaaactcattaatttttttccttaactttttccttagaaggcaaaagcaatgtggcaacttctctttagaagcaactaatccaccaacaatttccaactctgatgaaagaaattaaggtagtggttcacaaagctgactagaaattagtgtcacctgtaaagctgttaaaactgcaacagtcccagcacagaacaactaactcagaaggggtggggtgaaatgctgaaacattggaattattttaaagctttccagagcattctgaagaccagccaagcactgagaatcactgtttcagtgattcaaaggccacaactcctagattatttcattccttcctagtgcctctcttttcttataagtagccacaagcaggaatgaaaaatctggtcagcagcaaccccccacccttcatgagttatggcaaaatatgtattttgcttaagacttgcctgtatcttggtagcttatgtccagttgtattgttttaagttggtagcttttactccttatattatggattttaggcagagccaaattcataggcatgtgaactgcacttgcacagtgcctcacactcagaagggccctgcacgtggtttatggctctgctgttgccattttacaattattaaggcttgtttaacaggaggccctgcattatcatttttcactgagccctacaaattatgtagctggttgtaattccaggctaattcataaattacaaagatttgaaaaagagcaagctgacgtaatttttataaggcagacctacagtgggcctgtgatataaaaagagatttataatctatccccctacattctaatccctagatctcactcttcctttctttaaatacctcaagccacaattcataacctcttttctaccacaactcttccccatggcctatgttcttcttgctgataagaattataaaagggattatgactttaggttcccagctagaagcaaataacacattcaaattaggatacttcgagatgggcttacaaacatgtgcacggggtttaagaaaactggaaggtgctagagaactatcccagagttgagctaatgacctctggagttggcaggaaagagtcacatataagagactactttgagtaaagcattgagctttagtcaaaaattcagccagcaagaggcaacttcagccagaagaataagtactcagacctcattcttccccctcctgctgatctgccagccatggctacctattggtcaaacccaaccagaaagtggagggcaaagaagaccatacattgaagccttacaagtgattgcctggggcagaacaagattgaaaagtggatcttgagatgaagagtgaaattacatgtcacagttaacccctttttcctctaaacattcatcattgccccttatccaggtgaaaagttcctgcccacaacacaggaaatgtttggagtcccattgataaatgtaccatagggtgatgtcaattcagtcatactcccatctcagatcttacatgctagtcaacactgaggttctccatatagaggtaagaagcaaaagtaaaaaataattaggtaacataaatcatagcttctttaattgttacttctgcacctgcttcataagacttaagtttgtatttacagctttcttcttctactccacaaacttcattcccatgggaaatgtcagtggtcttatccttattaggttgccacaattttctattagccaggactgttggaaaaggaaatatcaaaggcacttcagtgaattccctggatcccagatataatcatccttgcccctaccatggaggagcaatccaatttctctctgataattgcaatctatttcccctgccaatacgatgatgctattctctgcctgtggattcaatggcagaaaaagcccagtgtgcacaggacatcagttatagcctccaatccatgggaactataactatgttacctgaggaaagcattcctcccttgagcatgaggacctacctccaaattctttctgagcccaggagcgcagcaaagagaaaacagaaattcttatagtggattattaagcgtaataaggaaagacattattcccaccaccacccagtggtttctgacccatgctttctgactacaagggaaagggcatgacaaatgtatacacaagtatatgtgtatgtgtatatgtgtgtgttaatgcatatgtaagtgtgtttctatatatgcatttccaattatctttcttcttatctaatttaggtaaagaatcttgataaaaggatcttataaagactttagtaaatactgtatttgctaattgtgtatgttttgtatgcgtgttgtgtgtgagagagagacaaatgaagaatccaagttcatcaagcccacttaagattaatggatttacttaaagatttttaatgtaatgagttcacaaatttttacgtccaaaacactgcacaagcaataataggttttataaattctattatatagacagaaggaaaaaatgagtaaattgagcaaggaaaatgaaaatacaacaacgaatgcagactccatgaaatgattacaagtttattaagattttaaatagaataaatttatcaagttactaaggtaataagactgtctgtcatatcagctttggacttgtatgtctacaaaagcccaaaattgacctacatttctttcttgcatattaaatatttagttatttacagagagaatgatgattaaaatatacttaagccccttttctccactttcgtactaaattttgccaaatttgcttcctttacggcctttacccttatgtcgtactttgcatatcagcctagttttagtacattttaatgataatgtctggttataaaaaggaacactaagaaatctgttaaatgttatgttccaagaatagtatctcctatggcaagcaaatggacagaaatatattgggctttaaattgtaatttcacttctttttggccagtgaaatgtgagaaacagggaaagcaatatctgagatggttttcttattcatatattaaccaacatatttcttacacatattttaactcttccttgtggaaaataaaacacatgcaaaagtagagaatagtataagcctctcttcttcccacaatgtacccataacccagctccagaaatgttgcacacatggctgatcctgcttccattctaccgcaacccacttcctacccactctcccgtcactggattatttcaaaccaagtcacatcatgtgaccgactaatttaatgtatatttaatctaaattaatacatttaatctaatactttggtataagctctaaaaataggtatccttttagtttttataacagcatagctatgaaacattatcatttacatctaaaacattcaataatttcttaatattagtgtacaaatttcctttagtgtttcatgagtgattttttttcttaacttgatttgtcaggatccaaacaaggtccacccattgcttttggctgatataactcaagtcccatttaatttgtaaatattatctttcttttttgtgtgggggggtacatgaggcaaattaatacatttatataatttgtaaaggtcaaatcagtgtaactgggatatctatcaactgaaatatttgtcttttttatgttagaaacattcttattactttttcttcttctctttttctccctctctccttttttttctatttcttttttcttttgccatttatttgttaaagaaatcaggtcatttgtcctataacagtttttctctatttggattttggtggatgcaatcccatggtgttatttaacaagctcctttcttccatgcatttgctataaacaggtatttaaatctaaagccgtgattggattcagttttaatatttggggcatggatgctttgtaggtggtattgtatgcttccatcaggagacctataatgcttgactgtcaattttttatgttaacttaaccagtaggtgtatcatgaaacatccatacaaaacagtggtttcctatttctttcattccatcttcatttattagaagaattaatctcacattaactatttggtaatgcaaagacacagttcctactatgaagaaggaaccctatttcttctcacagggaatggtatttagggaatacaacctctgcaaggagtgcttattgctaatgggttggtaattatttctagaccttttcagtggacagacttaggaaatacatatctttttttaaaagacagagtttattatgagtttatattgatattttcaattcaaatttaggtttgcagagttacttcactttttaattttatatgtgtgtctcttttctctaatgttgcaagactttgttctaatgacattaacataattaccttttgcttctggaagctgagcctagagcctacatctccagctcttctggtgattttgtaaagttctcaatatcctcttttaaattcctctctgtaaaccatttggggtggtttcttttgtctgcaactgaatcctgacagtataacctgtgcaggcagcaatgaaggggctttgcattgtcagtgcagtatctgtgcagccactcagggttaaaccaactggctcaagtgattctctagtgagagaattgttgttaatgtattaaacagagatggtgatcactcagtctttgtcatctctgtgcaaatccaaatttaccaaaatttgtgcttctgtttttcaaaaacagtccttctctctttttatctcttttcccaaaatcagaccctgggggatatattaggtcaggccctccgcaagtaatacagggtcttctcttaactgtggatcgtggtcattttagtgaagttgttcagagaccattccatccccactgcagagggaaagaatgagaattcttgggagtgaatgcacgtgggttagaagaattggaaagctggaatgagtttgttgcttcaggagccttgaggactgcactgggctggggctttggataagggacaagtcaaatgagtaggacattgatgtaactttccaaggtgtcttcatccttagagctaatctttccagctgagttatctgggggatgtgtcttcatgtcagagtaaacaactgagacattctgggatggaaagaagatagaagaacttatcctctagaaatgtcctggaggtattgccttctccttttttacccaactgaatagtcaggatctcagaatataccaagtctccccctgcaccctttagaatgcataattccataaaacatctacagctccaccacggcagggcagcgcagatggaatgagaggacttcctggaccaccagtgggagggctcctggttttatctccccagaaaccatctcctgaagaaagtggagccaatggagtcagcacaagatggcaggctccatctcagacccagaaaagtctttgattttcaccagcaccagcagtgaaacagcagggccacagccagaagaggaatgctgagcagctccgccgtgtctcttgcagcgataaggccatctctgttgcctagagtctccaaggaaaaataacctgtgtgagcctcagcagagaggtacagaactcggaattgccttttccttagctttgttgggtcctgagccatgggagaggaggaagctaagggcctaggactcatgaggacatcctggtccaggttatggcctaatttaaccaatatttttgggtgccttctatgcaccatccactatggcagataaagtgtacactgtagggagcaataaggatgagtggggttaataaataaaacaaggcatagtcatagacctcaagagaaataaaatctagtatgaaggattcaacatatacctgataaatgactaattacaagtacatgactggtaatttcagaggaataatatgctattggagttcaaaataggaggaagtcacctttgtgggtttaaggaaacccacctttggggagaaatttgtctctgaggacaaaaagtacctggtagctgaaaaatggaccatgaatgaagagattgctgaggcagaaatattgatttcaaagccatttgctttgaattactagataaaacttaaagtgtataaaatcacccatagaaaatatataaagataaaaaagaagagggttaaattgctcaagccttaacttggaagatatggacatttgttggtggggggtggggagggtgtcactcaggattaaatgattaagtgaagggcactgagaaagaaagatgtaaagataattaaaataatatcctattatgaaagtaaaagtcaaagagaattcaactagtaaaccccaacttagtgcctttaaatgttctggatcctctaaattcctttccacattgctgttaatctcacattctcttttatcatgattatttcctaacttataggtctacttctctttggctgtacacctacttcttaaacctgacttgttattcagctcagtgtttttgatgattccagcatctgcaaggcacttattaggcaattggcacacacatagaaaatcaattttagactatttttaaaacccttttagaaacaataaagcaatattgtgagctaatactatcactaataatagtttaatgtgatgaagagtaagttttttttcagcaaatttttcagagcaattatgtatgatgtaatcctgaatagcttggagtatagatcagattttatatccaggcagtttcagtttattttcttactctttatatttgctaattatgaaacttcaaatttacatacattatcatcagtggcaacaatggcccaaacatgggcttataaattatggaaagatctctccataacatactactttaagagcgccatcatgtgctaagttaatgaatatagcatacctccaaatagaaaaattgcctatttcaacttgtaaaataatgtaaactggtttctagtttctgttttggttgcatacagctttagaaggtttttctaagttgtaatctataacaagctttagatattgtttgtaaatgtgactaatatattattgttttgtttctccaatgagaaatgaaagtcataaaacacaagggagtgtcaactcttaactatcaaaccattttagcttttggtatcacaatgtgattattacaaattctgacttttttcaggtcttctaaatgtgacattacataaaagtaacatggtttaaaacattaccatttttatgaaaaaattttaaatcattttaaaaagtcatgtttttgaaaacttatgcctacacagaaacttgcacctgaatgtttatagcagacttattcataattgccaaaacctggacacataattgccaagatatccttcagtaggtgaatggataaataaactgtggtacatccagacaatggaatatcattcagtactaaagagaaattagccatcttgccatgaaaagacatgtaggaaagttaaatgtatattaataaataaaagaagccaataagaaaaagctacatactgcgtgattttaactatatgacattctggaaaaggcaaaactatggagacagtaaaaagatcagtggttgtcggggattagagggaagggaggaatgaatagacagagcacagagggattttatagcagtgaaactgtatgataccataatggtgaatatacatcactacacatttgtccaaaccccatagaatgtgcaacaccaacagtgaaccctaatcttaactaaggaatttaggtgatagtgatgtgtcaatgtagattcattgattggaacaaattaccactgtagtatgggatgttgatagttggggaggctgtggggttgtgaaggagcacgtatatgggaactctgaattttctactcggttttggtgtgaacctaaaactgctataaaaaaaagtctatttaaaacaaacaaatgaaacctcatgtgtgctattttcctctccgatatggtttgactctctgtccccacccaaatctcatgttgaattgtgatccccaatgttggaggtggggcctggtggaatgtgattggatcacggaggtggtttctagtggttgaggatcatccccctaattctgtcttgtgatagggttctcatgagatcgggttgtttaaaagtgtatggcacctcccctctctcttccttttgctctggccgtgtaagaacacttgagcccaggtgtttgagatcagcctaggatacatggtgagactcctcatctctaataaataaataaataaatgtcttttaaaaaagaaatgttctgtaaatatatattgagttcattgggcctacagtgccgattaagtctgatatttctttgttaaatacctgtcaggatgatttgtccaatgctgaaagtgcggtattgaagtctccacacattattttactacagtctatctctgtctaaatttagctttaacaatatttgctttattaatctgggtactccagtattgggtgcatatatatttaaaattgttatatcctcctgctgaattgaccactttatcactatataatgaccttctttgtctctttttacagtttttggcttgttatccattttgtctgataaaaagtatagctactcctactctttttttttctttttggtttccatttgcatggaatattttttccatccttttattttcagtctatgtatgtctttagaggtgaagtatgtttcttgtaggcaacagagatcattgggtctgtttttttataatccattcagccactgtgtcttttgattggagagtttagtctatttacatttaatgttattacggattagtaaggacctcctcctgacattttgttgtttttcagttgttttgtagtcttctcttccttcctgtctttttcctgtctttctttttctgaaggtgattttctctggtggtatgtttttttctttttattttctgtatatctgtggttttttgacttaaggttaccataaagcttgcaaatagcatcttataacccaacattttaaattaacaacaacttaacaatgattgcataaacaaataaacaaacaaccaaagaaaaaactcataagaactctacactttaacctcatcctcccccttttaactttttttcatttctatttatatcttcttatactatctctggcttgaaaagttgcagttactatttttgatcaggtcatcttttagtctttgtactcaagatatgagtagtttacacatcacaattacagtgttataatattctgtgttttttctgtgtacttatattactagtgagttttgtaccatcacattatttcttatttctcattaacatctttttttttcagatggaagaactccctttagcatttcttgtaggacaggtctgatattgatgaaattcctcggtttttgtttttctgggaaagtctttatttctccttcatgtttgaaggatattctcaatgaatacactattctaggataaaagggttgctgtttttgttttttcttctgtgcttgtaatatgctacaactctctctctgctgacctgtaaggtttccactgaaaagtctgctgccagatgtatcggaactcctttgtatgttttttttctctctctctctctctctttctgcttgtagaatcgtttctttgtccttaacctttgggagtttgattattaaatgttttaaggtagtcttaatttggctaaatttggttggtattctataatgttcttataggctattgatacctttctgaaggtttgggaagttctctgttattttccctttggataaactttctacccctatctctctctacacatcctctttaaggctaataactcttagatttgtccttttaaggctattttctagatcctgtatgcatacttcatatttttagtccttttttattttgtgtcctctggctgtgaatttgcaaatagcctgtcttcaagttcactaattctttttttctgcttgatgaattctgctgttaagaaactctgatgcattcttcagctccagaatttctccttaattctttttaattatttcaatctttttattaaatttgtctgatagaaatctgaattccttctcaatgtaatcttgaatttcattgagctacctcaaaacagctattttgaattctctgaaaggtcacttatctctgggatgggtcactaatgccttatttagcttatttggtgaggtcatgatttcctggatggttctgatgcttgtcaatgttcttctgtgtctggatgttgaacagttaggtatttattataagcttctcagtctggacttgtgtttacctggtcttcttgagaaggttttccaagtattcaaagggacttgggtgttgtgatctaaattgttaatcacttcagctttatctgcattgggggcaccccaagttcaataatggtgtggctcttgcagacttgtagcgatactattttcttgctcttgggtaagatctgggagaattccctgaattaccaggcagagacttttgttctcttcccttattttcccacaaacaaagagtctctttctctatgatgacctgcctggagctgggtaaggggtgacacaagcacccttgtccacgactactagaactgtgctgggtcaggcctgaagccagcatagcactgggtcttgcccaaggcccacagtgaccaccgcctgactgctgcctgtgttcactcaggataaaaggctctacagtcagcaggtggcaaaaccctctaggcttgtgtacttctcttcagggtggcaaggtcccccttggccccagacaggtctggagatgccatccaagaacgagggcccagggttatgaaccttaggaatatatctggtgctgtattctactgtggctcagctggcatctgggctgcaagacaaagtccttcccctctccttaagtagagaagtgtcttcctacggccaccactcccctaagcccacagtgaatactgcctggctactattgatgttcactcaaggcctgagggctcttcagtcagcttgtggtgaatgcttccaggcctgtatctctccctcagtgcagtgggctcccttctggctcagggcaggtgtgtaaatgccatttagtagtcaaggcctggaatcagggactccaggagcccacttggtgctctaccctactgtggtcaacctggtactaaagctgcaggacaaagtcccatttactctcccctttcctttcctcaagcagaaggagcctctccccataaccaccacaggctggaatatggtgggtcacacccgaagcctgtgttgctctgagtcttacccaaggctcatggtgagtactgccttgctactactgctgattattcagggcccaacggctctttagtcagcatgtgataaatcctgccaggactgggtccttcccttcaaggctgtgggttccctctggcccaaggtgtgtgtagaaatgtgatctgagagatagggcctggcatggggtcctcaggacactggctggcttcctcttctgctgtaactgggctggtacccaagttacaaagtttactttcttctcttctctcctcaagcagtagaaaggagtctcttttggagccatgatcttccctgcatgaggttgggggagaagtgatgccagcattcccttggccactccagctggtgtctcactaggccatgtgcaccccaagttctctggctctgagccctgcaccacaagatttgcccaagaattgcagtccttgtggcttaaactgcctttcaagtttacttagtattccagagtacttcagcccatggtgctggagcttaccagaactcagcttctgactgctaggatggaaaatttgcctctggctatgactggtctaaatgctcccactgtggacactggctgagttctgccccatgatactttctactgtgacagggcagcactgagttcccatgcaaagtcccacaatcactgtgctatccctgccccaagcacacagattctctctccatgccatgtggctgctgatgagggataggggtggggtggtgtcagcaattcaaggccatcttttctacccttttcagtgcctcttccctcttcagtgcctctttctttaatatgacgttaaaaccaggtactgtaatcagtcacctgatttttggttattataaaggtgcttttttgtgtgaccacttgttcaatttggtgatcccctctgcaagataattgctggaggcttctatttgaccatcttgctttgccagtccaaaattaatgcactttgtaaactgattttctatgaagaataatactctgatttatgctactgtagtttggcattttctgcatatcaagtgaccaagttcattaatttcctactaaaaaaagagtgttttgcccttgttttggaaaaaaaagtatcaattggtttaacaaaaacacttaatttgatgactgtttcatttctaaatgatgctaaatattctgataattggcttcatgccagtgactgacagtcttatacaaagaaaaaataccagtccaataaaatacaatgtccacatgttgattattacatttatgtgtttacagtccatatttgtgggggaaataaatacattcatcttcagcaactttctttgtctatacagtacgtggccagactcatctatctgttgtgatcttgtaaatttccttattccccactatcttatcctatcttttaaaaattcttatctttggttcctaacactagccttaggtcttcctaatactaaccccagattttctgaatctgaagtttagtgcagtctctgttacaattttgaaatcaccccctgtcaccagagaatcacagatgaatgtgaaaattctagcagtccttgagggcaaggcatcggagcccatgtattctgtgaatcctccccactaaggaaggagaatcagataacctccattagtgctttggctcatctatattcagtttttttgcactacttgaggaggttcttttacacatgttaagtccaagctgactataataacatcgttccaactagtaacgtaactaccactcgcttaatcttttgggatacttttcctgcatgtattagttcatttgaatcatgtccttgaaaaagtccttcctctatgttgataacccagctatttccaatctcttttccacccttcatagtttgtggcatttaaaaaatataatgcaataaatgttcatcataaaaaatgtacagaatgtataatggtttttaaaatgaagtaaatgtttgttatcttaaaaaggtaaattttatcttacctgcctgtgtcatccttcttattggcatgtctatatcctacctgaaaaaaatacacggaagttatcaagcactatactttactctttttgaacatctctgttgttatctaggtagaagttgatacatccactcttattgctaacatcttttcactagaatttggatttaatttatttaaaggcctgagggcagaataatcaatacaaagtccaattgaaaaagttgtcaagaacatgagcaagacaatatttctttatcagtctacttaatcacccatccttactgagtggaccaattagttggtcaaaccattaatcagttcactgaattaaattactttatcacatggatggaccaggcaagtcatttaagtaagtgaactaagggtagggaagtggagaaactatggcaaattacagaaggaaggtttcgtagaaagggggcagaacctctctattccccccgagaaacttggaaactaggatttgtcatacatttagacttgttgaaagtcagaaatctgatttttaagcaaaatatccaaattttaagttggcaataaatttataatttataaattatgacacttttcaatgaataaatgacctatagatcagacataccgatcagaccactggtttctgactcatgattataaactatgtggcaacgctaagtatcttttccaatgcacagagtgaatgcacatttttcaacaatacctacctccacaggcacacagacaatgtcattataaagaatatatttgacatgaagaataagatatacatacaactatgcatacatgcatatacatgtgtgtatatggggatgtgtatgcaatccttccttagccatagccagaactaggaaaataaaatggtgctaccaacaaaaataaatctgattcttaccacataatcaacaagccttccaaaacctcttcatgttccagagggtccatagggtgtatcgtattccaaaacttctgatcacaatctttcaatctttagtttcatcaattgttccttcccttcttgtcccttttctcagcaaaaggctatatcaggtgatccttatcatggaaccaccacagcagcccaggatttcacaccattcaccctgactcaataaactgaggtggggcatgggactctgcatttttaataaacaacctgggtggttctgaagcaagtggtccatctatatattttgacaaatgcagatatgtattccttccatttctagccctatagtactccccacctgtcttctttccttgctacttatttatctcacccagaaatccatacgatctttcaatccaaaggctccctcatatttcctcaattctgtaaaattctacctatgagctctatgtctttcctccatttctttaatgctgtgaaatcaagtactgctcccgaacttcagctcacctgtagcaggatccttctgacccagactatctgcctgaattgccactttcccctttttgatattatgctctccctataatcagagttatctctgattgtctacttttggacttctcctgagatgaacaatgggcttattctcacaactatttctgtggcctatcccaacccctgccctgtccattcaggccatccaatctctctctggggccaagtcatacccatcctgtccctttaataatgataataataatttttaaaaaacttccctttccagttttataagctcaacggcccagcaatacagctgatcttggtgatcagcagaattaacaatcagagaaagacctcaggaaataaaattggtgaagttacgattaaccattacacgttaaaaaaaaaaaaaaaaagaagctcagtctcacttcatttattcctttgacaaatacagattgagcattttgtctaaaggatacgctacactagacacaaggacaaaggaatgagcaaaagatataaagttccgtgtcctcaaaaagtttgtattctagtgagaagacagataataataaaataataaatatttagtctttccttcatagcatcatctatcatagtacaggttatacagagtgacaagggaaagggtggggataaagaaaagggtagaattccacataggatcgtcagagatggcttagtggcatggtggcctatcagcaacaacacaaggaagtgagggagcaatccatgaggataccagaagaaagagttagagcaatccatgaggataccagaggaaagagttttccagacagaggaaagagcaaatgcaaaagtcctgaggcaagagtgtatttggtgactgaggaacagcaaaggaggccaatatgacaggagtgaagtaagcaagggagagatgagaaggagacagggtcagagagacagcaggggccagatcatacagaaccctgtcagccattgtaagcactttggattttattcagagtgggatgggaaatatttaaagtcatcattttgaccagcagatgacacaatgggacatatttaaatgggagtactctggtgggagagtaggataaggactgaaggtgagcaaagatggaagcaaggactaattaggatagtatggcaaaaatccgggaaagagataatggtggcttgaatcagagtgctggcagtagtggtggtgaaagtggtaaaattctgacatattttcaagatagatctggctggatttgccaatggattaaatatgcagtatgagaaaagaaaaatgtcaaaatggctccaaatattgacttatgcaattgacatgctagagttgccttttatgtaattgagaagcctggaggagaagcagaattgagtaaaagaaaataattcagtgtggatatattaaacttgagataaccattagacatacaaatagaaattttcatgaacaattgggtttacaggctggatttcagagagatttcggctgaaaatgtgaattgggtgctatcatcacataaattatatgaaaagccaaaagaattagatgagcttaactggtgttgaccgaaaagaaaagaggtccaaagaatgagcccgtgagtaatccaacattaagaaaacaaataaatgaaagaggaaggtggggaagagaaccggcaaaagagacggggaatgagcaaacagtgaggcagaagggaaactaggaaagagttggtgacctggtgacccagaagccaatcagagaacatgcaagaaaaaggacacaatcagtgagatccaatggtgttgagaagtcaagtaagataaggaccaagaattgacccttgcacggatcaatgtcatagtcattagggatttttattagagatgctttaaaaaaggtgatagagactaacacctatttggttttagttaaaaagagaaaaaatatataggcaacactttgaggactagttacaactttattgtaattacagctttgttccacacaacctccttgaaatgttgtgcattcattaagtgttccaaagctgtatcagagaaaaggtggccttgacataccgtccatggaacaggatggctttataggacttaacactgggtgaaatgcagagctacagaataactacagtcattagtgccatgaatatttcataacctttaaggaattgaattaaatttaatacttcctgcaactgcattagatgcaagaagagagggcagtctataactattgcttactttaatgaaattacctataacctgattctttgctaaaagtagcagccaattactctgtaatccacatgtatcttaggtaacagtaggaggaaattactacgtgatgttctctttggtaacttgaaaccaacgaaagcatattatcctcaaaaagtgtatagactcagtacaatgtgtgaagcaatgatgtattgacatatagatatttttccctttaaaagcctccaaatgtcaaatttcatttatcaactcttaaggtgccatggagagtaaaataggaatacctacagatataaaatatgttcttgcattaagaatgtgaaagaagtcattactgcttcctattaaataaccatattctttgtggcttacagaaaagaacagtaggctccttatgctctctctgaaaatttgagccccttcaaagagttattaggttggtagagaaaaaccatccattaaactcctaagaagagggagtattgctcaaattgatgtttttctgtcatgactgtctttttctcttccctctaattgttctacaaaactgaatttaaggataaactctttaatcataaggatacttaggtcccatacccccattatctccagaaaaatatatataaggaagaggcctgaagatatagttgctaaatatcaacctaccaaaaggtaggagagtactaattatataccatgttctgcactgtttacttttatgtctagaatttcattatattcctccccaaactttacaagttaaatgtaataggcactattctaaaaacaaggaagctgaagctcacagagattaaatgatcatccagtaacatacagctactaagacagaggagtggtagttttgatacataaatgagaaaactttgatttacatgtccatgagtacgagaaaggatttttaaaaattaagctgagcacagtactatagaattctacgtcatcatggctgagagaaaacgtacctgctttaattcaggagacatattttgctttgagtgaaaggacattaccaaatactaaatactaaatcattctgttctattgaaccatgaccagtgttctttctccgagtttaggtaaataaaaattagaattagagactaaggaagagataaccagaatctctccacaaaataagattaagtttatcaaggcagccatccctatttttattagtcaaactccaagataaaagccccaatgctctcttgccccagaaagttgattcttgagcacatcatccatacagatgctgcatgttcttacacttgagttccctgcttcctcctgccttccgagaccttcactctgccctctagagcaccagcaactatgttcaacctcttctctgatgttctactttcttgccttaaaagctcagctctctcctcacatgtgattccttctatagctctcaaaataatggatctttagtctgtgtacagcatgtacgtcagggtttagtagagagattgttatcctcctgcctcccaaatgctgctcacactcactactcacactcttgtagaaaattctgtccctctgagactcattcattcatttatgccttaactcattcaatagatacttaaagagctagtgttgagtgtcaatagttttttttaagctctagggatatgaaagacattatgtgacttgatcatccactttccctcccagctgcagtcattataaacttctagatcatggtgtatcactcagagaaggttttgacatctagcttacagtcttgctctccacctcatatttgtttacaggacaagttttcttccctctggggaaggaaaagaaggcagataacctggtctaatttcctcttcaaatggacctctgggtaaatagactaatatttgctagtagtctttatatatacaaaggccttagcaagatgtctttggttaaggattactgataataaataaatctaatatcagttatgtgaggcatggctgcctggagaatgtcaggcaacctgtataattatcagcattatagaattagccacataaatacactctgctatgtgaggtaattatctcctcacttggaggtcccattttttacccagaaccagagagcacaaaagcaacaaaggaagaaagtgccagtgtaaccatgtgagatgtctcagacacctctcttatttgtctctgtttcttgattgcctacatccctgaattatttggaaagctggacatggagtatgatatcagatatatatgagtctaatttgacaattcaatcctggttttagctaaggctcccacctctatcattccatacgcatacacagaattcctcattaaatttaatttaccagttaccatcttgttgtcaaaactactgggcattcacagtcatcttacacgacccataacctctccattttactcaacactgatgactacgcccttctgtctggaaaatataattcctcggcctctctgccaaatataaacagttgaattattgccttcaatgcttcacactgccctgcatcggtaccttccccacagtctcaacatggtcagagtatatttccatacctcctagactttcggtttctctaagtgtctactttggccatggaatgaattatttggaaatgacagtgcatcagttccaatctagcaacttattctcttgtattcatacttctgtcaaggaaacacactccagctggccctgtcttacggagagatacacaaagcagaacctcagcagccaactccaagattttcattcaaagtagagccaccccagtcatcacagcctgaagcagagctatctagccacagattggccatataccccagccaaattataagcataaatgatggttcttttaaccatggattttggggctgatgtgtgtatttccacagactgacataaaataccacagactgggtgatttaaacaatataaatttatatttccccaattctgaaggctaaagattcaagattaaggtattaacaggtttatctgaaaattgcagatggctgccttctgactgcatcctcttgtgtttttttctttgtgcatatgcatttctggtgtctctttgtgtgtccaaatgttattgtcttataaggacaccagtcaactgtctaattttaacttaataacctctttaaaggatttatctccaaacacagtcacattctgaggtactgtcatttagggcttcagcatatgaattttggaaggacacaagtcagcacataacattatgttacatggcattattatgacaataactgactggtacacgacaatcatctggcttcttctacttctctgaccttttcttttatttcctctacttagccatttaaatgtaagagacctcaagactctatcttaggcccctctttcacactatactgtaactccaggcctgatattcaacaggaggaggtttttcccctcaccccacccagggacatttggcaatatctggagacatttttgatgatcacagctggggaaggtgtactactgacatctaggggagacagctgggatcctgctataagatgcacaatgcacagagtagctcccctacaacaaagtattaaccagcccaaaatgtcaatggtgcagagattaagaaaccctcttctaggcacttacatcgaagttgtaggctccacgccattggcaatagattcacatctctggccctgatatctgagtttcaaacacacttatcgtatttaacctcccttacttggataattcaaaagcacttcaaactcaaattatcccaaaacaaacttgtggttttccctccagatattggttctcttacttggtatttcagcttagcaaattgtgttcatccagaaactcaggagccaataactccctttcctctaacctataaagttcatcaccctgagctaatttactttctaaatatatctttggttcatccatttctttcatttccattgagagtaacttttctcctctaagctgtcatttgtctctcccttggaatgatgtcattcagtttgccaattagcaatcaaatgattactctcaaaattattgagcattctctttataaaatacaaatataaacatgacacttcactgattcaaaacaaacagaaaacattctccattgttcttaaagattgaaatccttaatgttgcctaaaagtaaaatatccataaaatgtattgtcaaaaccagtacacttttaagaggagtgtgtgcgtgcatgagtgtgtgtgtgtttgtgtgtgtgtgtgtgtgtgtgtgtgtgtgtgtggtggggaaatattaaaaattattccaaggcaaatgtaaacagggactgtccctgtttacatttgcataccctgttgctacttgcataccctgttgataagtcctttgttgcttcagccctgcctgcctctcaaaattcatctcatattattttcctttcccttttgactttccagataaattggactttatatgatgctatcttctatgtgcctcttatgtgccatattccttctacctcagtggttttacatgtttttcactctgcatagaaatttctcacccccaaatgtaaattagtacagtcactatggagaacagtttgaaagttcctcagaaaactgaaaatagagctaccatatgatccagcaatcctacctttaaggtacatactcaacaggaagaaaattagtatattgaagagatacctgcactccagtgtttgctgtagcactgtatacaatagctaagatttggaagcaacctaagcatccatcaacagatgaaaggataaagaaaatgatgtacatatacacaatggagtcctattcagccataaaaaaaagagagagagaatgagatcctgtcgtttgcaacaacatgaatggaactgggggacattaagttatgtgagataagccaggcacagaaagaaaaacatcacatgttctcacttaaaaaaaaaaaaaaagaattgaactaatggagataggagaaagacaatcatcaacatgggggagggagtaggtatggttaattggtacaaaaaatatataaagaataaatgaaaattagtatttgatagtgcaacagggtaattatagtcaatactaattgcacatttaaaaataactaaaagagtataattaaattatttgtaacacaaaggataaatgtttgaggtgatggatatcccatttaccttgaagtgattattacacattgcatgcccatatcaaaatatctcttgtaagtccaggaccagatggattcacagccaaattctaccagaggtacaaggaggaactggtaccattccttctgaaactattccagtcaatagcaaaagagggaatccttcctactcattttatgaggccagcatcatcctgataccaaagccgggcagagacaccactagaaaagggaattttagaccaatatccctgatgaacattgatgcaaaaatcctcaataaaatactggcaaaccaaatccagcagcacatcaaaaagcttatccaccatgatcaagtgggcttcatccctgggatgcgaagctggttcaatatacgcaaatcaataaatgtaaactagcatataaacagaaccaaagacaaaaaccacatgattatctcaatagacgcagaaaaggcctttgacaaaattcaacaacgcttcatgctaaaaactctcaataaattaggtattgatgagatgtatctcaaaataataagagctatctatgacaaacctacagccaatatcatactgaatgggcaaaaacgaagtgttccctttgaaaactggcacaagacagggatgccgtctctcaccactcctattcaacatagtgttggaagttctggccagggcaatcgggcaggagaaggaaataaagggtattcaattaggaaaagaggaagtcaaattgtccctgtttgcagatgacatgattgtatatctagaaaaccccattgtctcagcccaaaatctccttaagttgataagcaacctcagcaaagtctcaggatacaaaatcaatgtgcaaaaatcacaagcattctgttacaccaataacagacaaacagagagccaaatcatgagtgaattcccattcacaattgcttcaaagagaataaaatacctaggaatccaacttacaagggatgtgaagggcctctttaaggagaactacaaagcactgctcaatgaaataaaagaggatacaaacaaatggaagaacattccatgctcatgggtaggaagaatcaatatcgtgaaaatggccataccacccaaggtaatttatagattcaatgccatccccatcaagctaccaatgacttgcttcacagaattggaaaaaactactttaaagttcatatggaaagaaaaaagagcccgcatcgccaagacaatcctaagccaaaagaacaaagatggaggcatcacgctacctgacttcaaactatactacaaggctacagtaacaaaaacaggatggtactggtaccaaaagagagatatagatcaatggaacagaacagagccctcagaaataacgctgcctatctacaactatctgatctttgacaaacctgagaaaaacaagcaatggggaaaggattccctatttaataaatggtgctgggaaaactggctggccatatgtagaaagctgaaactggatcccttccttacaccttatacaaaaattaattcaagatggattagagacttaaacgttagacctaaaaccataaaaaccctaggagaaaacctaggcaataccattcaggacataggcatgggcaaggacttcatgtctaaaacaccaaaagcaatggcaacaaaagacaaaattgacaaatgggatctaattaaactaaagaacttctgcacagcaaaagaaaccaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcaaccaaaaaacacatgaaaaaatgttcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggacgtcagtgtggcagttcctcagggatctagaactagaaataccatttgacccagccatcccattactgggtatatacccaaaggactataagtcatgctgctataaagacacatgcacacgtatgtttattgcggcactattcacaatagcaaaggcttggaaccaacccaaatgtccaacaacgatagactggattgagaaaatgtggcacatatacaccatggaatactatgcagccacaaaaaatgatgagttcatgtcctttgtagggatatggatgaaattggaaatcatcattctcagtaaactatcgcaaggacaaaaaaccaaacaccacatgttctcactcataggtgggaattgacaatgagaacacatggacacaggaaggggaacatcacactctggggactgttgtggggtcgggggagtggggagggatagcattaggagatatacctaatgctaaatgatgagttaatgggtgcagcacaccagcatggcacatgtatacatatgtaactaacctgcacattgtgcacatgtaccctaaaacttaaagtataataataaaaaaaaaaaagttgacacacacacacacacacacaaagaatctaatgcttgatgatctgtcattgtctcccatcacccccagataggactgtctagttgcaggaaaacaggctcagggctcccactgattctacattacggtgacttgcataattatttcactgtgtattacaatgtaataatagtagaaataaagtacacaataaatgtaaaaaaaagaaaaaaaaaagaaaaatatcccttgtacccaaaaatacatatacttactatgtactaacaaaaattaaacattaaaagaaattttctacccccatccctattagtaaatctctatcattctttactatttcttcagaaaagtttgcgccctgactcttcaaaaaccacaagttcccctgctatataccctcacatcattgtatacactccttcaaagtattcagaatccaaagtcacttgaagtaaaaatacattcctaattgtgggttgttgtttgtctgaggtggatttttctttgtcatttgggttttttaaatttgttttgagttttgttttgtttgctaggtaacacttgaactgtgaggtccatgaggtatgttatactatgtctcacagatacttggtggtgaaatagttggattaacttattaattaacttggccaatgttacataataagtaaaaacaaaatctatattgaacattctatgagatatgtacaatatattactgcttcttacttttgcacagatataatagactctttaatagaatatgtatcattctttgtgtgtgtatatctggaaggtagtattctagcagtgtccattatttgttcatattttgagaataacataataaaaggaaaagtgtgttccatttattgaatacaagcgcctattcttaagagtaaatctgaagccaggaagtagttaagaattttttctaagttgttagaagtttcctaaactaactttaaagatttattagggttttccagagaaacagaatcaacaggatatatatacatatatgtatctatcctattggttttatttaaataggcatatatttacgtttaaatatatattcatatctctacctattataaagaataagaaattggcttgtgccattatagaggctgagaagtgctatgatctggcatctgcaagctggagacttaagaaagttggtagtatagttccagtccaaatctgatgatctgagtaccagaagcagcaatggtgtaagttctagtccaagtccaaaggcctgagaaccaagagggctgatgctataaatcccagtccagggcaggagaacatggatgtcgcagcacagcagtcaggcaaagagagagaattctcccttcctcagctttttgttcccgtcagacccacaatagatgggatgaggcctattcacattggggagggccatctgctttacttagcccaccaattcacatgctaatctcttctggaaacacccagacaggcaaaccaagaattaatatttaaccaagtatttgggtgcaccatcacccagtcaagttgataaataaaattaaccattacaaaaagtggtgaaaataactcctttacacaaaacattttctaatagaaacaaggttgtgatgaaatgcaacagaactttgaattatgaaaatattttttaaaactggaatgtaatctataaacatacaggctttcacatcaataaaattgtttacaatttgtttaaaaatgcttctgatattcttgtgtgatttacacatcagttcattaaactaggcctgagcccttcttcagttaatatccattcaaataccacacacacatttctcttctgtgacaccacaattactttggcattcacaataactcttctggagaaagagcttccacaggagaatttctcctttatgtttaataacaggaagcagattgttgattaagcaaggcaattaaagcttttattacagcagcctaatacagctttctttttcttctaagacctaagaattcgatttaaaaagtaccaattttacggttcatccatctagcttctccttgtatttctcatgtttgtatatactgagcagagacatttgctatgtttctaaaaatatatgagactttcttaatttttgaaaatcttttgaattgtatctttactaggtaggtccacttcaaagtagaagagtgttagtctgcagctatgtctaaacaattatgttccagtcattaaacattaggagatggcctgtttagtatcagcactgcattttatagctgtctaaaactttgaagtagtgatttgaaaagcaaaggaaatagcagtggaaacagatagagagtgagtactgagagctttcctaccccacaccgtccacgcgactagcatttatttcttataagaatttttgctcatcttgcaaaatgccataagcatgccttttaatttagagtaatttaatttaatttctaacattttaacacaaatggctttaaaaagaaaaaggaacaaaataattacatttaatttcatggtttcagattcctaaaagccatcatattctttggtgtgattgaagacttccattaaggaggggaagaaaaaaattcgtgaaacttttactctttttttggaacacaaacagaatttatggtgccattctattaaatatttactaggaaagatagctgtggtggttttgtggtgcttagaaatgcagaaatcattcaaaagaagtgggtctaaattctgatggaagaatgcctcataatttctttcttaatgtcatttcaagttggaaaaaagaaatctcaggatgaaggatagtctatttttgtatgtctctttgtatcttacagaatacagcatgagattttaaatttatgagagtaagcccagaggtagattaatagttggttgacttgggaccttaaaagatcatctaataacctttattcctgctaatccatctctccaggaaagcccgagtagattttaagagtcaattcagctttcaaaataaatccatttattagtagcaagcaagcaggtttcttcttcagcctagaataccctttcctgtaaaaaactgtttttttatccatggaatcttcctgatcatgtttcaaggcttaactgaaatttatatctagtagggaaacttctcctattcctccaattggaataaatcatcattctacacatttctataacaattttatacctcattttgggtatttatcatatattttttataaaattataaatatattgtctatgtacacacttctgggtaaaaagtaaatgagatacattatcttattctatggataagtttgactttgagttgactttctagttctgatccattggaaacctaataaagatagaatttaatattggctatgagagaaatgacacctggttgataaaatattttattatttagaaggttgtaaataaactatcagtacttagtgggaagccatggctttggacttgcctgagtgtgtgacttataactggacacatcgtttgcatagaggcatacctcatgtatttgaaaagcatggtgtattattttttaagtattcccccacttctttaaaaaaaaatcttgtaaatttcaatagctttgggggtgtttttttgttacattgatgaattgtttagtaaagtctgagattttaatgcagtcatcactgagcagtgtacgttgtaaccagtatgtagctttttatccctcacctgactcccaccatcccctttccgagtctccaagtttcattatatcactctgtatgactctgcatattcatagttcagctcccacttataagtgagaacatagagtatttagttttcaattcctgagttacttcacttaaaataatggtctccaactccaaccaagttgctgcaaaatacattatttcattctttcttatggctgaatagtataccatgttgtatatatatcacattttctttactcatcagttgatgggaacttaggttggttccatatttttgcaattgtgaactgtgctgtgataaacatgtgcagatatcttttttatttactgacttcttttcttttggttagatacccagtagtgcgattgctaaattgaatgatagatctacttttagttcttaagaaatctccgtagttttccagagaggttgtgctaatttgcattccaatcatcagtgtatgtgctcctttttcacaacatccatgccaatatctattattttttgactttttaataatggccatcctgactggggtaaggtggtatctccttgtggttttcatttgcatttccctgatgtagtgattttgagcatttttttatgtttgttggccatttgcatatcttcttttgggaaatatctatgtattcatgccattttttcactttttgacaggattatttgatttgctgatttgtttgagttttttgtagattctgtatattagttatttatctgatgcatagtttgtaaacattttctcctattctgtgggttgtctgtttaatgattatttcttttactgtgcagaacagcatccccctcttctaaatgacaattattttcactaacaattatgaaataacatattatgtcttatagtttgaaaaaatagttttaaaataataaattgtaattttaaacatactagtcaaaatcagtaaaatattcctatgggaactaaactttacacttacccaacaaaaatattatcattacagttcatactatgttttactcgtttaaattttaaatacaaataaaaactctaagctatcctgtaaaatgatagaattgaaataactcgagctttttcccttgatctttacaatctctgtgtcatcactttatttttaacatattgtttaaatgcaggaatatgtactatcacaggatttagagacatgagctttaccttaagcaagcttgaatgattcctaaccattgtggacttcctcttgaaggaaaaacacatggagttgagtccatgagtgtcagaggctggccacataactggaagtttgttgaattaatttccacaaaaaggacagtttactaaagcacaagtaatacaaatgtgctaatttgaagcttacatgtagtcttagtgaacttacacttctgtacaaaatggagtagcagatattggatttactttcctttctgaaacaattttttaaaaacagcagaaaaatgtataaagcaatcatttccaagacactgggcaccatgcagtaaaagacactgatctctgaagatggaacacaaaaaattttggccctaaaattgcctctgcttactgcctggaaagaaatttcatactctttagtgaaaagaggacagcccaggaagagtcccaaatatttccagagttgaggagacttggcttagagtctagagagattgtattggctagagtttgcagaacatactaccagaagagagtttcatagagagagaactatggatgtcttcagagagcctgccacaaatattctagagtactgatcagcatgtagtatttggaaactacccaaggctggggaaagaatcgtctaagaggattaaaggcaaaagtgttcagcatttacatggggccagaaacaatatgcgttcccaccagataagcaagaagattgatattttatgtgccattgggcagactatagaaaagggtctaaagcaacagtggacaatatttatccctagactgatcactgctttggagctgcctaacaactaataaatgcaagatcaaaaaagataaaaatgtttccaaataactgcattcataaataaagctcaagaagatttagaagaagacaaaaatatccagcaccccaaaaagtaaaatttacaaaatctgtcatccaagcaaacattactaggtaggaaaagaagcagaaaaatacaaaccataataaggggaataatcaatcaatcaaaactgacacatggccaaccacagtggctcatgcctataatcccagtgctttgggaggcctaggcagaaggatcacttgagaccaggagttcaagaccagcctgggcaacatagtgagaccctctctctaccgaaaatacaaaaattaaccaggtgtggtagcatgctcatgaagtccttgctactcaagaagctgaggcaggagaatcgcttgagcccaggattttgaggctgcagtgagctatgatcatgccacttcattccagcctgggtgacagagtgagaccctgttttttgaaaaataaaataaaataaataaaataaaaatacggtggcaactcttgaaattagatttcctctcaactaatcaggtgtgttattgttgctacttgtttttatgttattatttctgttatttagtaacattccctaagtaattctgcaaaaagtatgcttttggtcatatgcagccaagcagtctctactcggttagcccattggtcacctaataatcagacagaaatttccttacacgtcttgaaccagtaagtcttccaaattttacaagggactctgtgtatgtattgaagtatgtgtatggtgttccagcaggcaggttatagttatgccttagcctttacttccagctttcatagagcttcagtgttaaacagtcagtattcctcattgttttgtctacatgcatattttcatctggtatcatttttcctctccctaaatttttctctttaacaaatttctagtgccactgagaaaactcagacactgggtttactatacaaagactttaaatcacatatgtttttattttatatatatatatatgtatatatatatatatagagagagagagagagagagagagagagagtcttgctctgttgcccaggctggagtgcagttgcgtgatcttggctcactgcaacctccgcctcctgggttcaagccattctcctgcctcagcctccgagtagctgggaatacaggcgtgtgccaccacatcccgctattttttgtatttttagttgagatagggtttcaccatgttagtcaggctggtctcaaactcctgacctcaggcaatctgcccgactcggcctcccaaagcgctgggattacaggcatgagctaccataccgggactatttttaaagaattaggctgggtgtggtagcttacacctgtaattccagcactttgagaggcggaggcgggcagatcgcttgaagtcaggcattcgagaccagcctggccaacatggcaaaatcccgtctctactaaaaataataaaattagccacgtgtggttgtcatgggcctgtaatcccagctactcaggaagctgaggcatgaggatctcttgaacccaggaggcagaggttgcagtgagccaagatcgtgccacggtactcccgcctgggtgacagagcaagactctcaccaaaaaaaaaaaaaaaaaaaaaaaaaaaaaaaaaaaaaaaaaaaaaaaccaaaaaaaaaagaaaagaaagaaagaaagaaaagaaagaaaggataatgtctaaataattacaagaaattatgagaatggtgtatcaccaacatcaataaaaaggtagaaaaatataaaaaagaataatcggatattctggagttaaaaagtacaataatgaaaagtttgctagagggggtcaacaaaaaaatttgagttgtagaagaacaaacacgtaattctgaagataggtcaattctgattacgtattctgagaaacagaaagaaaaaaatgaggaaaaatgtgtatagcctcagagacatgacatataataccaagtttatcaacttaagcaaaataagaattcaagaaagagcgaaataaaggggaggagggaatactaaaagaaataatggctgaaaactttccaaatatgcttaaaaacattaaaattatttaagaaacataatcagcttcaagtaggataaactcaaagagattcccacctagacaccaactgttgaaagcttaagaaaagagagaatcttgaaagcagcaagagagaagaaatgtactacataccaaagacaaataaaaacattttataatgataaaagggtcaatccttttggaagatataacaatcataaatgtatatactcctaccaagaagccccaaaatacatcaggcaaaaactgaaaacaactgaagggagaaataaacaattcgacaaagatagctgaaggctttaataggtcaataaaaactttccagtatgaaattcagagaaaaaaaaatgaaaataaccaaaccaaatatccaataggtgggggacaaggtcaaaaggtgtaacatgcaaatttagcataccagaaagaaaaaagatggataatggaacacaaggaatatttgaagtaataatggcaaagaatgttccaaatttaacaatagacattaaactaaagatacagaaagctcaaagaacactaagtggaataaatatcaaaaactaaacataggcacatcatgttcaaactgcagaaaaccaaagataaagggaaaatcttgaaagactctaaagagaaaaaagcactttacttatagaagaacaaggatacttaaaacaaaattctcatcagaaaccatgaaaggacagagtacagtgaaatatctaaagtatatttaaagcctttaatatttctttaaatattaaagaaaacaaccatcaacctagaattgtatatccactgaaattatcctttaaaaatgaaagaaaaataatttttcaggtaaacaagaaatgagagaatttatgactagcagacctgccctgcaagagattacagatgaaagagctgcaagacacacactcttaaaatgtgaaaagaaagtcttcccacagaaagaaaaggatatatgtcaaaaacttggataggcgtacagaaaggaagaacatcagagaaaaaaatcaacacaattaaaacaaatgttttaaaattattaactgatctaaaagataactgtttcaataaataataacaacaatatattgagtgatcatggcatacaccttttgaccttttcccccacatcttggatattttgtttgattatttttattttttctttgaatttcatattggaaagtttctatgaatgacagtaatgttgtaaggactaggaaggacaaattgggaatacttcgtcatacggtacttgtgctacatatgaagcagtatgatattatttgaaggaggattcatcttagtcacaaatgtattctgaaaactatatggcaaaatataaaaaataagtttaaatatcattcctatgctaagagacaaaattaaattatattaaatgctcagttaggcctgaaacacaaaaaggacaataaattaaattagagcagacacaagtgaaattgaaaacaagaaaacaatagataaaaatcaataaaaccaaaagctgggtattttaaaaggtcaataaaattgagaaattctagcgaggctaacttataaataaagagaaaagacacaaagaaagtgagatcatcactactgatctcatggacattaaaaagataataaaagaatactatgaacaactctctatgccaatgaatctgttaactcaaatgaaatgtaccaattccttgaaagacacacaactataacaaaagtagaaataatctgaataggcctatatctagcaaaggaattgaatcaaaaattaataactttcaaaaagagaaggaatcctgattgaaaaagcagtaatacatccttatttgcagaaacatggtcttgtatacagaaaatcttaaggaaccaactaaaaagcaaagttgcaggatataacatcactacacacaaatcaactgtatacatgccaccaatgaaaagtccaaaactaaatttaaggaagcaattctatttacaatagcattaaaaaatatatttaggaataaatctaccacaaaatgcatgggctgtaaaccaaaagctgccaaatctcttggaaagaaattttaaaatacctaagtaaattgaaaggtattcatgttcatgcagtagaagacattcttgttaagatggcaatacctttcaaatgatatacacattagatgcaatttgtatcaagttttcagcatcttttttgcacagataaagagctgatcctaagattcatatctaagtgcaaggacaccatatagccaaatcaattttggcaaggaaccaatctggaggactcatgtttcccaatttgagaatttactactacaaagctagaatacttaagactttgtggtattagcataatactagtcatatagatcaacagaatacaatagacagcccagaaataaatccttccaatgaggaccaattggttcttcactacggttccaagatattataatggaaaaagattagtcttttaaaccaacggtgctgggacaactggatagccacaagcaaaagaatatatttgaaccacttaaactaggaaatagtttttctcaggtgtcacaccaaaagcacaagcaacaaatggaaaaacagacaaggtgaacttcaccaaaatttaaaattttcatgctccaaaagatatcatcaaggacatataaagatcacatatgaaatgtccacagaataaaataaaatattttcaaatcatatgtctgatgaataagttgtctctagaataaagaattcttacaattcaacattaaaaacacaaataacccaattattaaatgggaaaaggatttgaatagaagtttctacaaataatatatataaatgaacaattagcacattaaaagattctcaaaatcattagttattagagaaatacaaattaaaccaaaataaatacctctttacaaccactaggataactataaaaaaaagaaagataattagaagtcttggccaacacatagagaaattagagcctacatgcattgcttgaaggaacaaattatgatttatccacattggaagcaatttggcatttccacaaaaagttaagcatacagttaccacataacccagcaaacccactcctaggtataacccaaaagaattcagaatacatgtccacacaaaaacccaaacatgaatgttcatagcagcattattcctaatagccaaaaagcagaaagaactcaaatgcctatcaactgacaaataagcacaatgtgctatatccatacagtgaaatattatccattcataaaaatgaagtaacatgtgctacaacatagatgaaccttgaaagcattatgctaagtgaaaaaaaaaacagtcacaaaagatcacattatgagatgtccagactaggcaaattcatagaaagggatagaagataagttgttgccaagggctgggaagagagagtaatggggattgactgctaatggacatgaggtttcttttggcagttgtaaaatctataggtaacgataatgcattgtgtatttaaaatatgtcaacaaagtacatttttaccaccaaaaaaacaataactatgtaagaaagcagctatgttaattagcttgattatggcaatcatttcataatgtatgcatatatcaaaatatcaccttgtacaccataaatatatctaatttctatttggcaattatgcctcaataaagctggtggaaaagtaaaaattttttcaaagatctttaacaagttgggtattggtgattgccacataattttgtaagtatattaaaaaccattgaattgtacacttcaaaaaggtgactattatggtatgcaaactataccttttaaaaaatccactcttcctgcatcaacactttacaaggtcttccacattatggaaactgttattgactccaaccctatctcctctactccctaccaccatcatccccctttataacccagggaaatgggatattttctaattttcctagattgaaacaaaaggaaactagaatcaccttaaatgattgaagaaatttaatccatagtttaaaaaacattataaaatattcttacccaggttttataggtgagttctaccaaaacataaggaacaaataaatctaatcctacataaactcttccctagaaagaccaaacatttttcagctcattcaaagagtctagtataaccttgatactcaaactagacaatgacagcaaaagtaaaattacagttcaatctcattaattagcaccttgttttgtggtccaactacagatgcaggacggattaccatccaaaatttttttttggctgtcaacattgatgatgccacacatcctcaagttatgaaagggtttacattcacataatgaggctttgcggggaggccaggactggctttccaagctggtccaaaaatggctgaagagagaaagggaaggagactgatttggggtttttattatggtaggaggtggtgcagaagtaactgttcttttgcacaagctggagcttgcgtagtttgaatttcccatctgctccaaagaaaggaacacccaggctttattagcacttgaccaaacaaatatggaacagaaggggcagggagaggaataaaactcaatgctatcacaagtcaaacatccaaaaatgaagtcagattcttttttacaactcagtcctgattgactgatgtctgagacatgccatcatcagttaaaccaaattttggtacatatccaagctatttctgcagagtggctttaaaacaaatgtatgaaaaaaactaagctaaattttaactaattataaaaagataatttatcatgaccaagtttggcttattccaggaattcaaaaatttattaatgtattgcctttaccaattagagaagaaaaccaaataattatttaaatagctactaaaaacatttgataaaacacaacatcaactcaaggtattttttattgatttagaaatagaagaaaaaaattaatgtgctaaatatatatgcaaagcaatccttaaaaatacagacttagaaaaatatttcaagtatcctgtttaaaatcaagaacaaaacaaaggtacacactatctccactgctagtaaacattgtactggaatttttatctctcacaggggaagaaaagaaacaaaagatacaagaattggaaaagaaaaactgattatatttatcgataatattcatgtgcactttaaaaacccaaaacaatctacagatatgagaactcattagtaagctctgtcaggtgaataaatataagatcaatagtcagttttacatctagtcaacagtaacaaactaagagaatatgaataatgaatataaatacttagctcaaaaagtataattaatataagaataaatataacaaatatacaagatccttcaggagaaaattataaagctgattaaaaggcattagagaagacccaaatgattgaagagacatattatgtcaataaataagaaaacattgcagagttcttgattctctccagctgcaactcaagatctaagttaattcttgtcgaatttcaataggatttgtagttgaatttgacaagcttattctaaatttttatttagaagtgcaaagatttaggacagtcaagaaaccactgaagaaggaaaaagagaggacaatttacctaccatatgtcaaggtttatgacaaatctgtactaattaagacaaagtggtactagaatggaaatgtacataataggtcaagggataaaaaacacacaataaccccaaacaaattcgcacatgtatggatgcaatgtataatgaaggtggcatcgccttttagtgagacagtgaatagggctggaacaactgattattcataggagacaaaaattaatccttaccttactgtaaaaagtcaatttgagacagattaaaaatgaaaaataaaactttaaagtgatataacaaaatgagagtgatccttataatcatgtaaggtggagtgtttattaaacaatggctaaccataaaaacgtttacatctccacaccatcagtcactggaggtggaccaccctgaaaatggggcatgaacttggatgaagcagctgacttcagctgagtccatctctcaaagaagctggtagctgaaggtagtctttgggcagcactcctagaaactgggagagaaatccatttctgaaaaggggaaggaagggtgaatcactcagtgtccactgtagagcgagagggcacagctgttagatataaggaaattgattactgatattcactgtggtttgaagattggagttgtcttcagatttcaagctcttcagtttggccactcaccatttgatatttctggagcaaaatctggggccagacctgtaatatgtatcaacgacttatacctgctttctcctctcttagccctgccctagaactggcatattgccatctggctccatgtggggttggtggtagccaaaattaagaatttgacatgtggaaatttttaaatctgaattttggtaggtgctagcagcagtttcagtaatcactgtcacttctgatcacgcccaccaagccctctctaccaccacccatcactacccttaggattaacccagcactgccctctggagtcatggtttatcttacctcttcctttcttctcctactctctgcgggttggagagtaagatgagacaatttattaagcacagtggtggttaaacaaagatttgttttttctagggatgaatttaattatctaagaggctttggaaacaagatctattcttatctaaggaagtagcatcctaaatagcaatttaatcctaagaaggtatattaaattacaaacaagaagattagatcttggatgcatttagctttttaatagtcctaatatatgaatttggtaaacaggaatcaggcttagggggcggcggcagggggctataagtgactctctcaagagatttcacaataagcctgtgacaaatccaaaaataagagactagatgtttttcacttcaaagccaaagagccaaacatgtcactgctaatttcaaaatcctgagtctccatagaatacagtctcaattagtttattgtttccgtttgcgtaaaggattcatgccttgactaaaaccaattcattgttgcctagaaaaatggaaaggattagaaagggcaaagaaaaaagatgaaaagttgtcattctactttaaccacaaactatttttgtgattagaacacaaattaatagtttatccttcagccccaagcaactagaaaagtagataagttcttcaatgaataaaattaatcagtgacttttttcactgttggacagacttgctttcagacagaaacagtgaggagaaatgtgctgcatcccaacaacgactcagggtgccacctcgttcttcacaaagaggattagcttagtgaaacaaagaagtggaagatatttgttccgcttactctataatgcaccatctcaattgttctcttctagagaaaaaatgatgggtgcttagagctctgaatcaaccatcctatggggctctgttctgttacccattgttagcactaatcccatttgaatatgttggcattgttttaaagacagtacaaagaaattaaacagcgctaatttacttgctaccagattttaaaggtttgaatggcacttgctttctgatctggctatatataaaaaccggacactttttttaaagaaaagtatttttcatatcaatttcagttccttaaattgacattagtaaacacaaaatttgctcatgatctttacatttctccactgtcattgctttttcatctcctttcctcaactattgacctgttcctatatccttctaagactaaaaccagacctcacagattattcccctgtgcccacacaaggattcgacagtcctgagaattccatagtcctaagaatccatattacctgaagcagacatcctttttcctgatgggttacatgagcatctaagtcaaagtttctatatcttccatgttgcctagtaatattgtatgtattcagcaggtactcaatgttgtgtgtttgagaattttttctctgtttaattacaaattaataaatttaaaatgaacattaagattaatttacaacttttcctcctataggactctgtaatttaatataccttctaaggattaaagtgccatttgtacataactatgttggatgctacctcctcagataagaatatatctctccccaaaattaaattcatcctagaaaaaataaatctttgtttaaccaccactgtgctcaagaaattgtctcatcttactctccaacctgcagcaagggggagaagaaaggaagaggtaagataaaccgtgactccacagggcagtgctgggttaatcctaagggtagtgatgggtggtggtagagagggcttggtgggtgtgatcagaaatgacactgattggagtttgctggaggtcgactccagaccctgtttgcctgggtatcaccagcagagactgcagaacagcaaatattgcagaacagcaaatattgctgcctgatccttcctctggaagctttgtctcagaggagcacccagctgtatgaggtgtcagtcagcccctactgggaggtgtctccaagttaggctacacaggggtgagggatccacttgaggaggcagtctgtccgttctcagagttcactgtgctgggagaaccactgctgtcttcagagctgtcagacatggacgtttaactctgcagaagtttctgctgtctttttttcagctatgccctactcccagaggtggagtctacagaggcaggcaggcctcattgagctgcagtggtctccacccagttcaagcttccctgccactttgtttacgtactcaagcctcagcaatggcggacgccccttctccagccaggcttgcctcctcgcggttcagtcttggaatagcagtgagcaaggctccgtgggcatgggacctgctaagccagacacgggatataatctcctggtgtgctgtttgctaagaccattggaaaagcacagtgttgaggtggcagtgtcccgattttcctggtacagtctgtcacggcttcccttggctaggaaagggaaatccccccaccccttgtgcttccccggtaaggcaatgccccaccctgctttggctcaccctccatgggctgcaccaactgtccaaccagtcctaatgagatgaaccaggtacctcagttggaaatgcagaaatcacccgtcttctgcatcaatcatgctgggagctgcagaccagagctgttcctattcggccatcttgtaacggacctatatttcttaattgtttaaggcagtctgagttttctgatacctaatgccatcaacagattcttggaaactgtggctatagcatgggacgctgatttgggggggttgcccttgacacagtgcccctctgacacctggccagaacctcccagggcgaaggtcaggggctgacaggcatggggttaatggggcagtgaaggacggatccctaagtgcagggtgcacacagggagcagagacatggaggcagcagcatcgcacccccagggctctgcccagcaagccacctgcagcccagaaaggcctgttgtaaggaaaactaacaaacagaaaggaatagcatcaacaacaacaacaaaaatgacatccacaccaaaatctcatctgtagtcaccatcatcaaagaccaaaggtagataaaagcacaaagatggggagaaaccagagcagaaaagctgaaaattctaaaaaccggagcgccccttctcctccaaaggatcacagctccttgccagcaatggagcaaagctggacggagaatgactttgatgagtggacagaagtaggctgcagaaagttggtaataacaaacttctccaagctaaaggaggatgtttgaacccatcgcaaggaagctaaaaactttgaaactagaataaacagtggtgtagggaagaccttaaatgacctgatggagctgaaaaccatggcacaagaactacgtgacacatgcacaagcttcagtagccaattccatcaagtggaagaaagggtatcagtgattgaagatcaaatgaatgaaatgaagtgagaagagaagtttggagaaaaaagagtaaaaaaaaaatgaacaaagcctccaagaaatatgggactatgtgaaaagaccaaatgtaagtttgattggtgtacctgaaagtgacagggagaatggaaccaagttggaaaacactcttcagcatattatctaggagaacttccccaacctagaatgcaggccaacattcaaattcaggaaatacagagaacaccacaaagatactccttgagaagagcaaccccaagacacataattgtcagattcatcaaggttgaaatgaaggaaaaaatgttaagggcagccagagagaaaggtcaggttacccacaaagggaagcccatcagactaacagcagatctctcggcagaaactctacaagccagaagagagtgggggccaatattcaacattcttaaagaaaagaatgttcaacccagaatttcatatccagccaaactaagcttcataactgaaggagaaataaaatcctttacagacaagcaaatgctgagagattttgtcaccaccaggcctgccctacaagagctcctgaaggaagcactaaacatggaaaggaacaaccagtaccagccactgcaaaaacatgccaaattgtaaagaccattgatgctaggaagaaactgcatcaactaatgggcaaaataaccagctaccatcataatgacaggatcaaattcatacataacaatattaaccttaaatgtaaatgggctaaatgccccaattaaaagacacagactggcaaattggataaacagtcaagacccatcaatgtgctgtcttcaggagacccatctcatgtgcagacacacacataggctcaaaacaaagggatggaggaagatctacaaagccaatggaaagcaaaacaaagcaggggttgcaatcctagtctgtgataaaacagactttaaaccaacaaaggtcaaaagagacaaagaaggccattacataatggtaaagggatcaattcaacaagaagagttaactatcctaaatatacatgcacccaatacaggagcacccagattcataaagcaagtccttagagacctaaaagaaacttagactcccacacaataataatggaaaactttaacaccccactgtcaatattagatagatcaaccagacagaaggttaacaaggatatccaggactcgaactcagctctgcagcaaacagacctaatagacatctacagaactctcgaccccagatcaacagaatatacattcttctcagcaccacatcacacttattccaaaattgaccatagttggaagtaaagcagtctttagcaaatgtaaaataacagaaatcacaacaaactgtctctcagaccacagtgcaatcaaattagaactcaggattaagaaactcactcaaaactgtacaactacatggaaactgaacaacctgctccagaatgactattgggtaaataatgaaatgaagggagaaataaagatgttctttgaaaccagtgagaacaaagacacaatgtagtggaatctctgggacacatttaaagcagcatgtagagggaaatttatagcactaaatgaccacaggagaaagcaagaaagatctaaaattgacaccctaacatcacaattaaaagaactagagaagcaagaccaaacacattcaaaagctagcagaaggcaagaaataactaagattagagcagaactgaaggagatagagacacaaaaagcccttcaaacaatcaatgaatccaggagctggttttttgaagaaatcaacaaaattgataggtgcctagcaagactaacaaaaaagaaaagagagaagaatcaaatagatgcaataaaaaataataaaggggatactgccactgatcccacagaaatacaaactaccatcaaagaatactataaacaactctatgcaaataaactatagaatctagaaaaatggaaaaattgctggacacatacaccctcccaagactaaaccaggaagaggttgaatctctgaatagaccaataccaggctctgaaattgaggcaataattaataccctaccgaccaaaaaaagcccagggccagacagattcacagccgaattctaccagaggtacaaagaagagctggcaccattccttctgaaactattccaaacaacagaaaaagagggactcctccctaactcattttatgaggccagcatcatcctgtaccaaagcccggcagagacacaacaaaaaaagagaattttagaccaatatccctgattaacatcgatgcaaaaatcctcaataaaatactggcaaaccgaatccagcagcacatcaaaaagcttatcgaccgcaatcaagttaccttcatccctgggatgcaaggctggttcaacatacgcaaatcaaaaaacgtaacccatcacataaacagaaccaaagacaaaaccacatgattatctcaatagatgcagaaaaggcctttgacaaaattcaacagcgcttcatactaacaactctcaataaactaggtattaatgggatgtatctcaaaataataagagctatttatgacaaacccacggccaatatcttactgaatgggcaaaaacgaagtgttccctttgaaaactggcacaagacagagatgccctctctcaccactcctattcaacatagtgttggaagttctggccagggcaatcaggcaagagaaagaaataaagggtattcaattaggaaaagaggaagtcaaattgtccctgtttgcagatgacatgattgtatatttagaaaaccccatcgtctcagcccaaaatctccttaaactgataagcaacttcagcaaagtctcagaatacaaaatcaatgtgcaaaaatcacaagtattcttatacaccaagaacagacagagagccaaatcatgagtgaactcccattcacaattgctacaaagggaataaaatacctaggaatccaccttacaagggatgtgaaggacctcttcaaggagaaccacaaaccactgctcaacataataaaagaggacacaaacaaatggaagaacattccatgctcatggataggaagattcaatatcttgaaaatgaccatactgcccaaggtaatataagattcaatgccatacccatcaagctaccaatgactttcttcacagaattggaaaaaactactttaaagttcatgtggaaccaaaaaagagcccacattgccaagacaatcctaagccaaaagaacaaagctggaggcatcacgctacctgacttcaaactatactacaaggctacagtaaccaaaacagcatggtactgacaccaaaacagaaatatagaccaatggaacagaacagaggcctcagtaataataccacacatctacaaccatctgatctttgacaaacctgagaaaaacaagaaatggggaaaggattccctatttaataaatggtgctgggaaaactggctagccatatgtagaaagctgaaactggatcccttccttacaccttatacaaaaattaattcaagatggattaaagacttaaatgctagacctaaaaccataaaaaccctagaagaaaacctaggcaataccattcaggacatcggcatgggcaaacacttcatgactaaaacaccaaaagcaatggcaacaaaagccaaaattgacaaatgggatctaattaaactaaagagcttccgcacagcaaaagaaactaccatcagagtgaactggcaatctacagaatgggagaaaatttttgcaatctacccatctgacaaaggactaatatccagaatctacaaagaactgaaacaaatttgcaagaaaaaatcaaacaaccccatcaaaaagtgggcgaaggatacgaacagacacttttcaaaagaaaacatttatgcagccaacagacacatgaaaaaatgctcatcatcactggtcatcagagaaatgcaaatcaaaaccacaatgagacagcatctcacacaagttagaatggcgatcattaaaaagtcaggaaacaacaggtgctggagaggatgtggagagataggaaagcttttacactgttggtgggactgtaaactagttcaaccattgtggaagacagtgtgacgattcctcaagcatctagaactagaaataccatttgacctagccatcccattactgtgtatatacccaaatgattataaatcatgctactataaagacacatgcacacgtatgtatattgtggcactattcacaatagcaaagacttggaaccaatccatatgtccatcaatgatagactggattaagaatatgtggcacatatacaccatggaatattatgcagccataaaaagggtgagttcatgtcctttgtagggacatgaatgaagctggaaatcatcattctgagcaaactatcacgaggacagaaaaccaaacactgcatgttctcactcataggtgggaattgaacaatgcgaccagttggacacagggcgaggaacatcacacactggggcctgtcgtggggtcggggtagcggggagggatagctttaggagaaatacctaatgtaaatgatgagttaacgggtgcagcaagccaacacggcacatgtatacatatgtgacaaacctgcatgttctgcacatgtaccctagaacttgaagtataataaaataagtaaataaataaataagaagtaaaaaaagaaatgccactgattactgaaactgctgctagcgcctgcgaaaattcagatttaaaaatttccacttgtcaaattctcaattttgattcctactaacctcaaaatggagccagatggcaatatgcctgttctaagcaaggctaggagaggagaaagcaaatataagcagttgacacatattacaggtctggccccagattttgctccagaaatatcaaatggtgagtggccaccatattgaagagcttgaaatctgaagacaactccaattcttcaaaccacagcaaatatcagtaatgaatttccttatatctaacagctgtgcccgctcactctacagtggacactgagtgatacacccttctttcccctcttcagaaatggtctttctctcccagtttctaggagagctgcccaaagactacctttagctaccagcctctttgagagatggactcaggtgaagagagctgcctcatacaatttcatgccccattttcaggattgttcacctccagagactgatgagtgtggagatgtaacttcaaagagctgtgttaatgtaggttcttcaggtgtttgggaaacaggtgtctcacagagcacgctttgcaagaatagttagcgaaaaacatagtttcaggatgtctccaaagcacagtaacttctttttttcttctgaaacactaaaaactacaactactgtcgtaccaagtaggccagaaatcaagacaacattctagctgccttttctgtgaggaagagacagcaaaatttcattaaaagcaaggcaccagtatgtttctcaggaactcattctgttacgtatttattgttttgctaactatatagctagaggggaagatggaaaatcttacaagaatacagtagtcccctcttatctgtggctttgctctgtgaggtctgaacatataaaatgtgaagtttcagcaataaacaattcgcaagttttaagttgcatgtcattctgagtagtgtgatgaaatctcactccccactacttcctcctgccagggatatgaatcatccctttgtccagagtatccacgatgtctacacgacctgcccattcatcagttcattcatcactgagacagctactaagtgactgttgcagaataacagtgcttgtgttccagtaacccttattttacttaataatggccccaaagcacaagagtagtgatgctggcatattgttttaattgttttatttcattattgttgtagttaatctcttactgtgcctaatttataaattaaactttatcataagtatatatgtataggaaaaagacatcatatatatagggttcagtactgtccacggtttcaggcatccactgggggtcttgtaatgtatcccccatggatgaggggagactgccatagtcaattttgttccatttatttttgttttataagtaatacccatttaacatacataactgttctaaatttgaaaaatttagaggagacattatctgctttcacagaacttgaaatctaaacatttgatttttaggcaacattagttactagtacaaatgtgggagagctttagtgaagatagtaagaaaaataaatagtgagtgatgcagaattcattatattttattcagactgcattacatccatgttttatagcagatttattttcctaaacctgttaagtttcagcaagtattaaacctgatttacattctacagggacatctccttggatgattatgaaaatagtgcctggaagataccaaggagactgtgagtaaacagtgctgctcctgtccatgaagaaccctgcagcagctggtactcagtaggcactcagcgactatgctgaaatgaatgaacacaagagaaaccacaaaggggttcacaatagcctcctcttggattatctaggacaatggtttttaaactctaacttcctgagaaccacctggaggcttgttagaacacaggttcctgggcccctttcccagagtttctaattgagcaggtctggggtaaagcccatgaatttgcattcctaacaaggtcccaggagatgctgctactgctggcttcgtgagcacactttgtgaaccagtactctaaagatagatttatatcacaagcttgacttcccatgtccccagatataaaatatgcccctcattcttcattttcacaccaaaaatgagaaaaagctgagaaactggcaagcctactgtattgctcatggagccaccctcagtgttggactggagtaagctgggcaagctggttccagccctcagttccctgggaacacagctatagctgaagatcctactagctgtgtccttgacaattccacttgggttctcatagttacccatttcaacaaatgacatctcttcagatgtacaagccagccatgatgtcatctttgatacctcctccttccttataactcatacagcttcatctggtccttgaaaaggttaaaggagcctgagtaattgagtagagaagagcatgccatcaaggttaatggaatgtaatttgagtgggaacaagccttactttgtcaggaccctgaggttttgtgtttgttctttaacacaactagcataaattctccaatttgtataatctgggacctaggagaagttatgacctcattgctttactctccatagcccactcttcaaacgaggattttgagttatcccagattccagcttccttctacagcttatagatatatacctaaacatatggatatacagataagtctatcagtcaatagatgtatcaatatatagagtctctttttatacagggcagagtctccttctacagcttagtgagatacagatacacagagcagagtctcctctaggtcatattttctctatccacatagttaatatatctgaagctcctacaataggaatccttggaaattcagcagacacagaccccaatttctatttgaaaaataaaattaagaacattaattaaaaattaaaatctatacacacaggagtattcaaatttccaagatataggaaaacatttttttcatatgaaataaatgagcagctacacggcttttggtctccgaactgagaagacaacaccagaaacactttttagttctacgatgttaatttaggcctaaaattaaaattagatgagggcctgaaattcgtaccaatgaagatgagaaaatattttttagttatcaaatgattttataaatagctatacaaaagttaatgggaggtgtgcagattcttggcagctaggcacctactaaaacaaaagaattcaagagttttgtttctttctaaacactgtttatgaaaattaggaaaatgatatttcacatacttgtttggttaccatgacataatttaaatatatagacacagatgcaattccaaattacccacaatattagtgatagtaaggaagagttaaggatttattaactggtatttttataaaggaatagataattatataaaacactggctttcaaatttgcttgatcacaacccatagaaataacactttttaaatgacctagtccatacatgcatatgaatatatacaaactatatgtatacctgaaacaaaaaatttacaaaacagtacttagccttatatgtgccatataccctattttaatctctatcactttttcatgctagtcaaaactcattaaatggattatgcaatccaatattaaattgtgacatgcaatttgaaaaacaaataatacaaaatattgtctttgaaaaatgatattttttcttagatgtcctctagttgttaaactataatgataaaatggaagataccactagatttacaaaaagttaaaaatcaatacactctttgaatagatcaacaagccaggagaacgaggatgggtaaaagtgaaatctcaagatcaataaggcttaagtggattataatcatctataatccatggtgttgatcatagtcttcgtgagacacatctaaattatctgcctttgactagttgatagtaacaggaaatagaaatgtagttctttgtcccacttccttaaaaaaagaaaaagagcaaaagattccctttattattatgtagatatttccagatctatctagttatttccaattataaaagtaatatatattatttgaaaacatttttgaaaatacagagggatgaaagtctgaaggagtgctaggagagaagagatgggctggaagagggaaaaagagtgccatccacagaaaaatttttccagcttctgggaactgagtagcaaaaatgcttctctttttccctggtagcattcattcatacatgaagtattctggtttactatgtgccaaacactggtctatgtgctggcaatacaccaatgaacaaaacagatagatatccgcaccctcacagagtttaaaaatgaaggtagttggtaggctcttagaagcaatgtggggatgagctcacagccctcacagagattcctatcactgagcttagcaggaatcctgggttcaaaaagataagtgggcttggacaagacaggtatttaaaccaagaagcatttccctgagcacctcgtaatcttctggtatgcctgggtccaatacacaaaattaaaataaaattattggcaatgaatttcccagctatgtccaggcaacatagcttcttgtagttagatttaattactcaagaaaagtgggtaacgtgatagcttagcttagcttttgcacagctaagtttgtggagtaaaaatcatgtcaactataaagaggaagacaaaacagacagatttaaatttttatttgaattcatttctcaataccagaaactttattttaccttctccatttatgcctgttttggagttacccattatcaactgtgtgtgtgtatatgtgcatgtgtttgaagaaaggctcatgggagatatatcacctgagtgcatgtatgtttggaaatgtctgcctgtttcctttctccacatcctctccagcacctgttgtttcctgactttttaatgatcgccattctaactggtgtgagatggtatctcattgcggttttgatttgcatttctctgatggccagtgatgatgagcattttatcatgtatctgttggctgcataaatatctccttttgagaagtgtctgttcatatcctttgcccactctttgatggggttgtttgattttattctcgtagatttatttaagttctttgtagattctggatattagccctttgtcagatgggtagattgtgaaaatcttctcccattctgtaggttgcctgttcactcctatggtagtttcttttgctgtgcagaagctctttagtttaattagatcccatttgtctattttggcttttgttgccattgcttttggtgttttagtcatgaagtccttgcccatgcctatgtcctgaatggtactgcctaggttttcttctagtgtttttatggttttacatctaacacttaagtctttaagatgtgaaggacctcttcaaggagaactacaaaccactgctcaacaaaataaaagagaacacaaacaaatggaaaaacatttcatgctcatggataggaagaatcaatatcatgaaaatagccatactgcccaaggtaagttatagattcaatgccatccccatcaagctaccaatgactttcttcacagaattggaaaaactactttaaagttcatatggaaccaaaaaagagcccacattgccaagacaatcctaagcaaaagaacaaagctggaggcatcccgctacctgacttcaaactatactacaaggctacagtaaccaaaacagcatggtactggtaccaaaacagagatctagaccaatggaacagaacagagccctccgaaataacaccacacacccacaaccatctgatctttgacaaacctgagaaaaacaagaaatgggaaaatgattccctatttcataaatggtgctgggaaaactggctagccatatgtagaaaactgaaactggatcccttccttacaccttatattgtgtctcattctaaactcaaactttagggaagcaaaatacttttaaatgataacttggaagaaaagtctgagtccttgaaggaaagaacaaaaataaaagggagtatctggactcaactagagaacactcattaggggttctctatattcagtagtatacatatctttgtatatgtctctgtatattctggcttgggttttttaccatcctgtgataaaatggaattatgatgctttatatgacaggttctaaaatttatctttgtaaaataattaacagaaaaatcactttctagtatttattgaaagaaaacttatgtacttgttcgaagcttatttttcttgcagaggtgtgggctatataggtcatggagtattctgggctttataacctactaaatttataatagacccactgggagggcattaatgaatatctggtgattgaatgagcctcaattgtgtacagttttcaagagctgtccattttgttggctgttcatatacctggaggcccgcaaatctaggtctgaacatcccagagttgtgtctagagacctcttcgactacgaggctcctaggttggaaaccttcccgagtttgacaatcaccttcatctggagttgtcagcaccctcctaagggacctgctcatttggaaaatagcttagcatctgtgacaacctgaagagcatagacttttttatccattttattaagatatgtttaacattcttaaagtacatatttaatgtatacaacttggtaagtttggagataagtatatacctgtggaaccatcaccacgatctatgtcaaaaacctatccatccaaaagtttcctcccactttctttctttattgttattgttgttattatttgtgacaacatggataaacttggaggacattattctaagtgaaataaaccagatatataagaagcgtatcaatttaaaaaaaaacttttaagagctatacagatgtgtgtgttttattgtgaagtggtgtttaatttgtcttaattattttaaattaggattaatctttttagtaataatgtagtaactctgcactgactcctcaaagtcattttgtgataagtgactgtgatctaagtaatggagaaaaatttctagactgaaatatctagatcttcatgttattacagcaaataaataacttttgtggtattcattttaaaagcaagagagactaccacttgcctttgttatttgttttccttgacacctacagtctttttatgaaatatttggtagattgatgtagtgatttatttccagatttggcttttcccataaattacatttatggctgatctactaggcttgggacaacgctttctaaaaatccgtaaaggatatacaacttttccccagtgaacaattctttatgttttttaatcattgcctgaaaaagtacacatattgttagtagtgagtattacatagtgacctcgaatttggctttaaaaacatgctggcaaaggtcctaagggataaaagagactataataaacaggtagcaggcatttcagcagttattgtattgaactgcttctagaggaagagaccattaaattcatttccattgccattgctgtaaacatggaggactgcataacctgaagtcaataccagctccattgttacccagtggattcatcatcatttcctatgaccatattttgtgatgtgcctaagcagaaaaactgaaaagttgttcatgtgcttcctggatggaaacattgggttttgtttggtacatctataaacagttgctatctttctattgaatacattagtggtactcaataaacataaatgtaccatttatgagatggcaaatatcctagccccaagtaagcatgagtcaggtttgggtttgagtataggacactgattcaaggacactgagtgagtttaaaataaaaactgataatatcttgttagcacaacatgagactctttaggagccatgacccacagcactgcaaaatcctgtgtgaagatttctgaaagttagaaagagacccttgaaacataaaactctggacctggggaagaatcaagaaaatccctggttcacccatggaacatggatgtagggattcctaaggctctactctcccacatctcaacgtctcagtcaggaaaacaaaattcactcagataggaaggggttcaataagactgcttatgaaacttttggacgaggtggtagagcaaagagcatagatagttatctgcactataggaatttcaggcagaaagcttagaagagcaggggtagtactatttgccagtagcccaaatccagaacattatttgcacctactttttcaactgatttgacaaaaattatcacttaaaagccttctgttgtacagcccatcattgttttctgagaaattctttctgataatttgctggaggtaatctccttctcgttaccaaatacccatcacacataactgtcctattgtattgcacttatttatgttatgttatttcctctattaagatccttgaggacagcatctatagccccacatacctgtttgaaaacattacttgtaataatagtaatatcaactattaaatcaccaccagtcaccaagcactagcttctttcgtttactcactctttaaatacctatgacaagcctatgaaaagtcattgcctgttataattagaaagaagacccaagagagacaccagttagtgacacagttgagctaacaatttttttttttttttttttttttttgagacagagtctcgctctgtcgccaggctggattgcagtggtgcaatctcggctcactgcaagctccgcctcccgggttcacgccattctcctgcctcagcctcccgagtagctgggactacaggtgcccaccaccacgcctggctaattttttgtatttttagtagagacggggtttcaccatgttagccaggatggtctggatctcctgacctcgtgatccgcccgcctcagcctcccaaagtgctgggattacaggcgtgagccaccgtgcccaacctaagctaacaatttaactccagtttgtccaacacaaaacccatgcttttctgattttgcctcattactgtgatgtcagaaaattatggagttaaatgatgaccaaaatgttttcataaatatctctagtaatggagaaatatctctcaagcagcctatttggttatgggaaactatttcttaaaaggtagttgcttacagcaaatcttatagggaatggcacccttcttcatttgggtgtgctccagcgcccacagagtatagaaactctatcaagaaggaagagaactgtcttttctttagcaaacctttctaaacagcataatctgtccactgcactactccaagggacatcactgacatggatcatcatgtgatgattctgccttaagccagcaattagaacttactaggcatttgataagtattgactgctactgctgcgatgctctaatacaaaaggaaagaagttaaaaaattatttaataatctgtgagcctactttgggaagtaataataagtttaactacttccaggctggtgtgaggactaaatgagttattatatggaaccacctgtaacaatgcctggcacaaaataagcactgaagatgtatgagtttttgcattgatattaattctcatcagacacagacatatttgtggaagatacaatgggaacaaagacatggcctctgccttcaaaagactttttattttattgttctcctgaattttgttgcctctgtaaggaatgggatttccctcatttacactttctgaagtccattgatactacaactgtgaagaattctagtctttcattgagaggtgagaatatagggtagcctacttcattccatgatgtttcaaagaataaggagaaaagatcatattttctttctgggctgctatgattataaggtataaagccagacacttgacactagttttatggttattttttctaaagttgtaccttccaatataacaaccagacccaaatggctatttcaatgtaaactttcattaattcaaatgtaaaaatcagctcctcagtcatactggccacatttcaagtgctcaatagtcacatgtagctggagattacccttttgaacagtgcagatagagaacatttctatcattacatagagttctattgcacagcactaccctaaagtgataacaagtctagcaaaagtctgaagctcctatgggatgcagttgcaaagctagatctctatcctagctcaatattccaaatgactgaatataagcaataagccctctggattcaggcaattccaggaataacatcagaaagacaattgcccattaagtgtctctcatgaactgatcatttttactgcctctgccaaaatagatcacctcaccctgttgtccttattgagtctaccacagtcacccagagatataaagtgataggaatgctagacacaaactcagttaactcccaaactgtattagcaatggaagctggggcacagacacattgaaaaagtactgatatcaatctggactatgggaaaaaggacatcaactctgagttccaagaatttgcatgaccttaagaaaattatgtactctcatagagcttcagtatttatagttataacatggaagtatgatcagttgttgaaagaatagaaataagctaatgtgtgtaaagcatataccataaaattgtaaaaacctagaggtggaaagaagcagagatggtcatctgaaactgtgagaaaatcatttatttaacctgtgccttaactcttctgctttccaagaaatagtgtcccataatcagatgggctgcttgagagatgtttccccagaccagaaatatttatgaaaacacttcgatcaccattgaatttcataattctctgacactacaataatgaggcaacatcagaaaagcatgggtttggggtttaacaaacgaattaaattattagctcaattgaattgttgagctaaattgttatcatctacttttcttagctttattgaaatgataaagtgaggttatatacatgaaagtactttcgaaattttcaaataacatcaaaatatttttactagttttatctcttcaatgatgctggttattttcgacatctatctcatatgaattattggtataaatgtaaacaatatgtataatagatttatggaaaaatgaaaaataattaccccaatgatggttatgctatctattatgctttattttatatgggaaaacttcagattaatacaagaacttaagctacctcttaacaacaatgagcagaagtcagaacaaaccagtttacatctggggcccagatgtacaaaagtctccctgccccacctttcaaggggttagaagcctttccagaaacaaagaaagtcattagtccttggtcagcagtattttgcatttgttaagatagcaaattcagtttgacattttctatttattttttctagcagagttagagagctcaaggataatttggaaaattggtctaaagtgacatctgacccatctgctgctacaaatgttggactgtcagggaaaccagagaactgccacaagtcaaggagacatcatttgaaagttttgtttctcctactttaaataaaataaaatataaataattcctgaatctagaattaaaatgtgattattgcgagtcacacatcagtgttaattctctggcatcctattagtctactggctgatgttactcatactcctgttcttgtcacagaaagaagataaatgaaaaatgaaagccttgctaagtgaaatgaaaaaggtaccagagtctaggccttggcctttattaacagctcagaaacttcattctagtggggaaaaaaattgcaaggacttaaagtagcacaaaaatgatcatccgtatcaaaaggtacatacttattgttgattagaagttagaggtttattctaatctgcacaatccaacccttgttaaaagaagattctgaattatattgaaatgttacatggaaataggttgtcaagaatgccaaaatctttcagggttggtgtttagggaatttttattacatctacgtcctcttgtcacccccggaaactcaccgttcatcactttctactaaattggtcccatatgtgattccctgcctagagtgaactacctgaattcattcattcattcattcatctatcaataaatccaaccaccatttattcatccatacctcctacaatccatccaccatttattcatccatacttcttttactcatttccttctgatgtgtatcactaggtgctagtaataaaaccacatgctaaaatagcccctctcccctatgcctttcttttcccttgtccctgggatttattgcaggcaatttaaatagttcatcttcagagttgaattttagatgggaaagctgaacttcacattttttaaatcttctactgattccctagcacataccatctagtttctgccctgagtttttttttttttctctctctccacaagcccccagtactgttattaatgaaacacgactgtgccctctatgtacaaagaggagactggacttccatatagacctctacatcccctttccttaaatcatgcacagagaagccatgaattgttgctattattctttgcccacaataagatcacaaattcctttgaaagtcaggaccacacattattagcctctttgtgaaagtgataatgccaaacacaggcctgtgaactagtaacctaatagacacatgctgcataaaataaatcacaggcaaaactcagcccaagaccagcaagtccccctaacaaggccaacaggtatttgccataagaacagacacaaggactgagttcctagagcagaatttcatgcaggactatgggtggctcagagaacagaatgatgatcaaaacagaaaaaccataagccagacctctggatatgatgaataaacttttaacacttaatattgtcaggcaattaccccagctcctcaggaatgcttctctcattgtcagaaacccaaactcagattcatggtctttcccccaaagcagtgttcttaaccttggtgacaatattaacatgcattcagctgtaagtcagaatatctgagagttgctcctaatatttatctctccctcctcatcaacccactacacaccccaatctctcaccaacgctagccagttccaccttttggctacctcctcagcatgttcctcatggccctgtctaggctgccaccaccctagttcatgctattaacatcccctacccagattactccaataatctcccatcttgtctatccccctccactcttgctcccgctaacctactctccctacaatatccacagtgatcttcttaaaatgaagatctgacaatagttttgccctacttaatgcctttctatggcttcctattgctctctttggaaaatgtcaatccttaattggtctgagcatctccaaatgagcccactcctcttcacccttgttacaaaatgccagtcttccttctctcactgctgtcctcaaggtccttcaacaggctgtgtttcttcccatgccaggaccttcataattctggtctggagattagacaagatgactgctaacgtttacccttctctgcgtatatgaatgaggtggaatgggaaggccaaaatcaggatttagctaccacctggctctaaggaagagaataacactaccaggagctacagcatcacctgcaccatgatctacattgagcttagaaagtttaaaatgttgtttttgtgtcccacctcctccctccttttatttcctcagttttcattttacttaaaacaaagatttactccacctgtgcctgtcacatattacttctgaaattatctccattcctttcttccttattctgcttcccaaaggtcctttctgaccccattcttaaaagccctgttatccgtttcccaaagtaaactgatgaagtagaaagaatgtggagaatgataaaatcagggttattgagcctcaaatactgagctcaccttccagctcttctacatacaggctcttggctactaaatatatcacttttccctcatactctacattttattgtaaagaaccatttttatttgccttattaagtcctctatgttcccaaggctctcccatgttgtttttcctgccaggatcattgttccattgtcccttttgcctgctctactcatctcattttcttacttttgatgatcactccctaaggagttctcttaacccctaagtctatgttggctgcccttgtgtgctcttggcattctccacgtcccttatcagggcacttaccacacatgacaattaccttctttaaaattcactttccctccttagccttcaactccgagagggcaagagagataaacatcttattcacagttgtattccccaggtcttggtgccatgccagaataagtagtcaatacatgttaactgaacacaaatgccaaagggagactatattcactcacctataaactctacagagttgttgtagagattaattcattttatatttaaatattccaagtgcagggtctggtacaaaatagctatgcagttttgtctagcaaatagcaacggctcaataaatatcattaattcatgtacccacatgtatttacggctaccagcagtcaaatttattattccctttacaataacgtattttaaattgatatattcccttttggaaacacaaagccttaattcactggacagaattgaggtatcgtggcaggcgatcagtttaacatcaagacaggtagcctcttcacccttggagcgcagcacagtggacacacatctgtttctgtctacctgggatcagactttgccagatatatttcctgaagttaccaaagtaggggtagaccttcctggtgtgaatggcagggaccctggaaaagctcctggtacagctgcagcacccattggaatgccaccgggatgaggggaaagggaaataacgaagagtcagtgacagtagaaattcatcatgtgacaggcatgctaattctgccatcactgagtattcttgtcctttgtattttcatttgccccattccttcctgttccatcctggcattaccagcttccctctctttcacagcctggtcctccttgctgactatatttgcccatcaagcaactgtgatcttgaccaaatcagtggcaggcaatgaaggagagaagctgattgggcagtaagctccagctctcctaaagaagctgactgcttcatttgcagtccactgcctctctggcttctcccctcgttacttctcccaccagctgttctctccttccctcaagcctccccccagctgccttttagcttcctcttctactaatcctctatttcctcctccctgttattgctttccttcaatccttttctctctgacacccattttcatttcaaatgctatgtggtagacacattggacaagatggcagagaaaaagataaatctagcagcagcaaaaagtataacactatgccttttcttttccctatctctttccagggttctgaaaataaatcacctgtcttgtttccacttaaagttagcataataacacagtcattgcctaaaagtgaaaacttatcattctaaaaattatatcttagccaattttagaattagaatcatgtcttttcttaaagaaaggctacataacaaatagcatctagccataataatttctcacccttttagaaattaaaggaagagaagccttgatctgcctcaattgttacatccttttatatgtggctcagaaacaagaaaattatagccaggacctgcagaataatttcttgttgattcctgtccctccacccatctatatgagtttcaggaagaccaggtgggctaccattccagggagatcagaggtgtcactgataacagtgtttaaagactggagaccaagcctgagtaaaagaaatgcttatataaagtagcaaggcatgaagcagacagaaagataagctagttcagtcatttccaaagtgtaatccctggaccaagagtctgaccattcatcacctgggaacatgttagaaatgcaaatccccagctcccatccaagacctactgagtcagaaactggttctgtgactcattgagaactcctcatctggagaaatcgaataaggtttcatttgcagatgtaattttaaaatgaagctgagcaattagctggacgtggtggcgagtgcctgtaatcccagctacttggaaggctgaggcaggagaatcacttgaacccgtgaggcggaagttgcagtgaactgagatcgcggccattgcactccagcctgggtgacagagtgaaattccgtctcaaaaaataaaaataaaaactaaaataaaaaattaagctgaacaaataattatgctttaaaatgaccacagaaagagagattaatgcaaacaaggcctttttcgcatacatttgtgttctgagcttttatacctctactttgatcctttattttataaaggtgattgctttactattttttaattcatgatgatatgtttagtcacaatctactctgatgcaacaattttctgataaaaactcttataatttgatttgttatttttcttccttttgccttgtagcatcactgcatacattcggtgctattttttggttgttgttattattcatctttgatgagatgaattcctcctggaccattggatggaggtttttgtcaaacaggggctatggtcagtattctttcttagcaatattttttcttatgatgaagctttagatgtgagtgcttttaatatttatgtttgcagccaacagagatgaacaccacagaggtgaccacaaggtggactctttcccttcctctcattcatactaatagtttgctgcaaatatgacttgtgatttgcatcttctcttaatcctgccttctctgcctcttgcaacttcacgtaaaactgaatccagggaaggtcttgcattatcctttccatctatttcatatttaaccaacaggggattattggttttaagcctcagattgtcccattacttaagagaacagatatatgtcagtgttgtctgaggtctacagccacagccatcctctctagtacattctgacacctttcttctcgtttaattttataccatttggcagcctttgtttatatatcatagtttgtggttaccaagacttttactttcatcaaatatacagtggcatatttatgcttttattctttgatgctttatgatgtttttctgaaaggaaagtgagaaatccagaatactagatcaacaaacaacaggaaaacatgtccagcagatttcatcttctctccatctaggttatctgctttctattcccatatctttaatccagactcttcacttctcacccggactttgcagtgcctcttaactggtctccctgcctacagttatggcttttaccatcctttctctcaataatgccaaagtagtttctttaaaggtctgaattgtcaaattaggctcttgtttaaaatcatctaaagactccctttaccttccaggacaaagttcaaatttctctactgagcaccaaagtccattcatgactaatgaattgcttaacactctacttgcattctttcattttttattaaatacctgctgtgtgtcaaaatgaacacagaaaaagcaatcaaaaacaaaaaatatgtgccctgatggagcttctgatctagtggagaagaaagatattaaataaatagatgcctacatttacataattccaaattataataaaagcattaaatggtgaagacagggtactgtgagctgaaaaacctggttgaggggaaacgtatgccaattacagagggttcagagtttgtcagtcttcagaagtgacatttgagtcaagacctaaaggatgaccaggagtgagttagtaaggtgaagagcccagtaaggtattccagggagagcaagacaaagaggcaccagaggagcagactttgaaaggcaaaagaacttggcatttccaaaatatcatttcccacagggattttctccaatcatatcaacctccttggaattcctaagctagaaatatttcaggattcagtgtcatcatatgtgctcagatctctccttggaatgttcctgggattcctgtttaacttttgtgttagtctgtttgcattggtataaaggaataccttgagactgggtaatttataaagaaaggaggtttattttggcccacagttctgtaggctgtacagaaagtgtggcaccagcatctgcttctgctgagagcctcaggaagcttattatcatggtgcaaggtgaagggggagctgctacacatcacctggtaagagctagggcacgagagaggtgggggcaggagacaggaagtcccagactcttttcattagccagatcttgcatgaacttattactgctaggagggcaccaagccattcatgagggatctgcttccattaggcccacctccaacattggaggtcacatttcaacataagatttggaggcgacaaaacattcaaaccatatcatctttcaaatctcagctcagtcattaccttctgtagtagactgatgatgttgatggccccaattctttactcttattgtggacaccatgctcaacccacactgaatttgactgtaggctcatccaggtgatattctctggaatgtgggcaaatgtgatacaagcaaaggtgtgaaaagcacctacacgttgggacctgttctctcacttattcttgaacttcttcctccactatgagatcatgcccaggaagccagatggaaggatgtgacagaaacaaggcaaagagtcaaagccatccagagcagtcaacatcctgctgtcccccaaacatgagcaatcccacagccaagatcagccaagccacctatctgaccctcatctatggtagacatataactaagttgagctgaaactagcagaaccacccaaccaacccttacattcatgagcaataataaagagtggctgtttaagcactgaattttgagatagtctcttaagaagcatcaattttgacaacagtgaactgatacccctagtctaaaaatattttggatctactaaagcaaaattaattctccagtcttcagtctcatagcactttgaatttctctttcattgcatttttctcattttgccaaaataactgattggcttgttcagctccacaagggtagtgttgttacataattttcttttgtttcatcaagaattacaaatatctccattctggcatgtaataagtgacagagcaggagtattgccatcttggacaagcatggtcattctaaaattcagcttgatcaaaaactgcctaaatccaaatggcattatcctaatggctaaggtcagcatgacaataaaccacaaataacatctctgaccagatccaaaaccctccccaaccagacacatgccagccccgagataacctcctgtctggccagagagatgtcagccccaagataacctcccctctgaccagagacattccaaccctgccataaacttctccccaacacagaaaaattccaagctctctcactaataaatactcttagtctgtaaaagagagcactcctggccaaaattggccagaagcccctcttagatttatttttccaaaataaacctatctttgactgttaagctgcatatcatgtttctttcctctttctttaactcttacaataagcacttactaagtgtatttaaattaaaaataaatacataaattattacaagagaaataaataaaagtcaatcctagaagaatcttcgatggcagagatggtgcctttcttggtcactaccatgaacttagaatcctatgagccaggtacttagtaggtactcgaatatttgtttattattacttttgttttcctttattgtttccagtggggttggatcaaatatttgttaaagcacatgaatagatgaaagggggaattaaagaggtgaaccatatgatgagctttcctcactccactaccagtcttccacaagagtcccattgagtcagcaaaagagctgtaggtgtgtgcttagtgactccatttttatttccccaaatctaacccccttccttgtggaggtcacagagtcatcaccctcagacatggaagtaaggaccacattcctagacccatcatgtaaataagatttttttaaaacaaaggccacttatagtgttctactataagtaactctgagatacctttatgaaaaagggaagagaatagaagaaatacacataaagtgatgagcttgacttattaattgctttcttataatgctaaaggaggtatttcagggaaggataaatcaaagtgagactttaaaaaaaaatctaattcccctaggttcctgacctatattcagtcctataaataaaagcagtatattttatttataattacagattaatgaaaatctctagatgcttatgaatatacaaatccctcattatcttcatttatgagagaaacctaggattacttctaacctcctgaatttcaaatttaccgaagtccctatatttcttaaagaaaacactaattgccttttttacacactgtatttactttcatcatttcacattcaggagcaaatttgctaactccactcactggttttcaagaagaaagctacatgcagtcacttaaaggaggggaaattctttgattggaaacatccaattagttctttttacttgctttacttccaaaggagacactaagattaaacaccatgaataaccagaaaaataactgctctggccatttcctccttctcattataggcactaccataaataaatgagtttagcactgtaaaacatttagatgtattacaaccattaaaagacctatcaacaaacagtaggtactttaagagtctccagggaaggtcataaaaaatagggtttcttttatacttgatttttctccaagcctgttgatatggtttggctgtgttcccacacaactctcatcttgaattgtaataatccccacgtgtcaagggcaggaccagggggagataattgaattatggaggcagtttcccccatgctgttctcctgatagtgagtgagttgtcacaaggtctgatggttttataagggacttcctccttcactgggctctcattctttcacctgcctccatgtgaaaaggtgccttctgccatgattgtgtaagtttcctgaggcctccccggccatgcatagctgtgagtcaattaaatctcttttctttataaattacccagtcttgggtacttcataacagtgtgagaatgaactaatacacctggtctgactagataaacttaatttcatatttatttagctaagtatatttttgtctttattctccaaaactgtttatttaaaagaaaattgacatgcaatatttgattttgtttagcgagaataattcatagtcttgtcttttgaagtgctgtggcttccaactacagtttttaactggtcacatccacagagacttataagaaataacaacagcaataaccaccactattaccacagaaaggccaccacacccagattactcaacctcttagtgctaagcactttgcgtagatgagtttctttaagctttataatccaaaaaatttagttttattgaccacaatttatggagatagatttgatagaattcaatttaacatatgagacaaagataagatctttataactgctaccacttttgtaattgtacagatatttttcaataatcttaaaggtacaataaataaagaaacacagttgaggaaaagtggttataagaagagctgagaaaatttgttgcaaatatgaaggctctgctcatctaactggtttaggactagagtttagaatatctagaatatctcttgcctgtctcctgcccctaaatcaagtaggaacattacccccacattttctacctaatccctaatgattactaaactatatctccaggttgacaaggaaaaagcctttaaggtaaacaataggtctcttacatgatggcaagcccatagttggtgtggataagtaggtgcaactgacttagttgcaaacagcagcagtcagctataggtttattcactggctgtttgacaggtgtgcacccatcaacctaacagctacctataatggtaacttattaaattacacagtcttgattggtgtcctgcccttccctgtctcactaccctcctggtgttcctggaatcacctcctggaatccttatcttggaatctacttatgagagatatagggttattgtgacaattaaatgtgtaacaaattcaaaatttcactctgagtaaactcagattggccaaagtaaaatgaaacaaaatgtcactgctgtatattttatatcttttttttttttttgacggtctcactctgtcatccaggctagagtgcagtgggatcatggctcactgcagcctccatcttctgggctcaagcgattctcccacctcagcctcccaagtagctgggaccacaggcatgcaccaccacacctggctatttttttaaaaaattttaatagagacggggcctcactatgttgcccaggatgaactcgaactcctggactcaagcattactcccacctcagcgttccaaaatgctggtaatacagaagccaccacactaagtctattcaataactattctaatcttctcataacctttaacttgctaggtaatggcagaaggagaatctagaaaccttttttttttttaaatcccaatgaacaatgagtcttccttgctttctcggttgacacacaaaaaaataatccttcgaattcaaacattgtccattctttccatttttaatatttttaccatttaacaagatggcctcagcttatactgggtaggatgtgtttactacgtctctgtagaagatgtagagatgggagcctctaaaactttagtggttcttttgtaaagtggtttaatgatgctgctccctttgtgaatgacactgccatgcactggccccatttgaagctttgggaaaccatgacattacctttgactgaaatccttatcccagccattttttttctgcttacgagtttcctgtttacagcagcctctttaggactagtctttcccctggggtgcactaaatgtatgactctcatgtgtactctccacaggtcacagtaagtcagaagggtttccactgttgcattcaagaagccttttttctatgtcaatgtcattttaatctaactgtggaatgttggacatactgagtgagtatgaagactctcctagaggcttattaaggaaacataccactagacaattccccaaatgttttcatgctcctccataattatctggatatttctaccatctgatatcccatccgggttctactctgaaaggcagaaaaacctggactcctatctcttgcttctgtcctatgtctctcctactttttatctctgtgatcccagccagataggatgagctttcctgtccctctatggcatatcaagagttctctcaaccccagtgtataaaaattctccatgatttagggacacagatgtggctcaagactagataaataaagacatttggaattgagaaatctccacaaatcttgcttttaaagatcattgtctcagtacacagatcaagagaccaccctagaggctcaaagttgaccaatacctctattcctcactcccaggaccctgagcctcatagctcagtcttaaaacataaggctacaatctaatgtgactgaagaggaaaatggaaatttatcagtgtaatatatctaagatattatctatgtcatatatatataaggtgcccagaacactatccagctcatagcaagtggactcttgggtccactgctaaggtttgaaaacatgatggaaggtctaacttttgaattgaaccctgaagggataaaagttgaatacaatgagttgggcaaaagcattccaagctgaagggaaagtctgagcaggaaatagggcatgaattaggaaccaaatcattagaggattttgaatatcagacaagaattttgtactttattctgtaggcaatgaggggcattgaaagtaggtcctttagcgagaacggggcatagtcagagctttaaaagaaagatcaatatgtcagcaattgtgaaataaaatgtcatcattactatatagcaaataaaaatggaaacattagaattccaataggtaagatcccagaatacaatgattcttaagtaagatattcacctttcccaattattgcttttttttttaagttttttttcttttattattatactttaagttttagggtacatgtgcacattgtgcaggttagttacatatgtatacatgtgccatgctggtgcgctgcacctactaactcgtcatctagcattaggtatatctcccagtgctatccctccccccttcccccaccccataacagtccccagagtgtgatgttccccttcctgtgtccatgtgatctcattgttcaattcccacctatgagtgacaatatgcggtgtttggttttttgttcttgtgatagtttactgagaatgatgatttccaatttcatccatgtccctacaaaggacgagaactcatcattttttatggctgcatagtattccatggagtatatgtgccacattttcttaatccagtctatcattgttggacatctgggttggttccaagtctttgctattgtgaataatgccgcaataaacatacgtgtgcatgtgtctttataacagcatgatttatagtcctttgggtatatatccagtaatgggatggctgggtcaaatggtatttctagttctagatccctgaggaatcgccacactgacctccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtggtttttggctgcataaatgtcttcttttgagaagtgtctgttcatgtccttcgcccactttttgatggggttgtttgtttgtttcctgtaaatttttttgagttcattgtagattctggatattagccctttgtcagatgagtaggttgcaataattttctcccattttgtaggttgcctgttcactctgatggtagtttcttttgctgtgcagaagctccttagtttaattagaccccatttgtcaattttggcttttgttgccattgcttttggtgttttagacatgaagttcttgcccatgcctatgtcctgaaaggtaaggcctaggttttcttctaggatttttatggttttaggtctaacgtttaagtctttaatccatcttgaattgatttttgtataagatgtaaggaagggatccagtttcagctttctacatatggctagccaattttcccaggaccatttattaaatagggaatcctttccccactgcttgtttttctcaggtttgtcaaagatcagatagttgcagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggtttaggattgacttggcaatgagggctcttttttggttccatatgaactttaaagtagttttttccagttctgtgaagaaaggcattggtagcttgatggggatggcattgaatctgtacattaccttgggcagtgtggccattttcacgatattgattcttcctacccatgagcatggaatattcttccatttgtttgtatcctcttttatttccttgagcagtggtttgtagttctccttgaagaggtccttcacgtcccttgtaagttggattcctaagtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtttgtcatagatagctcttattattttgaaatacgtcccatcaatacctaatttattgagaggttttagcatgaagggttgttgaatttggtcaaaggcctcttctgcatctattgagataatcatgtggtttttgtctttggttctgtttatatgctggattacatttattgatatgcgtatcttgaaccagccttgcatcccagggatgaagcccacttgatcatggtagataagctttttgatgtgctgctggatttgttttgccagtattttattgaggatttttgcatcaatgttcatcaaggatattggtctaaaattctctcttttggttgtgtctctgcctggctttggtatcagaatgatgctggcctcataaaatgagttcgggaggattccctctttttctattgattggaatagtttcagaaggaatggtaccagttcctccttgtacctctggtagaattcggctgtgaatccgtctggtcctggactctttttggttggtaagctattgattattgccacaatttcagatcctgttattggtctattcagagattcaacttattcctggtttagtcttgggagagtgtatgtgtcgaggaatttatccatttcttctagattttctagtttatttgcatagaggtgtttgtagtattctctgatggtagtttgtatttctgtgggatcggtggtgatatcccttttatcattttttattgcgtctatttgattcttctctctttttttctttattagtcttgctagcggtctatctattttgttggtcctttcaaaaaaccagctcctggattcattaattttttgaagggttttttgtgtctctatttccttcagttctgctgtgtttagttatttcttgccttctgctagcttttgaatgtgtttgctctgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcattatgtacccagtagtcattcaggagcaggttgttcggtttccatgtagctgagtggttttgagtgggattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgcgtggatgtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttgtccatttgcttggtagattttcctccatccttttattttgagcctatgtgtgtctctagaagtgagatgggtttctgaatacggcacactgatgggtcttgactctttatccaatttgccagtctgtgtcttttaattggagcatttagtccatttacatttaaagttaatattgttatgtgtgaatttgatcctgtcgttatgatgttagctggtgattttgctcgttagttgatgcagtttcttcctcgtctcgatggtctttacattttggcatgattttgcagtggctggtactggttgttcctttccatgt

SEQ ID NO: 541 - DNA, 110711 bp, Homo sapiens
taggagtcgtggagccttctatagtcttcactgcttgaagctaagtaaggaaacaggtacaatctgtgctttgtgcctgcatgtgaaacagggcacatacttcctccctctctccctcacacacacacacacacacacacacacacacacacaagcaacacaagccctgttctgttcaaataaattatggccttttcttataccaacagattcatttggtggtaacagcaagttcattacatgttggtgtgcacgctgacccacattatactccacttaaatataatgaatgtagcttgaggttaactaggactcagaagtggtaagttttcctttcactcgtttttcatagttgaggtctatcgagacatcctgcacaactgaaagctgagaatgggaagggaaagatgaaaaagatattttcatacaaagttataagcaccagcattttgtctttgcttaaagacaagtaatcagaaaaagcactgagacttttgaaatgtttccatttgaggactgagagtgtatcccttacaaatgggatacgctggtattatcattcaccaatggactcactagctatatctcccttctatttatttatttatttgtttgtttgtttatttatttcgagacagagtttcactcttgttgtcccggctggagttcaatgctgtgatctcagcttactgcaacctcctcctcccgggttcaatcgattttcctgcctcagcctgccgagtagctgggattacaggtgcctgctaccacacccagctaattttttgtatttttagtagagatggggtttctccatgttggtcaggctggtctcgaactcctgacctcaggtgatctgccggcttcggcctcccaaaatgctgggattacaggtatgagccatggcgcccagcctatatctccctgttaaacaccaattcacaatagtgcttataggccgacacggtggctcatgctcgtaatcctagcactttggaaggccaaggaaggcagattacctgaggtcaggagttcaagaccagccaacatagtgaaaccctgtctctactaaaagtgcaaaaattagctgggagttgtggcgggtgcctgtaatcccagctacttgggaggctgaggcaaggagaattgcttgaacctgggacgtggaggttgcagtgagttgagatggcgccactgcactccagcctgggtgacagaacaagactccctctggcaaaaaaagaaaaaaggaacacaatgaagcatccataattaggtacatccataaatcatatgcattttctagggtttattggtcccaatgtatccatcagtcatgaataatttttaacccctccctctaaagacacttcctgaaactaaattggtacaatcttcctgaaaagcaatttggcaacatgtattaacaatctcaaaaaagatattgcagcctgggcaaaatagcaagactctgtctctacaaaaaattatttgtagataattcttataaccagcaagtttgagaaacattatttaaaactttcatttcctttctagcacttcttgctagttatcattacattccgtccttacctgtttaatcatttatttaatgtctccccctaccatcaaacagtaagttccatgaaaacagtgatggtgtctattcaaggaccagtatgcacatttttttgtttttttgtttttttttgagacgagtctcactgtcacccaggctggagtgcagtggcgccatctcagctcactgcaacctccgcctcccaggttcaagcaattctctgcctcagccttctgagtggctgggattacaggcgcccacgaccacacccagctaatttttttttttttttttgtatttttagtagagacgggtttcaccatcttgaccaggctggtcttgaactcttgacctcgtgatccacccatctcggcctcccaaagtgctgggattccaggcatgagccaccgtgcccggccagatatttcaatatagatatgcacaaacttgatatagagtgtataataccgccatataataagaaatatttacttggttgctgaccccagttcctgtcatgcagctcctaaaactcttgtaaaatttcctgagcaataagagcgctgagtgcatcttttgttctaatatttggtctttgacctcaatccctgacacagacctactaatcccttgaaatttcctgggtgatgataggaccatcttttgttctagtaacatgacttgatgcatactcctgaatggggctggtcaccagtaagtccaggtcataattagaggattgaaactttctttctttctttctttttctttttttttttttttttgagatggagtctcagtctgtcactcaggctggagtgcagtggcgcgatctctgctcactgctacctccacctcctgggttcaaacgattctcctgcctcaacttcctgagtagatgggattacaggcgcttgccaccacgcctggctaatttttgtacttttagtagagatgaggtttcaccacgttggccaggctggtcttgaactcctgacctctgacctcagctgatcctcccgcctcagcctcccaaagtgcttggattacaggcgtgagctacctcacctggtgaggcttgaaactttcagccacagttctcatactccagagaggggtgagggactggaaatggacttaataatccagaattcttatagaatccagaattctataaaaattcaaaaagtatggggttcagagagtttcagggttagcgaacacataaatatgtcaggagggtggtacaacccaactccacagggagagaaccctgccagtcctcgccctatgtatctcttgatctaatggttcttctgtgtcctttatcatatcctttattaatataataaactggtcaatataagtatttcctgagttctgtgagccactctagcaaattaatccatctgaggagaggattgtgagaacctccaaccaagtgggggagaagttgtaagtaaccagaaacctactgcttgggattggtttctcaagtgtgggacagtcttcttgtgggattgagcccttaacctgtgagcccttaaccagtgcagactccagttagtgtcagaattgaatttaattgtcgaacacccagctattgtccactagagaattgcttggtgtgtggagaaaaacccacacacatctggtgtccagtgttcagtatgtgagagcagaaggaaaaaagttttttttttttttatagaatcaattgtagctatctatacatgatcaactgaaggtaatacataaaaaagttaacaattagatgattgaaaggaaataaactaagatgctaacattaatatacttcctgaatgaatcaatctaagccttttgttatatatcataagagcccaacttaagtctggatcatcctcaggattgtaggaaaagctctacccctgaaaagtacaatgtgaatccagactatctggtactcaagcatggaaatcttgttatcttaaggagagtgccacacaaaactggcagactgttgcaaaacaagacatgctgactgccaaatgcattaagacatcaaattcatagagaaaacaagtatatatctgtctagatctactttactatctctacttaggcaatcacatgaagcttaactttctggttcctttgaggccagtcctgagggaagtaattgccaaacaggtcaggggccagtataactaaataggttccagtttctcttattacttaggttcaccaaaaactgtaagaataaagaatgtaggctgggcacagtggctcattcctgtaatcctagcactttgggaggccgaggcaagtggatcacttgaggtcaggagttcgagatgagcctgaccaatatgatgaaactccatctctactaaaaatacaaaaattagccaggtgtggtggcatgcacctgtaatcccagctactcaggaggctgagacaggagaatctcttgaacccgagaggcaaaggttgcagtgagccgagatggcaccattgcactccagcctgggcaacaagagcaaaacgccatctcattaaaaaaaaaaaaaatgttatagaaatctggggactgcaacaccctcaaaaacctttctctagtttttaataattaaattagagatggctactgaatattagctggttgaaatatggcatttgcgtaggtagatcaacagtaaacttctacatacataggcactgagtaggtgtttataaaatgctcactgaatcaatttgtcaggacaaaactaattctggaaagtgaaatacatggagtcatcttcctgttttccagctgtagcctgtcagcaccactacctccactgtccatggggatgccaactctgcccttacttttggccataatatctacagaggcctgttactactgtgacctgggcttcagatgactggggtcctgttgctcctccattcttgactcctggctaagcctttcccagccatccacatgcaaaccttagttgaaaaggcctagtcagggatcagcaaatgacagcccatgggccaaaactgaccagctgcctgtttttataaagttttattggaacacatccatgctcattcacttatgtattatttaaggctgactttggtgttacaatggtggagttgaatagttgtgacagagatcatctaacctataaagcctaaaatatctactatgtggcccttctgagaaaaactttgtttacctctgacctagatgcataaggccagataataataattattgggaccaggcatgatggctcagacctgtaaccctggcactttgggaggccaaggcaggtggatcacttgaggtcaggagttcgagaccagcctggccaacagggtgaaaccctatctctacccaaaatacaaaattatccaggtgtggtggcacgtgcctgtaatcccagctacttgggaggctgaggcaggagaattgcttaaacctaggaagcggaggttgcagtgagctgaaatcgagccactgcactcccctggacaacagagtagtgtgcagtgacacaatcataggtcactgcagccttgcgcttctaggctgaagcgatcctcccgccttagcctcccaagtggttagaactactggcacatgccaccacacctggctaatttttaaatatgtttttgtagaaacagggtcttgctatattgcctggctggtcttcaattcctggtctcaagcaatcctcccacctcgcctcccaaactgctgggattacagggataaaccaacacaccccggcctataataaagttcttgtgtggcatttaccatatgccaagcagtacgctaaggtctttgcatatgttaattccttagtcctcactacaatcctatgaggaagctgaggcataaagaagttaaggtaacacagctaataagcctgtgtctggcctagatagagaaggtattgcaaaataaatagattatcacaaggattcaagaaatgaacaaaatcataatttggaagctccaataaatcagcaaacaagtcatggtggaaattatgagaataatgtgattgtggaaataggttattcctaataaccacattctggccagctgcagattccttttgtgtctgggattatgtgaaaaagtaatgtttaagaaaataaaaaaccaggccgggtgtggtggcacacgcctgtaatcccagcactttgggaggccaaggtggtgggggggatcacttgaggtcaggagttcgagaccagcctggccaacatagcgaaaacccatctatactaaaaatacaaaaattagctgggtgtggtggtgggcacctgtaatcccagctactcaggaggctgagacaggagaatcacttgaacccaggaggcagagtttgcagtgagctgagatctcgccactgcactccagcctgggcaacaaagcaagtctgtgactcaaaaaaaaaaaaaagaaagaaaatagaaatgacaatatagaaaaatggaactgaccaaaaaaagttttttttttaaaaaaagatatttactatagaacttctacatttaaattgtaatttctgcatcaaggtagtaaccttgggatactctacatttattaagaaataatttttggccaggtgctgtggctcacgtttgtaatcccagcactttgggaggccgaggcaagtggatcacaaggtctggagtttgagaccagcctgtccaacatggtgaaactcccatctctactaaaaagtacaaaaattagctgggcatggtgacatgcacctataatcccagctactcggggagctgagacaggagaattgcttgaacccaggaggcggaggttgtggtgagctgagatcgcaccactcactccatcctgagcgagagagtgagactccgtttcaaaaaaaaaaaaggaaagaaataattttcaatgtttgtttaaaataattttataaattcatataaggaccccatatatatatatatatattttttttttttttttttttgaggtggagtatcactctgccacccaggctgaagtgcagtggtgcaatcttggttcactgcaacctccacctccccagctttaagcgattctcctgccccagcctcccaagtagctgggagtacaggagtgcgccaccacacctggctaattttttgttgtgtttttttgagacggagtctcgctctgtggcccaggctggaaggaagtggcatgatcttggctcactacaacctccgcctcctggattcaagtgattctcccacctcaggcatctgccaccatgcccggctaatttttgtattcttagtagagatggggtttcaccatgttggccaggctggtcttgaactcttgacctcatgatccgcctgcctcggcctcccaaagtgctgggattacaggcatgagccattgcgcccggactaatttttgtgtttttagtagggatagggtttcaccatgttggcaaggctggtctcgaattcctgacctgaggtgattcaccctgctcagcttcccaaatttctgggattacaggcatgagccaccatgcccggccaagaaacccaatatgtttaatttgtggtttcattgttataaagcttattttagtctcaagtcatatgattgctattatttagctttatagtgcactttattcgccaaatgtgatccccagagacttctggctactttcaaaaagtaagtccactccaaagtaattccaagaatagattttccagtcttgtctgaataattcactgcttaacaccagaatctggcacatagtagatgctcaaaaaactgttaaacaaaggagtgactttctcaaaagttccaaagtattttaagaaatgacaacactgttggaaaatctctctaggtgactgctttgaagaaacaacatgcagttggttcatcaaattactctgattaatcttttcaacaaatactcattgagaaccagggcttgctacatagtttgtggggcccagtgaaaaatgaaaatggaaaactccttgttcagaaagcaagaaaaaagtatttttctttcttctgcagtctccttctcaacctgaaattatgttttatatttgctagtcaatgtcgtgttcccttgggcatgtggatatttgcagacccttgcagacattgcagactctgtgagtgactccacaggtggtcatagtgctcctcctgtgcccagattgttggtgggtgtgtggggatgtagaaggatggcagtagtcactgagtaggggcaggagagcatccagtgaggtggaaccaggctagagcctagacttcaaacccctggtgcatgctccattgttccactggtcttcatttacaaaacacaaattcaaaaataaattattaagtataagaggacaactgctgaacattaaatcccaagcccacagctcccttctcagtgctcatgaaggtggttctgttgagaatctattacgtgctactccctgagggtactatatgaacaaggcaaagactggtgaacctttctgcctaacagggaaagcagacaagaaaacaggaaattactctgcactgggtaagggcattgatgggagtacaggcaaaccctggtagcttcattcctggggtcagggaaagaggctcaaacatagaaactgctaggtgagacctaatgtacaaaaaggaataaaactagagaaagtgtgcagatagaggaaacagcactcgaagaaccaggggtagaagagaatgggacattccaggaactaaaacaaactggctaaagtggaaggtggggactttctccattatgttaatgagttccaacattttttgcattttttgagggcagtgagagccatttggagggatttaaggcaaagtgacttgatcagtcttgtgtttatgtaagatcactcaaactgcaatggagagaataaaagtcccaaagggcagaatgagaaagtttggtaggaagacccatcaagggcaaagaagaggaagcagagattggtttggggatgtatgggaggcactagataactagaggggcttacactggggtaagaaagacccaggatactaaagattaagccatgaagaattcatttcaatatcaactgctggtaggctgggtgcagtggctcacaactgtaatcctagcactttgggaggccgaggtgggtggattgcttgaggtcaggagttagagaccaacctgccaacaaggcaggagaattccttgaaccctgggaggtggaggttgcggtgagctgagattgcaccactgcactccatcctgggcgatagagtgagaccctgtctcaaataaataaataaataaaatgaactgctggagggggacaaaatatatcaaacaaaacaggctgaagcctgcattgtgtgttttactttgcgggggaggactaggctacattagcagcaggctgtcaccacgcatgtactgttctggaactgttacacagcactgaggcttaatagttgttctggagcccatgaccagcactcagttccacaccctttcttacaaaagaacttactctgcaaagcaagtataataaccctgagggcgggcatagtggtacatacctgtaatcctagcactttgggaggctgacgcgggtggatcacctgaggtcaggtgttcaaaaccagcctggccaacatggtgaaaccccctctctctgaaaatacaaaaatttagccaggcgtggtggtgggtccctgtaatcccagcacttgggagtttgaggcaggagaatcgcttgaactcaggaggcgggagttgcagtgagccgagatggtgccaccgcactccagcctgggcgacagagcaagactccatctcaaaaataaaataaaataaaataacccagaggaaatgttaactgagcaattctgtggagagaccagagttaaaatacaaagacacatgtttcatcctctttaaaaagtgcaggataggccaggcgcagtggctaacacctataatcccaacactttgggaggccaaggagggtggatcacctgaggtcataagtttgagaccagcctgaccaataaggtgaaacctgtctctactacaaatacaaaaattagccaggcacagtggcgtgtgcctgtagtcccagctactcgggaggctgagacaggagaattgcttgaacccgggaggcagaggttgcagtgagccaagatcatgccactgcactccagcctgggcaacagagcaagactctgcctcaaaaaaataaaaataaaataaaaaaagtgcaggatatgttcctatgtttaatctttaggcttagtgcacagagaatagcaccaagagggtaaatgttggagagacagtattctaacatatccaatttgccctataatttgttgagcacatgaagtatctaccgtgttttgagaacttcctaactagttttcctggtgcaataagagtgattgatagtttcaaaattaattttgcaatcttgaatcttcaggtgttttctgaacagtgtggccaaagctacaggggacaaaagagatgatcagaggaccagcagtcttggcctctgggagattgctggacatgcagaatcacgggcctttgtatacacttaggaagcactgctctgaagatctgcttcctgatcttaagtaaattatcatttgagttggaaaaaccatagggaactactgaaggtagaatttaaaaaacttctatataatgtattatgaaatataagggctagaagggttaatgagagaggggctattagcagcattaatgttctcacgtgatattagaacactaattctactttgggttgttacaattaattgctttcgtgccttctgaattcaaaattaatacactccataaagtttaggagcatggactacacatttctgtattcctctcaacagtctgtacatagtatatgaagtacataaagatctgttaaataaatttgataatatgatcctggctggttggttgggattttacagattaaatttttagggggattttcttagtaaaaacataagagaatgtttagggtcatggcatttcttgctctagtctttatttcattttgggggagacacagaattgttcttcagtcagctctgtgtcagaggagagagtaaagctgttccttcatcatgcaatagtaatctgagtcaaggatatgaaacaagcccttcaggaagtgagccaattaaatgttattcttcagatatgaagttaataaacaaaatatagctaaagcatcaaaactttggagaatcttatattccctaagtggtagaaataaattgatgtcccatgataaaaataaacgagatccatgggaaatttttcttgttcttccccatcatgttgtctcatctctcacacattatgcacaatgatatgagaaaatcagcagaagaacttttctcctttctttcctcttttgttagatggtaaataccagctggagctttgtgagcagtgagtaatccacctggcacagaaccaaggtaactgctacctgaaaacgttccactctgttgttatccttctgttcaggaatcatatagtccaaatgaatgaatggaagaaaccacctctgtgggctttcatacataggacttttccaggagcattgagtgcctggttaagctgctgtcagctttcagttttgcccttgtacctagtccacactgaaatgcttaatctcagaatggtttcctcttgtttctcagcacccatctgggcaccctctcctggccacaacttggtttgttctcaggggatggaaactgactatatcataacaagtaaaatatatttaggactgccagtgtagcagaggccacagtgacaggtccttgctcatatccctcaggtcttctctgcaagcttccagctgtcagtacgtgcctctctgccctcaggccatttccccaagcccaaggagcctgctctacctgtgcacaaaacaggcctgaagtttagaattactatgcccaggaggagccattaccaatgaccaataagtgctggtgattgataccccagcttcctagtccttgagccaaggtaattctaaagtgtgtgttttatttcacggtggggctaagcttctaacgtacttttgagtggctgcattttctatccctgtgtcgtacacctgccataccagtgtttcctgcaactttcaaataaaccactagtcctcgaatctttgtctcagggtcagcttctggcggaactcaaagtgtgatggtcagtaggcaaacaaaatattctcataatggattccaaagccagatatacatagattttgaatttcccaggagacaattaaaagtcagcaattcatagataagccaagactcaaagttgctaaatctaaattcctttactcacagcatcaatattcatcatactgcctcttcatgctctgagagtgttcttctgactcaatgacctctgctggtaaatcgcttaacagaatgcatttccaatcattttaatgtgctttgaaggttacagcccaagccgccaaacatgattcacaggtgttttctataactctaattctgatgtaccaagtgaccttggccattacaatgcctgttttcaactagaatgcactgtgttgtgaaatgattgtttatgacaaataattttatactttagtgttatttaattatttttcaatttcttctatattttcccttttcctcaaatactgatttatgctttttttctctttcctttttactcgaatttctccctatttctatcctgctattattctttttgtaacaaaataatacagtccatctaatatgcatacagtgtatgttatgtccctaccagatccctttcggatcaaggaactcacccctccagctgctggatattgcctgctgatggctcacaactcagtttctctcaaagaattgccctgggctgaaagaagttatctagcccaaagttatacttctcggccgggcacaatggctcatgcctgtaatcgcagcactttgggaggccgaggcgggtggatcaaccgagatcaggagttcgagaccagcctggacaacatggtgaaacctcgtctctactaaaaatacaaaaattagctgggtgtggtggcatacgcctgtaatcccagctactcgggaggctgaggcaggagaatcacttgaacccaggaggtggaggttgcagtgagccaaaattgtgcctttgcaatccagcctggcgacaaaagcaagactccatcttaaaaaaaaagttacactcctccctggggacagccagcatccaaaatggcccagacactttgcctccatttggaacaactttgaagggctaccacagcttcaaagctctctgtaggatcagcagaggcctcttttgcaattgcataggagttcaacttctgcttttgcctagttctgttttttttactcttcacaagtgctgatcctgaaagtgcaccgcagttaaccttctgcacaaaaatctcagactctcagactctgtttcccaggaaggtcccagaaacttccagataaaattagaaaattatgaggggatcaggtgcagtggcttacacctgtaatcccagcactctgagagaccgaggcaggagaatcacttgagcccaggagttcaagaccagcctgggcaacatagtaaggccctgcctttatttatttatttatttatttatttattttttctttcgagacagagtctcactctgtcacccaggctggagtgcaatggtgcaatctcggcccactgcaagctccgcctcctggattcaagtgattctcctgcctcagcctactgagtagctgggattacaggtgcccaccaccacacctggctaatttttgtatttttagtagagacagagtttcaccatgttggccaggctggtctcgaactcctgacctcaggcgatctgccagccttggcctcccaaagttctgggtttataggcatgaaccaccatgcctagcctgtggccctgtctttaataaaacaacttggtggactgtcctggagtaaaaaaataaatacaacaacaacaacaacaacaactaaaggaaatcaagagggataaaaatgtcctcattttaatctattattttttgtgcactctgcctagtatatataagttggtatcgcaaaaacttagaaagtacaaatacaggccgagcacggtggctgacacctgtaatcccagcaccttgggagactgaggcaggcagatcacctgaggtccggagtttgagaccagcctgaccaatatagtgaaaccccatctctactaaaaatacaaaaattagccaggcatggtggcaggcgcctgtaatcccagcttcttgggaggctgaggcaggagaatcacttgaacctaggaggtggaggttgcagtgagctgagattgtaccattgcactccagcctggccaaaaagagtgaaactctgtctcagaaaagaaagaaagaaagaaagaaacagaagaaggtaaaagagttatatttctaaggcgtatttgccatgccttctgtgaaggcacatctgttggtactgcttcctttaattgcaatacttcaattactagccattacaatcagttagtagttagggtgctatggcctgaatgtttatgcactcctctcccaatttttttttttttattgagatgcagtcttacactgtcacccacgttggagtgcagtggtgtgatcttagctcactgcaaccttcacctcccaggttcaagccattcttctgcctcagcctccctagtagctggagttataggcggctgccaccacgcccagctaatttttgtatttttagtagagatagggttttaccatgttgcccaggctggtctcaaactcttgacctcaggtgatccacccacctcagcctcccaaagtgctgggattacaggtgtgagcgaccgcgcccagctcctctcccaattaatatgttgaaaccctgacccccaagatgatgatattaggatatgaggactttgagaggtgattaggtcatgaagcgccctcatggatgggatccttataaaagaggctggagaaagctcccttgccccttgcaccatgtgaacttatagtgaaattaccaaattctatgagccagaaagcaggctgtcaccggacactgaatttgccagcatcttgatctgggactcccaacctccagaaatatgaaaaataaatttttgttgtttataaaccacccagtctatggtaatttgttatagcaatcctaatgcactgtgacataggctcatactaacagctgtaataaatagacctcaaaatatatagtactaaaacatagtaaccgttcatttcttgctcacctaagaggttgttgttgctgaggggtggtggaccctctctttatcagggccccttatgttaagtttattatgtagctctcctttcctcaaatcctcactgtcatcagcatctagccagtaaagggggaagtagagcagagaagagacttacgtatttcttaaaataatgtcatagatcattattttgttccatagatcagaatttgttccatagatcagaattcagttgtgtggccacaactaactacaaggcaagtttagaaaaatagtctagttgtgtgctcagcaaaaagtggaaactcatttttgctgcacagttgacagacccagacacagagtctttgtgtagcacaagaaagacaaacaaataccaagctcttcaaaccatactagatggatcttaaaggtgccagtcggctgactgctagagtcagtcagtagcagaaacgcttcagatgagaatccaccttctttagctgtcctgagagtgcttaaaacttagtatctaaaaataattctaacattcaataatagttgtaccaatataccaaagtaggccccatagtaaagcactctgtctgcttcaagacaggatagatggcctcttaggaacggactgagtcggccttttctgccccttcccccttctaatgaatcagccacattgtttgggaaggcttctgagaccattatctggtgtctcattgctctgacactaccactttgggtgctagaatttcaatcatgaagaccaatgagacttaaccagttcattttcttaacgttttgtcaacaaatgaaatatgcttttcttataaaatgactgttaagaaaaaagttatttctcttgacctattcacacaagtaaacagtaaatctttcagcattcaagccagagatcagaattttatttgaagaagatgacaactttgtggctttgtacttactcgctcttccagatcaacgacagagaataattggccattctgtagatggcttcacgagagaagaacttacaacccatgttgggttttttctttttttttttagttcgaaaaggatgttcctgggggaaaatataatcacatttatatttcagatgaaactgtctgtgttggaggttttcaatttgtagcctaaatggttgactcagacatgtctacacatagaacagccaaataataattaagagctatcagtgaacaccaccacactagatattatcagtgtttacccgtagtgtctgctcatatttacaaatcactttataatgttcatgaaagtattttccctcaattatttatttctaactagtcatgtagcatgagtggataatctttcttttttaaaaattgctgattacattccctaaagcaaaaccaactatgtaattaatttagagttgtttttccttaaagaaacattaaacatcaaaatcatgtccttttccacctaagcaaacaaaaaagtacataattcttacaaaaaatgctttaaaataccatttatttccattttgtggtgagttaggagagaggggaggaaataggaagggagaaggaagaagcaggaggcaggggtggaaagtagagacctggataaagggatgagaagacataaaaaggaaaaggaaaacataaatgatcaaggaatgagttgagaggggaaacaaagccggggagagaatgagaaagaaaatggaggaagaagctgggcgcagtggctcacacctgtaaatcccagcactttgggaggctgaggtgggcggatcatctgaggtcaggagtttgagaccagcctggcaaacatgatgaaaccctgtttctactaaaaatacaaaaattagccaggcatggtggtgcacacctataatcccagctactcaggaggctgaggcaggagaatcgcttgaacctgggaggtggaggttgcagtgagccgagatcgcgccactgctctccagcctgggcaacaagggtgaaactccacctcaaaaaaaaaaaaaaagagggacatttggataaagtgaagagcagaacctacctattagggaagggaagtggattgggtttcctaccctgtctgtagactccatgaagaaccatgtctctccagccagaaagatattcttgcttaagtagctccttacaacctacttcttcataaattttgtagattctttcttaaaaattgaaatataatttacacaccatagaattcatccttttaaaatatatagctcaggatttgtggtaagttcacaaggttatgcaatctccaccactaattaattcaagaatattttcatacttacctaggaggtgaaataccatcatcacaaaggtgattttcccagggtgaggcttattcattgcactctggatgtgctgatccctgcaatttccccaaatgtggagaactcaactgcataatctttggcagtgggaaactgtgttcacactctcttctgtaacaacaacaacgaaaaaaatatatatatatatttatcagccctaggaaatcatgtgttttactacattagcagtaactctccatcttttcctccctctagctcctggaaaccaataatctcttttctgtctctatagatttgcatattctggaaatttcttttcttttcttttctttttttttgaaacgaggttttgctcttgttgcccaggctgaagtgcaatcgcgcgatctcggctcactgcaacctccgcttcccaggttcaagcgattctcctgcctaagcctcctgagtagctgggattataggtgcctgccaccacatccggttaatttttatattttcagtagggacggggtttcaccgtattgtccaggcaggtctcgaactcctgacctcaggtgatccaccagccttggcctcccaaagtgctgggattgcaggcgtgagccaccgtgcccggcctggaaatttcatataaacaaaatcatcaagtatgtggcatttggtgcatgccttctttcacttaccataatgtttttaatatttatccatgttaaagcatgtattactatttcatccttctttattttttttttttttgagacggagtctcgctctgtcacccaggctggagtgcagtggtgtgatcttggctcactgcaacttctgcctacaattgccagattgtaaaggaagggctaaaactatccctttttacatacatacgtacatgaaatatagagaattctagagaatctgcgaaaaatttttagggctaataaatgagttcagcaagtttgtaggatacaacatcaatatataaaaatcaattgtttttctatacactagcaatctgaaaatgaaacttagaaaataatttcattcagcataaaaagaataaaatgtttaggaataaactaaaaaaagaagtgcaaaacatatactcttaccaggtacagtggctcacacctgtaatcccagtactttgggaggccatggtaggagaatcatttgaggccaggagtttaagaccagcctgggcaacacagtgagaacctcatcactacaaaaaattaaaaatttagctgggcatgatggcacactcctctttgggaggctgaagcaggaggattgcttgagcccaggagttcaaagctgcagtgagctatgattgtgccactacactctagcctgggtgacaaagtgagactctgttgctaaaaaaattacaaaacatgttgaaatagtactagtactttgaaaggccaaggcaggaggatcacttgagttcaggagtttgagaccagcctgagaaacatagtgagacttcatctctacaaaaagtgaaaaatttggctgggtgaggtggctcatgcctataatcccagcactttggtaggccaaggtgggcagatcacctgaggtcaggagttcgagaccagcctggccaacatggtgaaactccgtctctactaaaaatgtaaaaattatctgggtgtagtggtgggagcctgtagtctcagctacctgggaggctgaggcaggagaattgctttaacctgggaggcagaggttgcagcgagctgagttcatgccattgcactccagcctgggcaacaagagtgaaactccgtctctaaacaaaaaaaaaaaaaaaaaaaaaaaaagaaagaaagaaagaaatggcaggaatggacatccttttcttgttcctgatcttcgcgggaaagcattttgtcctccaccattaggtatggtggtagccgtgtgatttttgttgatgaactttatcagattgaggaagttatttttcttttcttttcttttctttttattatactttaagttttagggtacatgtgcacaacgtgcaggttagttacatacatatacacgtgccatgttggtgtgctgaacccagtaactcgtcatttaacattaggtatatctccaaatgctatccctcccccctccccccaccccacaacaggccccggtgtgtgatgttccccgaggaagttatttttctatttgtgttgagtgtttttattcagaaagagtgttggattttgtcagatgcttttctgcatctactgagacgatcatatgattttggtttttattctattaatatggtacattatattcatttattttgtacatcaaaccaatcttacattcctgggataaacttttttttttcttttttgagatggagtctcactttgttgcccaggctggagtgcagtggcgtggcctcggctcactgcaagctgcacctcccaggttcacgccattctcctgcatctgcctcccgagtagctgggactgcaggcgcccgccaccacgcccggctaatttttttgtatttttagtagagactgggtttcactgtgttagccaggatggtctcgatctcctgaccttgtgatctgcctgcctcggactcccaaagtgctgggattacaggcatgagccaccactcctggccagcataatcctttttatatgcagtttgctagtatgctagtatttggtatcaggccaatattggtctcacaaattagtagaaaagtgttcccttctcatattttcagaaggtttcgtgaaggattggtgttcattcctctttaatacttggtagaattctctagtgacgtcatctggttctgggcttttatttatagaaaagttttggctgggtgcggtggctcacgcctggaatcccagcactttgggaggccaaggcgggtggatcacctgaggtcaggagttggagaccaccctggccaacatggcaaaacctcgtctctactaaaaatacaaaaattagccgggcgtggtggtgggtgcctgtagtcccagctactcaggaggctgagacaggagaatagcttgaatgcgggaggcggaggttgcagtgagccgagattgcaccactgcactccagcctgggcaacagagcgagattccatctcaaaaataaaaaaaaaaagaaaggttttttaatgattcatcaacctttctacttgctatagttctattcaggttgtctattttttaagcagtttgatagtttggatctttttaggaatgtgcccctttcatgtaggttatcttatttgtcggcatataattgttcatcgtattctgtcatctcttccattcctggttttagtattttgagtcttctttcttttatttcttttttttgtcagtctagctaactgttgtcaattttgattatcttttcaaacaaccaacttttagttttgctgattttcttcatttttattctatttcctattttgtttctacggccataccaccctgaatgcacttgatcttgtctattttctattttgtttatttctgctataatagttatcattttcttccttgtgtttgcttgatttgggtttagtttgctcttctttttctatttccttagggagaaaagttaggttattgatttttggcctttactctttttaacatacaggcatttagagcagtaaatttccctgtaagcaccaatttaacttcattgaatttaaggtaggttgtggtttttttattttcattcatctcaaagtatttctaattttctatgtgatttcttctttgacccgttagttatttagaaatgtgttgttcaggccaaacacagcggctcacgcctgtaatcccagcactttgggaggccaaggtgggtgaatcacctgaggtcaggagttcacgaccagcctggccaacatggtgaaaccctgtctctactaaaaatacaaaaattagccaggcattgtggcttgcacactgtagtcccagctacttggtaggctgaggcaggagaatcgcttgaacttgggaggtgaaggttgcagtgagctgagatcacgccattgcactcggctgggcaacaagagaaaactgtctcaacaccaaaaaaaaaaaaaagaattgtgttgttcaatttccaatatgtgtgaatttcctgaaatttcttttactattatttctaattttatttcactgtggtcagagaacatactttgtattattacagtcttttaaagttttctgagcttttttaatggcctaacatatggattgtcctggaaaatattccatgttcacttgagaagaatgtgtattttttaaaatttattttaattttattttattactttttttttttaaacagggcctcactctgtcacccaggctggagtgcagtgacacaatcttggttcactgcaacctctgcctcccaggctcaaacaatcttcccaccttagcctcccaagtagctgggactgcaggcactcaccgccacgcctggctaattattgtatttataattgtccaggctaatctcaaacttctggactcaagcgatctgtctgccttggcctcccaaagtgctgggattacaagcatgagctaccacgcctggccgaacatgtattttatagacacctttgaatatcttagaatgttgggtgttattattactactattatttttgtagagataggttcttactatgttgcccaggctgtctcaaactcctggcttcaggcaattgtccaacattggcctcccaaagtgttggtactataggtatgaacccccatgcctggctgaatgaatgttggatattctatagatgtctttcatgtcaagttgatttatagtgttgttaatatcttctatttccttggccatcttttatccagttgttctacccattatggaaagtggcagctaggcacagtggctcacaactgtgatcctagcacttggaggccaaggctggagaattgcttgaggctaggagtttgagaccagcctgggcaatatagcaagactccatcttaaaaaaaaaaatagaggccggcatcgtggctcacgcctgtaatctctgcactttgggaggctgaggtgggtggatcacctgaggtcaggagttcaagaccagcctggccaacatgataaaaccccatcactactaaaaatacaaaaaattagctgggcatgacggtgtgcacctgtaatcccagctactcaggaggctgaggcaggagaatcacttgaacctgggaggcagaggttgaagtgagctgagattgcgctactgcactctagcctaggcaatgagcaaaactctgtctcaataaataaataaataaataaataaataaataaataaatataggggctaggcctggtggctcatgcctgtaacctctgcgctctgggaggctgaggtgggcggatcacttgaggtcaggagtttgagaccagcctggccaacatggtgaaaccccatctctactaaaaatacaaaaattagccggggcggtgacagagcgagactccgtctaaaaaataaataaataaataaaaatctgttccaccaatctctacctattatgtgaagtgttcagtaatacacatttaatgtaattgctgataaggaaggatttacaactgccattttgctgtttgttttctgtatgtattgtgttttttgtttctcttcctccataactgccttcttttgtgttaacgtcaggctttcccacaatgctagttttgattacttgatgaccaagaaatattaactattctgagattgtacatatgactttaaatctcatttgagatattgattgttcttcactgttccaaaaaaaaaaaatcatgagtaagatttcagaaggatacggtttaggatttattcactgcttacttgaaaaatttgccaggtgtggtggctcatgcctctaatcctagcagtttgggagtccaaggtgggaggatcatttgggcttaggagtttgaaaccagcctgggcaacatagtgagacttcatctcttaaagaaaaaaaatagaaggctgggtgcggtggctcatgcctgtaatcccagctctttgggaggctgaggctggtggatcacctgaggtcaggagttcgagaccagcctgaccaatatggagaaaccccatctctactaaaggtacaaaattagccaggcatggtggcacatgcctgtaatcccagctacttgggaggctgaggcaggagaatcgcttgaacctgggagacggaggttgtggtgagcggagattgcgccattgcattgcggcccaggcaacaaaagcgaaactccgtctcaaaaaaataaataaataaaataaaaattaaaaaaatagaaaagaaaaattgaacatatcatcagtgacaataaaatatttttaaaagttttgtgtctcaatcttttcattatttattatcacaagaaattacgtgtcttctaggccaggcgtggtggctcatacctgtaattccagcactttgggataccaaggtgggtggatcacttgaggtcaggggtttgagaccagcctgaccaacatggtaaatccccatctctactaaaaatacaaaaattagctgagtgtggtggtggttgcctgtaatcccagctacttaggaggctgaggtgagagaatcgcttgaactcaggaggcagaggttgcagtaagccaagatcgttccactgtactccagcctgagcaacaaagtgagactccagctcaaaaaaaaaaaaaaaaaaaagggaaaagggccaggccccatggctcacgcctgtaatcccagcactttgggaggccgaggcgggcggatcactggagtgcaggagttcgagaccagcctgaccaacatggagaaaccctgtctctaccaaaaatacaaaaaaaaaaattagccaggcgtggtggtgcattcctgtaatcccagctacttgggaggctgaggcaggagaatcgcttgaacccgggaggtgggcttgcagtgagccgagattgcgccattgcactctagcctgggcaacaagagcgaaactccatctcaaaaaaataagtgtcttctatatgccaggcaattttataggcactgggaaaattacagtgaataagacagactgggtccctgtcctcaagaagcttgagttccagtgggagagacagttaataaataagtgaataagtatattctaaaatacacagaaagacaaaggacagaaagaaaatgaggcaaaggacaggtgtggatcatcctggaagggctatcttagattggagggttaaaagtagtagtttctgaagaagtgacatttgagcagacacctaaatgaagagagggttcaagtcttaaagatttactggaatagagtgtttgaagcagagaaaatagtaagtgcaaagacagacatgtgcttggcctatttccagaacagcaaggattcccatgggactgggtaggaataagcagagggactgcaagtgaggtagccagtgatcacatatatatgattttataggccttttagattttaagccattagaaggttgtgagcaagggaacggcattgttacgttttacactttaaaaacatcactctgggttttgtatagaagataaacagtaggagagcatgcgtggaagttgggagaccgatttggttgacacagccttagttgacctccaatgagtcatgccttgtgtaatattctcccttaagtgctgacagaacctgtgacttgcttccaatgaacagaatatggcaaagatgatggatgtcattctcatgaatatgttacattacataagacttcatcttagccgaccagagtgtgagtgattctgctgaagaagcaaaccaccatggtgtgaactgctgtggagagggccacttgcagggaactatgagacacttctaggacctacagatagctcccagccaagagccagtgagaagctgggtctccagttacacaaccacaaagagttgactttaccaacaatttgaatgagcttggagttaaattcttccctagtcaatccctcagatgagaatatagcaagcctacatcttgattacagattgtggaggctgtaagctgagtatctggttaagccattttcagactcctgacccacgggaacagtgagataataaatgtgtgtggttttaagctattaagtgtgtggcaatttgttacacagcaacggagaaccaacacaaccaattaggatgtttctgtagtagtcaggtgagaattgatggtgacttgaaccaggctagtagccatgaagatggggagaaatggttggatttgggatatgttttgaacacagagttgatagatttgccaaaagcttgggtatgttatatgtgagagagagaggagtctgactccaagattggctcaataaatacaaatactcagctcataaaattcaattaatttatattttgctcaccttagaaatcagatctgggccaggcgcagtggctcatgcctataaccccggcactttgggaagctgaggcgggcggatcacctgaggtcgagagttcgagaccagcttgaccaacatggagaaatcccacgtctactgaaaatacaaaaatagcctggtgtggtggtgcatgtctgtaatcccagctactcgggaggctgaagcaggagaatcacttgaacccgggaggcagaggttgcagtgagccgagatcgtgccattgcactccagcctgggcaacaagagcaaaactccgtctcaaaagaaaaaaaaaaaggaaatcagatctggttgaatcctactgatgtgctatagcacctcttccaggaatgcacttgaccgctttctaaaccaggcttgttctactaacacttcaagtttcaaatgaaatgatttccttctctgaaaactttcccatgcacgttagctagcttaactctttactccctttgctcaaaaatttcttatagcatttgtctcattaatcataatttatatgcactgtctcctatagcttttttttttttttttttttgaatggagtctctttctgtcacccgggctggagtgcagtggcggaatcttggctcactgcaacctctgtctcccgggttcaagcaattctcctgcctcagcctcccaagtagctgggattacaggtgcccaccaccacccccagctaatttttgcatttttagtagagacacggtttcaccatgatggccaggtcgaactcttgacctcaggtgatctactcacctcccaaagtgctgggattacaggtatgagccactgtgcccagctgggacatagctttaaaaaaacaaaacaaaaaaaaaactttatattcccagatcctagaacagagtctgggacatctaggaaatatccaaatgtttaatgactgaataattgtagtcattctgaaaacatttgaaatcatcagattaactgtattttacctaattctgtcttctcatagcaacatagttcatctcactatatgattaactaaagcagacaagatatgtatgtatgcatatattacctgcatcataagtataatgcaatatgcccatttgacaatgttaactccataaataataacactcataattgacccactgtgcatatgtgtctgtttgtgtatgtgagagaaagagaattctataagctacaaaagttttttatccagtttgagttgcagatccaagatttatcctcttgatttattgctttctagccttgcaaaaggacaaaagtaaagtttttgaaaagactttgtgacaaatctacttcaactactccagaatgtgaaaaacggataagatagatgctgggtcactttaaaaaggcaaaggaatgttccaatataaaaaatatggtactcgtgggctagtttgttcaaacacaccggagtgactttctaggcttcgatccaattgtatgatgcattcagaaaccctgtgcctactcataaaaatatctcagatgaaagattttgaaatttgtttatgagtttaactgaactgaaaactgcaatgttggccatttctttttgtgaccagagggaggaacttctattcagtattgaacctaatacaccaatggctatattttccctaattccagaagacagcacacacacacacacacacacacacacacacacacacacacttcctataaggacaagtaacctcaaaagattggagcagtctctctgaatcagttcaggatttgccttaaagtgttcattttcctactcatatcactctgggacacccaaacttgccaataaatctcaaatacgtaactgctgtcacttggggaaactttttggcaacaagacttatgatctgaagcatgatggaatttccgtctctccagttaaaaatgatgctcaaagcagcccattaatttggttagttattcacagattagaagcaaatctgaaatgccaagcccagaagaaagccaggcctaaaaacaactgaaatgattttccatggacaaaataaaaaagcagaacaaatctaggtttttcaaaaggttacttaatccaaacttagttctcaaacaaagatggaataacaactgataatgactgatatgcctttaccagtatgagttcaagcaatccaaggaacactaccagatggcaagtctcaaaatttgacctggtaccttgtaaacattcaagggattctcattgctgaaaatggatagcaattagcatctacatttttatttttttttttaagagacagtttagctctgtcacccaggctggagtacagtggtgggatcatggctcactctagcctccaactcctggcctcaagtaatcctcctgtgttggccttcaaaagtgctgggattacagccatgagccaccatgcccagccacaatctacacgtttattacactatattcactatatactatattcattaagcccctcataactctatcagtgactctgttaatggagtcaacagaatgatcaaaaatgccatttaggtggacaccctggtcgatgcctccaagcttgtcccaggcccttgtcctggccccgtggcctacagggtttgccctgctatgcatcctccaatgctgggcttcggattggccacagcttgcggatcctgccgtgccagcttgtacctccactctctcaatcagattctgaaagttaaaaagcacagtgtctatttgacaaatttgaggaaatcgggaactttgggtgacctaggctctctaaatgagatgacctatcaaataccagcagaggaaatgctggactcctaagcagaatttttttggaagaccttgcagatgaggcttaccaatttgagcactatgatgtctcctttgggaatggtgtcttaacaattaaactgagtgaagatctaggaacctatatgacaaacagcagaccccaaataagcaaatctggttatcttccccatatagcatctgaataagttgcactttgtcttcaaatcaagttaaagtttgacctctagtttgttttgagcatctcagctaacgaagaacacatgattgtgtcggaggcacaatgcagcctgtgcagcatgaaaacctgaggccatgcaaggaaagatgtccctcattcctcatctgtctggctgccaatgaagtagttgtaagaaagtaaaagtgaactgcccacagaaagctctcagacctacctccctgggttattcatttgcacttccaaagagaacatcatgttgactgtgaactggggaaggcccatatacagccaggctgaattctttgaaaacctggctgggcgcaatggctcacgcctgtaatcccagcactttgggaggccgaggtgggaggatcatctgaagtcaggagtttgagaccagcctggtcaacatggtgagaccctgttatctactataaatacaaaaattagccgggtgtggtggtgggtgcctgtaatcccagctactcagaaggctgaggcaggagaattgcttgaacccgggagatgaaggttgcagtaagcagagattgcaccactgcactccagcctgggcgacagagcaagaccttgtctcaaaaaaaaaaaaaaaaaaaagaaagaaagaaagaaaaagaaaacctaacggtatttgcatttaaaaacaattataaccctactccacttccaacattgacataatttcatcattttaaggcagttaatattgtaccatttatcatgctgtggtttgtatttctttgttcagaatgaagtgcatgcctccttcaaaactgtaaaataaaatatacatgctagtgaaattaaacaaaattagcaggtaaagaaatatttgctctatggttacaaaagtcatatttcagagccagaaaatacacatattttcttttagagaaaatcaggtaatttgcaaatccaaataaataaataaataataaaaccgggccgggcatgatggctcactcctgtaatcccaggcactttgggaggctgaggcgggcagatcacttgagcttgagtttgagaccagcctggccaacatggtgaaaccccatctctactaaaaatacaaaaattagccgggcatggtggcgggcacctgtaattccagctactcagaaggctgagacaggataatcacttgaacctgggaggcagaggttgcagtgagctgagatcctgccactgcactccagcctgggtgacagagcgaaaccccatctcaaaaagaaaaataaataaataaataaaccaaacattagtaatgtaaattagtaaccccacaggtttaagcaagagagctatgctaaattttacacagctgtttctataaagatactcacgcacagaaaagaaacattttgaaaaatattttcatgttggttttctagacaggaaaccagactcatattgccctaacacttggtttgcatttcataccagttaaattaaaaattattgttacttaatttctcagcaaaccaattttctaatttagccttgttccagatttaataatttttaaacataaaatgtggagtttttctgtcctttaatgtttatgagatggtttattgtagccttgtgggagctagcttaaatagatatatgtttctgggattgaaatgactaacttttataattctggggttaaaggacacaacgttttgatgagtttggtactatattcttttaggaggttagcctagattctaatttattcaggggaattctttacagatacatagttctcagttttcgtagtaagacgtagtaagatgaaacttttacttctttcattactttcttaattcttctttttttttttgtaactcatctcaccaccacaggccttctttcgttctaatgcaactgaattatcattaccaactcttaatttattttttcaaattttaagtccagccaggtgcggtggttcaagcctgtaatcccagcactttgggaggctgagacgggtggatcacctgaggtcaggagtttgagaccagcctgaccaacgtggggaagccccgtctctgtgatctcagttcactgcaacctctgcctcccagattctctcgcctctgtctcctgagtagctgggattgcaggtgcgtgccaccaaacctggctaatttttgtatttttaatagagatggggtttcgcctggtcctgctggtctcgaactcctggcctcaagcgatctgcacacccttggcctcccaaggtgttgggcttacaggcatgagcaattgcacccagtcatgacctctaatccagagcccaggcaggtcactccacacattcagagcttccaaccacttttacggtctaccatttttaaccataatggaaaaatcaatggctaccaaatctaaggaaaatctctaatgtaaaaaattaaacaacaaaacatgggaggggtaaaaagacacttggaggaaacagctatgcaggaaggagaaaatttcaaattagtattaatatttttagagaaataagaaaatatgtcatagccacaaaacaggaataggatactacttaggagataaaacaaacagaatgaaaagagcttttcagcagaaatgaaaaacccaatagaataattaaaagataacattttttagaaactcccagaaagtggaactaaaatacaaacaagtggaaaatagaaaataaaatgtaataagaagagaggaccagtcatgaacatccaacaactatttaataggagttccagaaagagagaacatgaaaaacagagaggaggaaattatcaaagaaataatataagaatattttcaggccaggtgtggtggctgaagcctgtaatcccagcactttgggagactgaggcaggcagactacctgaggtcaggagttcaagactagcttggccaacatggtgaaaccccatctctactaaaaatacaataattagccaggcatggtggcatacacctgtaatcccagctacttgggaggctgagacagaagaatcacttgaacccaggaggcagaggctgcagtgagctgagatcgtgctactgcactgcagcctgggtgacagagcaaggctccaactcaaaaaagagtatttccataagtaggggatgctagtttctgtaatgagagattccaccaagagctgggacaataaatgaaaattaactatgcaaaggcatattatcatgaaaatttataatagtgagataaaagagaatatcttaaaatctttttgaatgtaaaaataagtaacatacaaatggttggttatcataatggcagtgggttgctgaacaaacccctagaatccagaggataatgaatggatcaatgtcttcaaaattctgaaagcaaatgagtcccaatccagcattcccaaccaaactgtttaccaactatagagctaaaataatgatatgcttcaataaacaaagcctcaaatgattttcctctcatacaacctggagaatatggttagtggaacatatcctccagtagcccaggaaactcatgtagctactggaggatatgttccactaaaatgaggaagtaagctaagaaagaggaaagcagagatccaacttgagagagaggtctaggtttttcctgagatgatggtgtagggagatcctaggacatcagctttctcaagtttagagcacaaccagtccagattggagcatacataaagaaagcaccagtagcaatcattctttttaaaaaacaaaatttgatagagtatctgatgcatgcaaacatattcacaggagttgtattcttctggaagagtgtttgaagataacttaatataagctacatagaaaattgagcaaattaaaaatgaaggccaggtgcagtggctcatgcctgtaatcccagcagtttgggaggccaaggtgggcgaactgcttgagctcaggagtttgagaccagccttggcaacacggcgaaaccctgtctctacgaaaaatacaaaaactagcagggtgcggtggcaagtggctttagtcccagctacttgggaggctgaggtggaaggatcacctgaacccaggaggtcgaggctgcagtgaaccgtgatcacaccactgcactctagcctgggtgatagatcgagaccctgtctcaaaaacaaaagaaacaaaaaactggccgggcatggtggctcatgcctctaatcccagcattttgggaggccaaggagggaggaacacctgaggtcaggacttcgaaaccagcctgggcaacatggtgaaacccccctctctactaaaatacaaaaaaaaaaaaaaaagtagctgagtgtgatggcaggcacctgtaattccagctacttgagaggctgaggcaggagaatcacttgaaccttggagagggaggttgcagtgagctcagatagcaccattatactacagcctgggtgacaaaagtgagactctgtatcaaaaaaaaacaaaacaaaataacaaagaactacatggcccagctttgaataatattacataattaactgaatactgatctaaccaaaatctatgccttaattaggatatcagagagtatgtatttgtctatgttgtagaggtggagtaagagagttaactctatctttcacattaggaagccacagattgtctctgaaagtaagaaatcaagaaatagcagggtaaacctattaactaaacatagagtggaaaatgttaaaagaacagctgaaaggacaaatgtgggtacctctgggaagtagaaattaagggaaaaaaaggtaaaagcggaggagtgctaatttccacagtaacattactgaactttaaaaacgatgtacatataaaactttgataaaattaaaacttgtaaaaaagattaaatgacacactgtgtctcagaataacctatcagattacctagttgtagtaaatagctaatatatgattttttccgttgtttttaacagaagagtaggaaaattaggtgtttgctataggtttttttttgcacaagacgaagtcaatgacccagaaggtggaacttaagagcatattgtccaagatagcatgatgctgttacatcacttgaaattatgcaggccagacacgatggctcctgcctgtaatcccagcacttttgggaggctgatgtgggatctcttgaggacttgtgagctcaaggttggggcaaaggaggccaggagttcaagatcagtctggccatcaagccagaccctgtctatccaaaaaataaaataattagccgggcatggtggcaagcaactgtaatcttagctaatcaagaggctgaggcaggaggattgcttgagcccattaactggagattgcagtgagccatggtcacacgattggactccaatcttggcaacagagtgaggcactgtctcaaaaaagaaagaagaaaagaaaagaaaaaagatgaggttcttcctctcagaggccatctggagtggttctcaaatctgactatttgtaagcttcatacggaaagatttaaaaaaatcctgatgctcaggatgcatcctagacaattaaatcagaatctatctttcaacctacctcaaatgattccaatgtgtagccaagggaaagaaccacagccctaagtgtgagtttatgagactgggctatctgccatttccaaatctcatcagagcccaaggaggggtagagagaagtacatgttatggggagagaagttgggtatccctccctctgccaggccaacctgcacttttaactcgaccccactgtcacttggtagttaaatgaatgcatactctgggtgatgtttgtagggaaaagaaagagagatcagactgttactgtgtctatgtagaaagggaagacataagaaattccattttgacctgtaccctgaacaattgctgtgtcctgagatgctgttaatctgtaactttgccgcaacctctttgccctaacctctttgccccaaccttgagctcacaaaaacatgtgttgtatggaatcaaggtttaagggatctaggcctgtgcaggatatgccttgttaacaaaatgtttacaagcactatgcttggtaaaagtcatcgccattctctagtctcgataaaccagaggcacaatgcactgcggaaagccgcagggaactctgccctggaaagccgggtattgtccaaggtttctccccatgtgatagtctgaaatatggcctcatgggatgagaaagacctgaccgtcccccagcctgacacctgtgaagggtctgtgctgaggtggattagtaaaagaggaaagcctcttgcagttgagatagaggaaggccactgtctcctgcctgcaccgggaactgaatgtctcggtataaaacccgattgtacatttgttcaattccgagataggagaaaaaccgccctatggcagaaggcgagacatgttggcagcaatgctgctttgttattctttactccactgaaatgtttgggcggatagaaacataactctggcctacgtgcacatctaggcatagtacctctccttaaacttaattgtgacacagattccttggctcacatattttcttgctgatcctctccttattatcactctgctctcctaccacattcctcttgctgagatagtgaaaatagtaatcaataaaaactgagggaactcagagaccagtgcctgtgtaggtccttggtatgctgagtgccggtctcctgggcccactgttgtttctctatactttgtctctgtgtcttatttctttactcagtctctcttcccacctgacgagatatacccacaggtgtggaggggcaggccaccgcttcaatgtttgggctttctcaatagggtctcatcctccattcttaccgaccagaagaaaagttgtggttggtcaaaatctgagacattaatggggccacattttgggggtgtacctcaaaagcagagaccaagcttcattctttctcctgtatttctagcacttgggtgaactggaccatttttctctggccaggccacttgccttaaagtggtgggctcaggaacgttggccccctgtgtctcagtatctctgcacccggaacagggtctctgagaatctccggattggaaagtagagaactttagccccaggcctgggccttgcctccagcacagactcccagaggttattaggccttcagctggtgcttcctaagtagaagggtattgtttcctatccagtcaccgatccttttgtgtgccctcccttggttcagaatcccaaagagaatgaatgggagaactcgagttctaaattctgtcttagaagcactcaaatacagtttgtagggagactccaaactggtctctcactaccctgacagcctaaaaacgcagctggaattttgcattctcttcccctaaccaattagtatatgcatttcaaatactatgcataatatgcatattagtatatacaagataggctaaacactgtgtgaaactaagaaggtaaaccctctcctagcttacaaacaattggtacaattaaaaatatttgacaatggtgaaggcatgggcaatggctatttacaaatcaaaatataaatattttaatattttagtaataggcgtggtggtaccagtgtgtctcagttaaatagtagtcttgccccaaagcgcttttgaatgctttgccacctatgcatcagtggattcaggaatgtaatgagagttctcaaaagtaatggaagcaaagccaagcaagtctcccactccacacatcttgcttttccctttctgtgttgagctttggatcttccacaaaggggactgggtgcccctgcggaagtccagccagggagtagtcagacctggggggagaggatggattacaagcctgaatttgccttccctaccagacaagctctggcttgaggaatagagaagtgaaagaaaaaagaggtgcttcgactcagttggagacagggagggttatgagtggagtgaagacaaggctcttaattcaagctgcctcaaattacatttgtccacacacgcagcaaaatgctgcttaaaaaataaatgaggttaatttctctttacgggttccctttcatctcagggtttcaaagcactttgccacaaaagatcctttatcttcacaattctttttttatctaaatataaacagagggccctaagtttatatttaaagttcagtaaagccctaaactttggaaagaaaaggtactttaaaaattcttttatcattataagatccaagtagccaatcaaggaccacacagacagaaaatccacattcagatgaaaggccacacctctgctcagatgacctgcgtgctaattaaaatcacaattaaaacaagcagaggggatggagagtggtgacttaacttgcccttatcccagcagatacactcacaactgactcacacaggatacatcggattttctccagcaggcatttggaaaaaagcaaagaagaaattctagttttagctgccctccatctactaacccagtaaactccatccctgggtcggtgacacatccctgactcgcagccacctcagcagagccccattccgtgcaggaagagccagcttggcctcctggtgatgggaatgttgtttgcatatgcattttttcagcaaaagaaagtctcaaaatctccctggttccagggtgtgagtcattagtgggtgtttgttttttgggttctgagtgtgagtcaccacctttcctgctgttggtcttctcaatcctagggtaacaactaaaaagcgatgactagagatgcctgtgatgcttaaaagcggacacctggacattattcatttggcaattgtatcaacaattaattttaaagtttgttcttttctctgtaaacaagtgtataacgtttataaataacagtgggaaagaggaaggtgggggaagggagagaaacaaatctaaaaaggatatgactgaggtaaacggaagtagagtctagtcaaagccaaaatagacaactgcctgtttgtcagctagaggagggccggggctggtgatgttgaccaaactctatacatgaacaagcatctgatgctgctctctaggacttttcctcattagcctgggagtgtgcgtcgggagggcagtcaggagggactgccagtgttaaccatcaactctagaatctgaaagaacaacatggctttgaaatgacatcttccggccgggtgcggtggctcacgcctgtaatcccggcactttgggaggccaaggcaggcagatcacaagttcaggagttcgagaccagcctgaccaacatggtgaaaccccgtctctactaaaaatacaaaaattagccaggtgtagtggcatacgcctgtaatcccagctactcaggaggctgaggcaggaaaatcacttgaacctgggaggtggaggttgcggtgagccgagatagcaccattgcactccagcctgggagacagagtgagactctgtctcagaaaaaaaaaaaagaaaaaaaaaaaggacatcttcctgatgttcctcccattggtgctatgcctggtaccgtttagtactgggaaaggacctcaagaccacccagaattctacaatggagaatgttctataaagtcacggtgtcatgccaggaccaggaaccaaaaaacagcagcttgaaaaccagtgatttgacaatttgggctaccctaacggctagtttttatttcagtgacattgggcaataaatcaagccatttaagatggttgaaagaaatcaagatgaccacacacacacacacacacacacacacacacacacacacacagagcaggttttgagctcatggaggactcaacctggatttgactcagagaaggcatttggccacaggcatttcagtttgctttcagaaagtgaggaattacaaatgaaaaaaagctctgacttttcagctggtttgagtgtggaaatcaaagcttggcttttttctacccagaggagtctaggtactctgtgtcatttctagtatataattacaatatatctgtatgcccacatattgtcactatattaggtattttacaaagcccagaaaaacagagcctctgtcctggtgttccaaatgttagtcaacctatttaaactcttggtaacaatgctgaggtaatgaaaatgaactcagctgccactgttggcacagacacagcggaaggaagaagtattatttgattcaaagcattctcatttaggggagaaaaaattataatgcatatcaccactaagtggaaaataaagattataaacttggagttgtattcctgagaccttgacattttaaaataaaaggcttcagtgtttgcagaatattttttcattaatgtctcagttacttgtttttaaggataattatttgtggatattacaaaagaacttcctgaactacccatttacttgtgggcatatacatttgaaagatgccccaggcccattccaaagcaaaacaacacacacacctaattgtgactttatgcctaactagcctggtattcatgacacatctttaaaaattctctcaaaaaagtgaccagttgtttggctcctgcctttaatcccagctctttggaataccaagacaggaggattacttgaggccaggagcttgagagcagcctgggcgacatagtgagaccctgtctctacaaaaaggttaaaaattagctagatatggtggtgtgcgtctgtagtcccagctactcaggatgatgatgtgggaggatcacttgagcccaggagttcaagcttgccctgagctacaattgcaccacttcactccaccctgggcaacagggcaagaccctgcctgtaaaaaaaaaaaaaaaaaaaattaaaattaaaattctatgaaaaacatgaagacctgggatcagactctggcagactgacttgttaacactttttcagaagaattctgctcttatctcacttaaccttgggtatcttttctcagaaaagtgactgatgagatgttctcaaatcttatgacaacccatcaagttgcttccatgctcattcagctcaagatatccaagaagtcggtacctaggggccatgtctttgctgtcatcctgattctttagctgtagattatcagtgtgcctgtcccaagtcaggctagtttggcagagaatcccatattctcttgtatgagagcatggggtgtgaaatttggagatgtggtgttccttgccatatggaggaagccaattttcagaaagaaaaaaaaagagctcacacttggagagatgagacagagaaagtgctggctgcatttcagtttctggttctatttgtccctaagatcattcagcttgccacttagggataacatatgccagaatactttttaaagatgatcaccactaccttctcctttttttttttttttttttgagacagaatttcactcttgttgcccaggctggagtgcaatggcgtgatctccgctcactgcaatctctgcctcctgggttcaagcgattctcctgcctcagcctcccgaaatagccgggattacaggcacccgccatcacgcccagctaatttttttgtattttcagttgagatggggtttcaccatgttggccaggctggtctatgaactcctgacctcaggtgatccgccctcctcggcctcccaaagtgctgggattttaggcgtgagccaccgcgccggccttttcgttttgttttgttttgtttttggcctaagctacttcaggttgggtttctaaaatactgatcaaattgattatgaaaaaaagtatcaagatcaacaccatttttttcttaaggaaaattagacccaagggactgtagaaagatatttatttacattggtaagaatctttcaacaaatgactggagagcatgcaaatagaatgtgctacctgagtgctactacagggctttaagaccagagaattattattattttttattttttttatttatttatttgagacagagtcttgctctgtcgcccaggctggagtgcaatggcactatctaggctcactgaaacctccagctcctaggttcaagcgattctcctgcctcagcctcccgagtagctgggttacaggtgcccggcaccacgcccgctaggttttgtatttttagtagaagcaggatttcaccatgttggccaggctggtctcgaattcctggcctcaggtgatcggcctgccttggcctcccaaagtactgggattacaggcatgagccactgcgcctggcccaccagggaattatttttaagaccagaattattattatttctgtccttctaggagattgaaatcttgttgatatgatagaattagctttgcttccatgggaacttcttgtttactgtatattacccaccacttgtgtagtcacaaggcaggaatatgggctttgttttttgatgtagctaagcacctaggacaatgctttttatatagttggcctgcaagaaaaatttgctaaatggatgaactaatgtttgttcacatcttattcctgttaggtatattagttcttatatgaatgacagaagaaacaatgaaattgaaggaaaggaagatgaacgctaaggtaattaggacaaaaagcaagctcaaatgtcacaggaaaactatttttaaatttaacaatttggaaaattttgctaacacttctgtttcagtcattgatcatagatgaaccaaaggtatttctctccatcccacctctatttaatttctgttttatgtactgctagttacagtcttttacatattctttcctttccttagtaatagcaccccttcaattttagctaagcaaatgggagtacagccaaaaaccgtattttccaacctgctccccctgcccaggcttctgggatggtgagttctgatcctcccttgtacggggggacgatcgtcatttcacagtggaagattatggtgcccccagtgtcttgcttgggtttcctgtggcacgttgcagaggggagccaatccatttgacattgtaaactaggcagcagtccgttgccaagagtgttgctgtctcagaactacacaacttcccatgtcttattaaataaccgtgacttaccctttctttgtacccactaaacatctcacgcttttgcccatagatggtgtgtggcaaatctctttgccgccatgtgtcagatggtggtctgtctttagaacaaaacagataattgggtctgcagacagctgcccccttctccatcctgggcctgccgtggtgcatccaagcagctaacctgagtacctgtagccacttctatattgcttgtattgctacttaggggtcttgctgcaatgttcctccacatacctggccctctgcatacctggctctagggaaatcatggaagaacaatgtgataagaatgtgagggtcactcaagagtatactggggtgggccaggcacagtggctcatgcctataatcccagcattttgggaggccgaggcaggtggatcacctgaggtcgagagttcgagaccagcctgaccaacatggagaaaccccatctctactaaaaatacaaaattagctgggcatggtggcgcatgcctgtagtcccagctactcagaaggctgaggcaggagaatcacttgaacctgggaggcggaggttgcggtgagccgagatcgcaccactgcactccagcctgggcaacaagagcaaaactccgtcctccacaaaaaaaaaaaaaaaaaaaaaaaaaagagtatactggggtggagtgtattgtagaagcaacttacagcaataacttaaaagaagaatgtgtgttcagagctctgagcttaaggaatccaggagtggccaacgcggagattcattccttatctatgaggaacttctgaacccccagactgtctcatgaacacgggccatacaggggattgatgtcctgacgtcctttgttttgggttgaatgaaggttgccacgtggagattgctatggggaggatgctaagtgaaaatgttacctaaactgcatgctttctgcaagcagtcttggttctcctttccagcccactgccactgggccgtctgtttatggaagttacccctaataaaactcaatattggccaggctcagtggctcacacctgtaatcccagcactttgggaggctgaggcgggtggatcacttgaggtcaggggttcgagaccagcctgccctacatatagtgaaaccccgtctctactaaaaaatgcaaaaattagctggacatggtggcgagcacctgtagtcccagctacttgggaagctgaggcaggagaattgcttgaacccgggaggtggaggttgcagtgagccgagatcgtgccactgcactccagcctgggcgacagagcgagcctcggtctcaaaaacaaacaaacaaacaaaaaacctaatacagtgtctgacataatataggcataatgactcttcctgtaatgatagtgatagtggtaatagtgaaagaagatgaggaggaggaggaaaagggagaatgaggggtaatggaggggaagaagacagggatgaggagaagaataggaaaactattcctggactaggttggtgggaatgaaaatgaataagaaagggtgactgtggcctgtaatctcagcactttaggaggcagaggctggagggttgcttgagctcaggactttgagaccagcctgggcaacatagcgagtccctgtctcaccccactgtaaaaaaaataattaaaaaaagaagaaaagatggattagagagctattagcaaacattaataagactatatgcagtctggaaatgggaagtgaggtaaaaggaaaagtcagttgtgattcaagtttaaaatatcagttgaattggctgattcttgaatttcatcatttgcatccaccagtaccaaaagtaggaacaacgatgatgaaaaataactctgtggtgtgtgtgtgagagtgtgtgtgtgtgtctgcgtctgtgtgtaagaagctaaagatttcactgagggccaggcgccgtgtctcacgcctgtaatcccagcactttgagaggctgagccgggtggccacctgaggttaggagttcgagaccagcctgaccaacatggtggaaccccgtctctactaaaaaatgcaaaaattagctggacgtggtggcgagcacctgtagtcccagctacttgggaagctgaggcaggagaattgcttgcaccggggaggcggaggttgcattgagccaagatcatgctattgcactccagcctgggcaacaagagcgaaactccgtctaaaaaaaaaaaagaaaaaaaaaaagattttcttgagtattctccctatccagtgccagctacataatttgtgggactccacaaatttggttaaacatcattctggctgtttctgtgagagtgttttgaaagagattaacatttcaatctgtacactaagcaaagcagtttgccctccctaatgtggggggcctcattcagtcagctgaaggccagaacaaagggctgacccttcccaaatgagagagaggttttccctgacttaagatttaaactggccgggcgtggtggctcacgcctataatcccagtgctttgggaagccgaggtgggcggatcacgaggtcaggagttcgagatcagcctgaccaacatggtgaaaccccatctctactaaaaatgtaaaaaaattagccaggcatggtggggcacacctgtaatcccagctactcgggaggctgaggcaggagaatcgcttgaacctgagaggcagaggttgcagtgagccgagaccacaccactgtactccagcctgggtgacagagtgagactctgtctcaaaaaacaaacaaacaaacaaacaaagatttaaactgaaacattctcttcctgggtcttgagcctgctggccatcatactagaaccacaccatcagctctcctgagtgagtctacagcttgccaactcactttgcagatcttgagacttgacagcctccataatagcaggagccaattccttataataaatctctttatacacacatatgcgagtgcatgtgcgtgcacacacacacacacacatacacacacacatacacacacacacacatacacacacacccctacatcttactgtttctgtttctctggagaaccctgactccagagaaagtgcaggatcttgtgtagctgcactgatcacatatccatgaagccgaccctgttcctattttccctacttgccaacacataccacaaagagagagaaagaaaaaagtaggggaggagaaagagaaagaggtgagttagtgggaagaacaaattggcttggtttttatgagctatcaataatctcttgctgtcactataaagcatacataattttttacatatagcaataaaagtacagaccacataagatagcttagaaatttccagtgtcctgagatcatatattgaaacctattgatttagaaaaatattattttcatatgctaaagagtaacagttcagaaataatatcaactgaaccaatgtccttcttttgtacagttatctctgctcttataggacaacaaggctttatctaaaaccctggggccagatgtcagaattcagaattatcttggatttttagaaaagtaatacaatgtatgtactgtgtattatttacactcccagcagactctgggacagcactctgtactaaaatacattaatatttttgcagtaaaaggtgaatatttatgctacttggccaaatagtctcatgtaggtccaggtaaagttttgctttcaaatgagttcaggtgaggtcagattttgctgccaaataagctacaaaaactcagtttgtagtgctttctggattttggaatgcagatcaggattaatggatgtgtggttcctgtttccatcagttggcctctcctgccactcacattcatgttccggttgcaatgaactcaggagaacaaaatgagagaggcgagtttgctgggagagaatcccatgatacattgaaaaggccaagaggatggctcaggatttaaccttgcaactgccttccacaccccttggcccagataactgagagctacgtgagcctagaaaatgaatcagaactaaggttcaggggacaaaaatccccaccgacctttcccggagttgttccttcatgcactgtagcacacccatggaaacttcctcctaggttatcctaagtcaaagtggctgctaccactttgggctctgaactgggggaagtcctctagctctttaaggatattcatatctgtcaactgaagggctggtggtagttaactgtaggcaaagtgcttcaaaagactgtctgcaacattcagccagatcattcagccagataagtaattatttggaatcgttttcttttcttttttattttttttggtttgagacagagtctcgctctgctgccaggctggagtgcagtggtgcaatcttggctcactgcaacctctgcctcccgggttcaagcaattctcctgcctcagcctctcaagtagctgggactacaggcatgcaccaccacacccagataatttttgtgtttttagtagagacagagtttcaccaagttggccaggatggtctctgtctcctgacctcatgatccgaccaccttggcctcccaaatggtgggattacaggtgtgagccaccgcgcctggcctggaatcatcttaaaatacatatattaacacactaaatatggctatatgtaattatcacatacatagataatggtccacaccatgttttctcaacatatctttagtcgtgctcttaaaatatatgtagaagtcttatcagcatcttgtgacactaccttggcaattctcagatgtgtggccattgtataaatattgcttgaagccttcttaaaaggatgtaatttttaagagattcaatgttgctcatattaaaggtaaaggaagactttgcctatggggatccttctgcatggtggtgcattctcatccatcctgccctcaaagcccaggaccaatgccacttcctctacaaaaacctgaaacaaagtctcacctggttcctctagttggaagggaactctcttacatcttctgaagtctcacagaactatttcagcatcttttgtgtagtgtcaattactttttgtcttgccaaattgtttctggaaaccatttacttttacatctgcaactgcccccaggctaaaaccttaaatggaggtaaatacttaatcatttaaaacagttttttttagagatagggtctcactctgttacccaggctagagtgcagtggtgccatcgtagctcactgtagcctttatctctggaatcaagtgatcctctccgctcagcctccctagtaactgggactacaagcgcatgccaccacaacaggttgtttttatttttatttttttgtagatatgggaatcccactatgttgcccaggcttgtctagtactcctggcctcaagtgatcctcctgcctcagtctttcttagtgttgggattacaggtgtgagccaccttgaccggccttgacattgatttttaatatgaacatttgtgcacttaactttttaagtatttgtttctttaagttcactgaaaaaatgaagttagtcttaaaaagtttctctaggccgggcacagtggatcatgcctatgatcccagaactttgggaggctgaggcaggtggatcacctgaggtcaggagtttgagaccagcctggccaacatggtgaaaccccgtctctactaaaaatacaaaaattagccaggtgtggtggcacatgcctgtagtcccagctactcaggaggctgaggcaggagaatcccttgaacctgggaggcagaggttgcagtcagccgagaacatgccactgtacccccagcctgcgagacagcgtgagactccatctgaaaaaaaaaaaaagtttctctaataagttgttgatgcaactgaattaaaaaaagatattctatttttcaaaggaaatcagattactcattaattactcaacatcagtcactatgaattgtgcaataatgaaagcaaaatttaaaaacaggagactctaaaaagagtcagcaaattagattatgaatggaatgtttaaaagacaaagattgagcaattttaagggtcacagctgtccctaggaacttaaccaactacaatgttcagaacaatagtgtatgtaaaggaatgcatattagatcagatcacataaagccaagtattgaaacactgaaattcaagtaaggaacctacacaatccctactgttaaaacagagagagagagagagagaaagaaaagtaatttattcatctccagtaacatgatcattcactatattgaaatgctaaggcagtaaataatctaagatttgggtttgatgaaattagtacgtttatttctcagacatgcagaaggaggtatttaattaaccagcaagattgccagatgaaataaagtactctcaagtaaatctgaatttcagataaacaacaaataatattttagcataagtgtatctcacatttttaatggatttatatctcagttctgattctctgctactaattattatgactcattaattcaattactgattcaacagtaatttgttgagggccttattctatgtcaagtactgtgggtggaattgaccacatggtgataagcaaaatagtcatgatcttttccccataattcgtacagtttagtaggctgattgaaatgagtaaataggcaattactctaacataatacttgccatgattcacagtttattcattagagggacaattaacccaggcttgggtcagaaaaagatgcctagagaaagtaatttagattaggccaaaggcaaaaaggttgaggaagtagagggagagtctaatgagagtgtacctaccacaaggggaaagcttggaagacaacggatatcacgggacatttgagaaaccgaagactccaataaagtctagttgaactatagaccacaaagctgtgagtggcaagaaatgtgactagagaggtatgccatggtcagatcatgaggggccttgtataaatccaatggaagccttattgaatggtccatgcagcaaagtgacagtcatatttacaaattagaaagctcactctggcagtagaggagaaaatagactggaagtgaggacaccattgttgtgggttcggaatgggtatagaaagaagtaaatagatacaagagctatttagaaggtcactcaaaaactgttttgctctttagataggtgcaaaattggagagagcgtctccctctgtcgcccaggctggagtgcagtggcactgcaggagttcaagaccagcctgggcaacatagtctctacaaaaaataaaattagctgggtacagtggcacatgcctgtggtctcaactgcagtgagccgagatcgtgccactgcactctagcctgcggtgacagagagactctgtctcaaaaaaaaaaaaaaaaaaactaggctgggtgtggtggctcatgcctataatcccagctttttgggaggctgaggcaggtggatcacctgaggtcaaaagttcaagaccagcctggccaacataatgaaatcccacctctactaaaaataccaaaaattagctgggcatggtggcgggtgcctgtaatcccagctacttggaaggctgaggcaggagaatcacttgaacctgggaagcggaggttgcagtgagccgagattgcatcattgcactccagcctgggcaagaagagcaaaactccacctcacaaaaaaaaaattaataaagtgtacctaatttacctataatgtgattttggttgacttggagttactggaaaaccagcccataaatgggcactttgccagggttatagacagaaatttccatgggccttatttgactggctgcctaagaggatcaccaattatacaaactatccatgagatagtttttattaataaaggagtatgtttagttttttctcatgaagatgatctgtgccccgccatgatgagagaaataattcaaaaaggaagccagaaagcgaaatcaatgatatgcaaaggaatcaagactagtgacaaacattggcaaatggaaaagggaaagaagcaatgtcatcaaataaaacaaataagcaaacacggccatagtttctctctttttattatttttttcttttaaaaatagaagtgggggctcttgggccacttgcttgaacccactcccactttgtggagtgtactttcatttcaataaatctgtgctttcgttaaataaataaataataaagatggggtcccactttttcaactacactggtctttaactcctgacctcaagtgctcctctcgcttagctggaattacaggcgtaagccactacatctagcccatagtgacgacttattgaaaactgggccaggcgcagtggctcatgcttgtaatcccagtactttgaaaggccaaggtgggtggatcgcatgagcccaggagttcaagaccagtctaggcaacacagtgaaaccccgtctctacaaaaaatacaaaaattagccagatgtggtggcatgcacctgtagtcccagttacatggggagataaggtgggaggatcacctgagccaggaaggttgaggctgcagtcagcggagagaccttgtctcaaaaaaaaaaaaaaaaaaagagagaaaatggactcctgtgccatgccctggtttaggacagtacatatattatctaatttcattctcacaaatgtactaagaattaattgttgttcctgttttacagatgaggaaaattgtggctgtaagtaactccccgctaaaatcacactgcttgtaattgctagagtcaatatttccatcccaggtttctttacctgtaaaggactattgtgctgctcagaaaagataattttctcatggagggtcaacctggcatttctgaagcagtacctttgcattctgaacagaacaacaaggacaactcatagggaccattaagtttatgaaatgctggtatctttctattgggaggtaaaaaaacttccatgcatagatttggtgaggctaatagaggcatgttttataatttgtgaagatgttattcaagattcagtacacccacctattacatctttatttatttctttatttgtttttaggctcgtcaggtgaagcagtgggaatggaaaaggaacaaagaaatctgtaactgattgtgatcaattagttgtaaacaccactgcccttggaccagcgacccacctagtacttcctagttctatagatttaggtaaggatagcagatgcagccaaaatagttaaattattgatggttgatttatgatgacttagaaaacagtaacactcatttagagttagcagtaggagctatgttcactaagaacaagccatgtcatgctaatctcattttcatccatatctgtgctattctgctgaacaggaagattaggggaatgctgtagaaacattctaccttgctttgatcaaggttcttagaaagatgcttcacaatatcattgtgaaatgaggatggtaatctgaatactagttcaattgaagacagctatggttacttaaacaatcacatcctgaaataatcaatagtgattggatatctctggtgaaattccataaggcatcatatttctttgtgtgtttgtttgagacaaggtattgctttgttgctcaagctggagtgcagcggagagatcacggctcactgcggcctcaaccctgaggcttcaagcaatcctcccaccttagcctcctaagtagctgggactacaggtgtgcaccatcacgtgcagctaatattttattttattttttgtagaaacggggtctcactatattgcccaggcaggtcttgaacttctgggctcaagtgatcctcctgcctcagactcccaaagtgctggaattacaggcatgagccactgtgcctgaaggcatcatatttgaacttgtctttttcagtaaatttttagtaacttgaataatgtgattatcttattgagcttcagattcctaataaaaggattcctagaaatcttcatgtgaatgtccaaagcaactcaaattaacacgttcaaaactgaactcattatcctctctcggaattgcctctgtccatttctccctaactcaattaacggactatcaaatagtcaagattctcaactgcaagtgcccgaactcaattttaagtagtttagacaacaaaggaaatgtattgcctcatgaaatccaaggaaaatttatataaccaaattgtaggaggggcagggatgcagatgggccccgggaataactgcagccagggtcttcaatattagcaggaatcctcttcctgtttctccttgccttttggcttcattttcttttgcttcagactgacttcttctatatgatgaaaaatatggctgccagctgcatccttttatatctatctattgcaacttccattctttataagggactgactaaagttcactttggttccaagttagaaattttggagaagtctgattggcttggattgaatcagttgttctcccctgtatccatccctatgtatgccagtgggatgggatatatgcttgtcataggtgaggtgtcttcctacaccagtcagttagggccactgtggcaaaattataggaaagccaactccagctcccttgaagtaaattgttaagcagtttcagaagaaaagttgggagtttcttttttttttttttttttgagatagggtctcgttctgtgacccaactggaatgcagtggtgcaatcatggctcactgcagcctcaaccttctgggcccaagggagcttcccacctcagcctcctgagtagctgagactacgggtggtgccaccatgcacggctgattttttgtagagatgagctttcgctatgttgagcaggctggtttcaaactcctgagtgtctcacgtgtctgtgtgaagagacccccgaacagactttgtgtgagcaacaaggctgtttatttcacctgggtgcaggtgggctgagtctgaaaaagaagtcagcaaagtgtggtggattatcattagttcttataggttttgggataggcggtggagttaagagcaatgttttgctggcagagggtggatctcacaaagtacatgctcaagggtggggagaattacaaagaaccttcttaagggtgggggagattacgaagtacattgattagttagggtggggcagaaacaaatcacaatggtggaatgtcatcagttaaggctattttcacttcttttgtggatcttcagttgcttcaggccgtctggatgtatatgtgcaggtcacaagggatatgatggcttagcttgggctcagatgcctgacattcctgtcttcttatattaacaagaaaaataaaatgaaatagtggtaaagtgttggggcggcaaaaattttgggggtggtatggagagataatgggcgatgtttctcagggctgcttcaagcgggattaggtgtggcatgggaacctacagtaggagagattcaactgaagaaagattttggggtaaggggtgatattgtgaggttgttagaaggagcatttgtcatatagaattattggtgatggcctggatgcggttttgtatgaattgaaaaactaaactgatgacacaaggtccgaagagaaggagaaaaacaggtattaaaggactaagaattgggaagacccaggacatccaattagagagtgcccaaggaggttcagcatagccctgccagcaaagattatttatttactttaagagggagttaagagtggcggtttggggatagcaccaggagatatcagctgtgatggcttggagaaacagtgtaaaccggcggtgtaaacaagagtagggcatttatgagtagttgagaatgttgtaggagtgtgactagatggaagatagtagggatgactattttggggggctcagtctaagtagtgggggtgacttcgtaaagccctgttgcaaaaagtagggtaaggacgaacagacctaatagaatgaagggacgtattaggcgcataagggttattactgttcttcagaaatgtgagtgggtttaagggaagtaggagagagtacttgcgatttccaggaggaagaggagagattaggctggctgtcggagggacacagctttatcctggaacagtgaacccggtggggaggatcctgcaggtggacggcagttgaggtaccatagatgactaagtggggtaagggcgattaggttttaatgggatggtaagtggtgcacgattggttgccaagaagggagtagaggtgtcctatatttgtggtttaaggtggggagatacaaggagaggatgtgaaggagggtttgaactggggaaaagggcggcactgaggtgtggctgtagcctaggaatagtcagggaagcagataatttaattaaaatgtttcagcctaataagggaactgggcaggtgggcaaaactaaaaaggagtgcttaaaagagtattgtctaagttggcaccagagttggggagttttaagaggtttagaagcctggccatcaatacccacaacagttatggaggcaaacgaaacaggcccttgaaaagaaggtaatgtggagtaggtagcctccgtattgattaagaagagtacggacttaccctccactgtaagagttacccaaagcatctgtgatggtccaggaggcttccgaggctatcgggcagcgtcagtcttcagctgctaagctgagaagatctaggaaagagtcagtcagagagccttgggccagagttccaggggctctgggagtggctgctgggcgagttggacaatctgatttccagtggggtcctgcacagatgggacatggcttaggaggaatcctggctgtgggtattccttggcacagtggccagatctctggcacttgtagcaagctcctgggggaggaggttctggaggaacccctggcagctgcggttcaggcgtttggagttcttgtgtgctggaaatatggctggggtttgtttcacagtggaggcaaagaattgcaactcagaaatacattgctacttggctgcctctactctattattgtacaccttgaaggcgaggttaattaagtcctgttgtggggtttgagggctggaatttaatttttggaggtttatttaatgttgggagcagattgggtggtaaaataaaatgcatattgagaataagatggccttctgacctttcagggtctagggctataaagcatctcagggttgctgccaaacgggacatgaactgggctgggtttttatatttgatgaaaaagagcctaaatgctaactgatttgggagaggttggataaagaaaaaggagcattaaccttgactatgcctttagctccagccacctttttaagaggaaattgcaggtaggggagggctagtcgccgaacgaaactgtaagccggaccaggtgtgaggaggggaggtgataaaaggattatagggtgggggattggaggctgaggaaaaattggggacctagctcggcctggcaaggagcagcctggggaggaggggagaggtcagatgggtccgtagaaaaggaagattcagaagactcagagacacttggggttgggactgaagggacaggcaggagggaaagaaggaagatttgggatgagttgcattgggaacagagactagggagggaccgatgtgtaaaagaatgcctggacgtcaggtacctcacaccgtttgcccattttatgacaagaattatttagatcttgtaggatggagaaatcaaaaatgccattttctggccatttggaaccactgtcgagtttgtattggggtcaagtggtgttgcagaagaaaataagacacttagattttaggtcaggtgagagttgaagaggttttaagttcttgagaacacaggctaagggagaagaaggaggagtggagggtggaagcttgcccatagtgaaggaggcaagtttaaagagaagggtagagacatggagagaaggggtggggggtgcttgctccccaggaaagtggaaaaggggtgggaggtgcttgcaccccaggaaagtggaaaagcagcagagacacggagagaagggatgaggggtgatttccccccaggaaagtggagaaagggtagagacacagagagaaggggtggagtgagcagccctgggctgcaatgtggataagcagccaaagcaggcatccccgcaattgacttgccaccaagggaatgtgggtgaatgaccaaggcagacatccctgcggagatcagacaccaatggaatgtgggtgaataatcaggcaggcatccacacaatgattaaacaccaaggaaaggctgccttcccaagtccgtgaccagcaccggagttttgggtccatggataaaatgtgtctcctttgtctctaccagaaaatgaaaggaactgaaattaacagaagggagagattgaagggtggcgccaagattgaaaggagaaagaggttgagggatagtgagaggggttggacaagagagtaaaaataggccgcttacccaatttacaatcggtgagatgttccttgggctggttggtctgaggaccgaaggtcgtaggtggatctcttcacagagtgagggtgaggacaagggactgctctcccaaaggagtcccgctgacccgggtcttcggcaccaaatgtctcacatgtccttgtgaagagaccaccaaacaggctttgtgtgagcagcaaggctgtttatttcacctgggtgcaggcgggctgtgtctgaaaaaggagtcagcaaagagtggtggattatcgttagttcttatagggtttgggataggtggtggagttaggagcaatgttttgcaggcagggggtagaactcacaaagtacattctcaaggatggggagaattacaaagaaccttcttaagggtgggggagattacaaagtacattgatcagttagggtggggcagaaacaaatcaaaatggtggaatgtcatcagttaaggctattttcacttcttttgtggatcttcagttgcttcaggccatctggatgtgtaggtgcaggtcacaggggatatgatggcttagcttgggctcagaagcctgacactgagctcaagcaattctcctgcctcagcctcccaaagtgttgggattacagatatgagccaccaggcctggcctgattttttcatttttagtaaaaaatgcagtggtataagcagcaaagccttaggtgccacagtaatgacaaatccatccattcaaatgagagaaagtcatcctagacctctattcctcttgaactctcttagccaatcagtcaacaaatccccagatgtattaaattggcttcttcccatttttaccaactacgttccactttccaacttcagatcctccctgtatcttgcctgaacaactggcagtggttttatctggtggcactgccttttgctttcaccattcttcctgtttccatcagaatgagcttcctgaaacacaagtctgatcctaattacaatccttccaagactccacatcacccaaaggataaagttccaaacctaacataaagcaaaatccttctaacaaggtttgatgccacttctccagtctcatcctcactgactcctgatttattcatatttcatgacttcagcacacttctggaaattccctcagatgtctcaaccagcaaatgcaaggagaatctgcttaactgtaggactttagaagttagcaagataattccaaagacctcctctgtcagccactgatcggggatcttatcttacacagaatctaaagagatagagactctctaatccaccttgttttatttttacagatgagatcctgagtcccagcagaataaatttactttatctatgttatggtgggcaacagcttaagtcttctgattctcattctaatgctcaaaatccagtgagaagtgtgaacagatctgataaacaaaagggttgggaaggaggaggatatagccccagggagaaagggtccagaaaagaggatgcacattcatttccctaaatcagactccaaaagtgtaaaattaaaccaaaaaagcttatgaaggttagggagaagagagactagaaacttcaaaggggaagtggagacggaagaaaagaaatggagaaacagggaacttaagaaatcatctgcttgggagagggatgggtccagggccaggaacaaaggacccagatggttttaatgaccaaactctgcctcattactttcatctgactgcagcaggaactgtcatcggtggtgaaggcaccactggtgccttggaagtttctcactgaagctgggatactttcccacttgccaaatctcacaccaagaagcctgtttacccattctcaggactgttccaatattcaagcctaggttgaaatttataaagtgagtaacagtctccgaagtctcctttggtcctgcccatgatttactttaaaatataatttatgttggaatatgatttctggcttatctcggcctgcttgataaagcaaagaattgttaacacctgtgataaatacaaaactaccaaccaatgtgtgctcaaaaagaatactttgaggccgggcatggtggctcatgcctgtaattccagcactttgggaggatgaggcaggcagatcacaaggtcaggagctcaagaccagcctggccaacatagtaaaacctcatctctactaaaaatataaaaattagcagggtgtggtgccatgcacctgtagtcccagctactcaggaggctaaggcaggagaattgcttgaacccaggaggtggaggttgcagtgagttgagaccacgccattgcactcctgcctgggtgacagagtgagactttgtctcaaaaaaataataataataataatactttgaatacatttgattttaaggaaaatggtaaaattcatcttgaaacaactcttctctcttttcttcttgctgcccaatccccgcgaaagttgaattattattattattattattgttttgagacagggtttcactcctgccacccaggctggagtacaatagcatggctcactgcaacctccacctcaagcgattctcctgccttagccactcaagtagctgggactacaggggcatgccatcatgctcagctaacttttgtattttttttgtagacgtggggtttcgccatgttgcccaggctggtctcaaactcctgggctcaagcgatcctcccaccttggcctcacaaagtgccaggattacaggcatcagccaccacacctggcctaaaagttgaattcttaagatattccaatgttggagttacctatgttggggctcaaaaaccaaaataccaacatatggcattttgacatgctaaattaaaaaagtctcaaggtctctctgatctccctccctccctcccaccccccaccacctctcccagaatctttatctgcttaagatccaaacccaccaaaaggaacaattgtttttcttccccttccagtaagaccaagaatgttaccacatctgaacagatccttttaccttcaaagagaaatagatgcagaacaaattaatgcctgttcccagatctattaattctcccttgtaatcccctcaacagaatttctcttctcctcccatagcctgttttgcggaggtggtatacaagcttctaaccacactggagatgggcaattactctgagatacttctcatgcatacattgtacatgtgttaagtacatttgtatgccttttctctagttaatttgcctttcgtgatttgacttttcagataactctcagaaggccaaagaaaaagctttcccttgaccctcacacctacaattaatgaaatattcagaaacaaaaggtttcctagccaggcacggtagcttacgcctgttatctcagaactttggggagccaaggagggagaattgcttgaggcaaggagttcgagaccagcctggccaacatagcaagacccccatctctataaaaaattttaaaaattagcagggcatgatggcacactcctatagtgctagttacttgggaggctgaggaaggaggattgcttgagcccaggagttcaagattacagttagctgtgatcctgccactgtattccagtcgtgtaatggagtgagaccctgtctctaaataaaaaaagaaaaaaaaaagaggtttctccataggaacaaaacagtaacgtaactccatgaattctgaagtgaatcattggccttccatagacccacccaaatttcttttccaacaactcgagttaatatcagcaacatgagatcccagactgtgttctttttattagtttggaaagaatgactaatccctgtattctattcttggaaactgttattttcaccaacttaggaagaatggactaatactaatagtatctaacatttatagcactttcacagtttacaaagtcttcttccatataatcctcacagcagttccgagccgaagtgacttgccatggctcacctgtagctaagtggcacagctaggatataaacacaggttttctgaatctggccttcagttctaactgtgcactggacagggcatgtaatggtagctgctgaaactaatgacatccatgtttcagtggtggaacgcagtaaagttgattcctcattcttgtcacagcaatatgggttgatggggctggggattctgctccatgtagtcacgcagagactcatgttctttctacctgtgcattaatatcttctacatgtggcctccaaagctactagagaatgggaaatagtgggagatcacacatgggagctttttatgggccaggcctggaaatggctcacatcacttttgctcatgtcctttggccaaaacccaatctcagcaaggaaggccaagatgtaattcaactgttttcccagatccacagccttgggaaagtagaactgagaactttgtcttttagtactttagtttatcaggcctccgtgaagtcccttctgctgaggaggccatgctgagcagtctctggaagttttttattttccttcccatgtgatccttttgcttctctgagctcccagaactcctctttctttattcctcctacttttcaaacctttctcagaggctgttttaagatatataatgttatcttcttattttctgtaacttttcacttgtgtatttctccctgacatgaaacataaactctttaaaagcagaattgtatctactattgcaatactgtgagatacatttcctctagtcaccttaatcaaccctccacttcatccaaagaaattaaattctgccaaaattgatggaggcttattatgtacaaggtgctatgcttggtgccattggaagaagcaaagaggaattaggaatgggtctttaaaagcttgtaaaaaaaaaaggctatacgtgaaagtacaatcaagaatgtagaaatacactgataagaaaatatagttggaagaggctgattctgaattgacggaaaggggactggaaaagttttcactgaagaaattataaacatgatagaagtagctagcagttgtcgaacttttcctataagccaggcactgtattggagtgttttatatatgtcacaccatgtcattctcataacaatcttatgagagggcactgtcattgttcccattaaccaaataagaacaaacatggggagaatttgctataaaggacgtttctgggtcaattggtgagatgtcaatatggactgtagattagatagataatcgtattattgtatgaatgctaaatctcttgattttgatcattattttctggttatataaggaatgtccttgttttttttttttttgagaaggagtctcgctttgttgcccaggctggagtgcagtggtgtgatcttggcttactgcaacctctgcctcccaggttcaagcaattctctgcctcatcctcccaagtagctgggattacaggcgctcgccaccacgcccagctaatttttgtaattttagtagagactgggtttcaccatcttggccaggctggtcttgaactcctgaccttgtgatccacctgcctcagcctcccaaagtgctgggattacaggcatgagccattgcacttggccaggaatgtccttggtttttttttttttttttggaggtggagtttcactcctgttgcccagcaacctctgcctcccgggttcaagccattctcctgcctcagcctcccgagtagctgggattacaggcatgtgccaccatgtccggctaattttgtatttttagtagagacggggtttctccatgttggtcaggctggtcttgaactcctgacctcaggtgatctgcctgcctcggcctcccaaagtgctggcattacaggcgtgagccaccttacccagccgaatgtccttgttaataggaaatttactctgaagtatttaggaataaaggggcatgatgtcataaatttcctctcaaatacttcagaaaactgtaataattagatgtgtgtgcattcatgtgtatggagagagagagagagaaggaaagaatgataaaacaaatgcagcaaaatgttaacaattggtgacatatggcaggttgggctgctataacagaataccacggactaggtggcttacacaacagaagtctattttttttatagttctggaggatggaggtccaagatcaaggtacagcatgatcaggttctaataagaactctcttcctggcttacagatggctgtcttcttactgtgttctcacatggcaggggggtagcaagttctctggtgcctcttcttctaagggcactaattccattatgagacccaactctcatgacctcatctaaaccaaatcacctcctaaaggcaccaggctaaataccatcacactgagggttggggctttaacatatgaattgtggggagacaccattcagtccatagcagtgagtgatgggtatagtggaaattttgtactatttttgctacttcctgtaagtttagaattatttaaaaataagaaggtaaaagaaaaaagaaaaaacattggcataaagtgttttacccaggtcacgcagctggtgagtggtaggaaatggtcttttcctatgttctttagaacccactctcttagatgctgcacggacacagatgctttgtgacttctcatatcctctggcatggtccacctcctcaatcataccgcagctgaggacaaactaggccctcccccttggctagtgctctgcagctggatcaagcagacgctcttccagaatgtctggcttctcccactgcttccggatttggatgaaatgctgtgctgcagggcataggatcagataggcaaaaggaaagaatgatgcaagcaggaatgcaaggtagtttctgcctgcagagcaaactttcgccaattagggccgtgtgcagtggctcatgcctgttattccagcactttgggaggccaaggtgggcggatcacctgaggtcagaagttccagaccagactggccaacgtggctctactaaaaatacaaaaattagctgggcgtagtggtgggcgcctgtaatcccagctactccggaggctgaggcaggagaattgtttgaactctgggaggcagaggttgcagtgatccgagatcgcgccattacactccagcctgggtgacaaggtgagactctgtctcaaataaaacaaaacaaaaccgcaacaacaaaaaacacactttggccaactggaagcgggagacagggtttcgtctaccttcctctcttccacggacaacctcaatgtgagagaagttctgtgtgctgagcacgcacccgcacaacagagtaaaacattactttatattgcaattttatattattattgcactttatatattaccttaatatagtattataatattataattatataacattaatatatattaatatataatatatacattatattattgcactttatattgcactttatatattactttatattgtgcaatatattactttatattgtacaacagagtaaaacattactttatattgctccacatcttttcttgccccacttccccttttccccatcccagctgctgtgggtttgcacttctcaaaggaagcattagcactttaatccctgccttgggctctgttttctagagtactagggctaattagagaaaaaaaaaaaaaaaaaaaaaaagggccgggcacggtggctcctgcctgtaatcccagcactttgggaggccgaggggaggcgggcggatcacgaggtcaggagatcgagaccatcctcgctaacatggtgaaacaccatctctaccaaaaacacaaaaaattagccgggcgtggtggcaggcgcctgtagtcccagctattcaggaggctgaggcaggagaatggcgtgaacctgggaggcggagcttgcagtgagctgagattgggccactgcactccagcctgggtgacagagcaagactctgtctcaaaaaaaaaaaaaaaaaaaaaaaaggccgagcacggaggctcacgcctgtaatcccagcgctttgggaggccgaggtagatggatcaccaggtcaggagatcgagaccatcatggccaacatggtgaaaccccgtctctactaaaaatatgaaaattagccggatgttgtggtgcgtgcctgtagtcccacatattcaggaggctgaggtacgagaatcagttgaacccaggaggcggaggttgcagtgagaattgcactccagcctgatgacagagtgagacactccgtctcaaaaaaaaaaaaaaagaaaagactatgctgtactgcccctaatttgagctgagtcctaaagacaggtaatattttgacagccagaaatttgagagaaaggcaatacaaaaagaaggaatggctttatttatttttgagacagcatctcgctttgtcatccaggctggagtacagtggcatgatcatggctcatcacagcctcacactcctgagcttaagcaatcctcccacttcagcctcttgagtagctgggactacaagcgggtgccaccatgcccagatgattttttaatttttaaaatttttttgtagagacaaaatttgctatgttgcctagactggtctcgaactcctggcctcaagagagcttcctgccttggccttccaaaatgctgggataacaggcatgagccacagccaggccaagaaataggagtggtcttaggtaaagcatgagggataacagtaaatggcttgctgaggctgtagtatggggcaggcgggtggtaatgggatacagggaatgaattgagatgcaataaggttgggcacggtggctcatgcctgtaatcccagcactttgagaggccaaggcgggaggatcacctgaggttgggagttcaagacaagtctgaccaacatggtgaaacctcgtctctactaaaaaaattagccggtttagtggtgagcgcctgtaatcccagctactcaggaggctgaggcaggagaacagcttgaacccaggaggcggaggttgtagtgagccaagatcgcaccattgcactccagcctgggcaacagagcaagactctgtcacacacacacacacacacacacacacacacacacacagatgcattaaaagatgattggcttaaatgcctgctgtagagttcagacaacattctgtgggcattagtgagccatgaggactttttgaggtaggatgaataaaataataataagaatggtgatgacaataagtatgaggatgataatagtagcattactaatgaaaactaatgtttattaaatacttattaatactatttgctcatctttgtactaagcatttttcataaattacttccttttattctatcaataatcctatgacatgggtactgttattattccctaaagcttagaatggttaataaacttggtcaacgttacacggattttgaaccctagaatgccacgcactttgccaccagagctagttttaggaacataattttgggaaaagtgtgaaagctaaagacattagaagtagggctgctcatagtcaaagatttttccagctttttttttttttttaaataaaagatagaaagaaatgcgaaacacaactttccttgtccatatttattttatttatttatttatttattttcttgagacagtgaggcatgatctcagctcactgcaacctccacctcctgagttcaagcaattctcctgcctcagcttcccgagtagctgggattacaggcatgcgccaccatgcccagctaatttttgtatttttagtagacacggggtttcaccatgttgaccagactggtctcgaactcctggcctcagatgatccacctgccttggcctcccaaagtgctgggattacaggcgtgagccaccacgcagggcatattttctccctcttttgttttacttcagccacattggacccctagctgttccataaacacctcaggctcaccctcacctgagggcctttgtacttggtgctccacatatctggaaatcctcacccctcccctaaccacacctagcacttcctagcttccttccctgtttcatagtaatccttgggttgctataacaaaatactacagactgagtggcttagcaacaacagaaatttacttgttacagttccagaggctggaaaatccaacatcaaggctcccgcagattagaaatctgtggagggcctgcttcaggttcttagacagcagctgtcttcttactgtatcctcagatggtggaagaggcaaggaagctccctggtgttcctttatatggacagaaatgtcattcatgagagctctgccattatgtcctaatcacctccccaaagaccctacctcttaataccatcaccttgggggttggatttcaacatatgaatttgttgggacggggggcagcaaaaacatacgcaccataacagtcactgtctaacatactgtgtcttctaaccagctcttctgtttaggatctgtgtgcctccaccagtagaatgtaagctctactgtgttcactgttgggatgctttagcattcaaaacaatatctgccatatggtaaaattcagtacagtaagtggttgtcaagttaattaattaacttttgggggtgattgttctgcaaggcactttgctattgcattagctcaggatgaaaaagataggaggtcttggaagcccaggcctctgtgggtctccctgtaaaacagcaaagggtttagttacattactaatttttttttttgagacggagtctcattctgttgctcaggctggagtgcagtggtttgatctcggctcacttcaacctccaactcccaggttcaagcgattctcctgcctcagcctcccaagtagctgggattacaggcgtgtaccacgatgcccggctaatttttgtatttttagtagagacagggtttcaccatgttggccaggctgctctcgaactcctgacctcaggtgatccacctgccttggcttcccaaagcgctgggattacaggcgtgagccatggtgcctggcctagataaattacttttgtgatgcataggtcagaccattcttcaggactgaaggtcttatttcctcagctgacagcctttttgggagattatctcagctgaagagaggtgcctcgtcaattgtcacaattttgtctcagggcagcccaaatccagtgactgatgtgtgtaaattttagaggccctgacctcttgcctcggtgtaggacaattctgaagtgtcccccatctttagaactcccgtggggttggctgtggccttcatcatgtctgtgtggtagctccacttcttcctgtgcccaattttgcttcattttctttccttccacaggtgtggatggcaaatgcactcccccatacacttcctgcacactaactccatctcagaggctgcttcccagggaaccctacctgggataactccccaaatcaagatgcttctctatttctgatgtttagactcacaaagactgactctttgtcataagagggaaaaacagactgcctcctggaaaagtcaattagcttaataaaggccaagaggtaatatacctcggaactctcaaaatcaatggcacgccattactgaggaaatacaaaacatatccaagcagttctaaagaaagggattgttatctttggggttttgggaattttagtgtcatgtccagataacatatactcttttaactggggcctcctgaagatagctcatgcccttttatgagaatgctgggaagaccatagtcttctctgtaccttggcatctaaaaataatcagagttaatggagtctaactttcgggaagcctgaggcagggaggggtaaagtgaagcagttacaggtttttacacatacttctgtgttatttcaacatttcgggagaaaatatttaggtttacttttccaagtcaaatcaacaaaaaatttaaagactaaaataaaatacatgttttctgaacatcattgaatctggggacacaggagtccactccctggcagtgtgcctggtgttgccattccagccattgctcccagctgctactccccatcaaatacatctgagcagatctcgagacatcttaggtgctgcttctagatgttctgtgctgacaacacaaagaccaacctccttaccacaatattgaatgcctttcacagtcaaactgcaaccagatactccaggttccattgtaaggcttggaacattttctttcctccctgccactgactttcagaaccacttcctgttcccttcccaactctttgtttttgcatctactaaaattcctctttctctcttcctctaattctgtgcctgctttaatggcacttgtctaccagccttcggactcccccggttcctccattcatcacttccacctttgttctcatgcagcatcttgtatttatcgcatttcaaccttttctctttattaaaaaaaatcacaatattagtaaatgtttatgtaaaaaagaaacattaggcctagcatggtggttcacgcctgtaatcctagcactttgggaggccaaggcgggtggatcacctgaggtcaggagttcgagaccagcctgaccaacatggtgaaaccccttctctactaaaaaaatacaaaattagtcaggcatggtggtgcacgcctttaatcccagctactcgggaggctgaggcagttgaatcgcttgaacccgggaggtagaggttgcagtgagcagagatcgcatcattgcactccagcctgggcaacaagactgaaactctgtctcaaaaaaaaaaaaaaaagaaaaaaagaaaaggaatattgaaaaatatacaattacaggccgggtgcagttactcacccccgtaatcccagcactctgggaggccgaggcaggtggatcacttgaggtcaggagttccagaccagcctgggcaacatggtgaaaccccatctctactaaaaatagaaaaattagccaggcatggtggcacatgcctgtagtcccagctactccggaggctaaagcatgagaattgcttgaactcaggaggcagaggttgcagtgagccgagattgcaccactacagtgagcctagattgcaccactggactccagcctgggcaacagggctagaatccatctcaaaaaacaagtacatagagtggcaagagtgaatcccttcacccacgtttttattcagaagctggttggtggggttagaagaggtacccagtacagaagtgctcattatattattttgtgtacatttttgtatctgaactatttcatacaaaagtaatagtctttcattttctttgccactcatcctgtttgctagaaaaatgactgttaatagtttattgggtgctcatttttctagagtatttgccatgtttccaaacctataaatagacacaaatatgtaattttttatacacatggaaccatactatacctattgttctataatttaaaataaattaataggctttgtttcttagagcgggtttaggtttagagaaaatcaaatagataggagtcctcggctgggcactgtggctcatgcctgtaatcccagcactttgggaggctgaggcgggcagatcacctaaggtcaagagttcaaaaccagtttggccaacatggtgaaaccctgtctctactaaaaatacaaaaaaaattagcctggagtggtggtgcacacctgtagtcccagatactcaggaggctgaggcacgagaatcccttgaacccgggaggcagaggttgcagtgagccgagatcacaccactgcactccagcctgggcaacagagtgagacttggtctcaaaaaaaaaaaaaaaaaaaaaggagagagttctcatttactcccctccctgctcatagtttcccatgttattaacatcttgcattggtgcggtacatttgttacaattgatgagctaatattgatacattattattggctaaagtccacagtttacattagggttcactctgtattgtgcatgttatgggttttaccaaatacagtcatgtatccaccattacagtatcacacagaacagtttcactgtcataaaagtcctctgtgctctgcctatttgtccctctcccctaaccctggcaaccactgatctttttactgtctttgtactttggccttttccaaaatgtcatatagttggaatcatacagtatgtagccctttcagactggtttctgtcactcagcaatatgcatttaaagctctttcctgtgttttaatggatataatttatttttaaataaattgaaaaataaaataaaattaaaaatgataaaaatacatcggtggatataaatatttttccatgtccttacatagagagctaccttttgctttttaatgtctacatacatattttacagtatgactgtacaagcaattttactctttttcttttctttctttctttctttctttctttatttttttgagatggagtctcgctctgtcacccaggctggagtgcaatggcgtaatcttggctcactgcaacctctgcctcccaggttcaagtgattctcctgccacagcctcctgagtagctgggattacaggtgcctgccaccacacctggctgattttttgtatttttagtagagttgggatttcaccatgttggtcaggctgattttgaactcctgaccttgggtgatccacccaccttggcctcccaaaatgctgggattacaggcgtaagccaccatgctcggcctgattttacccttttcttcttgacagacacataggttttttttcaaatttttgaattgtctgtttagctcctactaaactttgtacttcttagcctcaaaacatcatattcagtaaaaagtcattattgtttctgtcagcaaagaagacctatttatataagaaaacgttggtggtaactcaaagaaagaagatggaagggtcctgtaagtgatgacagaggcatttagaggagggaaggtgcagcaggctggcaccagatgatcaggaaggacttgacggagggggtgggcttttaaattgagccttgaaagaatgggtagggactgggacgactgggagattttgatcctttctgtttctaaaatgaagaagccacctcagcctgttggtgctggcatcggcattgttgctcagcagcctgagggcttggaaacatgcccacgctgtctgctaaagccttctccatctgccttgcttcacccgagggagcatgtaaaggaaaggcagacacactattaaacagggcttcctgaaaacatagatgggtatgcttgtgcgactcccaggcagaccctgaccaaaaaaggcaaggaggcctggccttcaagagctcttgttcccaaaatattctttgcttgtgaaaatcaaataaatgccaaaggactcatggggtaattgcctgacagctcctggggctaaaatctcataacatttcttaccctctctggtacagaaaacatcacgatacatctcatcttcttctacactgatttttctcatactcaagaaccacgttagtcaccttaacttctgtaggatctactcctcagagtaaccccggtgttggttgctgaatgactgccttggtttgaatgtgtccctcaaagttcacgtgctggaaacctactcccaatgcaacagtattaagaggtgggacttttaagaggtgattaggtcattcatggattattattattattattattattattattgagacagggtctcattctgtcacccaggctggagtgcagtggtgtaatctcagctcactgcagccttgagctcaagggctcaattgatcctcccatctcagcctcctaagtagctaagactacaggtatgcacaaccacacttcactcattttcttttctttttcttttttttttgttttgtatggagacgaagttttgctatgttacccaggctggtctcaaactcctggactcaagtgatctgcctgccttggcctcccacagtgctgagctcatgggcctgagcgaccatgcccagcccaaattaatctttttatttttattatttttattttattctttttcctttaaaaaaatttttttaaaatcttatttcttatagagacagggtctcactgtgttggccaggctggtcttatactcctgggctcaagtgatcctcccctcttggcctcccaaagtgctgggattaagggcatgagccactgtgtctggctatggattggtgtttttagcacgggagtatgttacttactgtggggatggttttgttataaaagcgagttcagcactcttttgctcactcttgccatgtgatgccttttgttgatgcaacaagaaaggcctcagcagttgaagcctctggatcgtggacttcccatcctccagaacagtgagcaaaatgaacatctttttttttttttgagacagagtctcgctctgttgcccagactggagtgaaatggtgcaatctcggctcactgcaacctctgcctcccagttcaagtgattctcctgcctcagcctcccaagtagctgggattataggcgccctgtaatcaccatgcccagttaatttttgtatttttagtagagatggggtttcaccatgttggtcaggctggtcttgaacttctgacctcagatgatccacgcacctcagcctcccaaagtgctaggattacaggtgtgagccactgcacccagccatgagcatctatttttataaatcacccaatctgtggtattccgttgtagctgcacgcaaactgacaactaaatgaacaaacactgttagaagatacttctcggcccggtgcggtagctcacgcctgtaatcccagcactttgggaggccaaggcaggcctatcacaaggtcaggagttcaagaccagcctggccaatatggtgaaactctgtctctactaaaaatacaaaaattagccatgtggtggcaggtgcctgtagtcccagctacttgggaggctgaggcagagaattgcttgaacccgggaggcggaggttgcagtgagccgagatcgcaccactgcactccagcctggcgacagagctagattccatctcaaaaaaaaaaaaaaaaaaaaagaagaagaagatacttctcatactttgggtctccctagaagcatactctggaacaaggattcctgtgtaagttgtttagttgggaattgatcccagggacaccataagggagagaggaagtgagatggggaagagaaagggaggcagccaataaaagggtgtgttattaagcaagttttctctgtgggcagctagagtctaatctcagggaagctctgggaaatggtacaaaacatgtcctcagaattatcccaccccagggtgaggtggctcaaataatttatatgccaaatcctgagagtcatttgttgagggctgctcctgggggagtcataatttcccagccctttcaacctgccacacatagaaggacagggtggccttccacagtttcagaaactccctcaggctccatgatgcagacgctggaaggtggaagtcggccagagcacactgacatggaaagtctgagggaaagtctgtgggcgaggcacacactgcattttctacacccctttccagggaaaaatgtccacaggagacctgaatcctctccatagcatttgtgacaactggttgttcccatacccaccccacacctgaactgagaagaaacttagtacatatcagggcaaatgatttcattgctggcaacttcaagtgttgaagtgctttcccatgtatcctaaaatctccctgtccctacattcctcagtggctgctagttcaactctctggagctgctcaaaacacctaaagccttttctgcatgtcagcctttaaatatgtgaaatagtcacaatagtccctctgtatacctgtggttccctgttttttaaacatctgcaattctttcaacataatgcttacatgatatgattttgagttcccagccatccctcacacacctaagaaaaattttttataaagggaaaataaagtatccactaaggaccatgtactaaattgcttttaaacactggcgtcccttcaacccacattctttaaatatgtgatgacaacatagtgagaaaagaggctgggcttccttggggagatggatggaggatgaaggtcgttaacaaggctcagtgtcccctctacattccagcacaattcaactcttgttacaaacttgcaaatacctacaacaaaagtaaagccctgtaagtaattgttgtatcttctccaaaggcatattagggatttgagttcttgttctctacccttaccccaaattgtttatgaatatattcctttcagtcatgtgtagcacttttcctgagtggactaggggaatttgattttctccatcttgttacatttctagtacagtcttgttgagccccgtgctcctttcacagattaattcctttcccagcagttgctcagctttcctgacaaggcttatagtactttctgtaatgctcattgcaccccttggagaaaaagattattcctgttatattacagaagaggacattgagcctcaaagaagtgaatatttttgtctaaagctaaaatgggaacctaggcttgcctgactctcagcaatttctgttatctttttcctgtttaggatccattcctccttattctggtatagtgcccacatttatcttttggaaaccgccccctctacttacttcaatctttgttatttgggtgaagatgtctccatcccaggttccaggcacaagccagtcaccatacactcttcccttggccagttattggttcaaagatgagcacgtgaccagagttaggcccttattttattttattttattgaattaattaatttattttttgaggtggagtttcactgtgtcgcccaggctgaagcacagtggcacaatctcggctcactgcaatctctgcctcccaggttcaagtaattctcttgcctcagcctcccaagtagctgggactacaggtgtgtaccaccacgcctggctaatttttgtatttttagtagagacagggtttcactatattggccaggcttgtcttgaactcctgataggcctgccttggcctcccaaagtgctgggattacaggcgtgagccatcgtgcccggccaggcccttattttaatcgggtgaaagaaagcaagaaattctttccaataagactagaagttgtaagggtgatgtgagcctgaatctaccaggagccaccacgaagagcctaataatggagccatcaaagaggataattgagataagggggagagagggtgagctcagatggcatcactggagttcctagatccagctgtatctatttatctctggacttctctgttacaggatcaataagtcaaaatcagtctctctatccaccccaccatgttcttccccctctgcctctttctctctcttctccttcctccctctctacctcctaagcaagtttgagctgatttattatttgcaatggaccaaccaaaataattgtaacaaattggtactcctctccccaagctcttcccacaacagtgcacagattacattttggtatagacaccacacatacccacatccacgcaatcatttatttttttcagacccatttgctctcacaaactgatatggtttggatgtttgtccctttcaaatctcatgttggaatgtgatccctaatgttggaggtggggcctagtgggaggtgtttgggtcatgggtggcagaaccttcatgaatggcctagtgccatcctagtaataatgagtgaatggttgttctattagttcacgagacagctggttgttagaaggagaccagcacctcctttcttctctctcttttgttccctctcttgccatgtgacacacctgctccctctttgccttctgccatgagtaaaagattcctggaggctcaccagaagcagatgctggtgccatgtgtctgtagcctgcaaaactatgagccagataaacttcttttcttataaatttcccagtgttgggtattcctttatagcaatgcaaaatggaatgacacacgctttgagagaagctggggctgggtccgtattaagttgttataatgtgttgttttttttttttctgagacagagtctcgctctgtcacccacgctggagtgcagtggcacgatcttggctcactgcaacctccgcctcccaggttcaagccatactcctgcctcagtctcccaagtagctaggattacaggcatgcgtcaccatgcccagctaatttttgtatttttagtggagatggggtttcactatgttggccaggctggtcttgaactcctgacctcatgatcctcccacctccgcctcccaaagtacaggattacaggcgaaagccactatgcccagcctatagtcttttttataagtgaagaaactgagactcagagaggctaaatgacttatctaagatcatgcagtgagccagtggatggcagacctggtagaaggacccagacaccgggtcttaggccagtgttctttccactgtatcttgctggattcctgggctcatgactcaccttaatcaacaagctacatgattctccaaaaaagctcatctctctggactttaattctcaactacaaaatgaggaagttggcaactatgattccaaagggctcttccaaaacttgtattcaggtgctccatgatattgcttcataactgtgcctaggactggctaggttgactctaagaccctaatgagagaatgtcacatcagtcagcatgcacacacacacacacacactcatgtacacacctgtcattaaagtctctagtgtttttgtgctgagaaggagcaaacattggtaacaacccaagagtaataaaataattgtgtagatgctccgtaccccatctgttctattcctgtttttaaaacgagtgccatgtgctttaatcttcttgtcttttagtccccaaacaaaatgaaataaagcagtctttgcgttgctgcatttccagtgacaatgagacaacgggctctgcaccagtcctgggtcactcactgagctctgcactggggagtgggaaagtggaggagctgaaaagcctgcctcctcccattccttaggtgtggagacaaggttcagacacagctctgagccaaacatgtgttctcccagctggggcctatggcttctcaagatgtcaaacagggaagtagtatgtccacacactgatgtattactgataattcatttatctctcttcttttttttcgagacggagtctcgctctgttgcctaggctagaccagtgcagtggcaccatctcagctcactgcaaccgtcacctcccgggttcaagcaattttctgcctcagcctcctgagtagctgggattacaagctcccaccaccatgcccagctaatttttgtatttttagtagagatggggtttcaccatcttggccaggctgatcttgaactcttgaccttgtgatccaccttcctcggcctcccaaagtgctgggattacaggtgtgagccaccacacctggcaataatttatttatcttattattttatttttattagtaccaaagaccaagactagtggtgttttgttttgttttgttttttgttttcgagatggagtctcactctgttgcccaggctgaagtgcagtggtatgatttcagcacgctgtaacctccgtctcccaagttcaagcaatactcctgcctcagcctccggagtagctgagattacaggctcccaccaccacgcccagctactttctgtattcttagcagagatgagatttcaccatgttagctgtgctggtctcaaactcctgacttcaagtgatctgcccgccttggcctcccaaagtgctgggattacaggagtcagcccctgcacctggcccaaaactagtgttaatgagaatctaaatccccattagactacctgcttgttgtgggcacctccctggccttcatttactttgcagattcttttagtcactcttggacttttctttttcctgcatactgctttaaaagatttctaaaaggaataggagcacaaaggatattgccttgctatattttgttgaaccctaattgtgtcggaaaaaactcaaaccatctgtctgctgttctcacaccacaacaacaacgaacacagaagacttctgtgagcaaatgtgtgggagtttctccccacacaccatgcaagcaatcagttttgcagtggatcccagctgtatagcatcagaaaccacaggatgagggttccatctcacaagtctgccccctctccttcccaccagtcatgaatctaggcccctggaacatctgaccaaccagctttaacttggggttttcacaacccccgatttgggttggattaatttgttagagcagcccacagaactagggaaatacttatattgaccaatttaatgcaaaggatatcttaaaggacacaaataaacagccacatgaagagatacacaggatgagttctagaagagtccttgagtgcggcagttttgtccctgtgaagttggggacattctcttggcacatggatgagttcttgtgcacttccctgaaagctgggggatggagctgaaagtcccatcccctctaaccctgccttgttccttctggtgaccaggcccccatcctgcaactacctaggaactgccagccttgagtcaactcagtgtatgaaagacacttatcactttgaatattccaaggattttaggagttgtgtgccagcacacacggtcaaagaccaaatatatatttctcagtatcatacaaatacaaatccttcccagtgaactgcaatcaactggctcgtgagaatcaggatcattagcaacccaagaatgtttcttgagttcctgcactctcctcatgcagagctcctgcccagtcattgttctagctgcttcattgctcccttcgtaagggagacactatgtcctgacaaagcattacttgcccaaagtaatgtcctgtactctgtctgttctttagaaaattagcattacactgtcacatgttcaccttttactatcccagatgttatctctgaattcaggattagttttagttaataggactttaaaacttttgctggggtgggagggtaggtgagtatactggagtgtagaaccatattccaaagctcaacaagacaacagcaaagcctcactcattgtttaatttagaataaggtgggacatggtcttctatgtgaaggaaaaaaggcacttggtataattctgactttcctaggagtcaggggtttccagattggcctctctcttttatttttttgagacagggtctcactctgttgtccaggctggagtccagtagcataatcatgacgaactgcaggctctaccttctgggctcaggtgatcctcccacctcagccccccaagtagctgggggactataggtgcgtgccaccaggcctgctaatttttttttttttttttttttttggagagatgaggttttaccatgttgccaggctgttctcaaactcctgagctcaagtgatccatctgccttggcctcccaaagagctgtgattacggcattagccaccgccaccatgcccagaccagattggcctattattgatgtccaagctccttcagagagaaccttaatgagagctccataccttgggcaatatgtacattttaacacttcaagaaggaaaagtgataaacttcccagatagatttcctgctccacaaactgacaataatgtcccagagttcatacgatgtagccataaaacactggagtgttgtttctgtaagaagaacacctctgtcatggcgtccatctgtagaaaccctgccctgtatcataagcctggatcctctgcttagatgcagacaatcccttaatatggacgtcagatccattacttaattcttgaaccactggggaattaaagaccaagagtactcatgaggccaggcatggtggtcctcacctgtaatattaacgctttgggaggccaaggcaggaggattccttgagccctgaagttcaagaccagcctgggcaacatagggacgccttgtctttacgaaatataaaaataacttagccaattgtcagtgagccgtgatcatcagatcacttccttccaaactacgcaacagagcgagactgtttttctttttttaaaaaaagagtgctcatggaacagttggcctcagagcaatgtctcttgttaaattgttggcaaccacaatatcagcttgctgttcccttataggcatagaccaaaatttgcttctccagtttcctgaaataacttcctggtctaatctaatcttgccaatcccttaagggccagctcaaaccccatcatcactggttccataaaggcattcccaattacctctctctagccacagcctgcagtcttaagctgtcttatttccttcttctttagaatctaattcaaactccccacacctgcctttgttcttggtctatattttggaggttttttacctcttcttgtctcttcctctttctccctaacatctttctgatttctggggctctggaccttgtgtctcatttcctgtatctagccttacacttgcccctggtatctgatactgatatggcttctctggaaatgaccagagctcccttctttggctccaatattggtacttgccttttggattttgtccactaatgaaagatctggatactttgcctgactcactccattcctggaacttacctcagtgctgacctctaaggccagctagtttctggtcctgtacaaaggaaactgaacaagcatagcaagtaatgtattttcctttggctaaatgtcttaccccaggtagacagtaactctcctgatgtgggaccacaaatcataaaatagggaaggcctagcctcgtaagttttggagttagatgtttctgagttctaatcgcagcttgccattgaattcatttacttattatgatcttgggcaagtaatgagcctttttgaacctcagtttttttcgtatcagttaaatgggaataataataatagtacctaataggattaatgcgacgattaatgaacaataaagcgaaactttgaaatgttaacaaaatcctttcacactagtacaaactctaatgcttggtccaaggatggtgtggggggtgtgtgtgtgtgtgcgtgttactaggaaaaaatttccaagaactgtcagggtctatgcagaatatccggcacacacaaagcactcaataaatgtaagcttaaaaaagaaaagcaggccaggtgcggtggctcacacctgtaatcccagcattttgggaggccaaggtggacagatcacttgaggtccggattttgagaccagcctggccaacatggtgaaaccccatctctactaaaaatacaaaaattagccagacatggaggtacgctcctgtcatcccagctactcgtgaggctgaggcaggagaattgcttgaatccagaaggcagaggttgcagtgagctgaaatcgcatcactgcactccagcctgggtgacagagtggggactctgtctcaaaaaagaaaagaaaagcaatagaagattgaaagtcaatagatggggccaggcatggtggctcatgcctgtaatccctgcactttgggaggccgaggcaggtggatcacctgaggtcaggtgtttgaaaccagcctcacctacataatgaaaccccgtctctactaaaagtacaaaaaaaattagccgggcatggtgatacacgcctgtaatcccagctacttgggaggctgaggcaggagaattgcttgaacctgggaggcagaggctgcagtgagcctaggctcactgcactccagcccgggtgacaacagtgagagactccatctcaaaacaaagagaaagtcaacagatggatcaccatccttccagatcagaaaaacaggctggggcaaagggcaattgcttacgcttaccttaccgatttttccagggtttaagcgtgctgtgaaaatttaaatttctttctttctttctttctttcttctttctttctttctttctttctttctttctttctttcttccttccttccttccttccttccttccttccttccttccttcctttcttctttctttctttctttctttctttctttctttctttctttctttctttctttctttctttcctcctttctttctttttgagatggagtctcgctgggtgcagtggctcatgcctgtaatcccagcattttgggaggccaaggtgggcagatctcctgagtttaggagttcaagaccagcctgggctggccagcatggcttaaccctgtcactactaaacatacaaatttttctttcctttttttttttttttttttttttgtgacagagtctctctctgtcacccaggttggagtgcagtggcgtgatatcagctcactgtaacctccacctccctggttcgagcgattctcctgcctcagcctcctaggtgtgaaagcccagtgacagcttagtagaggagatagttggggtatggactctggattacttgacttacatgtaaaaggtaaactttactaggtttacctagtaaaggtaaaaaaaaaaaaaaaggtaggtgagtcctttactatttctaggaattggctagccgttagagggtcagtccctccagggtgcagaaaaccgcccgtgtcaaagcacccaaaacccttggttaacacaagtttcaacaatcattgtcagagccagggactgtattagtttgcgagagctgctatagcaaaataacacagactgagttccttatacagctatgagaaatttgttttctcacagttttggaggctagaagtccaagatcaaggtgttggcaaggttaatttcattctgaggactctctccttgccttgcagatggtcaccttcttgttgcatcctcacatggtcttttctttgtgcatgcacctctctggtgtctcattgtgtgtccaaatttcctcttagtatgaggacaccagtcagattagatctgggcctaacttaacagcctcattttaacttcatctctttaaagaccctgtctttaaatatagtcacactctcaggtaccgggggttagggctccaacagttgatttttaggaggacacctttttgatcacctgaaaacaagagatggatttggggccggtcgcagtggctcatgcctgtaatcctagcaatttgggaggtcaaggggggtggatcacctgaggtcaggagtttgagaccagcctgaccaacatggcgaaaccccgtctctactaaaactacaaaaattagctaggcatggtggcactgcctgtaatcccagctatttggggggctgaggcaggagaatcgcttgaacctggagggtggaggttacagtgagtggagatcgcatgacaagagcgaaactccatctcaaaaaaaaaaaaaaagacacagatttggtagagggaaagatacactcatgaggactatgaggtagcaacatttgggtagtatgtgaatatgacctcactcatatctatgagctttgggggcctagacaaatttagagtgcagaggtgtttgcttatgtgaaagaatatcaataaatctatatggccaggaacggtggctcacacctgtaattccagcactttaggatgccaaggtgggcagatcacctgaggtcaggagttcaagaccagcctggccaacatggtgaaaccccgtctctattagaaatacaattagctgggcatgatggcgcatgtctgtaatcccagctattcaggaggctgaggcagcagaatcacttgagcccaggaggcagaggctgcagtgagccaagatcgtgccatgaactccagcttgggcaacagagtgagactctgtctcaaaataaataaataaataaataaaataaatctatactgaatcaagattcaatcaataccaaaggccaatgtccataactccagggggatcaaatcccctttcaaaagcacatcaatcatatttacttgcattaatagttaacgccctgacaatgtagagcctgggtcctctctttgacagcaacagttcatgcagatattgcagagaaagagggccaacaggcttgactgtctgaaagagagtacatgatatacaggttttaaagttcaatggaccaacaaattggccattgacttctttctcctcttccctggtcaggagaatcttgtataggctctcttcttgaacacacacacacacacacacacacacacgcatgcacacacgcacaccaaatttgttgcagcccaccaaatttctccctcactagttaccatgcaggactctagagaattccttttgtgccacctatgctctgcttgaagaggtggttgggaacagctggcagaagccatgctgcttgcctctcttcctctccatgccccttccttctcacaggaagtataaaacctttgttatgaataaagagagagagagagagctcataggtcatgccaggaactctggctccagctcttcaggagtaaacggtccagatttgtcaataaccatggtgttcctagcagtatttgggttttttttttttggagtctttgcttttgtggcccaggctggagtgcaatggcgtgatctcggctcactgcaaactctgcctcccaggttcaagtgattctcctgcctcagcctcctgagtagctgggattacaggcacacaccaccacacctggctaatttttgtattttttgtagagacagggtttcatcatattggccaggctggtctgaaactcctgacctcaagtgatctgcctgccttggcctcccaaactgctgggattacagatgtgagccaccaagctcagccttctagcagtatttgaattaaccaagcaataggactgatggaagcagatttgcacaaagtgctctgagaggctttgtaccagtcagaggtggtgaatgccagtaaggaaaaccaacgctggataacttaagcaaaaagagagattcctggaaggttatcaggaggcggttcacaggatccaccaggtctggagtaaggagggtagaaatccttggaaacaggttggaaatgagaaggcttcagaaattgtcacagaaacaatctgggtgggggttctcattatctttctaaatgtcaacctgttgctggacttgaccacaaaacatggccaccagtggatactgttgccactctgcaagtgcacaccagcaggcctatgctttttgcattatactctgccaattcaaagtgtcaagagtgatcatctgatcaattggcctagcttccttgcttgaacccctactactaggggcagaagaaagtgggggctatctcccctttgtcttcccctggtcttagaaagttgggaagaacagtgtcttataataataggcatattggtggatttctccaaagtaaaaagggaggttgaatgttggaaatgcaaaaaaattaatgaagattcaccacaactatgactctagctacagaaattaaaagctatgtcaggaaaaagaatactgaatgtagaattgtattaatatgtatgtaccagcccttagctggtgaagcagagaaagcaagatgtacactgaaaatctgtgcccttcctttcaaagtataaagttgtcaaagggaagtgccttccaagctagagactacatttaccgacactgtttttttttgtttgtttttttgaggcagagtctcgctttgtcacccaggctggagtgcagttgtgagaccacagctcattgcagcctcaacctcctgggctcgagtggtcctcctgcttcagcctcccgagtagctgggactacaggcacacaccaccatgccaggctaatttttaattttttttgtagagacagaatctgactatgttgccgaggctggtcttgaactcctgggcttaaatgatcaaagttctgggattacaggcatgagccaccatgcctggcccctcagtactctttttttttttttgagatagagtctcattctgtcacccaggctggaatgcaatggcatgattttggctcactgcaacctccgcttcctgggttcaagcaattctagtacctcagcctcccaagcagcagggcttacaggcatgcaccaccacgcccggctgattttttgtatttttagtagagatggggtttcgccagtttcccaggctagtcttgaactcctgagttcaggcaatccgcccgctttggcctcccaaatgctcaggcaatctgcccacctcggcctcccaaagtgctaggattacaggtgtgagccactgtgcctcgcccctcagtactctatagtaaggtgcagccaagtgactgggttatatcaaatggaatgtacaagtaatacactcccacttccaggcttagcttatagacattttccatgtggtgttcctccatgttgttttttctttcattttttttttttttttttggaaacggaatctcgtctctgtcacccaggctggagtgcagtggcgcgatctcagctcactgcaacctccgcctcccgggttcaagtgattctcctgcctcagcctcccgagtagctgggactataggtgtgtgctaccatgtctggctaatttttgtatttttagcagagacagggtttcgccatgttgcccagacagatcttgaactcctgacctcaggtgatttgcccgcctcggcctcgcaaggtgctgggattacaggcatgatccaccatgccgggcctagttgctcttttttttttttttttctttttttcttttttaagaaggagtttcactcttgtcacccaggctggagtgcagtggctggatctcagctcactgcaacctctgcctcttgggttcaagtgattctcctgcctcagcctcccgagtagctgggattacaggcatgatctaccgcgccaggcctagtctctctctctctctcttttttttcttttttgagatggagtttcacttttgtcacctaggctggagtacagtggcgggatctcagctcactgcaacctctgcctcctgggttcaagcaattctcctgccacagcctcccgagtagctgggattacaggcacgtgccaccatgcccggctaatttttgtatttttagtagagatgtggtttcaccatgttggttaggctggtcttgaactcctgacctcaggtgattcgtccaccttggcctccaaagtgctggaattacagacatgagccaccatgcccagcctcgtctctcttttgaaaaacaaaattaatggtatgtaccacaaaaggtagatgtcaggaataaatgaaattgtgaatgtaaaacaccttgcatgatgcttggcatgcagtaagttcttaatgggtggtaggctgctggcagaacatggtgtatatggtgaggagaggggtacaaactgggaagtaagagactggaattctcattccaggacagctgctttctgtataactttgggaaaatacctttatccctttgaactttgcttttcttatctacaaagcaatggcattggatggcacctgggatctccacactgtttcctgtaaaaacaattggctttgcaaatttcctcagggaatcccctaggaagaggctgcgtcaaaccaagcagactctggtccctgtctctgtttcaaacagagaagctccaattccatttgttcgacatgttgggctttcagtagagtgctggtttaaagaaaaggtattgctgcggtttaaaaaaaaaaaaattgaatatcagtgtactccaagatttaagtcttccccactctaatactctaagattctgtgaaggtctgagcaatgatgggttagtccactaagtcatgttgggaaaggctatagctttcctcctccacttgaccagtttgaaagaagccaagggagtgacctgcaagtcccaagactgcccgggcataaaagtacttaggtggggcagaatcatgactatgaataagaactcaaaatgcaaccagcaggtacagtccctggcactagaactcaggaaaagggcaagtgcacactgttctggttggaaaatgtgtaagccaagtacgtgactgaacaggctctttctaaccagtaagctaaggaaaagaaagcagccggatttgcaggcttatagatctgtcactgaggagaaagtaactggctcctggtcaagtcatcagcattccaatatggctttctaccataggatgtgtggccttataacacacaaatgtcccaggaagagagtgtggccaaaggctacatatagtgctggtgttatgaatttcatttactcagcccacatatagtgccaaatgtgctaggcactgttttagatgttggggatagagacaaatccctatattctacatttcagtctggtagacagacataaatctttttttttttttttttttttgagatggagtctcgctctgttgcccaggctggagtgcagtggtgtgatctcggctcactgcagcctctgcctcctgggttcaagtgattctcctgcctcagcctcctgagtagctgagattataggcacgtgccaccatgtccagctaatttttgtatttttagtagagacggggtttcaccatgttgatcaggctggtcttgaacccctgacctcgtgatctgcccgcctcagcctcccaaagtgctgggattacaggcgtgagccactgtgcccagcctttttttttttttttttttttgagatagtgtcttgctctgtcatccaggctggagtactgtggcatgatagctcaatggaacctccgcctcctgggttcaagtgattctcctgcctcggcctcccaagtagctgggattacaggtgcccaccaccacacatttttagtagagactgggtcttatcatgttggccaggctggtctcgacctcctgacctcaggtgatctgcccgcctcggcctcccaaagtgctgggattacaggcgtgagccaccgtgccaggatggtagtggtttatttttattttttttttagttgtttttttcttttttctttttttgtagatgtggggaccagtgcaacagggtgttgcagtaggggagagagattggactcaaattcctgttgtttaaactacaacagtagcagtgtgagtagtaagccatcaaattctggatatatgtttaagatagtgcaaatcagcccaactgaaccaccaggacattgcctcgttgttctgttcttttttttttttttttcctgattttaatattcattataaagctctagtaagcaggacaatgtgttaatggtataaaaaagcagacaagttggcctggcgtggtggcttacgcctctaatcccagcactttgggaggccgaggagggtggatcacgaggtcaggagatcgagaccaacctggccaacatagtgaaaccccatttctactaaaaatacaaaaattagccatgtggtggtgtgtacctgtaatgccagctactaaggaggctgaggcaggagaatcacttgaacctgggaggcggaggttacagtgagccgagattgcaccactgtactccagcctgggcgacagagtaagacttcgtctcaaaaaaagcaaaacaaaacaaaacaaaacaaaacaaaacaaaaataccccccaaaaccaaaaaacagacaagtcaatgaaatagaaatgaatccagaaagagacccacatatttatattgacaactagtttttatttgtttagtttttttgtttgttttttgagaaccctggatagagtgcagtggtgtgtacatggctcactgcagccttaactgtctaggctcaaagcaatcctcccacctcagcctcctgtgcaggtggggctacaggcacatgccaccatgtccagctattttttttttttttttgtatttttgtagagatgggttttcaccatgttgaccagggggtctctaactcctgggctccagtaatccacccaccttagccccccaaaagctaggattacagacatgaaccactgctcctggcctgataactgtttgtttatttttgttttgttttgttttgagatgaagtcttgctttgttacccaggctgtagtccagtggtgtaatctcagctcactgcaacctctgcctctgaggttgaagcgattctcctgcctcagcctccagagtagctgagtttacaggcgtgagccaccacgcctggctaattttttgtatttttggtagagacggggtttcatcatgttggccaggttggtcttgaactcctgacctcaggtgatccgcctgcctcggcctcccaaaatgctgggattacaggcataagccaccacgcccagtcctgacaactgtttttgacaaaggcacaaatgcaattcagtggacaaatagtctttttaacaaatggtgctagaacaattagaaattcatacgcaacagaaagaatgtcaatccattcttgcaccatatgaaaataatgatctaaatatgtattatcccagcctggccaacatggtgaaactccatctctacaaaaaaaaaaaaaaaataatagccaggcgtggtggtgggcacctatcatcctagctacttgggaggctgaggcaggacaatcacttgaacccgggaggcgaaagttgcagtgagctgagattgtgccactgtactccagcatgggcaacagagcgagactttgtctcaaaaaaaaaaaaaacaattattacagacttaaatatattatctaaagtgattaatcttctaaaagaaaatatggtagaaaatctttgtgatcttgggttaagcagaaatttattagatattatacaatactaaaaagcataattcctcaaagaacaaacagattaaatagacttaatgaaaattataaactccttttttttttttttgagacagagtctcgctctgtcacccaggctggagtgcaatggcacaatctctgctcactgcaggttctgcctcccaggctcaagtgattcttctgccacagcctcccgaatagctgggattacagacgtgcgccatcacgcccagctaatttttgtatttttagtagagatggggtttcaccatattggccaggcaggtctcaaactcctggcctcaggtgatctgcgtgccttggcctcccaaagtgctgggattacagatgtgagctgccacaccggtaaacttctcctttttgaaagacactcttaaaataaagaaaatcagccaggcatggtggctcacacctgtaatcccagcactttgggaggccgaggcaggcagaccacttgaggtcaggagttcaagaccagcccggccaacatggtgaaatgccgtctctactaaagatacaaaaattggccaggagtgttggcgggtggctgccatcccagctactcgggaggctgaggcaggagaatcacctgaacctgggaggcagaggttgcagtgagctgagattgggccactgcactccagcctgggtggaaaaaaaaaaaaaagaaaagaaaatataacccatagaatggaagaaagggtaatctgataaaagatttatatctagatatatttatatctagaatacacatttatactcagaatacataatttggattaaaacaatccatttttgtaagtgggcaaaatgctttattttattttatttttttgagacagagtctcactttgtcacacaggctggagtgtagtggctcgatctcggctcactgcaacttcttcctcctgggctaaactgatcctcccacctcagcctccctagtagctgggactacaggtgcataccaccaccaagtccagctaatttttgtattttgagtagagatagagctttgccatgttagccaggcctgtctcaaactcctgaccttaagtgatccgcccgcctcggcctcccaaagttctgggattacaggcatgagtcgctgtgcctggctttattttatttttaattaacatggaataatgtacatatttataggtacgacgtgacattttgatatctgtatacaatgtgtaatgattaaatcaggttcattagtgtatctattacttcaaaacatttatcatttctttgttttggaaacattcaaaatccacagggtgccatacctcatgctggtaatcccagcgacagaacgaagctctatgtcaaaaaaagagaaacatgcaaaatcttctcttttagctatttgaaaatatacaataagttattgttaactattgtcaccctatagttctatagagcactagagcttactcttcctatctatctgtccttttgtattccgtatccaatctctatctcccatcccccacccttcctagcccatagtaaccacaattctactctatttctgtgagctcaactttttagctcccacatatgagtgagaacattagaattccattgctgttactgcatgctttttctctattctatctctttgctcctcccaggagaggagatttcctcctgagcaaaggaggtgtgtgggttgggaagggaaagcaaagtaaagggatagaaaacaaaaaagaagatataaatgcagcaaaaagtaaaaacagaagagccaaagaatgaacactaacaggagaagaaaagcaagaatgagaaagataggaatgctattcatctttctggctttctcatctcttttcttctctgttgataacataaaagtgtgaagaggctgatttctttttcagcaaaagccttcatggaaaacactggtgactgttttgttttcaatggctatatgcacaatgcaaggttgaagaaggagaaataaattttctgtaaagaaaaacaaaaatcagtcctggagtgggaggtgcatgctgagagatgtaaattcaattaatcatcacttttgataaaatccaagtcttcttgcacaataatgggtgctggcctagaatgttacttcctcttctgtcttcgaggagagaaaaatctgatttccaaagaaagagaaattcatcatctctcctgggtcaccttcaacaaccacagagctggttttctgaagtgatgtgtcataaagtcacagtacccttgaaggtaaccggaaatcattgttttcacagggaaaaaggcaaccggaagttacaacttccactggagaatataatcatatcctcttgccaatgtggctggaacattccctgaccactgtagctttttgatactgtcagtgaaggaaatagtgattataaatcttgatgaaagattacaggagtcatttcagccttagagaattgcaatatgttcaagtgtttaacataatcttaaaatgtaataggaactgttgtctaatttaatcatcagtctttagctgtcaacacagatgcattaagttggtaaatggcaaagggaaaaataaagaagtggttgtgcacagacgaaaggatactttcatttcccttagagcttggtttagtcaacagttccaaacagtcacacagcagtctgtttgtatgaaattttgccagtgggaattaagctgaaaaagagtattttcccttcagaacttacgagtttccaactgggacattttgcataatagattcacttttctattgtgaacatgtgatctacttatgaaatgcttcaacaaatgaaagcaacaacagaaaaggcaggacacatccagtattatcaagcttcaattgctctaaaaatttttctgcaaactctccctctttgttccttactctcctcatagccttcctcttttctgtcccaccaaaccccaaactaacaagtagcagaggcattttgacgttgagccataaaaaataatcactatgacacacatggttccaggcctgctttcaccttccatcaaagctttgtctcaacaacagctcttttccagcctggaatcttgccttaaattttcgtgtcttttcctccccagaaggacaggatgttaatgaatcacggtctactaggaaaagcttttacctaggctgaggaatgggctttcaaagaaaaaccaataatctccatcaagtcctggaagcaaactaacattgggtctcccctcaccattctaacaaagctgtgctctgtcttcattgctctctttctctctttctttctctaatacacatgtactcatgcacacataccttgtcttttgagtgaaagtctctctctttgtgacacacaaacacacatccacacccaaacaccgaaacacatacccattgtctattgagagaaagcctttgggctttattgataattttgactctggaaattaagtaactgtatcattttggcagggacactcgtgggagttgaaggtcaatatgcagctggctgcatcttacaaattgtttcagtaatttttgttatctcttcctggagcagaatctagctgaatacattagatgtaagaacaaagcccagcagccacagaatttgaataatcacttccggggtaaaccactcatgtctcagaaaccagttggtgatagacaagatatggaagccatggaaaacccataaatcattgaccaatgatgcccgaagaaagggcttgggataaaatgtcagcatgggaagaatagagccatttataccatctttaattacactacaacttaaattatattcaatgacattacttcatctagagagaaatactagattcccacagattttgctgtttttgaaaatccacacctggctgggcgtggtggctcacacctgtaatcccagcacttttggaggccaaggtgggcaaatcacttgaggtcaggagtttgagactaacctggccaacatggcgaaaccccatctctactaaaaatacaaaaaaaatttagctgggcatggtggtgcacgcctgtaatcccagctacttgagatgctgaggaagaagaatcacttgaaccctgggaggcagaggttgcagagagctgagatcacgccattgtactccagcctaggtgacaagagtgaaattctgtctcaaaagaaaataagaaaataaaaaagagccaggcacagtggctcacgcctgcaatcccagcactttgggaggccgaggcaggcagatcacgaggtcaggagttcaagaccagcctggacaacatggtgaaaccccatctctaataaaaatacaaaaattagccaggcatggtggtgaatgcctgtaatctcagctacttgggaggctgaggcaggagaattgcttgaacctagtaggcggaggttgcagtgagctgagattgtgcaattgcactccagcctgggcaacaagagcaagactccacctcaaaaaaaaaaaaaaaaaaaaaaagaaataatgaaatacttgaatcagtagaaacatttatatttcccccaacatctttgtggctcaaaagaagtagctattctaggcttttcattgggctatgcaaaattgtatgtgtgtgtgtgtttatatatataaaaaatacagttttatgtatgtatatataataacatatatagtatatgatattatgtattatacattaatataaatatacttataaacataagtaaacatgcttataaatatacttataaataaacatttatatttttgcagaagaaatttagagtattgatgacatagtagcttttaatacatttaatctaagcacatgataaatatatatttgaaatttggtgcataataagtaatgctgctaagaaagtgagaaaccttttttttcaacattattatgcttactagcaagaacatcacatcacgtgactgcttccaaaagtaagctagcttttcaatgaggagattcgtgctcactttggagcaagcttgtgtcattttcaaactgttaaataaaccatgtttgaatgataatcctatcaaaataattgtagactagtgtccactcatgtaaaatgttctttttgttgttgttgtttgttttttgagatggagtctcactctgtcacccaggctgacctcgactcacagcaacctctgcctccagggttcaagtgattcttctgcctcagcctcccgagtagctgggactacaggtgagcaccaccacacctggctaatttttgtatttctagtagagatagggtttcaccacattggccaggctggtctcgaactcctgacctcgtgatccacccaccttggcctcccaaattgctgggattacaggcgtgagccaccatgcccggccaaaatgttcactttttaatagtgccatctttttgttgtttgagatttccacttctctgagggtttcttacatgttcttatccttggggaacacctcagggaagaaaaacagttcaggaagttaggcaggaggataaagaagggatatgttgcccagaatggtctccaaatcctggcctcaaacaatcctcctgccttggtctctcaaggtgctagaattacaagtgtgagccactgtgtctggccccttgttactttcttgtcactagatacttgctttcctggcttcccttgctgttagagaagccaagtggtcaagttctggtcagcaagatatgaggaaaaatctgctgggggatcctaggaaagtttttgctcttcttgctttaagctgccacagtctctgttgttgtctttttgctgttgtgtcacttgcacaacaaaagtgaggtgcatatgactaatggcaagacaaaacgtgatctattaagaggaaaagaaaggtagtcaaacactgtgcaacttgcctggcataataggaaccaaaaagagcctgagggaaatctcacaacatttttatttgatatgcttttgagagtaaaataagactggagaaaagagccttcaaaatattccaccttaccaatagcacaatctgggaagttagccagataatttaaaagcaaaaccaaaaattagactgcagtagagatgcagtacaatcagtccactattcagaaagttgcttagaagggaacaggagaaaaagggaaaagaaagcaggaaaggagggagtaagggaagaagaaagaaagaaaccatgtttgtcccatcacaagcactaaaatagatacctgttgctaggtagatgtcggggcttcacccatagtgttaccggaaagcggtcccgatccagaccccaagagagagtccttggacctcatgcaagaaataatttggggtgagttgataaagtgaaagcaagtttatcaagaaagtaaaggaatagaagaatcgctatcccataggcagagcagcagtgtgggctgcttgactgattatacttatagctatttctttttttttttttttttaaatagagatgagtctagctctatcacccaggctggagtgcagtggcttgatcttggctcactgcaacctccgcctcctgggttcaagcaattctcctgcctcagcctcccaagtagctgggattacaggtgcgtgccaccacgcccagctaatttcttttgtattttagtagagacagggtttcactgtgttgctcaggctggtctcaaactcctgagctcaagcaaccagcctgccttggcttcccaaagtgctagtattaaaggtgtgagccaccgtgcccggcctagttatttcttgattacatgctaaacaagggatagattattcatgagttttctgggaaaggggtgggcaattcccaactgagggctcctcgcctttttagactatgtagggtaatttcttgacattgccatgacatccataaactgtcatggtgctagtgggagtgtcttttggcatgctaatgcattatgattagcatgtaataaacagtgaggacatccagaagtcacttttgtcatcatgttggttttggtgggttttggctggcttctttaccacatgctgttttatgactaaggtctttgtgacctgtaccttgcgctgacctcctatctcatcctttaactaagaatgcctaccctcctgggaatgtagcccagtaggtctcagccttattttacctaccccctagtcaagatggagttgctctggttcaaacgcctctgacaatagcctctgacaatagcctctgacaatagcctctgacaatagcctcttgagttccttttggtgcacaccacatattttatgcacactggctcccaggtgatttcactcacaacagtccaaacctgagtgtctttatcagatgattgtcgtcaggttaccgaagctactttggcctgtgtgtatgaagggccagaagattctgggggccagaagtggtggctcatgcctataatcccagcactttcagaagccgaggtgggaggatcacttgagcttgggagtttgagactagcctgggcaaaaaggtgagacccccatctctacaaaaagtgcaaaaattagccaggtatggtggtatgtgcctgtagtcctagctactagggaggctgaggtgggaggattgcttgagccagggaggttgaggctgcagtgagccaagatcacaccactgcactacatcctgggcgacagagtgagactcgatctcaaaaaaagaaaacaaagaaacaaacaaaaaactcatcccccccaacacaacaaaacaaaaataagcaaacaagaaaaccccccaaaactcaggagattctgggcatatttacacatttgtgagatggcctttaaccattgatttatagacacaagagtataaatacatcaacttcacctctgtttgaaacaactaccttttccagagctacccagcaggtttgaggcagtcccatggtggctttgtacttgatactgtgcttgcctctttgtgcttgagcctgggaggtcgacctccctcttgaatcaagagggcagtatcaaccacaaaacggttcctttggctcccatccaacttccttttttcttattgtttcttctcagaaacgttttctaataaagtactttagcatgaatcttggtctctgggtctgcttctggtgacctatatctaaaactccttttctccagactgtaaataaaattactcacccaaggcaagtcatgcataaaagcaaaagaagttaagcagacagtgaatcaaaaagaaaatgagaaggggtttgccaaaagccaaaaacatgaaccataactctttgggctgcccactctggcctgattgttgatagagtgaagcagtaatatttcccacagaagtatgcaatgaatctgatatcctgctaaacaccaaggcatttgcaatacttgaataggaaatctaatattgcttatagttagttagaagggtcaacaaatgaagaagagcagaattgctaatgcagcccagctggcaagggttccaaagcctggccttagacctattccttctgtggggacacacacaggaaaagctgagctctatatcttcacaaattttcccattccatgtgggtgacttgatgcaaggctgaattaaggagaagtttggtgtctttcttgttaaggaactagtctccagtgatctcaggcttcatcttcataacgacaagaaatccagaccatgggtcagacaacctagtgattcatgtgtcttaatgactgaccctgctggctgcatggtgggtaattttagctggaaaataccaggtcagtcatcatagagccagcatggttacatcaaacaaccaaaggatcagtctctgaggccctggaaagactggatttgaagtaaatacagaaactttttttcatttccatttttaactaaataaaaaatttgagaacaaacagggcaagagagaaaagaaatcatatttacaacatgaaaattaatgtgacttacaggtttattgctaattactctcaaaagaaaatattctgcttccttgacaaaaaacaaaaccttctagaaaattttaaccccaaagtgaacaataacacctttagtgactcaaaatgctaattgactaggtatcacctgaattcaacagacatgcctaaattcattgctattctcattactaacatagaaaacatatttaggatttaaaaaatgagtagaattattcaataagaaagagatgaactatggacctttgtgcatggttttatcaagtgtacttttctacatgacactctctgatcagtccacatgataaattaatttcaaagtaggccatattaaggagataagatcaagttgagtacggtcaaaagattacttttatagccataataagtcactttattttttatattcttattttccatggaagtataaattacatacagtaaaatgcataaatcttaagcttgcagtttgatgagttttgacaaatatatacacgtggttgggcacagtggctcacacctgtaatcccagcactttgggaggccaaggcgggcagatcacctgaggtcaggagttggagaccagcctggccaacatgctgaaaccttgtctctactaaaaatacaaaaattagccgagcatgatggtgcatgcctgtaatcccatctactcacgggaggctgaagcaggagaatcactggaacccgggaggtggagaatgcagtgagccaagattgcgccactgcattccagcttgggtgacagagcaagactccatcaaatacaagacaaaacaaaacaaaacaaaaaaaacataaaaagcagaaaacaaaaacaaaaaaacaaatatatacattcacgtaaccaatatccaatgcccagtatcatgagggagaacatcttctgtgcccagcaagttttcccatgcttttttccagttagctgcttgccttccatggacaaccacttttggtgtctttacttattcttggacttcatataaacggtatcaaccagggtgtacatttttgtgcctgcctttttttttgagacagagtctcgctctattgcccaggctggagtgcagtggcatgatcttggctcactgcaacctccaccttccaggttcaagtcattctcctgcctcagcctactgagtagctgggattacagatgcacaccaccatgcctggctaagttttgtaattttagtagatacttggtttcaacatgttggtcaggctggttttgaactcctgatctcgtgatccaccagcctcagcctcccagagtgctgggattacaggcgtgagccaccatgcctggccagtgtctgtcttttctgctcagcataatattattgacattcatcacactgttttgtatatcactaatttgtttttattgctcagttgtattattcagttgtataaatgtgttatagtttgtttatatattcacttaatggaaatttgggttgtttcttggttattatgaacatgcttatacaggtgtttctgtggacatgttttcatttttcttgggtaacatttatttatttttcgaggcaggtgtcaggcctctgagcccaagctaagccatcatatcccctgtgatctgcacctacacatccagatggcctgaagtaagtgaagatccacaaaagaagtgaaaatagccttaactgatggcattccaccattgtgatttgtttctgcctcaccctaactgatcaatgtactttgaaatctcccgcacccttaagaaggttctttgtaattctccccacccttgagaatgtactttgtgagatccaccctctgcccgcaaaacattgctcttaactccaccgcctatcccaaaacctataagagctaatgataatccaccaccctttgctgactcctttttcggactcagcccgcctgcacccgggtgaaataaacagccttgctgttcacacaaatcctgtttggtggtctcttcacacggacgcttgagacatttggtgctgaagacccaggtcagagggactccttcgggagaccagtcccctgtcctcgccctcattccgtgaggagatccacctacaacctcaggtcctcagaccaaccagcccaaggaacatttcaccagtttccaatcgggtaagcggtcttttcactctcttctccagcctctctcgctcccttcaatccccctatccttccaattccagttctttttcctctctagtagagacaaaggagacacattttatccgtggacccaaaactccagtgcccctcacggactcgggaagacagccttcccttggtgtttaatcattgcggggacgcctgcctttcacccacattccattggtgtctgaccaccacagggacgcctgccttggtcattcacccacattcccttggtggcaagtcaattgctggatgcctgctttggctgctcacccacgttgcagcccagggcttctccccaccccccttctccgtgtctctacccttctctttaaacttgcctccttcactgtgggcaaccttccaccctccattcctcctccttctcccttagcctgtgttctcaagaacttaaaacctcttcaactctcgcctgacctaaaatctaagtgtcttatttttttctgcaacactgcttggccccaatacaaactcgacaatggttctaaatggccagaaaatggcacttttgatttctccatcctatgagacctagataatttttgtcgaaaaatgggcaaatggtctgaggtgcctgatgtccaagcattttttacacattggtccctccctagtctctgctcccagtgtgactcatcccaaatctttcttctttctcttcttatcaaccaaattgttttgcctatccacccagtggtgccccacccatacactcttttgtcctcaataccttcctccacaactcactattccgttcctgatcttaaagatgcttttttcactattcccctacaccccttgtcccagcctctctttcttttacctggactgaccctgacacccatcagtcccagcagcttacctgggctgtactgccgcaaggcttcatggacagctcccatgacttcagtcaagcccaaatttcttcctcatccattacctatctcggcataattcttcatgaaaacacacatgctctccctgctgactgtgtcctgctaatctcccaaaccccaaccccttctacaaaacaacaactcctttccttcctatgcatggttaggtacttccgcctttggatacctagttttaccatcctgactaaaccattatgtaaactcacaaaagcaaacctagctgactccatagatcctaaatcctttcaccactcctctttctgttccttaaaaacagccctagaagctgctcccacactagctctccctaattcatcccaacccttttcattacatacagccaaagtacagggctgtgcggtcaaaattcttacacaggagccaggaccgcaccctgtagcctttttgtccaaacaacttgaccttactgttttaggctagcccccacattattcttgatgccatatctgactcccatgactatctctctgatccacctgacattcactccatttccccatatttccttctttactgttcctcaccctgatcacacttgctttattgatggcagttccaccaggcctaatcgccactcaccagcaaaggcaggctatgctatagtatcttctacatctatcattgaggctactactctgccccacttcactacctcttagcaagcctaactcattgccttcacttgagccctcactcttgcaaaggaattatacgttaatatttatactggctctaaatatgccttccatatcctgcaccaacatgctgttatatgggctgaaagaggtttcctcactatgcaagtgtcctccatcattaatgcctctttaataaaaactcttctcaaggctgctttacttccaaaggaagcttgagtcatatagtgcaatggccaccaaaaggcatcagattccatagctcagggcaatgcttatgctggtaaggtagctaaggaagcagctagcattccaacttctgtccctcacgtccggtttttctcctgctcatcggtcactcccacctactcccccactgaaactgccacctatcaatctcttcccacaaaaggcaaatggatcttagaccaaggaaaatatctccttccagcctcacaggcccattctattctgtcatcatttcataacctcttccatgtaggttacaagccactagcccacctcttaaaactctcatttcctttccattgtggaaatctatcctcaaggaaatcacttctcaagtgttccatctgctattctactacccctcagggattgttcaggccccctccctttcctacacatcaagcttggggatttgcccctgcccaggactggcaagttgactctactcccatgcctcgagtcaagaaacgaaaatacctcttggtctgggtagacactttcactggatgggtagaggcctttcccgcagggtctgagaaggccactgtggttatttcttcccttctgtcagacataattcctcagtttggccttcccacctctgtacagtccaataatggaccggcctttactagtcaaatcacccaagcaatttctcaggctcttggtgttcagtgaaaccttcataccccttactgtcatcagtcttcaggaaaggtagaacggactaatgatcttttaaaaacacacctcaccaagctcagcctccaacttaacaaaaaggactctgtcaaggatagagcccaaaaactcaccaaccaagcaagtaattacgctgaacccccttgggcactctgtagttggatgtcctgggtcctcccagttcttagtcctttaatacatgtttttctccttctcttattcagaccttatgtcttccatttagtttctcaattcatcctaaacggtatccaggccatcaccaatcattctatatgacaaatgtttcttctaacaaccccacaatatcaccccttaccccaaaatctccctttagcttaatctctcccactctaggttcccatgccgcccctaatcccgcttgaagcaaccctgagaaatatcgcccattatctctccataccaccccccaaaattttcaccaccccaacactttaccactatttcattttatttttcttattaatataagaagacaggaatgccaggcctctgagcccaagctaagccatcatatcccctgtgacctgcatgtatacatccagatggcctgaagcaactgaagatccacaaaagaagtgaaaatagccttaactgatgacattccaccattgtgatttgtttctgcctcactctaactgatcaatggactttgtaatctcccccacccttaagaaggttctatataatctcccccacccttaagaaggttttttgtaattctccccacccttgagaatgtactttgtgagatccaccccctgcctgcaaaatattgctcctaactccactgcctattccaaaactggtaagaactaatgataatcccaccaccctttgctgactctctttttggactcagcccacctgcacccaggtaaaataaacagccttgttgctcacacaaagcctgtttggtggtctcttcacacagatgcatgagacagcagggtcttgctatgttgcccagggtggagtgcaattccatgatcatggctcactgcagcctcaaactcctggtctcaagcaatcctcctgccctggcctcccaagtagttgggatgacaggcacatgccaccacatccagctaatttttgtattttttgtagagacagggtctcattatttgcccaggctggtcttaaactcctgaactcaaggaatcctcctgctgtggcctcccaaagtgctaggattgcaggtatgagccactggtgcctggcttctcttgggtaatatttagaagtagaattttgggtcataggataagtgtagcctttatttctaagaaaattctaaacagttttcccaagtggttggaccatttcgatttctaccagcaacataagaaggttccagttgctccatatcctttcggacagttgatattgtcagtctttccaaatttagctataggatgggtcactataggtagaaatagtttgaaataacaaagtaggggccagatgtggtggcttatgcctgtaatcccaccactttgggaggctgaggctggtggatcatgaggccaggagttcaagaccagcctggccaagatggtaaagccccgtctctactaaaaatacaaaaattagctgggtgtggtggcacacacctgtaatcccagctactctggaggctgaggcagaaaattgcttgaacctgggagacggaggttgcagtgagctgagatcgtgccaccgcactccagcctgggtgacagagagagactccacctcaaaaaaaaaaaaaaaaaaaaaaaaataacaaagtagactcaaatctcattctagttggcagtttattcttacctgtttgtaatttattctgatgtcttctcgtttacactaattacttgatctctggtccaccaagagtaagctgcttcaatgggccatggaatgtcctgttccaaaacagacgaaataaatgttttttttttttttaattcctcttgtcaaattgtttgaacctgggaggcagaggttgcagtgagccaagatcgcatcactgcactccagcctggacgacgggtgagactccatctcaataaaaagaaaaaaaaaattcctcttgtcttatatcatttctacctcttccttccttcattagcactgaaacagaagtagtgtcaggttgttttattgagcacaaattctcatattagcaccttgcctcaaaaacaagaaaatgctttaatgaatgaagtaattttcaagtgctatcctcaagaattataatgtgagaaaaagtggtttcaataacccattctcactgagataaaacttaagcaatcataattttttcatatttaagccacatagaatgggtcccattaaatggaagtcacctcaaaataaattctaaaattttaactgttcatcacctaaacaagtttattgggcatggttgattggcagagtcattaggggcttcatgttgtgaagaattcatctgtttgtggtaaaaacaatataatggggtgtaagattatatacatggctctggacaactcaagttcaaattttgattccactcctaccagccagatgaccttgggcaagctgttaaagctctttcttccttagtttactcatatataaaagagagataataccatctacatcctagagattatgaggaataaaatagtaaagatataatacaatgtttagaattgtgtcaggcacattctacacaaatagatacataaatgcactattactatttatttgacaagtatttactgaatgcctttgatgtacattgcacatttttgtttgtttgtttgttttttagacagggtatcactctgtcacccaggcgtgatcacagttcactacagcctcaacctaccagactcaagtgatcctcctgaaaacacccttgcaaaaattataactgatgaaattatgacagtgagagaaatctgacatggctgactccatcttgtctctagctcgcaggttggctgtgctcatttctgggcatgggctgagctaactttggaagaaatttagtttataatttaaataataggcccttccccaaaactaaactgttcttgtaaaaataatgaaaggcctccaagttaggatgacaggggtttgaattctaaataattaccggccattattccagaggtcataagatttgcaacttccttaatcacccttgaagataacatcactactgcagagcctaagattggccttttgagatatattttcaggcttttgtatttctgacaactggatggccccacctggacctgccaaccagtcctgtggtctccacccagaaactgacagaggacagctcgatcccctttgatttcatctccaagccaaccaatcaacactcctgactcactggccccctacccaccaaattatccttaaaaaccccgatcccagccaggcgtggtggctcacgcctgtaatcccagcactttggaaggctgaggtgggtggatcacctgagatcaggggttcgaagccaacttggacaacatggtgaaaccctgtctctactaaaaatacaaaattagccgggcgtagtggtgcatgcctgtaaccccagctacttgggaggctgaggcaggagaatcgcttgaacctggaaggcagaggttgcagtgagcagaaattgcgccattgcactccagcctgggcaacacgagcaaaactctgtctcaacaaaaaaaccaaaagacccccacaaaactccgatcgcagccaggagcagtggctcacacctgtaatcccagcactttgggaggccgaggcaagcagatcagccttaccaatatggtgaaaccgcctctctactaaaaatacaaaaattagccgggcgtggtggcatatgcctgtagctccagctactaaggaggctgaagcaggagaatcgcttgaacccgggaggaggaggttgcagtgagccgaaattgcgccactgcactccagactgggcgacagagagagactgtctcaaaacaaacaaacaaacaaacaaacaaacaaacaaacaaaaaaccccaaaaaactccgatccccgaattctcgaggagactgatttgagtaataaaaactccagtttcctgtacaaccagctctgtgtgaattaaactctttctgtattgcaattcctctctctccataaatcagctctgtctaggcagcgggcaaggagaacccattgggcagctacactcccacctcaacctctggagtagttgggaccacaggcgtgcaccaccatgcctggctaatttgtagagacagatttttgccatgttgcccaggctggtcttgaactcctgggctcaagggatcctcccaactcagcctcccaaagtgctgagattacagatgtgagccaccgtgcctggcctctttgaacaattttaaatgctgacgatataggggtcacaagaattatgagataaagcacaagaattatgagagcatattcagattcagagctaaaaaatgcagcaattgattagtaatgtctgacatggtgggtaaggtatgtgtgtgtgtggagaggatggttgaatagcaatacacacgtcaaatattggttaccctgactgaggcacttggaactgtacttattttccatgaaagcacatatctgatgtggaaccatgctcaacttcctgttaagctgaagtttgtaccctgggacctgtgaacaaaatctaggcatgggtagcatgaattctagaggtctatagatggagcacgcacactccatatctcacattcaccaatttccccaatcacactttttctctgcctgatatttgtttgcttttcactatctaattattatttcattttgcagactggaaatttctgtacacttctggatgtaccttacctagggaaatgcaaggcctagcagagtgctccatatacagagtggatattcaataaatgcttgctaaaatgaattgagttctgcttttcataaataacagtgtattcctcagacaatagattagtaatcatctatcagacaacagttggtaaga

SEQ ID NO: 542 - DNA, 51270 bp, Homo sapiens
ggaggctgaagtgagaggattgcttgaacccaggaggtcaaggctgcagtgagctgagatcatgccactgcattccagcctgggtgacagattaagaccctgtctcaaaaaaaaaaaaaaaaattcacaggtccaaaatggctaaaaaaaggtatattgtaatattcctaataaaatattacattttattgtatttttattacatattttattacatgcttgtaataaaatatattgtaataagacctgctgaataaggaaaatagtatttggggccgggcacggtggctcacgcctgtcatcccagcactttgggaggccaaggtgggcagatcacctgaagtcaggagttcgagaccagcctggccaacatggtgacacccagtctctactaaaatatacaaaaaaattagccaggcgtggtggcgtgcacctataattctagctacttagggggctgaggcaggagaatcgcttgaagccgggaggcggaggttgcagtgagccgagatcatgccactgcactccagcctgggcaacagagagagactctgtctcaaaaaataaaataaaataaatataaaaaaccaggaaaaaaaagaaaaaaggaaactagtatttggaacataatatgtagctcagaacttccagcaattatatgatgtccactgtccattagtagaaaaaataagccacagttcatgaagaaacagaagcttttcctggtactgagttctcagaatctatcactagactcttacttattgtaatgaagtctcccacagctgtttttacaggaaatgcaaacttgtctcccatgtgactttggcgaaagacccagtaaacaacaacagtcctgaaagcacaaagctacaggaataagtcctcccagccctatcctctactcaaggtctgaatgcaacacacctgtggcttgtttctggctcaacaataatcttttcctcacaaagcagctcttaagcactaagcagggcttcctgtcactaatccccaaaacatttctatgggataaaaacaggagaccaagggtagactcctgctaatttagaaacattttaaaagatggcttgggttcagtctgctcattcctccctgcctctaccaccacaaacctaaagaaaacaaaattcctacagaaaagcaaactgtaaaactcacaaccgcagcatgaaatgaggaagcaatggggtgcagcacaaactgtaatgtggaaatgctacacagcgtctctctgctgcctcccaccagccagggccgggctgggagccaggtctgagaaatagtagcacatgctgccactctttttgtggatggttgccatggcaacctgcctctgttcaaatgctgagcatctttcagcagtctcatccttatgctcttctggcctggaagggaagtattagaaagaaggtagtatgggggggttgggggaataccaatgagggtatatgaaacaaatagattgttggaggatcaggtaagatgcctcccgttatactggaagtctcaagaaaggggtggaagatgggtgggctctcgatgtaggtcccaccctattttctgcagcaatttcagtcattcattcatttacccacttgctcattcttacattaaactaattttatggagcaccaatcatactccaggcattatactgggcattggaggtttaatgatgaaaaagataccatcccccccccccccacagggagctcacagttcacatgggagataggagatacacacacacacatgcgtgcacacacacacactcaattaatcatgatataatgttataagtgcagaaatagacatacataaaaaatattacagacttgaaaaaccaagtgcaattaattcttagagttgagtgtaaggagctgataagagaaaactgcatagaaaggttaatacttgagtagggtcttgaaggagtttgttaaatggaaaaaaaaattgtccagacagggcacaacacaaacacttgtggtatgttccacatgggatgtatcaaacaaccaccaataataacagcacttgcagagtgctcagctactgttctgtgtgctttatatgtattatctcagctaaccctcacagtgactctgtagaggaggtattgctgtgccattttacagaggcacagataagtaaaataacttgcctaaagttacactggtatttgatattgggtgggagaaccaggcttctggctccaaagttcatgtgcttaatctcagccttatgcttatcccattgttctgggaaggcaaggtcacaggatatacatggggaaagaggagaaacaacagttgagactgctgggaaacaaagatgaggggtaaattatcatgccctcaaatgccattttaaaaaatctgaaatttgtgttttggtcatgagaagccatgatggtgttacaatgaaaatggtattattatggtgattctggaattcacgtgtaggatagaatggaggagaaacagactgacgatttcaacagcaggaacaggaagagaaaggaaggggaagatcgcatgtagtttaaaacaaggcaaggcccgtgtcatttggttcatcacagagcctggtataccacaggcattcaataaatattggttaaataaatgtttcaaagttgtcttatttggctttacctgaaagcaaattctgaaataaaagttcccatatgagagtttatttaggaagtgtggggaataccagcagattagagaagtaagacagggaaggaaaggcagccaataaaggccgggcactgtggctcatgcctgtaatcccagcactttgggaggatgaggcaagtggattgtttgaacccaggagtttgagagcaggacgaaatgattaaactttttctctacaaaaatacaaaaattagctggctgtggtggtgcatgcctgtagtcccagctactcaggaggctgggtgggaggattgcttaagcctaggaggcgaaatttgcagttagccaatatcgtgccactacactccagccagggtgacagagtgagaccctgtctcaaaaaacaaacaaacaaaaaaccccagaaaacaaaaaggaggtatagagacagcttagtgtttgagttatttgaacatgtctgtgattgactgatccctggctgctgtcactggctgagactcagctatttgttataaaagtatatttctaagttaagctttcagttagtttaaatactaagttggttgcagtttgttcagtaaggagtcaagtactgaggcatcttcaggccaaatttagtttaatttaaccattgggggaatgtgttcttagtggtgagaagttggtgttttagactcttggattttattatttgggtgaactccagaaaacttcccaaatattatgggtggcttttgtagaaggttaattatattattcaacgttgaaagctgaaactccatcaagtaatatttataacaaagattgagtagaaaagacggaggaaggagaaggaagaggaagagaaaaaagtgaagggagaaagaaggggagagaaagactactactaaaatcggcatcacaggtcccaaagccagctcttgtatctgaatgtgcaaaacttgactagtgtctaaagtttctaaacagtgagaatgagatattaacacgcgatttgtttttctggctaatcatgaagttctcatctgaagaaaaatttctactcattcccacctcccctcccaccctactcatctcagcatctttcccaccttcccaccccactgagatcttgtctacccaagattttctgtttcttatcacaattgcattctatgaaggtaggtcttcctctatttcccaatttgaacagataaaaagtaatgattcctaaacttgcaatgcaactgtgtctgccccagggaaggatcaaaggaaattagcccacagagtctgttctgttatacaaaaaccatgggtttttgttccaaagcgtgactctaggggtaccgcagagactgatgccatggctatgtggttagagcatgagtaagtacctcagaaagcatgatgtcatcaatgcacttttcaagccttaagacaaccttgcaggtatagcccccatgtctaacttgtcagaactttatcaatggcagaatggcatagaaggaagcaggtggctaacctgttgcctggagtcacatgggagcttcagagacctgctgaaaggagaactgtcttagcattgctcccttagtcattgcatgcctcttttggcaaaccttgaaattccctctagtaaccttataaggaactgaaaattatagccaacatctaaacacaagtggatgtatttaacaagtgaatatcgtattcaaacctgtcaaaacaaagataactgaaaatcatgtgaacaccacagtgtgaataaaaattcacccactttcggccgggcacagtggctcatgcctgtaatcccagcactttgggaggctgaggcgggcggatcacgaggtcaggagatcgagaccatcccgactaacacagtgaaaccctgtctctactaaaaatacaaaaaattagccgggcatggtggcgggtcccagctacacaggaggctgaggcaggagaatggcatgaacccgggacgtggagcttgcagtgagctgagactgcaccactgcactccagcccgggcgacagagcgagactctgtctcaaaaaacaaaaacaaaaaattcacccactttcaagacatgtcactttccagacattgcctcattgactctttcacctcaagagagaggagagttatggcaagctatgaatatttcttgtccctggacagaatgggaaaagtatggaaatcttgccttttgaaaagcatagcaggattattaaaaacatcaagaaccaccaaactaaggtgaatgcaaaaagaaagaagcagttattgtgagaccacaggtatcttttgagagtagacagtgagaaacagtcttttacagagcagagtatcaaatgaagctcattaggcctggcaaggcacattaaagagacattcagaccaggcactgactcactgaaggcagctcaggtgtggtccagggtactaggttctccctgaggttgtgactaccaattagatggtgatggaaggtatggtgagctatctgtcaatgtcttcaaaggcctctggagcaaagccacagtgttctaaccaggtgcacacagagaatatttttctgatccacagccagaacatggtgtaggcctgaaagataacctgtgactgagcaagtcaaactgttgcaaatgggtgagtactatgatctccctagatgagtaagtgctctaccactactatttatttatacttcaattccaacaattagcaaaaagataaaagaaattgggaagacaatatagaatatggttaagaaggccgagtatggtggctcacacctgtaattccatcactctaggaagctgaggtgggtggatcgcttgagcttaggagttcaagaccagtctgggcaacatagcaaaatctcatctctacaaaaaataaaaaaattagccaggcatggtggcacgtgcctgtagtcccagctactccagaggatgaggtgggaggatcgcttgagcctgggagttcaaggctgcagtgagccgtgattgcgtgcctgggtgacagagcaagtctttgttaaaaaaaaaaagagaagaagaagaagaaggtggttaaattcggactgcctgagtctgaatccaaggctctgtcacttattaacattaaatcatgggcaaataatgattctaggcctcaacttcctcattcacaaaattgggatttttcagggttttggtaatgattaaatatgggaacagacgcaaagaacttaatacaatacgtctcagtaaatgggaactattatcattatattaataaaacatatatctgaaagagtaaaactgatgtggaaattgaaaattaaatacagaggtgtgtgttttgggaggaggtggtaaatgctagttattttattagccctagttaggcaaatatgattactttgattggacgttatatttagctttgagtttcctaaaatctaaggaaaaataaaaatcattatagaccaaattattctcattttgttattaaacacaacattaatatacagttaattctcaatcaacttttgtggaatgccagaataattgctgctcaatagaattccctcagccagttgtcttacttttctacttgcctctttttttcaactttaaccttaagacattttgaaaattaataaaattcaggaatccactaatacctgtgccttcccattgttcaagtacttagctttagttttattttattttttgctttttatagaagtcttaatggctagtttcctttattttaacttaaataaacacgaaatcaaaagcattcttccttgagacttccagaatggtgaaataaaaagtctctctctggcaaaacaatttaacttgtgaaaataatttttaaaaaatcatttaactttgggaggctgaggtgagagaattgcttgactcagagttcaagaccagcctgggcgacaaagtgagaccccatctctacaaaaattaaaattagctgggcatggtggtgcatgcctctagtcccaactacttgggaggctgaggcaggaggatctcttgggcccaggtggtagaggctgcagtgagctatgattgtaccactgcatttcagcctgggcgacagagcaagatcctgtctcaaaaataacagcagcaacaacaataaccatttaaagtctctgaaaattggctgggcgcggtggctcacacttgtaatcccagcactttgggaggccgaggcccgcggatcacgaggtcaggagatcgagaccacagtgcaaccccgtctctactaaaaatacaaaaaattagccaggcgtggtggcgggcccctgtagtcccagcgactcaggaggctgaggcaggagaatggcgtgaacctgggaggcggagcttgcagtgagctgagatcacgccactgcactccagcctgggtgacagagcgagactccatctcaaaaaaaaaaataataataaaaataaaaatgaaaaataaaataaaataaagtctctgaaaattgtctcaagaacatatagcaaatgaagaaaactcactcaagaaagtcaactgggaatctcagtaagagtgtctgtggcatttcagccatggcctggcctgctaacctttcctgcagtgccatgttaccaaagctctaccctgaaagtgctgctcctggcaggcacagataatgagataggggctcccttgtccgtcagctcccattctgggcaatggtctcactctaagagaggtggactgccaacatttctcaaatatatacattttatcctgttagtctgcctgctgtaaatttatttcatagtctcagttattttttattattattttgaaacagggtcttgctctgtcactcaggctggagtgcagtggtataatcatggctcactgtggtcctgagttcatgagttcaagtgatcctcctgccacagcctactgagtagctgggacaacaggcatgtgccaccacatccggttagtttttttatttttaattttatttttatagagacagggcctcactatgttgcccaggctagtcttgaactcttgggctcaactgatcttcctgcctcagcctctcagagtgctgggattacaggcatgagccactgtgcctagccagtctcaactattgaaccctcagaggagagagggaaattattaaaaactttgagaagaaggaaaagaaaaacaggacaaaacatatgttatgtagctaaagcagtgctccaagataaaattatagctgtaaatgcctatattaacaaagaagaaagatcacaaatcaatcacctaaacctctaccttaagaaactagaaaaaaagagcaaacaacccaaagtaaacagaaggaaataatgattagaggagaataagtgaaatagggaatagaaaaacagtagagaaaaccaactgatatggtttggctttgtgtccccacccaatctcaccttgaaatgtaatccctgggtgttggagaaggaactggggggaggtgattggatcatgggggcggtttcccccctgctgttctagtgatagtgagtgagttctcatgagatctgatggttttataagtgtttggccagttcctcttttgcttgcttcttcttcctgctgccttgtggagaaggtgcttgcttcccatttgccttctggcatgattgtaaatttcctgaggcctccccagccatgcagaatggtgagtcaattaaacctcccttgtctataaattaccgagtcttgggtagtatctttatagcagtgtgagaatggactaatacaccaacaaagccagaagttggttctttgtaatgatcaacaaaattgacaaatcttcagctggaccgaacaagaaaaaaaaaagaagactcaatttattaagatcaagaatgaaggggtagacataccaccaaccttacataaatgacaaggattatcaggactataagggaatattatgccaacaaattagaaaagatatgtgcaatgactttgcttataatggaaaaagatcagaagccatccctatgtccataaattggggacagactagatgcatacgtaaaaatatcaatagacctacatgatatactgttgaattttaaaaagcaagttgtagataaatatgtttagtatagtatctttttttttttttgagatggagtttttctctgtcatccaggcttcagtgcagtggcatgatcttggctcactgcagcctccacctccagggttcaagcaattctcctgcctcagtctcctgagtaggtgggaatacagacgcctaccaccatgcctggccaattttgtatttttagtagacgcaaggtttcaccatgttggccaggctggtcttgaactcctggcctcaagtgatccgcgtgctttggcctcccaaagtgctggaattatgggcgtgagccactgcacctgaaccagtataatatcttttatgtaaatatacactgagtgatattctgaagtttctatgggtaggtgtaggggtgtgtgtgtgtgtgcgtgcatgcacatgcacgtatagggaaggacgtgcaccacaactaataaccgagtttaccagggagaaggtggtgaaacaccagggctgggagttaggggtgggggaaaaaggaggaaaattgtagctttatttataatggttcatattttttgaaggaaaatatatttatgaatagtttgtgaaatttgaattgttttttaagaaaataatagcttaataaatggtgtcaaaatctttgattcatttaggaaattacaaatttggtggttttacatagatatggccttggataaaaatgaacattaaaaacatttttctgcatttgcttatacatatcagtatatctgccactgtcaggtctaaatgaaaaaggctttaaaaacaatattatatgaaaaataaagattaaacacaaaagataaaaataaatgctaacaaacataaggctcatttgaaccctgacatagttctgaatctctaaaatatctattacttcattaaagactcaaatgtaatgtctagagaaacaaattgccttatagtttaaaacaacagaccagtgaatttgcctagtttcctagaccctaatgatgcagatgctgagtgtagctttaggcatttttcaacaccaagccttcagtatgaaaaagtacatggctcattgccaaatacgtttgccaagtcccaatttacaagcactattcagctcatttgcacttctatcttgatcctgagtgttggttattaagaaataataacatcatggcattgttccttgggtagacagagccatgaccttggtatatctcatccccgcgaacaaaaatatccagaaatgtctttaagtgtctttaagctctcattttctattgaattgaacactttcctatggggacctcttaggttcatcccaaaaggcaggatttcctcattgagataagtcatgaatgccagagtctcattctttctcaattatttggtcaaaaaaaaatcatagctattaatagttagaagaaaatagttcagaaaatagaagaaaatagttcagtcctaatttcacctttcattctgaatagaggaggaattgctagtgctcatttccttgagtgcttgaattaatcatcccaagtgtctcctatcaataaaaactagaatagacttctacaggccgagagttagggtctaaagttaaggataagttatatgttcaagaatctctggtactagtataaaagaattatgaaactcaggaaaggagttaataggagccatcatcaacagattgctaaaggaagagatgacagtgaacctctgttgtttttgtctgcttagaatccattcctttcttctggtgataagatcctgagtccctttgcagaaccatccctcttccactctcagttcatgaggttcaggttggactattatgaccacctggctctaggagtaggcacatgactcagatcgggccactagagaattctatacctcaagttaaagtaatagattcatagatgagatggccacttgacccacaccaagctaatgagaatccaggaagtttctggcactgctggagaaaacgtgctatatcttgtgttggtagaacttaattctgaagctctgcatagtcctgtttacagagactgcctaccagaaaataaagccaacactaagaagagctaggccaagggaaggagagagaatcctgatggcattttgtgagacctgaagtaagcatcacaccttgaacttctccgttacgtggataattttaatttcctttgtaatttgaatgagtttttggccactgacaaccaaaagaattttgactgatacacgagtaatgcagtgtatttaggtgttaagcaagcctttccagaggttgcccttctactgtgcttatctaagtcctattttttttcaaagaccaattaaaatatagtgttatccttgcagccttttagaatcccatcagacttttgtgaatccttcctccttttaatttcccaaagcatttgtttccaattgtcaattattatccctccttgtttgttttaaatatattcacacatcctctctcttcacattgattacagtaaaatcccaaggttaggaaccatgtgtagtaatgcattcctttatctcggtgctttgagtagattagggtttcagtaaatatttgctgatacattttaagggctgcagtatctgtgatccagttttgtgttccatctcaactaaccccaacacatgcccaacatatacacttaccctcaaccaaacacatacacactgtgtacacagacccctaaacatacacatattctgaagtcactgatgcagggtgagctcctttttatgtattgccataaagatctatttggcagagcaaagggggagtggggagagggagagcatcaggaagaatagctaatgcatgctgggcttaatacctaggtgatgggatgatctttgcagctaaccaccatggcacacgtttacctatgtaacaaacctgcatatcctgcacgtgtaccgagaacttacaataaaagttgaagaaaaaataaaagatcctattagggagaggacaattccagtaactaagttccttaggattcagaaatggctgaatgacaaggatagaagtgtttggtttcctcacccccatctcaactgaaatgaaaaggagtggtgaggggaaaagccatgttgaggagaaaggtgagtctgactgagtaatctctaacccaggagaaggcctgtgccccgtagccagctttagagtaaaaacaataaaatgattttttgctgcatcataagtacatgttacaacacccaggcacaggccttgaaataaattatacaggacttgtaagcagcaggatctgggtggatgagaattttaataataatgaaaatatgactcaggtcttggctctcccctaaggcatttccaactctctgaccttggttgcatcattgctctgctgtgtggaaagaagagagtgagcggagacccatggagcgaagtgtttttcctttccctttcttccagcttctctgggtgagtggggtgaaaagttatataaggtgatgtctaccagagtggtgaaagagaaaatcttcaccaaaagagaaaaaatgaggctgggcatggtgactcacacctgtaatcccaacactttgggaggccaaggcagatggatcacctgaggtcaggcgttcgagaccagcctggccaaaatggtgaaacccctcttcactaaaacaaaacaaaacaaaaattaacccagtgtggtggcagacgcctgtggtcccagctactcaggaggctgaggcaggagaatcacttgaacctgagaggtagagtctgcagtgagctgagattgtgtcactgcactccagcctgggcaacaaagtgagactgtctcaaaaaaaaaaaaaaaaaaaaagaaagaaagaaaagaaaacaaaatgagttttaaaaaaatttaaagaatacagtcaagaagtgagaacactcagggtcttgaagtcactgaggggaggtgtttcagtagctactactattgcaatgagtatcaaagagagtcttcttggtagaatttcacaaacagtaatagaatagctcacctttactgtagatgtatgatgtgctaggcactacattaacactttacatttgtctcctcacccaacctctccttacatgtgtgttaggctgtatcaacattctgatttttacagatggggaaactgaggcttatagagagtaagaagctcttctaatactgcacagcaagtgagcaatggaaatagtcttagagttcaagatcctcttattccatccttttaacctctccaaaatatgaaataagatggtactcagagaaatacctttgctcttttcctggcaaaaaatcttagggaaggtacaccataaagaaacaaacacagaagttcctcctggtgcctaaaacccccaagtgcccaaagtctaaatagagtgtaaacagtttgtccttacccacagttttgctttccgaggtttcagttacctacagtcaactgtggtctgaaaatattacagtattttgagagaaagagagatatgacattcacataaccttttttgtttttgttttttgagacagagttttgctcttgttgcccaggctggagtgcaatggcgcgatctcggctcaccacaacctccgcctcccaggttcaagcgattctcttgcctcagcctctggagtagctgggattacaggcattcaccaccatgcctggctaattttgtatttttagtagagacaggtgtttccatgttagtcaggctggtctagaactcccaacctcaggtgatccgcctgccttggcctcccaaggtgttgggattacaggcatgaaccactgtgtccggccttttttttttggagtgcagtggcaagatctcagctcactgcaacctctgcctcccaggttcaagcaattgtcatgtctcagccacccaagtagctgggattacaggcatgtgccaccaagcccagctagtttttatatttttagtggagatggggttttgccatgttggccaggctggtcttaaacttctggcctcaattgatccacctgcctcagcctcctaaagtgctgagattacaggcatgagccactgcacttggcccacataacttgtattttagtatattgttataattgttctattttattattagttatttgtgttaatctcttactgtgcctaatttataaattaaactttatcatgtgtatctatgtataggaaaaaacatagtatacatagggttcagtattagctgcagtctcatccactagggatcttggcacacattccttgacgataagggggaactactgtttaagtggcttcaagtgacttttacagatcagttgaaaccctcagctcctagtatatatccaccctggcttcttccctctttgctttgcttggagcttgctctgagtaacttgttttcagtcataacttttgtattaaaacagatgagggtggccaggccagatggctcatgcctgtatgcctgtaatcccagcactttgtgaggccaaggcaggaggatcacttgagcccaggagtttgagaccagcctgggcaacatggtgagaccacatctccacaaaaaataaacaaaatcagccagatgtggtggtgtgtgcctgtggtcccagctactcagggggctaacaaggaaggctctcttgagcctaagcagatgaatctgcagtgagcagtgtttgtgccactgctctccagcctgggcgacagagcaagactctgtctcaaaaaacaaatgaacacacccacaaaaaaaccacccccaccgctaccaaaataaacagatgagggtgtgggacaccctttaattttgtttttcttaaactatctctacttcgagttctgggaacttgaataatgttttctctcttccaactgcacttagggatcttgtgatccagttcagtcataagccacttacaagcttatgtgagatagaagctccagcacgttcatgaaggcagctcatataaccaagatcacccccttcccttttccttttcccacatgctgactccaagtaagttttttgttgttgttttgttttcattttttagagacagggtctcactctgtcagctcactacagcctgggcctcctgggctcaagcagtcctcctgcctcagcctcctgagtaggtgggaccacagacacatgccaccacacctggctaattaaaaaaaaaaattgtgtggagaagggggtctcactatgttgctcaggctggtctccaactcctggcctcagcaatcctcttgcctcagcctcccaaagcaatgaaattacaagcatgagccactgcaccaggctgccaagtggtttttactaggaatcaggacttttaagactgacagtgacacagaaattgacacttgctttaccctgctggagctcatcaaggacaatggcagcctgttgggcatgctcagcatgccagaccacagaccaaggtctcagcttccctctggaactccactacaagcagatcgtatcggtgagtgcttaaacacagtggcatgaatagagcagcccactgtctcattactttaagcaccacgcttgagaattccaagccaacagaagaactcgacctgttcccaagccttttgttgccgtctcctaaatcctgcaagtcctcctccttaaactaaagggctggggatttcagaaagggtgaaggaaacagtgctcttgaatcagaaacaagaacaaggcacacaggaactttttcctgaccttcaacttaatcacttgcctaccaaggagctaaaagcattcacattttaattttcaaggaaatgtttggtctcagttttcaggttcttcctgcttgactgggtgtcctcatttctctcagaaaaaaaaaaaaaaaaaaagacagtgatgacacagatctgcctgccctctagtgggcaacgaaaagaatttaaagtatgacgaaagacgagcctccagggaattaagatgactttttaactttgctacatttcccctaactgactagcagattgagtttttgccaacactgctcaaacagaacctgcagaccatgtctacaagaagttgaactttttcttgataaaaacaatgactggtgggagaaaaaagaggtgacatcagaaaacggggaaatcactgggtttggaatgagctgtgcatggcactgaagagtcatgtgactagatctcaccaatcatcagctatctcatatgtcaaactgggataatagtacccattatcataccagtgcggtgagaatcgaggacatctggaacatattatttgtgttaattgtgcttcatcaagccatgtgactttggctagagtgcagtggcaccatctcggttcactgcaacctgcaccgcctgggttcaagtgattctcctgcctcagcctccagaatagctgggactacagatgcccgccaccacccctggctaatttttgtatttttagtagggacgggatttcaccatattggccaggctggtctcaaactcctgacctcaagtgatccacccgccttggcatcccaaagtgctgagattacaggcgtgagccaccgccaccgttcaagcctcgtgactttaaagagaagataccattataaaatgaaggcagaggaagggtgaaaacaaaggcaccatcctggctaacacggtgaaacccggtctctactaaaaatacaaaatattagccgggcgtgggggtgggcgcctgtagtcccagctactcgggaggctgagacaggagaatggtgtgaacccgggaggcagagcttgcaatgagccgagatcgcgccactgcactccggcctgggcaacacagcgagactctgtctcaaaaaaaaaaaaaaaaaaaaaagagaaaaggaaacaaaggcactgagaaagaagctcaagcccacccacagagaacccttaaagacacaaattcatgtttcttgcttaaatcttaattcaatctgattccacaaataggtttactctgatacaattatcagcagtacaattgaaatctaaagaaagaaaaaatgactttccttcaggtgtctgcaatgtaaatgaaaattaaagcctggatatatgattgtcttttctcacttagtttgcaatgaaatcagcccaccaaaatataaacttttacctagcactcttttcaaaaaacttttaacacacacattttaaaaaattctctcacctcctacttaacctgaaatcttgcttagaaacaaagctaaacttggagtgataatggcttttctttagctacaattcctaaggttaaaaaaaaaaaacaaaattaaaaactactgatgtatgctatttaaaaaaataaaaagcagccatcctcccatctgcctgcaaaccccaatgtaaaaaaataaataaataaaaataaaaaataaaatacttttctaaactctgaaagaagatctaaactccgacactctggcctcaggacccaatgttaaaaaataaatcttagaattcaatcttctgtgacttttttttttctcaagattatctaaatttggcttattatgaagacaaggacaaccattcaatacttatttattccccaattaattcactcagacatgccaaagctctgtacacatgataatgtctgacatttcttgctttctatggtataacaggaaacttgacatctcaacaaaaaagataaaatgaggacatatatcataagactattgaattcttcaggaaggcaatattattttaagattatgcttcaaagaattataagcaaaatgaagaggcaccatttcaaaagcactgatagtaaattaaacttaaaggaataatattctgaacacttataataatgtaactcaaaaaccaatctgttctcacagaaatctccaggacgtctaagataattttaagaggtgcagtgagcagtattctaatgatagtagatgctgtactaattttaacagagtaggcaattgttttgactcactctgtttttcaaatacatgtaaaattcttgttgctcaagctatcaatattttacaacagaaaaaatctaagttgtaataaatatagtaaaagctaaaattgtaacaaaactatcatgcaagataagttcagatatataataaaggcaacttgtattcaattggtgaaaaattactgcctgaaatgttaggaccagaacacctgtctgtaaaccccattataaaaaatcagatgaagataacatgggtgttcacgttcatataccttcttttggcttttcgtagacttcagaattttttttttttttttttttttgagacaatgtctcgctctgtcgcccaggctagagtgcagtggtgagatctcggctcactgcaaactccacctgaggcaagagaattgaggttcaagtgattctcctgcctcatcctcccgagtagctgggtttacaggcagtgccaccaagcccagctaatttttgtatttttagtagaggcagggtttcaccatgttggccatgctggtcttgaactcctgacctcaggtgatctgcccgccttggcctcccaaagagttgggattataggcgtgagtcactgtgcccggcccaagaattatttaaaattataattgggggtggttgttaaagccaggaatatggaaagtatgtctgccttcaccattcttttcagcattattctagaggtccttagtcagtataagaaaatgtgaaaagggattagaaagaaagaaactgttatttgccaatggtattactggttacataaaaaactaaaaacaatttacagagaaatgttaagaaaaagataatatagcaatatggctggatataagataaattgcatttttgtacaccagtaacagttttaaaatgcaatttaaatacatataagatttaaaaaagcaagaacaaataagataattatgaataaatttaataagaggtgcataggatatttatgaagaacatttacaaacttatggaaagaagttttaaaagatttataattttaaaaatgctgactgggcacagtgcctcatgcctgtaatcccagcactttgggaggcttaggtgggctgatcgcttgagcccaggaatgttagatgagcttgggcaacatggcaaaacactgtctctactaaaaatacaaaattagccaggcatggaagtgcatacctagagtcccaagtattcgggaggctgaagtgggaggattgcttgagcccaggaggttgaggctgcagtgagctgagatcattccactgcacaccagtctgggtgacagaggagactctgtctcaaaaacaacaacaacaacaacaaaaaccaactaaccaaacaaaaaacacattaagggcttgaaagatctaacatcatgaaaaagtcaattcttcccaatttatctgtagactcaatgcaatctcaataaaaaaatatattcagagctttttaaggaaatcagcaagatgactccaaaatttatacgaagagaaaagggccaagaatagctaagacactatcaaagcagaaaagagtgggagagaggatgactagtcctatctgatatgaaaacttattaaaaagttatagtaattagaccaggcatggtggctcatgcctgtaattccagcacttcaggaggccaaggcaggtgggtcacttgtggccaggagttcaagaccagcatggccaacatagtgaaacactgtctctactaaaaatacaaaaattagctgggtatggtggctcatgcctgtaatcccagctacttgggaggctgaggcaggaaaattgcttgagccagggaagtggaggttgcagtgagccgagattgcaacattgcattccagcctgggtgacagagggagactctgtctcaaaaaaaaaaaaaaaaaaaaaaaaaaaagttatagtaattaagacaacccaaggatagagagaaaaagaaaacagaatataaagtcagaggtaatatttaaaggtcagagggaagaattttatccctgtattctccaagaaagtctgcaataacatttcccatcctacatgctcttccaaaatcttgactgtcttttgaacctgcatgggtccttgagactgccacaaccaacagatgcagtgacactgtggaacttccaagggaagatgataaagatcaacatagcttctgtctagaacacacgctctatctcttgagatgctcaccagtgaaatctaattaccatgagaagccacttgcagagaaagtgaagcccctagcccttggccctggctaagctctcagctgacagccagcactaacactttagccatattagtgagctgtcttggaagcaaatcttctaaacttcagttgatcttacttaggtaaagccacatggagcagaggtgagctttcccccacacaaccatgctcaaagttctgtattatgagcaaaataagtgataaggataaaacacacttaagccaacaaaagtgtgaaaatggtaaaaggccagcctgtgcaacatggtgaaactctttatctacaaaaaaatgcaaaaaattagctgccataggcagctatgtcctatagtcccagctacttgggaggctgaggtgggaggatcacttgaaccctggaggtcaaggttgcagtgagctgagatcgaaccactgcaccccagcctgggtgacagaatgagaccctgtctccaaaaaaaaaaaaaaaaaaaaaaaaagggaaagaaaagaaaagaaaagaaaatggcaaaaggataatcagcacaaagtaaaacatcagtgaatacaagatgaaaggaataaaaccaaatatgtaaatttattgcaataaatgtacatgcatggatttcaataaatatacatgaacagataaatgtacatgaacagataaacagatttatcaaaagatataatttttagtttttgttaaaaaactaagtgcagcaatttttaaaatagaaaaaatattgaaaacaaagtgacaaggaaagagtaaaatcgaagataaagatattctaggcaaaaataaaaaaagtaagaagaaaccaaaagtgacaatatcaatatcagataaaagtgaattcaatatcagatgcattaaacaaagcaagaagcatatttgtaaaaataaaaatacaatccaagacaaaatctaacaactataagcctttatgcactgaataatatgattccattagttaggataacctaggtgatgctgtagaataacaaataatcataaaaacttcagtggactagcacagtatgtttattattcaaacaatgtctgttgcaagtctgggaaactttataaggcagctatcccccatgtgatacttctttatcaacacatattttcatgattaccattagggagaaaagtacagtagcaatcaaacaatccagaaacatattggtcataacaaggcacattgccatgccaaacctcaacgtgggagttagcaaaaagtactgctttctcatgtgcttgaaaggatcagagatgttggtgtgaagcactaacatttagtgaaatacattaaggaaagatctctgaaaatacaaggcaaacttaactaaaacaccacaattttagaaattttgaaagtacatttttaaagaatttggacaatcatgtaaacagaaaataatgaaggacagaaggaattcaaataacataaatagcaaatttgatttaatatccctatatacaatttgtaatccagagagactgtttactcttctctacatttatggattaattttttatgtacttacacaccaataaaattttattttaaaaagtaactattttccccgggcgcggtggctcacacctgtaatcccaacactttgggaggctgaggcaggacaattgcttgaactcaggagcttgagaccatactggacaatatagtgagaacctcatctctaaaaaataaaaaaattagttgggctgcacacctgtattcccagctactcaagaggctgaggtaggagaatcacctgagcctgagattgaggctgcagtaagctatgattgcaccactgtgcttcaacctgagtgacagaatgagaccctgtctcaaaaagaaaaaaagtaactattttcaaacaacattctctgataattcaataaaataagaaattaaaaattcctcctgaaactgactttacaaattaagaaacattcatataaatttatagaacttaagaagaagacaaaatactaaattttgacaatgagtaaaagatttaactagatacttcccgaaggaaaatatatagagaggaggtggagaaagatggtagaatagaaaggtccaccgattgccccccaagcaaggacaccaagttaacaactatctacatagaaaaaacactttcataagaacgaaaatcaggtgagcactcatagtacctggttttaacttcatatcactgaaagaggcaatgaagaaatagaaaaagcagtcctgaatcaccaatgccacccctcccctacctaactctggcagctgcagtggggtatggagagcacctctgggcactgggtgagggagaaagcagcagctgtgaggtattgaactcagtgctgtcctgttagagcagaaaggaaaaccggaccaaactcagctgacacccacccacagagggagcatttcaaccagccctagccagaggggaatcacagatctcagaagtgggaacttgagttcccacaaacctcaccacggagggccaaagtactcttggcctctaagtaagctagaaaggctgtctaggtcctaagtactgcaactcttaggcaagttctagggtggaagtaggtccagagacagcggactgcgggtggagggcacgtgatgtactgagacaccagctggggcagcccaggaagtgctggcatcatcccttcccagggtacacagttagtgtctccaaaagaaaccccttccttctgcttgaggagaggagaggaaagattggggaggacttcgtcttccatcttggataccagctcagccatagcagcacggggaaccagtcagagtcatgaggcccctgttccaggccctagctcccagatgacatttctagacacaccttgggttagaagggaaccggctgccttgaaagaaaggatccagtcctggcatcatccagctaactaaacagccctacatcaagggccttgggtgagcctctgagacttgctggcttcaggtgagactcagcacataaccagctgtggtggcttcagagcaaaactccttctgcttgagaaaagcagagggaaaagtaaagagggccttgtcttgcaccataggtaccaacattgccacaggagagtagagcaccaagagggctttggggtaccctaattatagggcttgactcatggacaacatttctggacctgcctggtgccagagaggagcccattgccctaagggtgagtcccaggccaccgcaagctgactttagagaccttgggccttaacggaacattggtggtaatctggcagtacttcttgtagccagggtggcaatggctattggttgaggctcctttgcctttggaaaagggagagaagagtgggaaggactgcatcttgtggttttggttccagctcagccataatacagtaaaacatcaggtaaaggatggcacttctagacccacccagggtttgggggacctctccaccctgaggggaaggacagaggcctagctggctttggcacctgtggatggtagagccccaggaccttggtcaaacataggcaatatccagggagtggttacagcaggccttgggtgagacccagtgctacactggcttcaggtctggcccagcacaaccatagtggtggtggccacaggagtggttgtgtcacttcattcccagctttaggtgactcagaacagaaagagactgtatgtttgggagaaagtaagggaggagaacaagagtctctgcctggtagtccagagaattcttctggatcttgtccaagaccatcaaggtgttggtggtccacaagtctgcaagaaacacagtgttactgggcttggagtgccccttaaagcagaaacagcttagatcacagcacccaagtcctttcaaatatctggaaagccttctccagaacgacagctacaagtaagcccagacaatgaagactacgataaatacctctcgtcaatgctcagagaccgaagaacatctactagtatcaacaccatccaggagaacatgacctcactaaatgaactaaatagggaaccagggaccaatcctggagaatcaaaggtatgtaaccttttagacagagaattctaaatagctgcattgaggaaactcaaagaaattcaagataacacagagaaggaattcagaattctatcagataaatttaacaaagagattgtagtaattaaaaagaataaagcagaaattatggaactgaaaaatgcaattggaatactgaaaaatgcatcggagtcctttaatagcagaatgaattaagcagaagaaagaattagtgagcttgaaaggaggctatttgaaaacacgcaaccaggggagacaaaagaaaaaagaataaaaaacaatgaatttaatccaaagaagactacctcaaggcatttaataatcaaactcccaaaagtcaaggataaagaaaggatcctggaagtagcaagagaaaagaaacaaataacataccacggagctccaatatgtatgacaacagacttttcagtggaaacctcacaagccagaagagagtggcgtgacatatttaaaatgctgaaggaaaaaaatttttaccctagaattatttatctggtgaaaatattattcaaacatgaaggagaaataaagacttccccagacaaacaaaagctgggggatttcatcaataccagacctgtcctacaagaaatgctaaagggagtacttcattcagaaagaatgaagtattaatgaacaataaacaatcacctgaaggtacaaaacttactagtaatagtaagtacacagaaaagcacagaatattataacactgtaactgcggtgtgtaaactactcttattctaagtagaaaaactaaatgattgaaccaatcaaaaataacaaaaacaacatttcaagacatagtataataagatataaatagaaacaaaaaaagtggggtaacaaagttaaggtgattttttattggttttctttttgctagtttgtttgtttttgcaaatagtgttgttatcaggttaaaataatgggttacaaaatagtatttgcaagcctcatggtaatctcaaaccaaaaaacatacaatggatacacaaaaaataaaaagcaagaaactaaatcatatcacctgagaaaattatcttcactggaagaagacaggactgtaagaaagaaggaagaaaagactacggaacaatcagaaaacaattaataaaatggcaggagtaagttctaacttatcaataataacattgaatgtaaacggactaaactctccaatcaaaagacatagactggctgaatggattaaaaaaacaagacccattgatctgttgcctacaagaaacacacatcacccataaagacacacatagactgaaaacaaaggaatggaaaaagatattccatgccaacagaaaccaaaaaagagtaggaatcactatatcagacaaaatagatttcaagaggaaacctatgagaagagacaaggtcactacagagtgataaaggggacaattcagcaagaggatataacaattttaaatatatatgcacccaacacaggagcacccagatatataaaggaaatattattacagctaaagagagagatgggcttcaatacaataatagctggagaattcaacaccctactttcatcattggacagatcttccagacaggaaatcaatgaagaaatctcaggcttaatgtacactgtagaccaaatggatctaatagatatttacggagcatttcatccaagagctgcagaatacacattctcttctttagcacctggattattctcaaggatagaccatatgttaggttataaaacaagagttaaaacatgtaaaaaattgaaataatatcaagcatcttctctgaccataatgcaataaaactagaaattaagaggaatttaggaaactatgcaaatacatcgaaattaaataatatgctcatgaatgaccagtgggtcaatggaaaaattaagaagaaaattgaaaaatttctggaaacaaatgataatggaaacacaacctatcaaaacctatgggctatagcaaaaacagtactaagagggaagtttatagctgtaagtgcctacatcaacaaagaggaaaaacttcaaataatttaatctaaagcaaatcccaaatcagtagaagaaaagaaataacaaagatcagagcagaaataaatgaaattgaaattttaaaaatacaaaagatcaatgaaacaaaaaggtgattttttgaaaagttaaacaaaattgacaaattggcctttagccaaactaagaaaaaaacagagaagatttaaataaataaaaccagaaattaaaaaggagacattacagttgatactgcagaaattcaaagggtcattagtagttattatgagcaactgtatgccaataaattggaaaatttagaaaaaatggatacattcctagatacatacaacctacaaagattgaatcagaaagaaatccaaaacctgaacagaccaataacaagtaatgagatcaaagctgtcataaaaagtctcccactaaagaaaagcccaggacctgatggcttcactgctgaattctaccaaacatttaaataactaatatcaatcctactgaaactattctgaaaaatagagaggaagggaacacttccaaactcattatagaaggccaatattaccctgataccaaaaccagataaagacacataataaaaaaccgcaaaaaacaagcaaaaaaacccccacagcccaatatctttgatgaatattgatgcaaacatcctcaacagaatactagcaaactgaattcaacaatatattagaaagatcttcattatgtcccaggatttatccctgggatgcaaagatggttcaacctactcaaatcaatcaatgtgatacgtcatattaacaaaatgaaggataaaaaacatataaccattttaattgatgctgaaaaagcatctgataaaattcaacatcccttcatgataaaaaccttaaaaaatccggggatagagggaacatacctcaagataataaaagtcatatatgacagatgcacagctagtatcatactaaatggggaaaacctgaaagcctttcctctaagacctgcaacatggcaaggacacacaatgtcaccagtgttattcaacatagtattggaagtcctagctagagcaatcagacaagagaaagatataaagagcatccaagttggaaagaaacaagtcaaattattcttgtttgcagatgatatgatcttatatttggaaaaacctaaagactccacaagaaatctattagagctgatcaacaaattcagttaagttgctggatatgaaatcaacatacaaaaccagtagcatttctatatgccaacagcaaacaatatgaaaaagaaattaaaaagtaatcccatttacgatagccacacataaaattaaatacctagaaattaatctcaccaaaagactgaaagatctctataatgaaaactataaaacactgatgaaagaaatggaagaggacccccaaaaatgaaaaaatattccatgtttatggattgaaagaatcaatattgttaaaatgtccatactattcaaagcaatctgcaaatttaatgcaatccctatcaaaatgccaatgatattcttcatagaaatagagaaaaaaattctaaactttatatggaaccacaaaagatccagacttgccaaagctatcctaagccaaaagaacaaaactagagaaatcacattacctgatttcaaattatactgctactggcataaaaaacagacacatagactaatggaacagaatagagaacccagaaacaaatccacatacctacagtgaactcattttcaacaaaggttcaagaacatacactggggaaaagacagtctctacaataaatggtgctggaacactggatatccatatgcagaagaatgaaactagacccctatctcttggcatacacaaaaatcaaatcaaggtcgggcacggtggctcactcctgtaatcctagcactttggggggccaagaggggtggatcacctgaggtcaggagtttgagaccagcctggacaacatggtgaaaccctgtctctactaaaaatacaacaattagctgggtgtggtggcccgcacctgtaatcccagctactcaggaggctgcgacagggaatcacttgaagccagaaggcagaggttgcagtgagctggagatcatgccactgcactccagcctgggtgacagagcaagactctgtcacaaaaaaaaaaaaaaaaaaaaaatcaaatcaaaatggattaaagacttaaatgtaagacctcaagccatgaaactactacaagaaaacacaaggaaaaatctctaggacatagatctgggcaaaaagtttttcagcagcaccccataagcacgggcaccctaagcaaaaatgaacaaatgagatcacatcaagttaaaaaacttctataaagcaaattatacaatcaataaagtgaagagacaacccacagaatgggagaaaatatttgcaagctacctgtctgacaagggattaacaaccagaatatacaaagagctcaaacaactgtatagaaaaaaatctaatactctgatcaaaagatgggcaaaatatttgaatagacagttctcaaaagaagacacacaaatggcaaacaggcttataaaaaggtactcaatggtcaggtgcagtgcctcacacctgtaatttcagcactttgggaggccaaggcaggcggatcaccttatgtcaggagtttgagaccagcctggccaacatggtgaaaccccatccctactaaaaactcataaattagtcaggcatggtggtgcacatctgcaatgccagctactcaggaggctgaagcaggagaatcacttgaacctgagaagcggagtttgcagcaatcagaaatcatgccactgcactccagcctgggtgacagagagggacttcatccaaaaaaaaaaaaaaagtgctcaacattattgatcatcagagaaatgcaaatcaaaactataataagaataagaatataatctcaccccaattaaaatggcttatatccaaaagcaggcaataacaaatgctggcaaggatgtggagaaaaggggacccttgtatactcttggtgggaatgtaaattagtgcaaccactatggagaacagtttggaggttcctcaaaaaactcaaaattgaactaccgtatgatccagcaatcccagtatatatcccaaagaaagaaaatcagtatattgaagagatatctggactcctatgtttgttgcagcagtgtttacaaaagctaagatttggaagcagcctaagtgttcatcaccagatgaatagataaagaaaatgtggtagatatacaaaatggagtactattcagccataaaaaagaatgagattcagtcatttgcaccaacatggataggactagagatgattgtgttaaatgcaataagccaggcacagaaagacaaacgttgcatgttcttacttatttgtgggatctaaaaatcaaaacaattaaattcatggacacagagagtagaaggatggttaccagtggctgggaagggtagtggggtgatagtggggaggtggggatggttaatgggtacaaaaaattagaaagaatggataagacctactatttgatagcacaacagggtaactatagtaatttataacaactgtacatttttaaataacttaaagagtataactgaattatttgcaactcagtggataaatgcttaagaggatggatacaccattcttcatgatgtgcttatttcacattgcatgcctgtatcagaactgctcatgtaccccataaacatatacacctactatatacccacaaaaattaaaaagaaaatatataaatagctgataagtacatgaaaagatacttaacatcatttgttatcagggaaatacaaaatgagctacaatgttataccactacacatgcactcaaatggctagaattaaaaagactgaccacaccaagtgttagtgaggatatgaggcaagtggaactctcattcattattggtgagaatgtaaaaagttacaatcactttggaaaacagcttcgtggtttcttgtaaagttaaatatacatttaccacatgacccagcgattccaatccttagtatttaccaaagagaaatgagaacatatggatctgcataagaatattcatagcagcttcatttgtaacagccccaaactggaaacaaccaaaatatccaaacgagtgaatgaatatacaaattgaatatatccattcaatggaatattactcagcaataaaagaaaacaaattattaatagatagaaaaacatggatgaatctgaaaaactttaaccatagcaaaagatgtcagattaaaagaaaaaaaaaagcagctagatagaaaaaggcacacatcttacataattcatttatataaaattttagagaaaattaatctaatttaaggcaataaaatgcaaatcagtggtggccagaggcagtatgtggagattgggatttgacatgaggaaatattttgcactgtaactgaattagttgacttgcctattgggaagtttaagtggagcccatgtcttctcactgctctaatactgccaagcatgggcgagagacctatgtgcagccagttggactgctctttcttcactttaaatcttgaaaaaaactattacacagatagaagaaaatattcaatagtttcctatcctaatgctaggcctggttcttcagactttgtcaatatccttccaataaattccctcttgtggtttaagaagacattgttttagaaatcctagctacagcagaaagaatagaaaacaaagtaagtgttaatatagtagaaataaagacacaagatgacttttatttgtttttggcatgattgactatttaaaaatcataagaaactttgtagaaaagattaatttgaaacaaattaatataatttagatgacaacccctgccctttttttcttttgaggtggagtaaaagaaagttataaaattattttaaaatcaaaacttctcccaagtttcagcaaaagatgatttgggggtggagtagggaaggaggatattaagataccataaagctatagaggtcaaaacagtaatttcataaatataataggtggaaactggaagctacagataagtaaacctggaagccactagatcagtaaattatggtatgtttacacaatgagtgtgaatcatctacaactttatgtgtgctatactctgaatgttcctcgaaatgtatgtgttgaaatttaatccccattgtggtggtattaagagctgaggcctttcagggagtgattaagtcatgagggcatgaattagtgtcttataaaaaggctggagggaaccagcttaggccctttattgtgctcttcttctcttctgccctgtgagtccacagcattcaccccttttgtgcttctgcctttctgccatgtaagcacacccagacagtaccatctatgtggaatgaaccctcatcagagactgaacctacaagtagaatgttcttggacttcctagtctccagaactgcaagaaataaattcctgttctttatacattactcagtctccaggtattctgttatggcagcaccaacaatgacaacgcaaatatatatatttgtgttgtcattatatatatattttatatataacatatatatagtatatatatataccattgaataaacaaaaatatatattgaatgaaaaaggccagatacaaaagagagcacattacattatttcaattatataaagtacaattatataaagtgcaagcacagatgatacaaatcggtgccattagaaatcaggatagtggttacccttggcatgggaagtaactaaaagagaacatgaggataagtccagggtactggtaatcttctttttattaaatagattacataagagtgttgtttgtcaaaatttagtaagctataaatttatatgtacacttttctgcatatataattggtaacatatataaagtttttttatgctagaagaaaatgcttgtaatatatattaaatggttcctaagcattacagataaagaattattacaaatcaataataaaaataaaatcacataggagaaaataggctaagactacaaacacattttataaggaggaatgctaatggctaatatacatatgaagagatgtttacctaaaattatgagttttgggtgttagaaagacagcatttaaaacctgtccgtatgacctgctaaaaattacttgatctatctaaagtttagtttcctcctctaaaatggagaaaatgatggtgcttaactttgtagggttgcgagagttaatcaataaaagacaaagttttgaaaactatttctgctacatagttagtgctcagtaaagggtaatagcatttggagtggcattagtagatgtaggagaagcaccaccagtattaaagaaacaaatataaatctaaaaggcagcgccattttttaatccattagattagcaaaaatttaaaagactgataccattcagagtgtggggaaataaccatgtctttggtagatgtgagaatggctacctcattttagatagtaactatatgtttttagatagtaactatatgtatatctaatcattacatattttaatattaattatacattttaacctatatatgtataatgattaaaataaataattttaagttttttacctaataattccatattggaaacataccctacaggaataaattaataataattactccatgtgtttatgtggtaaattctcatttttgaaagattaaagcacaccaatattgaaacgatattgcaatgaaacttggggatgggggaggaatgaatgggcagagcgcagaggacttctagggcagtgaaaatactctgtatgataccataatgatagatacgtgttattctgcatttgtccaaacccacagaatgtacaacacaaagtctgaacccatggacttcgggtgattttgatgtgtcaatgtgggttcatcaatggtaacaaatgtaccactgtggtgggggatgttgacagtggtgggagtaacgcgtgtgggatagcaggggtatatgttaagtctctaccttcctcccatctctgctgtgaatctaaaacttcttttaaaaaaataaagtcttaaaaaaaaaaaaccttagaaaatgtggccagaaatgttaaaatgaaagaaggaaaggaaaatttccttatgccttcccactacttttagggttgagtgtaaactgcataagaacccaaaaggacctgcttacttctccaatctcatccctcgtctcttcactccacattgcagataactaaccatattgggtttctttcacttcctcaatggcaccctgtaatcttacatatgtgggtcttgcatgtgctttttcttttcacgaaaacatcccctacaagcacctctactgtctttcacctgattctttgtctgggtctcaatttagatgtctttcatccagaaagccttttgtgacctcctttctgtatcatttccatttcatctcaccactcgcactgctcctgtgcttccgtaataccttaatcttcctatatcataatacttaccttactatgttataattttctagtacttgattgattagtaggctatcacctcaaaagttttctcatgctcctttaaaatactttccccataactctctgtcaagccccaagcaaccagtgatctgttttctgtcaccaaggagcagttagtattttctataaatggaatcatgtattacatagtcttatttgtctgttttcttttacttagcttaattattctgagattcatccaagttgtttcttgtatcatagttcattcatttttattaccaagtggtatttcattccattgatatacctcaatttgtctatccagtcacaggttaatggacacttgggccttctcagtttgaagtcattacaaataaaactctgatgaatatatttgtagcgtgttttttcttgttgttgtttgtttattttgagatggagtctcactctgttaccgaggctggagtgcaatggcacgatcttggctcactgcaacctctgcctcctgggttcaagcgattctttcccctcagcctcccatagctgtgattacaggcatccgccatcatgcctggctaatttttgtatttttgtagagatgggtttcaccatgttggccaggctgttcttgaatgcctgacctcaggtgatccacctgcctcagcctcccgaagtgctgggattacaggcctgagtcactgcgcctggccagaagtgtttttatagacatatatttttgttattttggataaatacctaagagtagaatatgtgggtcacagtcagtatttatttatcattttaaggaattgccaaactgttttccaaagaggttgtactattttatataccctccagcagtgtatgacagttccggttcctccatatccttgctaacacttggtattgccaatctttaaaaactgtagacattctaaaattaggtacgtagtagggtcttttgtatcattcagtagttttatttttttaattttttttattttttgagacggagtctcactctgtcacccaggctggagcgcagtggcgcaatcttggctcactgcaagctccacctcccaggttcacgccattcccctgcctcagcctcccgagtagctgggactacaggcgcctgccaccaagccgagctaattttttgtttttgtgtttttagtagagacgaggtttcactgtgttagccagggtggtctcgacctcctgacctcgtgatctgcctgcctcggcctcccaaagtgctgggattacaggcctgagccaccacgcccggccatcattcagtagttttaatttggatttccctgattatcagtgacgctgaacatcttttcttgtgcttgtcatcctccatatgtcttctttggaaggtgtctttttaaatcttttcctcattttttattgagttgtttgttttgagttttgagtgctctttatatattctagattcaagtctgttatcagatatgtgatttgcaaatattttctcacattctgtgactcatctttttaatctcttaccaatgtcttttaagaaacataagctcttactgttgataaagtcccatttatcaatattttctctttatggatagtacatgtggtgttagaccttaaagagctgtttctgactaaaagtcacaaaacttttctcctgttttcctctataggttttatagtgttaacttttacatttaagactataaccattaagtcagttcattctaaactgatacatgtatatgatgtgaggtatgaatggcatttggatatccagttgttgcagcaccatttgttaaaaagactatgctttcccagtgaattgcttttgcaccattttgaaaatcagttgtgatggtctccatctagacaatattcagttccattgctttatcttaatgccagttgcatactatcttgattactgtagttttataataattcctaaagacaatgtaagtcccccaacattcttcttggttttttttttccacttttttgactattctaggttctttccatttccagaaaaattttacaaacagcttagcaatttcttttttggggggatggggtttttctctgtcagtcacccaggctggagtgcagtggtgtgaatatggcttactgtagcctcacctcctgggctcaagtgatcctcccacctcagccttccgaatatctgagaacacaggggtgtgccactgtgtccaggtaatttttaaatttttttgtggagacagggtctcactgtgttgctcaggctagtgtcaaatttctgggctcaaacaatattttcaccttgacctctcaaagtgctggaattacagccaccacaccagcttcaaaatttctaaaaaagaaaaagccttaatgaatttatacatcaatttgggaagaatttattttctaacaatatggagccctctgatatgaacacagtgaatctccctatttatttaggtcttctctaatctctctaagcagtgttttgtagctttcagggcgtagatcttgcacataatttgtcaggtctatacctaagcatttcttatttttgatgctattaaatagtatttttattttaatttctgattgtttgttgctagtatataaaaaaattgacttttgtatattgatcttgtattctacaactctactaaaatttattagtaatggcctttttattggattttctccgtagatgataatgttatattcaaatgaagtccattttacttcaatcttcccaatctaagagccttttatttctctctcttgcctcattggccaagctagaacctccagtataatggtgagtagaaatagagtcatctcatccctgatgttagggggaaagcattctatctttcgccattaaatatgatgttaattctaggtttatcaaagatgcgttttaccaggttgagggaattccctgcaatttcaagtttggttagagtttttgcccggcacgaatgttggattttgtctaataccgtttctttttttgtttacacaaacaaaatgtattttgtttaaaaatataatttacatatatatacacccacacaggggaaataacaaaatggtaatactagctaatttctagagttggcatattaagtcagaggggtattgatgaatagatgtagtttattaaattttttcctgtatttcctaaattttctataagtaacttgtagtttttattttttttttatttttttttttgagataaagtctggctctgtcgcccaggctggagtacaatggcctgatctcagttcactgcaaacctccgcctctcagattcaagctcttctcctgcctcagcttcctgagtagctgggattacaggtgactgccaccatgcccggctaatttttgtattattagtagagatggcgtttcaccatgttggccaggctggtctcgaactcctgacctcaagtgatgtgccctccttggccttccaaagtgctgggattaccggcgtgaaccgccgtgcctggcctgtagtatctttataataggaaaaaaatgttactttaaaaaacatcgcatgtactttcaacgtagactaaattcaaaatatttacacttacttattgtcatcttcactgtcaaaagaaaggaggctactgttttttatttgtttttgtgagttctttttgactgagtcctgatttattgcatcttaatttgtcttctttttgggcttgcttttaaacctgaatatttttcatctgaggggcacttgactggtgctttactggtttttgatacatgattcttccctcagctggagctggttctttatctgctttggcagcctttacttctgctttaattttcatgacttcttcaactgacaggtctccctttttaaaaaacatcacttgaggctcttcatctttgtcactgtgatccccattttcgtctgggagatgaggctggattctcttggtctctacggtgggctcctccctatagccaacccactccttgaagcgagccaggaatgctggctcggctggccgcacgtcttgtccaatactttttctgcgtctatgtagacaataatagttattcacttttagtctattaacatggtgaattacaatgattaatttttgaatgttacatcaaataattatctctattgtttgttgctggtaacttaagattattatgaccttttgataaatttatcccattatcattattaaatgaccagttttattttttaaaatctactttgatagtaacatagccactctagctttcttttagttagtgttagcatgttatatcttttttgccttttaaattttaaaccgtgtgtgtccgtttatttatttattttgagacagagtctcattttgtctcccaggctgaagtgcagcggtgcgatctcggctcactgcaacctccgcctttcaggttcaagggattcttgtgtctcagccttctgagtagctgggactataggtgtgtgccaccacacctggctaatttctgtgtttttttagtagagacggggtttcatcatcttggccaggctagtgttgaactcctggcctcaagagatctgcctgccttggccccccagagtgctggaattataggcgtgagccactatgccaggtctatgtctttatttttaaagtggatttctcaggtgggaggattgcttgaggtcaggatttcaagaccagcctgggcaacatagtgagaccctgtctctacaaaaaaataaaaaaaattgtctgggcgcagtggctcctgcccgtaatcccagcactttgggaggctgaggcaggtggatcacctgaggtcaagagttcgaaccagcctggccaacatggtgaaaccccatctctactaaaaatacaaaaattagccgggtgtagtggcaggtgcctgtaattccagctactcgagaggttgagacaggagaattgcttgaacctgggagaaggaggttgcagtgagccgaggtcacgccattgcacttcagcctaggcgacaagagcaaaactctgtctcaaaaaaaaaaaaaagtagctgggcaggtgatactttgttggtttattagctataattctttgttgtgttattttagtggttgctttagggtttgtagtaaacatctttctcccatgctggatgcttcctgacctcgaacatctgactccaagttcttcagcttttggactcctggacttacaccagtagtttgccagcggctctcgggccttcggccacagactgaaggctgcactgttggcttctctgcttttgaggttttgggactcggactggcttcattgctcctcagcttgcagatggcctattgtgggacttcaccttgtgatcatgtgagtcaatactccttaataaactccctttcatacacacatctctcctattagttctgtttctagagaaccctgactagtacagttgggtttaaatctaccacagtattatttgttttctgtttcttattcatttccttttccttctttttgtgcctactttagattaattgaatatgttttatgattctttaacttatcacagtttgccttcaagtgatattatattataccacttgatgcatagggtaataactcagttaatatgcttctgtttctcccctcccagcatttgtgctatagttatcacatattttacttccatgtatgttataaacaccacacaattggatgagggccgctagaaaaaaacaaacaaacaaaaagtaacaaaatcttttttaaaagaaaaaaacctagaatatcttattatttttgctttaaacagtccattttcttttaaagagattttaaaaataagaaaacaagtattttatatttatattttatatttacccacgtagctaacatttgtagtgccctacatttttttaagtagattcaaatttccatctggtatcattttccttctgcctgaagcatttctcttacctttttttttttttttttttttttttgtagcttaggtctcctgatgatgaattcttttagcttttgtatgtctgagaaagtaattttacctttgtttttaaaatatgctttccttaggtataaaaatctaggttgatggttttacttattctttcagtacttcaaagatgttctaatgttatccagcttacttattttttgttatcatttttattaggttggtgcaaacacaatttaggttttttcattaaaggtaattgcaaaaaccgaaattacgtttgcactaacctaacctaatatgtttgttcctttgcccagaatgtgtccttgtccccctgactgttttgatgtcttcttctctatcactggttttaaataatttgattaagataagccttggtgtagttttctttgcatttttttgtgattggtttaattgaactctttagattggtggattataatttttaccacatttgaaatattttgacctttattttttcaaatatcttgtctgtacccttctctctttcctctctttgatgcactccaattacaggcatgttaggctgcttgaaattatcccacagctcactaaagctctgtttatttttctccagctttttatttttgtgtgttttattttatatcctttcaatctctatacctccaggttcactaatcttttcttctgcaatgtataatatgccactgatctcaccaagtgtttttcaatttcagacatttgtagtttttatctctagaagttcaatttggttcttttaaaaatatcatccatgtctctacttaccattctcaaccttttttctagctttttgagcatatgaaatacagttatagtaactatttaatatccttgtctactaattttatcatctgtcactttgagttggttttgattgatttttttaatcttattgtgggtcatattttcctgcttttttgaatgtctggccatttttgattgggtcctgtgcatttaaaatattttttgttctgtgctggttgttagttttattactatacatataacttgagctttcttcatggatatagttaagtttcacttcttgtttataagcctacttagattaaaccagagcagcatttagtccagtactactttagctcactactgaagcaagacccttctgagttcttttcctgatacctcatgaattatgaagttttccactttcgtgagtgggaaaggggacaatcctcagtcagggtaaatactgggtattaatacctctcatccagtagttctcagctgggataattttgccccatagaggtcatttgacaatgtgtagagacactttttgttgttacaactggtggggtagtgctactggcatctagttggtagaagtcaggatattgctaaatatcctataatgcagctcccacaatatagaattttttgcctccaaatgtcaatagagctgaggttgagaaatcctgcctaatcctgtgggcttggggtattttcttcacatgcgtgtgctgatcaacactcaggtggagttgaggaagaccctattcacttctctagatttttctttctgggcaggtctctcctctctggaactctgctccaaaaactctagccatcttggcctcctcatccttacagttttgtctcctcaaatcaagaagactgctgggctttgtctgggtccctatccccatgctaaactgaggcctggaaactctccaggcagtaagttggagaaatattagggttttcctcattcatttctcttctttaatagattactattttacattgcctaatggaagccatatatatatatatatatatatatatatatatatatatctggttatatatatcagatatatatatatctgatttttagtttagtttttttttcaagcagaaagttaattcatatccctgttactccatcttgtattagagcagaaatctgcttttgacatttttttcttttttttgagacagaggagtcttgctctgttgtccaggttggagtacagtggcacgatttcggctcactgcaacctccatctcccaggttcaaacgattttcctgcctcagcctcccaagtagctgggattacaggtgcctgccactgtgcctgggtaatttttgtatttttagtagagacgggatttcaccatatagcccaggctggtctcaaactcccaacttcaggctatctgcctgccttggcctcccaaagtgctgggatgattacaggtgtgaaccaccgcgcccggccatgcttttgacatttttgaaattcaattaaaatcatagcattgctctagatcagtggtcaaaagctttccgtagtgaaatcttcctcacaggagtattttggttatttaattttttcaagtagggtgccaaaactgaaaagtagggggattttcacataaaaacccaaatttttcagctattcttgaaacatcctctttggggaatctcaaaacaactcgagagtacttaagagtactctcaagagtatcctttagcagtcaagacattggagggtgataggtgggctggatttcttcttcattgcccccaagcttcacccttcattcttttctgtcctgccttgtgccatcctgcctcctctatagaggaggctgacctctatgactgcatcaagagattgtttagccctttggattctcactgggttcagccaaacaggggcactgaggggatttgagggtggaaggagagagtctggcctccttcttgctggtttactaaaggttggtcaagttcttcctaaagctgcagcctttgtcaaatggtcttatccacactactctctctttggatctggcaacctcgcctatgtacaagaaagctggcaaacacagagaaaccaaatacctcgtggaccttattgccaggttaagaatgtgactcatacatttttttttcccgaaactccgatgggaaatagggcattgcaaggcttggaaatgtttgattgtccttttccagtgagtttgtttttgttgagagggaaaaaggaatgggagagagttattttgaggcatgtatctccagattaagatttagttgtatttctagagactctcttctatttaaattctgtttttcagttatgtgtttcatcaatatcattatgatcaccttccatagtctagtcaattcacagaatctgttttgacagctctgaacagaaaagtccctaatggaaatattagataccatcttaaccattttctccaagttgtattctacactctgtaatctcagcttaatgttattagctctggggcacaaatacacactcctacatacaagcatgtatacacatttttgcacactaacttaactcatgcttctctgtgctcttctataacagctatgtagtctgtgtctgtggtcttctaaatatttagtgatgagcacagactattggttaattatatcaacaacaagcctttttaccagaggaacttgaatcctgaaagaagtaaaataccaaagatcattcttgggttttagatctgtaagataaagacaaaatttgcctgccaagattaagaaaaccagcaaatatgtagggtgaagaacatatattctgtggattcactaccccaaagctatataggccaaagtgtgcaatgaagaaggcaccactccatgataggcttaaaaaaaggctgagtgtggtggctcatgcctataatctcagtgctttgggaggctgaagtgggaggattttgagccctgaattgcaagatcagcctggacaacatagtgagaatccatctctacaaaaaaactttttttaattagccaggcatagtggtgtgcacctgtagttctagctactcaagaggctgtggtagaaggattgtttgaacctaggattttgaggctgcagtgagctatgattgtgcctgggtgataaagtgaaaccctgtctcaaaaaaaaaaaaaaaaaaaaaaaaaaagaagaagaaaagaagaggaagaagaaaaagaagaaaaattaatcatggatacatttggatttcaaatattgttcatcctctgaaaaacataaacaataataaaaactatgcttttgaatttaacgttttcatgactaaacatatttcccaagcctctgaaatattgtatgtccaaagtatagggtctaacccatgatacactgccaaaccaatgagttcctcaaggggcttggcaaaccacaaaaccatagtgatacttggttcttgcctctgtatagtggggtttatagaactagagcagtctctaaggtgcctcccagctctccaattcggtgactcaaggaatgatgactgatttagggatttaggaagaagtgctagttaacagaaggctatatacttatggcattaatattgagtcatttcaagaagaaatggtggcaatctaagacctttgcaggaaacattctgattgcctgaagttttgcggaatagtctacaatttggtgtctgggacgaggaagggaacaagatggtggcaatggtatctacatgttcaaatctacccttgttattctttgaatttccatgatggtctctctcagtaaccaactccattccagttctagaagttctaggctgtgaattgtggatagtaacttggactttcccccgacctttctctccctcagattcctccctcaatcatttccaaataaagtggtaaaaaaccacttctcttgtggtagatgaaatcactcccctccctgcttaacaaccaaattatttaatagtcctttttttagcacttatgatttccatatgatgctcctccttatgagttattgaaatatatttttaaaggcatcaggaaattgacaatttgccctgagagtagaaaaacagatggaaacctactttatcactttgatatgcactggtttaatgtgatttcttagcaatttggggcatattagactgtcttaataaatatgtttcatccactaagtcttaccaatttatgcattttgtccattttacacctaggtttctgtgtctcatgttccccagaaggcctctctgttttcctgtgatgatatataaagagcagagatcttggctttttggcttactctgtttaatgtcacattcaaagtgtcattgagtaaaattttctcatgtatatgtaattgataataatagctgtactggaatttacctcctttgccaaccccttaatgaaatagtgggtctaactgacagtcatcaatgtacaaagacctgcccccaaaagagacaactggacatcatgagcctcctcatggaatattaccacctataaaatattattactaaaaaaaagtggaatctagatcagatcaataaaacaccactttgttggaaaaacaagaatcagaggactatgttaacactactgaactgcaatcagcaaaaccagaacctggaaaactagacagaacaaatgccccaatttcttcaataaattgcaaggaaaaataaaagagaaaagttgagaggggagagttctagactgagagaattaagtgatacatcaatcacatgtgtgggacctgtttggatcctgattaaaacaaacaactgtaaggaacaagcaaacaaaaagaataacaagaacaactttatgagacaaccagaaaaacgtacctggatatttcccgatattcagaaatgattgttgattttttagatgagataatagcatgacagttatatatatatatatatatatatatatatatattttttttttttaaaagagtccttttctttaagggctgtgtacggaaataattgtggattagaggacaggaatttcgggattcgtggcagaaagagtggagtggggattacaggaagaaataagagaggccatggattgatggttattgtagctggtagtggacacatgggggtccattgctctctactttttcaaactgcataatatttgtaattatttctgaattaataaaaactttcctttgctaatgcatctaagtttactatcatacatgttataaaattagtaattagtgatacctactaatattcggaactactcaacagtttacaaaacagttaaatttataatctcatttcttccttctcagtactctttgccgggataggtgctgttggaatccccacttcacagatgaggaaatgaagttcagtgaagctaaagacaatgccgctgtaaggggcggcggactagaacttaagtcacagaactccaaattccaggctccttcccctacactaaaaaacttttaaagaagcgtaggagtgtggggctcagcggctcacacctgtaatcccagcactttgggaagccgagactggtggatcacctgaggtcaggagttggagaccagcctggccaacatggtgaaacccagcctctaccaaaaatacaaaaatcagccaggtgtggtggcgcacgcctgtagtcccagctactcgggaggctgaggtaggagaatcacttgaacccgggagacggaggttgcagtgagatcgcgccactgggtccttttttttctttctttttttttttttttttttttttgacggaactgttcaggacctgacaaagcagcagctttaagagtggaggagctctcttcggctggggagatccttactctccatggccaccagatggcgaaggctgcccgcggcccagaagagagaggagcctgcagacccgcgcggaaactctgctgcgggacctggaggccaagggtgaggcgtggggtcctcctccactccaactgtgtggggaaacctgggtagaacttaaagttacaaaagtcattgtgcaagccctgctgtccccacaagggcttataggaaggggttcggagcttttcaaggaggcaggggaaaattaaactcgtgtctcttaatgtgtatttggtgggaggggaatgctgcctgaaataatgcattgcttcggcggcggtcagagatccatgtgacgcgggggcactttagggaccattgctgagggcctggttagcatttgggcagctgaatccttcccttggcgaactccatacgtgccctcggcgacacacagaggactcccagagttgaagaagggggtggatgtgtgtgtgcgcactcgcccacgtctcgtgttttacttttcatttaagtcgtaataaggagaaattcgatgaccagcaaggctggagtcccatcgtcttgttgggggagaggggggagaagaaaaaggtgcctgtaacttcagactgtccaagatatcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaagacacgcgccggtggaccgggtcctgggattggcttactcccgggctggaccttggggttcgcatatttgaaagcgtaaacttgaggaatgacggcggggtgatgggtattttatagagtgggactcaatcgtgctcagcaacagatttctccaaattcccttttaaaaagagcctcccagagctgtcgaaatctccgcggggtgaaagctaaacttttggagtcgctgtgtagccgggtagaggacacggcggcgcgagccggaaagataagtgtccaggcgaatgggaaaggaaagatcttaatttttgttcctactgttagctgaatgtccataaaaatcaaagggaatgcggggaagtttttattccagagcgtttccatgacacccgcagagatttaaaaaattacattcctccccctacgcaggtttaattcggaaagaagagactgcagaggagagggaagaccgtgagtctgctttcacctaggtttaaagcgaatcaaagacggctgtaaaaagggaaaccgggaccaaaaacagatttggagcctcgaaactctccattgaaggtttggaagatacgttgctgcagacttgaaaccggctccaaatccggcccaaacatgggctgaaaatatggcgcgctaatctgctgcttcccctcctcctcaagttctttctgactcttcccacctttcccagtttcccttccagacgtctgcggctccccactccacccccaggatagctactctacatcccgacaattcccagcttctacacccaggaggaggaattctggaaccacccagagcgaactcgtgccggggcggggtggggaccggaggaaggtcctgctccgaattctctccagagcagaaaagaattctagaggctacatgtgggctgctttccccccttcttccttttttccctcgcaaaccaacaaccaaaaagtgtttggtgatggaaagaacaccagtggaaaacggcaaataacagtatttccaactccgagtcaggtcctctttgcactgctttttcctgtttcattgcaatttattgattttattgtggttttttgtttatttggggcaagaacggagatgtgaaccaggacgagccagcagacccccgagccagtatctcctccctgggcagggaacaccgcctgcaccggtgcatactaggagaccctggcggagaatgtaaacaaaccgggcgccgagcccttgatctttatttaaatagaggcttgtttatcggtgtcatcctaggaggattaattagatacatctcttcacaatttggtgtctgacactccatcttaggaatgccttatcataaggtgttaattggggccactcagccacttacgtttctattaaacactgtgagggacttttcacaagtaccaggttcttttttactgtacgatgcaaaaacatacaggacccgaaatagactagggccagaatctgctatatcccggcagtgattagcactttggggctttctagagggcagaaataggagagcactgttttcgaaattccatcgcatctcccaatattcggtggttggatgcagatgtaagggggctgttgggggtgtggggaaggcgctgaccaggataggggggctatgagtctcccttccggaatctaaatcagtcatccacagtacatatatcttaaaaagcacatcttcaacgcttttgtccttggctccccggtaaagttcggggcgcctttgccaaagtgttttgagtaggccgttcggaaacgcggagcaggagttcgagcccccaaggtcacgggtggcgcgggaagaactcgggccccagagggacggaggggaagggagacaggacagtcgaggtacaaggtcctggcggccttaattgggcgcagaaggggaggaggtctcggctgattgctcgcctcccagcagctaatcctcttagcagctgcatttccgcgctacacagttagcagaatgatcctcccagctagacctttaccccgggagggtccaggagggggctggaaaggtttgcaatctgggcctgaagccgtctgcagataagcctggcgggacgtctggctggggggacaaaggggaccctccaccccactctttggacctcccagggttcagccaggggatgggctgtccttcgtcttcccgtggagcgtgggccaaataaacggaactaagcgcaaggtgaactgctccaaggtcactgtttgcagagcggcagtgcacggaacgactggaatcctcctttgtaagtgccacgcccgtccctagcctgcgcctcagaccgagtccgggcggagtttgactgcagctactgaggccggcagccggcggcggcgggtgcgcagcgtctgggttcagaagaaagccgcaggtgggcgcagaagctgagctgtgtgcagccccccgctccgccgcgccccagggaccctgaactggtgggcgctcaaagggccacgggggttcccagggagcctaggtgggcctaaggatgggtggccccaagtaagcctagaaaaaagcccagagaacttagtggccaggcgctctgacagagcctggtctccaagagccagaagcggaggttttcgaggcttggttaagtctgatgtgggcaatcggcagcaatcttccctcccccgttcccccgcccccctcccccgccccgccaacacccattgtccagacttcccagtggggtaaggaaatagccccattccacttcaaggaaaaaagaagataaacaaaacatccccacccccgcatgactacagtatccagttagagattctagagccttccgtggaggtaggggatgggtgaggcactgttaaagctgaaaacgatacaggaggaagcaaaatgagatctttaaagcaaagatgaaaaccccaacagcacagaagacagagctatgtccgttcccttactgaaccacatttattaaaaatgactaagactgtacataaaaatccaagatctctaaaatgcctataggagctgtggtatcaggttttagtttcttcacattaccaagttagggagaggggatggcgcaagaagaggatgaaataggagttttccttaaacacggttcaagttagtacatagtagctgaatacattcttaactatctaagaagtaaacagaatattcccaaatatcatggggatgatgaaactctccccttgcccctgcagctgttaagtgatttgcaaattctttacaaagccaaagcaccagttttacattatcccagacacctatgtagactatttgtacaatatataccacattattctatagtgtatctaaacacacaactgtacacttttaaattctcccttttttttttttttttttttggtgactccttagcttgctctctcctgagtcccactggccaccccagcacacagcagaggcctagcaagtctcaagtgaggcaatcctggactagggcaaacatggcttgttccaaaagccgggggttaaggaatcaaagtcaggtgaaactatcactttcacaaaagcttttcttgactcctgggcctagtatcttttgcccctggcagaatgtaacagcaaaatgtctccttctgaaacggaaggcacagccctctttcagaagcaaaacaccttaacactcggcttctatttgcttaagaatttacaaatagaaatgagaatcaaaggttttaactcatctgatagcactgggcacccaatgttcacagcctgcttctttgaagggttagtgtctccccaataaataaatacagaaccttggatacccttcgaattttaaaataccttaaagtcttccattaatcttattttttaaaaatgctaggtttgtttcagttacctgca

SEQ ID NO: 543 - DNA, 40001 bp, Homo sapiens
taacacacatttatcaaatgctgactgtgtgccaggaatagccccaaatgcttctgcagcagtgattttcaacctcagcactactgacattttggactagataatttgttgctgccataagcactaaaagtgagagccggagacagggcctaacaggagcttcgtatgtgtagactacctattactccttcccctttccattttgctgacttcaggtaagtcacttaacctctctgagcctcagttttctcatctccaaagtgaagatagtaactctaacctctccaggtggttgagaacataaaacaaaatgaactctgcctataaagtcccttactaatggctggcatataacaggagtgcaatgagaagtagtccttattatctccccctctatactcgcccatacagcagagagctgggcaataggaccagcttgatcctgagtgcagaaataaccacagtggggtgttcatgcccaggttatgtatgggcttggtcatcttcatgaaaagatgtgtgcacagtaaagagagaacacatcactggggccaggaaggaacagtggtagaaggaaccccaagcttccccaaaactgcaaattccctgcctccaacctggggcacctctggcagccagccacgttggcagcctcgtactttctcttgggctcttcctgttggcatagcccaccctgttttacaaagctccagtggttttttttttttttttttttcatggctccagctgttagataaactttcaaggatatttctgtggcaggtacaaacctggacaggaagacttgggaagaaatcctaaattaattatatgtcaacatttaagccacaagaaggagcagttgtcataaatttttggaaggttaaaatccaattttagttgtaaatgtgagcaagctcactgactcacttgtgaacgggtgccaacaaaatgatatattttacattctttcacagcttgttttggctaaacacaatgaaaaaagagagagagagaggaattacagtttttattcttcagtgggctgaggtgttcaatcatgcacaaaagctacatgtgccaaagcagaagaaattagctgagtttatccatatttttgggtgccttccacctttatagagaaaggaaatggagctgaaaactcaaaagacggccacaggtaccgcagttggtcatcgttagtgctgatggcccaaggctggacattcctgatgacaaatcaagactcctccaggaactaccctcatggtttatcctcagtcctgaccaaaccctggcacactaacaatttctaaagcatcatttctctgagtattggcttgggttgaatgcaatggtagggtgtcaagagcaggaaggcagaagaatttcctttaattttcacaaaattaggaaggtggctgggatacagttataatttttgcctattttctcattcattcatgcattcattcagttcttcaattcaacaagcaatcatttttgccagccatgggccaggactggggatttgagggggagtaggacataaaccctaatctgggagacttgcagccaggtcaggggcacagatgggtaagaagacaactgaaatacaatgtgatgtgtgagttcatgggggcccaggatgccccgagacacctcatatggtgtcagagagggccagcaaacattcctcatagaagatgacttccaggttgagatgtgaggggtggtgagtaggagctaccgagtggaagagggaagagaggaaccatctgagcagaaagcagcatgtggtaaggcctgaaatagagccaggccaaagctgacccagtgaacctcaagcaccaaggacacaacatggaatgggaaggggggagtagcagagtcagggcagagatgcaagcaaggccaggccacgtgggactttatggctacattaaggagactagatgctgccttcaggcagtgggacaccatggaaggggagtgacctggccagatgtgtgacttcagggcaaagtggaagctgggtggaggcaggtggggactacataacctttccttaagggaagaacaattccttgggtggtgtcagttgaactctgtcccctaaaaagatattttcaagtcctaaccgctagtaaatgtgaatgtgaccttgtttggaaatagggtctttgcagatatatttgaattaagataaggttatactgaattaggataggccttaatccaatgactggtgttcttagaagaggaaaaattggacacagagacacagaatacatacagggagaaggccatggggtgatggaagcagagggtggagcaatgcatctataaaccaaggaatgccaagggtaccagcaaccaccagaagctcggaagaggcaaggaagggtctcccctagaggcttcgaagagggaatggccctgccagcaccttgattttggacttctggcctccagaaccatgaaagaataaatttctgttgttttaagccaaccagtttgtggtactttgttacagaacccctaggaaactaatacaggagtcatggtggagttctgctgcactgctcccaataaaactgaaactccaggcagccttggtgctgaaaccatgggggtccatttgggagagggtcatctgagatccaagaagcatctcctcttgcttctgtctccctttgacctggttgagcaacttgtgctcaaaggcccgcgtcgtggctctcccaagggtggctgtccgtgagagagttagcaccaaaagtcaatatttgtccacaggcaacagttgtgtttgcactatgaaagccccaacaggttttttcagagatttcaattggccatgaagtaactctgtcccaaggaaacccctgaagatgagccaggagggacaaaagtcccaaacagtaggctctggcaggcagcatcacaggaagcacgaggggactcgtccccgggccagggtcttcacggggccttggtgcacaatcgctgtgcttgtgctgctgctggggttggacttcctcatgcagctcagccaaagcctcctggccctcccttggtgctgatcagctgttcccagctggaagcagcaatgtcatcctcttcccaggactccagctgacacagctgatgggtctgcaggccagcaggagcacacgtgtctccacacctcctttgggaggaagggatgtcctggccaccccagttctggcctggatgggggcaggagagtcaggaagtatccacatggctattcagtgcctagcacagtgcctggcactaggaggttcttaataaatgaatcagtgaatgaatgaagaccttgggctctttaatccaactgaatttgagtccaatcgtggcttagcccatgattagctatgcaaccttgaacaagaaactgcacttttctgggcctccactgccccatctgtcagacggagatagtaaaaatatctaaagcatagaggtgttgagagaaatagcatagaccagacatgttagtgcttagtggggggcctcacagtcttaagggctcaataaatattagtcaatatgactatcatttttattgtggagttgtatgccagtgtaaaagaagtgttcatatttgccagctctagacttgggggaaaaggatgagagaagagaacgtagcgaaatcctcttaagactccagttcacaaaccctttgctattaccttgatctcaactgaccgtcatgacaactctgtgacatagggcaagggttgtcatctccacttctgataagagaatctgaagttcagggcaattaagtaacttaggcaaacacttttcagtgataagtagcagagcaaaaccccaacccagaagtcttcccatgacatcacaacaaagtacagaggcatgccatacctcctcctggaatgaatgaatgaatgagaaactcaatcgcaaaatgattctcaggtataggtgggaaagaaaataagagctaaaaactataggatggaagcatcagagacttgggcactatttcatgcgtgggtttgggcagtcaactccccttttctgatctctgtctctcaatctcttctagttctcaaatcctaggaggaggcaatagggtagagtcagggtagagtcagaggccactcctcagctgtgatttaatgtcctgagcctcagtttccttacctgtccaataaagatagtaacaccccacaggcttccttggaggatcaggggtaatatgtacatgaaagggcttcataagcagcactgatattaaaaaggatgaagcaaaatatgatggcagattggaaaaaagaacctgaaggaaatggcccaagataaaaatgcattaatattaaccaacaggttcctttagaacaacaaagcaatgaaacaataattttagagaaacaaaaccctgcctaggaacagcctgccagagggagcggaaatgaaggcacaaccaagtggcccttggcttacctatctggaaaataacaagatgaaaaagattctttgtaaactaatatttgtaaaagccccactgggctttctgcctgcacagactgcctattatcttggcaaaggatgaaaacaagtgaattcttatttaaaatgagtatgaagcaaattcaggtaaatgttatcggcatcatcatgagctgccattcgctgaatacctactatgtgctgggcactgagccagggactgtgcatagatactttatttgacaaaaaaaaaaattttagcactctcacaaggcaggcataatattcaatcattcatatattcataaatgttcatgtttctttgttcaacagatatttcttgagcatccattgtgtgcaggtatggtactgtctggtacagacacaaggataaacaaggtctagtccttttctgtaagacaagtcatttctgacttgttgagattattctttatttaagaattccttgtggggtctgctctatgaattacaggatgtttagcaacatccctggcctccacccactcagatgccagtagtaccctagtttgataacgaaaaatgtctccagaccttgccaaatgtccctgggggtggggagggatatggggatggggttgctcccggttgagaactgctgacttagatcttaatttccacatcttttaagatgaagacagtggatctcagagaggctaaatccaaggttgcaatcaagtatgggattctgccatatgaagcagaaaccagagctgacctttgaagttgatagggttttgtttctgcatgttgagttccaggagatgggagtccccaggccatagccctgggattctgtctcatttactatcaatgcatatccacccttcaagtctacctttggattctttttttctctccaaatctgccaaatcttaaccatcataaacatttaattattgaaagttgaaggaaactctagctaatccacattctgaacccaagacatccctgcatattgctatgaatgtgagtcaattttccagtgagctcctggattgactatggagcacagttcacgttttgactccttaaacagtaagtcagtgagggtgtacggaaactcttagaggaaagagaactgggattattacattcccaaaatatcttggaatttttaaacttcaaagttgtattgcagttccaagagtagcctaacctttacaaaggttactttgcaaatatatgcaagataaagaattccctggaagaatgtccaccaggatcctaagcctacatttatatttaatttataatcaccctgaaaaaaatgggttcctctttcaaggagctcgcattacccttggactgacattgtgcaaaggagtgacaggtgcaatttacgtgaataatcaccataatcagccacacttaagaacaaaccagagacgtgctcttcagggggagaaactgctgcatcacacagtcaactactgctccctcaaatggtgcccaggccactggctgctattgacaatcaaatgcagaagacacaggagaagtaatatggctgactactgtgattcaagtactctggcctgggagacctgagttctagtcccaatattgccaaactcattgtatggtctggaagactttttcttcactgggcctcagtttccccattttcaagattaggtcattggtctagatggaataaaggctcctctttattctcttcctaaagcaagaggaataaaggattcctctttggagatgatgtcactggtagcagtaatatctcacagtaggcatttcatgaatgaatgaatcaacaaatgagtggagttttcctgcaactgcaatgctgagctgcctctgccatcttatttaattcaaaaccaaggataccttattctggggaataaatgatgtttaggtttatgaaaaccatgctatggaccagggattggtaagatagcaaagggccagacagtaaatgtgctaggctttgcaggtcttatgatcctgtcacagctactcaattctgcaatcgtggcaggaaagcagtcacagacaataagtacatgaatgggtgtggctgtgatccagtaaaacaaaaacaggaggcaggctggatttggctgtgggctgcagtcggctggctcctggtatggcttgaaacgtctgacctgacatgttctctccatcttgatcagtccctggtgctcagggcctggagagcagcacagcagcttcccaagatatctgcaataattatagccccatctctccctcagctcatctcctatggttggagcctacaaaaatctccctgcgagaacctccttttcagctcaggaacaagtatctccaagattattggcatcaaaagccatactttctccatgcgttaggctggggcctcaagagctgggaaatcagaaggaagaaatggttggaaatagagcacctgtgcacaggaacttggcccaccactgtcacttgctcatcactgggaaatcaaatccaagtgttaagtgttacgaagcctaattattacaagcagcagtcagaggtgggggtgggcatcccccctccaccagaacacctttccatctcacacaggagcacggtttggattctaacaggactatgaaggaataatttgatcgggaggtcatcgcacagggctccagagcccaactgaccttttgaagtctgctcagggaacctcattatgttgcattttggagtcgatcccttctctgatttttttccaagtctttttgccctttcattcctttgatggttagatttttgcttgatagagaggcacaggctgaggggagggagagccatggaaggaaccaggaggaaagacttgattattaagtgaatgatccactctaggggccttggcctgctactccttgggcttgacttgctggctaggatgtctttaaggagctgtaattctccagaaggcaagactcccattggttaccaacacaatttggaatgaattgatgcaaccctcaagtcacaagcaggagcccttgccaaagcaagcacagtttcccttcttgtaaagcagtaattgggagtaacttctaggaaaaggaagctgatccttccccatgacaagccacccctcccttgcccctgaacattaatgtgtttgctcagcccactgtctgcccctgatgtgcatttgtgtccttgctgccatttttcatgctaatgactcctgacttcctgctagcagaatgtcagagcacagagaagtccccaaagattcctggttcccttttaaaagatgatgaaaggtgacctggtgtataaccacatgcacaaatcacagatactcacgatctcatcaggaaaggaggtcattctccctctgatttcaacctgctgatgggaaccctcagccaggcccaggatttcagctcagcgatagaaatgaattccccttcctggctgcctttgtcgaatggtttgcctttccctgggccaccactggcaatgacaggacataatcctcctcttctctccttcccacctcaacatatttgaagagttttaaggcacatagcaaacctggtgaaggggctcatctcacttgcttgaatgaaagccttggcagtttcgcagtcattaatcatggctgtaaaaagactggcaaataaaactcaaggaactgtcctcggcttcagccttccatgctgatattccagattcaaggctgctttataccaagactacgcaaatagagctacacaagatctttggcttgagctacatcacccttttcataggatttctggatctccttggtggcataaagatatcaagggccatttcaaagtaactctgactaggagaattccctgcatgaatgggaagaccatagagctgacttctagttcaggctagacctgcatccttgtcccagctttaacatgaacacagagggtgacctgggttgagctgctcaacgtttcactgccttgatcagagctccccagctatataggtctcttcctctgaatctaaggaccgacacaatatgattgctttcattttatgattacaaacaacaccagcaacagggactaagctggggcttgtcatggggtacaaaactcagtgagattcatccctgccctcaaacaaacaagcaaacaaacctctatgtccagtgatatctcaagtatgtaataatgatgacgatactttttgagcatgaaccaggtgtcaagtacagtttctaaggctgtttacatatattaacgcactcaattctccccaagtcccttttcaatacatactctttttattctcatttagagatgagaacacagaggactgaacaggtcaggaccattgttcagggccacaaagttattaagtggtacagccaggaccaaacccagcctggccactgggccctagtaagctgcacccccatctcatggacataaaggtactatcaggctccttctttacttgtgctgtgttctcagttaatcggttcacttttacatttattccaaaatattttaataaactcttggtagagcctgacccaaggctgggtgctgggatgatagcagcaactgagaaagacaaggtccctggctctcacagggctttcaacggaacaggaaaaaaacaaacaaacaaaaactgcctgaaacccttcttctctggtgagggcccttggcccctaaaatcctggggcatgagtcagaaaatgtcttcctagctgtcaggactggctaacctgcaaagacagggtcaacactggaaggaccacagggtaaggcctcattttaccaaaatatgcttctcgcctaagggattttcacagggttagcaaatcctgtgtccgtcaggggacagagtgagatctggcaggagtgtcacagatgggagaggccaggctgtggcagaggcctcctggcaacagaggctgagtccaagaagggctcagggtgcttgggtgagagacggggcagagggagaagaacatgactaaccattctaaccagggctcatgaccgttcaaaggttccctcatctccctctgtgtccggaatgatactgacagtattcacacgaatcaccttaggaaccaacgtttgctgcatgccctgtaccaggcttgacactaagcacacagcatgtcttttggcatttaatccacactacctccctgtaaggggagtgatcatagttccatccaaaccccgagtccactccctcaggcaaaaggagcaaagaagccaaagagtagaagactgccaagaagagaggaggtgagaaaggaaggtgatggggtgagggcagtgggtaggagacccagaggcggctcaggccactggggctggtgtggagagatcaggatgccagcaaaccaaacagcaacacacgtgtgctgctcctggggagatgcttccatgggagtctcagacccgctccttgctctcctgactctcacatgcccgcacttcacccaggacagctctgcattttctcccttccagatgctgaggttccttataacatttccttcgaattcaagatttcatattattttgatgatgcagagacagtgaagcccagcgaggggcaggtcacccagggagtgagtggtagcgtggcgagctggataagaatgcagcccctacaattggacaggtcaggatggaatcccagcttggccacttactggtcatgtgccttgggcaagcgacatcctctccgaaagcccagcttcatcctcaggaaaaggataacaggaactccacactggatggatgtgaagatgtgatgagatcctgtactgaagaacttagcacagtggggtgcagtggctcatggccataatgccagcactttggaaggccaaggtaggaggattgcttgagtccagcagttcaagaccagcctgagcaacataacaagacctcatcttaacaaaaagaataaaaataaattagccttagccaggcgtggtggcatatggctgtggtcccaggtacttgggaggctgagatgggaggactgctgcaatcataccaacgtactccaacctggatgacagagtgagaccctgtcaaaaaaaaaaaaaaaaggccaggcttggtggctcccgcctgtaatcccagcactttaggaggccaagatgggtggatcacttgagcccaggagtctcagaacagcctgggcaacatgacgaaagcctgcctctacaaaaaaattacaaaaattaacagcatgtagtagcacacgcctgtagtcccacctacttgggaggctgaggtgggaggatcaatcgagcctgggaagtcgaggctgcagtgagctgagattacgtcactgcactccagcctgggcaacagacctcgtgtcaaaaaaagagaaggacctagtacaggacctggtgcaaaataatagctcaataaatagtagtgagtattattttcagtcctattcaaattcttcccttttcttggggtcaagctgcaatctgaaggagcacaaggtgatgacaggaggttccccagtcatttcaaaaccaggacccaaacagaacagtgatggcccccatggttttgagaggaaatggctgagcatcatggtcaatggaagacataacggtgaagaggcagcatctgcacaaagaatccagtggctgaagtctagcagctgaaacagccagggacacaagtcactcgaccatcaaccatcagtcactgtggccatttccaccagggttcctgctgtggccatgactcatcccaggtgtatccaggatgtagtatttcatggtgtgtgagttcagtatgttatttcagtggctcagagcttcatttcccaaccagctttccaagtggggctgaaacatgttccccttcatcttgcctgacttgtagtttcttcagctcctcttctaagtgacaggagaaatatcctctggaatattggaaagcaggaaactactgtacaaaaataaatgggtaccttaagccaacttgctggaattccactgcatgactgccttccaaattcaactaaggcccagagcttgtgtgagtgccagcaggtccaggaatattatttttagagagaaaggctgtgggtgggttttggggagagaaggtggaagtctattctaagccacaattgaggggtgttgccagagcaaaagatttatacccaggagacaaatgtttggagaaactgaggttctgatgactggtgtgagccaccggcagcagataacagtggaaaaggtgggagtaaaatagaggtaaggctcacacccatgaatggggctgtctgtaccctcttcctaaagcatgacctgtgaaaggggctaggaccatctcccccatcctatgtggaccttcttccattccttatattaaaacaacacaggctgggcgtggtcgcctattatcccagcactttgggaggccaaggtgggcggatcacctgaagtcaggagtttaagaccagcctggccaacatggcgaaattctgtctctactaaaaatacaaaaattagccggacatggtggcgggtgcctgtaatcccagctactcaggaggctgagacagggagggagaattgcttgaacctgggaggcggaggttgcagtgagccgagatcacaccactgcactccagcctgggcaacgagagcaaaactccatctcaaaaacaaaacaacaacaacaacaaaaaaacaatagttttaagtctcaaattctaatcccattgtctctgatgtgcccagagtaaactttctaaaacatacaaattggcataagtccctttggtagctccttactgttctaaggaaatacccacaagaccaagtcacctccttaagcttcttccatcttcccagctgcctccactctctgatttagctttctcctgtcctccttcactggacaaactcaaactcactgtccagacctcaggttagacaacactgcctctgggaagccctccctgagccctggtctgagttagatgattgttgcccttgcttccaaggccccgtacctccccaaccctgagacttcccagacgtagctgtgcggtcctcccagctgggctgtgagctccatggagacagggatcctgcctactcggtctgccactgtggccctagcactgtgcctgatacagagtatgtgcccaataagcacatattgtattgattggctgagctgacttgatgcagggcctggagtaaggtcttgcaggacccaagtttgttagtctctgtcaaaggagttgaagtcataaattgagaaattgtgaaacataaaaattgaaacttatttaaagagtttcgtagtaataaatctgaacttcctggcccctgctaaggggctacactaaacaaacgggtgtgggaaataactgaagggtaggagcccctaccatcttactcagatatcaagacaacctaccagaagtggggcaaaccctagatcactctcagaatgctgatggcctcccagccccctcggcccagtgcctcaaccccgtcctacaggaagggactgtgaaacctcaagcttttgccttgaaattagaggcatctaaacctgtcacctaagaactttcgccacatataattattgacctgagacatcagtcacattaaaaaattcaatgctgacagagggcaaaagaaaagcgtctagaatatcaaaaggtaaagggtccagattaaaaagagagatgcaaggagggcttttcccaagtcacagcctttaattgactccagtctctgctgaacaccttggcgtcctttgccagcatgctgggaggccgcatgggctccaccgacaccggtaactcactgcagaccagcggggctggccggccacatttccacaagaagtctcccctcacagccatgctgggtgccacaagcaatcaatgtctgcaaatgacaagtttgctgaaagaacagtcttagaaaccaggataggtttggagcatagaggtggaagacgatggtttccccccctgaagtgacagactccagaaaagcatctagaatatcaaagggtgagataccaggcctgagacttaacgaagtctggtccaaagggaggctggctggtgtttttcattcaaaggtcagttgagtaaatgttatagtcagctagctgatttctttggatcctagcttacccatctgtgaagtgattctagaaaaatgatcggtgtctctgctccccgactcgcactttagagcagaggcatacttttaaattaaaaagctctccccgcttacaaaggctgcatactctgggtcaacctctagtttagtacaaatgcagctttccactctttcagatacaaagaaatcataagctgtcttggaaggaaattaaaaagacaaaccagggtaattcttgtagagagccttagaaaccaaagtcctgcttactctgcatggaggacacaggtcatgaggacacatttcaacatctttcccttttgaaaaaagtttcattagcatcttagttttctgcaaagaagtccaaaaatggaccaaagggcttctgaaccacaaatgaaggctgtgcctattactctattagaacactgcatccccttcccccaattgcggacgagcccaccaccctccaattgtctctctggtaggtgtgtgggaggcggtggggaggagattgtatgatcagcatgtcaaatcctttgaggtcatttaggataaaactggtatcaaaaggaatgtcaagcagagaaatctaaataattaaaatctgttagtagctatagaccatcatctcttcctgtttggggtttttgtccctggccttttctttttatctgaatttcacatcaacccgtgagattttgctgggcaaaaccagctttcctccagttgctgggctgtgcttattaaatgtggatgaatgtcaatgtcacccatctcattaataattgatttccagccctgtctctatttgcagagcagaagccacttacagagtctattattccaactctgtgtgtgggtcacagggccaaaggggttccaccaggggtaacctttgttggcagcaatcaccatgacaacaccacacatctccagcctcaactcggatgccgagaaggtgctgagtcctgtcccacactggggactgggttggagtttgctgcgctaaatggctgtgtgagcaaagctgctggcaaaatgggatttttccattttaatttttagtctttgttgaacggcattgcgtgctttaacgaacgcttttggaaaccaccatggaaaagggcatttttggattcacaaaacaaaaccctgtttttctttctgtctcctcaggcaaaaaataaagacaaggtaaatccctctctggctgcttttaggtcattttaagtcaatgaaacctatataatcccggaataaccgattgtttcttttccacccgaccaaagactgcaagcttagatgggaagaattactgttttgcttttaaccgcctattaatattttgtcctaccagccacgcttcctctatccctctatcccttctttgaagatttccccccattaaattaatgtttaacaattaaatgaagccaacggagagttttgaaagatccacacaattgtggattgggtgggcgtacagagcctttaatttaagtgggaaatgtttcccaaattatggcctgagacctcacagctaattacataattttctgcatctgaaaaaacataagctgagaaaatacaaacagaatcacactgataataagagagaaaaacctggaagtgggtccattcattattttagaaaacagagctactaggcatgaaagaagcacaatgttagagtatattaacgaagggtgcataaaagcccaatgctggaacttcgcatggcttcagagatcatctgccccatgttcatcaggttgaggctggacactgaattgaacaaatccacttggtcaaatacatctgagaaatagcatatattttatccatgcttggagattttctaagacgtattttcttttcttttattttcttttttctttctctctctctctctttttttctttctttttttttttttttttttttttttttgatggagtcttgctctgtcgcccagactggagtgcagtggtgcgatctcagctcactgcacgctgcacctcccaggttcacaccattctcctgcctcagcctcccgagtagttgggactacagacgcctgccaccataccaggctgatttgtttttttgtaattttagtagagacagggtttcaccatgttagccaggatggtcttgatctcctgacctcgtgatctgcctgcctcggcctcccaaagtgctgggattacaggcgtgagccactgcgccccaccctaagacacattttcacactgaaagctctaagtcctgcaataaaaacaatatatttaatgttgtttagcccagaattggccaaatgtttgtgattatagattttttaaaagaatacttatttcagtaatgtttattaaaataataaaaatattttaaatgctcattgtaaataatactaatttaatatatcctgtggggattttttttttttttttgtaaactttttacagttctatggaaccagtgtttatcagaatatatttgggaaatgccaactggatcccatgccttataaacaaagatactgaggcctagagaggaaaggatttgttcaggatcccaagggcatcttagggagttcttgggagataaggatcctggatcgctgcatttccaggctaatgcctgtggattaaacctcatttatgccctacctgaggttatatcctacctgacaatacagactagatgctctttaagatcaggataagtcaatgtgccattctgtgacatctttaaaagactgtgatttttaagggagaaaacagaatgcacttggggaactggggagcaagttcatcagaataggtgcccactgagaattcacatagatcatttcacaccttactcttctactttgggcaacaacttgttgtggtgagaatgttccagactgagaactaggggactaagccagtattatttaaggctgatcttttctgcaaagtatggatgctgagatggctagggaatagaggtaagaaatggtctatgctcatttgggagaagaaaatccaagatttaatgaaagctcagccactgagttgctctctgagctcaggatggtgccttcttgtccgggatcttagtctccccatctgtaaaacgaaggaggtgaaccagagtattttggaggcccctcccagctttaacgttctttatcccactctcctgggagtgacactcaaagccacattcacacaatgactgtaccatgaatagctgcttttaaagtcaaaattctcttatctgggaaagaaatgtctttgttcctttcaagagcaaggtcagttcggaccggcaccccacagaccaaatgcttatgcaaagcttatgccatttctgggaggcacctagggcagtcctggaagggttggctgttccttacttcccagtcactgcaagaccctcagataacagcttctcttattatagtctggctcccactccctatgaagaaagtgagaggtgcagatgtgcaggagccaacaagtatatatataaacatcaaagttttctttggaagggaatttcagaaactcaagaaaagtcagatccaaactttgggttcagctcaggtcttcctccttaacaaaagccccattcctgaaatgctatctgagaaaaaacaatttcattcaggacatcaagccgtgaagtcatcaagtcttgaaaaacatcaacctcccagaccaccatctgttatgcaagctacatgcaatgtacaaggttgctaatttttttggccagaacttcaaattccatgcttttaaaaattaagatgacaaacaacttggttttacaaagacgctgaaacagccaaaaacagtctggctcccccttaggtcccagaaaagccacagctttgatgaaaggccttaggttgtcaaatcacgccattggtgctcgctggggtttagaccccgtagcctacatgacaagagccctggtggtagggttgactttccattgtaaataaaagccattggctttccattgcaaataaatgctaggaatggtcattcccattcttggctcttatctggcttgtgcatctgactatctctgactatctctggtagggaaagttcatgggaaggtttaacaattcatcaagagcagctttcacaatctttatgttgtcttctccaacataaaaattggccattcctaagcacatactatacacagaatccaaaaattgtgaggctaagtgtctacacaaaatggattgtctagaaagccaggcgaggactgtcatgagactccagatagtaatccaagcaggaatgttttgccctggttagttttacaaacgttgaatatagacaggtcaatgtgttaatatgccaagtcaatgttttttgaaccaattcagccaaaaacatattaaggcaagttgctagacttgaaagagtcttaagaattttcacaatttttgccaaactaccccttattgagcattttccaagcgctgtgaaaagcaatgacatatagcatctttaatcttcatagtaattctgcagagttgacgttttaaacccattttactgttgagaaaattgagacagaaaatctaagaatctatctaagatcgcaggatttatataggatgaagccaggaaccaaccaaatgtacacagataagttcttttccctatatcctacagaagaggtcagttctttttcttttcagtacagctatggtggaggtcaccactcccttgtgccacgttaatcccccaatgctgagatcattgaagattgtatcaaaaatgggaacattgcccaagatggtaaatacatctcatctagaatgttattaagacaggcttgccatggctgcctggagaaccatactcactgtggctctgtgaaaagagtgcagaaggtattggttaagccagccttgggactggagagtagtggcacctgtattacagatttctgactctgaactatggatattaatactgtcaggaccaaaactcatctctctctctctttctcatgccttgaaaaagcaacacgttgagtccgtaactcatggcaccaaacttgacttcccccaaaacttactctggcagtgaaatatctgagaacagaaaaaaggaatatgaaaagatgggacagatctttcatgaaaaaatgaagagctttgagtgtctttcagattatttcccctttctccccttctcattgacagcagctctgggtaacctttttcatccaaatttttgtctacttcaaggttacccatagcttccctaacagcagactagttacctcttgactaaaagacaaaaggaatagtcaaaacttctctaagccttctaatggattccatagtggccaatacttgtcttccttctgctttctatttccacccagaaaggttcaggtcttcctaaaacaaccactctcagcttctaccccttagagaagggaatcctctgcagggattcctcctgggctgttaccactgggatgatctgctaggtcccacatctgctcaaagcctccatatctctggtgtttcactgcaagtccatgagtctcccttctcctggcctgccttcctgccttcctgcacccgctgtgtttaatctgtccttccatctatccctgaactccatcagacctcgtctctgggggagtggaggagtaaggctgaaataacaggggctgtggaggagctgtctcggatgggggcagcagcaaaaggctgtccacgtgtaagcagtcaaatatctgcacttggagggagagctacagggagacagggttacatcagccagtaacatcgagggccagagcttagactaataggaagaaataaagaatggaaatgtttcggccggacatcaagaaaaacatcccgatgaaaaaggaaggctcccacgtgggggatgttctcataaagatgagtgagtggccaggtcactgcagcgctctccccagcctggctccagtgcggtcacaaacgaggcctagtggcctcaggcgggttagcggttggcctccctccagtttcccttcccttggagaagaccacagagatggttcatgcagatgacatggtgtgtggtcaccttcaccctgtaagtctctcttagttgtaagaatgaaggaggcacttaagctaaatcaagagaacgggagcttggctggggacggattcacccagtccataggatctggaggagggtcaggagctggggcagcatggatctcctcgttcctgctgcgctgtctctgtgtgccatttgcttctctctacgtccctcttctctggttcctcggaactacagcttgcatgtcatggctgccctggccactctcccactctctctcgaagccttacctctcaccactaatcaactccacctccccacgatcctcaattcagattctcaagaacaagaacctgcctggcctatttcatccgttcagggaggccgattcacaggagtccatccagatgatgaggtggctgctgttggtcccagtgctcagccctcatccaatcaaccatggctggggcagggcagcatgggactaagcaaggctgcccaggcaggagaggctaccgatggggatgagagtgatgtgggcctttagatacctctgggcctgtctgggacgctccctattcccctcttcaagcacctaagtctaggcctccaagcttcaggtctcagcctcccaattagagttatactcctccttgagctccagggccctgctgcttgggttgggcaagtgttcgacagacagaaaagggctgtcctcccactcacacatgtggcccagtgatgggctactgggtttattaggcctcaacgacagcattttattagtgactgatgtgccatttggcctccattccttacctcccacccccagctctatcacatccaccctttgtctctggctggaaagaggccaaatccttctccacctaagaagttctccacctcccccaccccatatcagtgggggaggatgacggggcagtccttctaggaattgtcccctggggcattatttggtttcctctcacttaccagagtcacttaggataaatctgaattctgagttgtttgccaaatgctggatcctcgctggatactccttggattccttgaagaattcagcataatataaaacagcttaaagtcaagaagccccttctgagacccttaccaagggaggcaggaggagggacaaaatacaacaatcactatcattccacacaaccatatacaaatcatcatagcaatggatgctgcctgttacgtgcctgactccgtgctagggctgttacctcatcatatcctcaaacaacaaaggaagaattacatctcacaaagtgtaaattctttgccaaagggtcctgtgaccaatgtcagacaagagatttgacatccatatctttgctaaaggtgtctacttctgtggttatcattgtgacgtttccttcatgtaatgcaaaatagcccctactttccacatctactgaactgcaccttcatctgtattgtcagtcatcattttcctggctgtataagtgctttctccaaaagacttctctcccatctcatcaatcaccaaaccctgatgcttttattctttagaatatctctggaaaccagtgcccattctccatcctcactccaccacggccacatctctcttctagattcttgccatagtttgctaatagaactccctgcgtcaacatcctccagcccatccatactccaaactccaaatggcaaccagagagctccttctaagacgcaaatccaattacatgactccactggggagggatcagaaggatggagtggtaagaagcagtgagccaccaggacacgcagtgaacactgatgtcctactgcatttctgcagagcggcggaaggtgtgggctgctgtgcgtcggatcacgtgggaatgcatgggatcaggtagaatggatgggtcacaggagtgccaggcattgtaaatggggaagagttgaacatctcagtaactgaggaacaatttatcctttcagtgggactcttaggggtaatctgcttccattggagacactccaagaagcactcacagaaaacctctgccctccagtcaggagtttctgtgtgtgtcatatggagcagacagagtacaccaacactgcaaagaacaggacaggaggagacttaaaagaggcaaagagaggatggccagctgtgctcatagttgctgtgccagggggtacccactgggccgggtcctcctgccagggttgtgagttcttgggtgtggttcagagcatggctgggctggacagccggcagcctctgctgctaaaggaacccaaggggcgggggaactagagaatcccatttggaggtcttgggtcccgttaccctgtttttggtgccttccttagggtccctgagcgcatacagggttactcagtaatgctgtgagaagagaatacatggacggaaaggagagcagaaagtgaggacccagtggtcaggagccagagagcatcatcctgacctatgcagtatgggataagctaggaaaagcttcagactggggaggagggtccagacatctggctctgtggttaatacaatgaaaagaagaataacggcgacagcagctacccaggaggcagaggctctgctcggcacttcctgggcctcttcattctgtccggcctccctgctggtccttcacagactaggctggctcctacctccaggcctttgccttccctatgccctcctccgggagcactgtcccctcagccctggcaagactttgtttaaatcatttcccagtgagaccctccttgagcaccctattaaccctgttccatgctgcacccccaccccttctctgggattcatttttcttcaagtgactgacatcattttctgacatgcagcctcatttccttgtttatcatattcactgtccatctccacattagaatccaggttctgtaagggcagggattttggtctgttttgttcactgctacatctccaaggccaagcacagtgccaggcactagaagctgttcaataatgtgtgttgaatgaatcctatttcaccatcacagtgacaccaatcaaaacgaggtgttgaggctcctcccatttcatgaatgagaaaactgaggttcggtgagggtagggaactgtctatgcacagccagccagtaaggagtgaggaaggaagatgtgtgcaagcgcaggcctctccggtaccagagagctgtctcctccccacccctaacccagccacttacaacttatgtgggaaacgaggagtttgggctcaatgatttattgccgaggctctctctcctgaggtctgaagctcagttcaagtccataaccatttcctcataggaggcggagtcgcaggtggtttggggcactttctctggaacagagtttaagtcccatttttcccactcagccctgggactttgagacaacttctcaacatctctgagcctccctttctttcgtttgctggctgcaaaacgagaatggtaatagcgtatctctgtaggggcgttagcaaagacagcaggggatgcgtgtaaagggcttcttacagtgcctggcacacggcacctgtgagctgctgtcttggcactctgctgatgcccagggctgtcctcgacttgccccagccgggcccaccaccactgaatctcccggggtgaggaagcacccctggctcctttcatcctctacatcggccaggtctggatagttcagcctctgggaggcagggtagggcccagcgggccatgtttgcagcccagcaaatgttcctggagccttgttttttgttctgttgctgggccatttgtttttatagcttatcgtttctgcaggggggctttgaaaggctgccattgctccagtggacgtttccggtgcgcctccatcaagccacatttaatgaaaaccagtttaaggtcttctttctcataaaatgtctcattgttgctccggcagctcctctttagaataatgaagatgaacgcttcctccgtggggtagcacacaaaacccccagccgtaggagagctttgctcagtccccaggaagtctcagagaccaggggagaaataaaaagctagtgcagtttctattagggaggaggagaggtgggggcttaggaaccctcagtgctgcaaatatagggaatgaagcttgggttcctcatcctctctgaaggaattgtcaaatgaaagaattttgctactaaaagcgttttataagaccctcaacaaacacttgtggtccaaagaagggaagcagcagacgtaaggtcacacagcagagctggactagttggggtagagctggggagacaagcagttttcctgggtccccatccagacctccttctgctccagaggacccccatgagacagggccagggggccttcttcaggctgtcaggtctagcccggagttgaagatgcctgatgaggatctggctggtccacaataggggctggggaagcagctggtggccagtttcacagacagcaggaggtctcctccaaataaaaatcacaaggattttagatgcacttgttgaatgccaggctgaagtgacctgtggcccctacattccaggggttaccagctgatgtgaatgcctgtgggtgagatctagtcctcccaaaacatgccacatgggcaatgccctccatagcagttgtttgaaaaggacctagtgctcgtctcccaacgatacattaatttttctcctttcagattaaatttaaataaatcattttggaattactctactaattgactatttggtcagttgttacaggagatgtaaatagtgtggcttgatctgggttttttgcaaatgagacatggccttttcccctctaaatgtgtctacacagttactcttaatttgcccattcattgccccatgtgccacacttgctctcacttaagtccctatcttctgggctagaaaacaagggcagggaaaaaccccagccacacagacatacgtgtgtcagcaaggagctaagcatggccaagggcggggctggagagaaggcatccaaattctctgtctaccccagttctgacaatcaaaagctgggtgtccttcgatgggccacttggcttctctggaactcagtttttctactttaataacgtgggtggcttagatgaggggtcccaaatgtgcactgttcacatgggtaccaggcaggcttcttaggagtagaaggcatggtggcaggcaaactgggagagttcctgggtcaactaaagagacagccaccacctctccctccagccaatgttgtttttcagaaatggagatctccagcagccagatccttcatttctcaaaagagaaaccccaaacctagagttttatgtgaactaccaaattcctacatcttggcaacaaaatcagatgtgtaagacaccgtgctatgcaggtcaaacaaaatgcatctgttgatctctaaagtaactccggttttaaaaccccataatccatacttatttattacagaaaaagagtgtgtattaaacagagaactgaatttggctgcataagacaggagttagagtcctggattcaccactgactcaaagaacctatcacctcgagcatctgatctttctatgaaatggtgtttgcaatacctgtcctatggttccaccagtagcctgtgaggacgaaatgaggtccctcctgcaaaaaaaaaggcctctatgaagggtagaataccatgtcctggttattcttattatccagaaattcttctcttcaccactggggaccctgaggcctaaacctggaacttaagcagctgtctcccaggcagctctccgaacacaaaatgcctgagacaatatggaaaccagatgcggagcaaatgccgccttaccttttttttttttttttttttcctgtgcttttgtacgttttcaaagcctttccacattcatgggctctgatatcaataaactcacagctgctctgcaaggctgttatatcaggtattattctattccagatgaggaaacggaggctcagagctaagaatgattgggtcaaggtgccagagaaagtacatggcacaagatggaagccctgtggcctagactgctgtctgctggcagtcctctctgggtggttgcctgctttcaaaagatgaactttctaaatataggcttaatgcacagggccctgtcctcagcgagctttgcagcagctgaagcatcctagtacatggttttggtagtgaggatggtaaaaacagcaacagcagctgcttctggtcaccaccacctcctttctctctctctctctgcccccaacccccctccccgacacacacaagagagagagagagagagagagagagagacagagagagagagagaggggaaatactatgttaataggacacttttctgtggcttcttactgcacattgtctggaccatactctttgacaggacttcccacctggtctagcctggtcctgtgcacctttgccctttgcaaccttccctgggctcatgctccctccctctctgctgaaccttcttgcagtaatacttgcctcattccctccctctttaaggcctttgcaccacctgtttcccctcagctcaagtgtcactgcctccaggaagccctccctgaagcctccattcttggtcatattcatctctcataaaatcatggtcctttccttcaaagcccttattcccatttgtgcttgtatgtttgggtgtgtgattatctcacttagttccatctctttcactgaaatgtaagctgcttgagggcagggcaatcagccctttgtattcaatgtcacaactccagcaccagggatgatgtgcagtaactatttgttgaaccaatgcataaataaatatgtgaattaggtaacatctacctcatgtaattctctccacacccaatgagatattatgaattgttattcataatatggattcataacaatggatgttatgaattgttccttgttgcaggggatggggagaagactgagagtctgagatggtcagtggcttgtccaaggtcacacagctagtaagagatgggggaagatttgactacaggtctgcccgatttccaaattttcaaacagatataatttaagaaataggggccgggcgcagtggctcacgcctataatcccagcactttgggaggccaaggcgggcagatcacgaggtcaggagatcgagaccatcctggctaacacggtgaaaccccatctctactaaaaatacaaaaaattagccgggcgtggtggtgggtgcctgtagtcccagctactcgggaggctgaggcagaagaatggcgtgaacctgggaggcagatcttgtagtgagctgagatcgcgccactgcactccagcctgggtgacaaagcaagactccgtctcaaaaaaaaaaaaaaaagaaagaaagaaataacatgataagcctctgtgttagccatggttttccagagaaacagaaccaacagtatgtgtgtgtgtgtatatgtgtatagatatacacacacatacatatatacacacatatatatacacatgaatatatacacacatacatacacacacatatatatattatggagggagagagatttatctcaggaaattggctgctgggcacggtggctcatgcctgtaatcccagcactttgggaggcagaggcgggtggatcacctgaggtcaggagttcgagaccagcctggtcaacatggtgaaaccgcgtctctactgaaaatacaaaaactagccaggcgtggttgtgggtgcctgtaatcccagctactcgggaggctaagccaggagaattggttgaacccagaagatggaggttgcagtgagttttcacggtgccactgcactccagccttggagacagagtgcgattccgtctcaaaaaaacaaaaaacaaaaaacaaaaacaaaaacaaaaagaaattggctcacgtgtttagaggtaaatccaaaatctgatggggtaggctggcaggctgaagacccagggaaacatttaaattcaaaggcagtccactggcagggttcctccctagtctctgttcaatgaaggcctcaactgattggatgaagcccagcacattctggagggtaatcagctttactcaaagtcctccgatttaaatgctaaactcgtccaaaaaaatatcctcacagaaacatccagaataacgtttgaccaactatctgggcactgtagcccagtcaagttgacacataaaattaaacatcacaacttctgtatacccatcactcagattcagccattatcaatgaaattgctacatttgctccagctggcccccttcttttctttttttctgttggtgaagtgttttgaaacataccccaggccctatatccttctatcccaacctactttataagtcaagctatccaactgcaaggcatgcccatagaaccccgcacctctaagagctagctcggtcctcaactgtgagaaacctggcctctcagagtgcagagaggaggcttcctgatgtgtaggcccaatcggcatgcccaaaaggtgaggtctgatttgtgagacaatttccacagtcttagaaagaagtttcctctatgccccagccacgtctgtttataacttgaccttggccaggggtggggttgggggcagggaaaaagacttgcacgttccactccagcaaagcgctctctgtttttccatggccatacattgttttcattttcatgttgcacccgcctgctccccatccatttattgctttctcctccttctcttttcccttcttcctccccctcattcttcctccctggctttgaggcgtctggacttttgcacaccagagaaagaaacctatttaatctaccatgtttacaagctgcgtaaacaaggtacagtgagtgaatcatggaaaaaatgcactttatgtgaaaaagttcattatatgactttgttctattaaaacagccgggtgtaactaaccccaaccagagaatttggaaaaaaggaaaaaaaaaaaaggagaaaagaaaggaacccctgaaaatgccctgttagcatttatatcttacaatttcacattagcattcatataatttctgctggtttaagaacatttaaatggagttctcctctagggagaagatatagggactcattttctgttgctttctaataatctcttccttaaaaatatatacatatattttttaaaattgtcccagtggatttaaggaaatagggttaaaaaccaaccgactgaattagttcttttcttgagttgttgagtaattggtcatcattcttctaccttactctcattttgtttgggtcttctaacttaataatttctgtgtcgttattattgtggggcttccagattttttttttttttttttttttttttttgagatggagtctcattctgtcacccaggctggagtgcagtggtgcaatctcggctcactgcagcctccacctcccaggttcaagtgatgctcctgcctcagcctcctgagtagcttggactacaggcacacaccaccatgcccagctaatttttgtatttttagtagagacggggtttcatcatattggccatgctggtcttgaacttctgaccttgtgatccacctgcctcagcctcccaaagtgctgggattacagacatcagccaccacgtcaggtccagatttttctatttttcttatgatgataacaatagcaagttattaaaatgcactggcactatgctgaacaccccacattaagaattttatttaatcttcacaagagccccatgagaatatggaggtattgtggggttaaggaactggccccagttcatggttaagaaatggtagcactggctgggcacggtggctcacccctgtaatcccagcactttgggaggccgaggcgggcagatcatgaggtcaggagatcgagaccatcctggctaacatggtgaaaccctgtctctactaaaaatacaaaaaattagctgggcgtagtggcgggcaccggtagtcccagctactggggaggctgaggcaggagaatggcgtgaacccgggaggtggagcttgccgtgagtcaagatcgcgccactgctctccagcctgggtgacagagtgagactccgtctcaaaaaaaaaagaaatggcagcactgaggcttaagcctcacagccaagcatcggcatcattcaagtctaattttctaagtaagaaaagccaattggaaacaatgactatgttaatagtcatagaactaactttaggacgtgggaatatgagtgacttttagtttcttcttcaaattttattaaaatttccaaattttccatagtgaattatggaatagtgcctttagaactgtttcatggaggaaataatgtaatcctgcctaggcttaactagggaaaacaatgtcttttatgaagtatctaaatacatctgagaggaaataatacacatctttgcataattctttgcatatactgaggtagaatgcggtgttctagggtgtagacgacctggactatcttaccatccatgaaggcaagcgctttccctttcctgggccccagttgttccatctgtaaagtgagactcatagactgaaatggctttaaaaggctttttcataaacttctttgtttatgaaaaaacctctttgagaccaaagatggcctctttgtcaccaaatattcaaagatactgctttatgggagctgatgacatccttaacaagtagaaaggcctttcaggcattttccgtccttccattttgtctgttgctttcaagacagaggtgcagacgggacctgaaggagtgagtagccaggctgaagccggactcctaggaactctgacaagagacacaggcctgtttttaggagacaccaaatggatgataccctctcctggggtgtggatggtctcaggctgctgtgaatggccttttcctcttcttcagaaacagcttcaaaaccttccttaatgacaaaacaaagacatttgcaaactgcatggttcagagtcctctctgctgcttcccagggggctgggttcccatgcatgtgtcccttcccccctccccccttccccgtgctgcaagctgcccttgttttaaaccaagagttagggctcagcctaggggcactgtcagcctcatctcagagcacctgggttctcaaggctggcaaatatctctcttcccaggccccaagagaggatgcagctgctctgcccgctaagctttcagcttaccccagcctctggaaaggaaggagggggccttgggctgcctgtgaggtggggcccaaagccagcccagagccctggctctcagacagaaacttcaccagcgattctgaggatcccatttcccaccaccacgcccagccaccttggggaagtcagcaccgagagcagtggaaacaaaatcaaaatgcaggcacaaataagatgaataatcctaataatttgagacatgccgcccttgctaaaaggaccataaagggcatttgtttctaattaaacaccaaaaccctaaacctttcaactctgcatccacaactactgtaaatgtttatgaaaaacgggaaattctcgtttaattcaaaccatgccagaaatgcattttcgttgtcttgaccggtggagaaaccctatcggccccagcttgagcacatctgagctttaaattgagaaaggcaacaggcctgcaagtgaagctgagtcctgagcaagacctgggtgaggaaacagcatctcctcatcatggccaactctcaaatgacaccagagcaaatgcttggagcgtcttccagaaagagaaatgggtaccagggccgcttgcaatgttagggggagggtcacagacgtctcagaaataaattaggctgcccagcaaaatggttaaaagcagaagttgtagagtcacacaacttggttggatcaacctcttaccactggggtgatgtgggcaaaatagttaaactttctgtcttgggttcttcaagaatcattgccacagttaagtgagatgaagcctttagtgtgacggcaagtgaacctgcaaggcccctgccttcatgaagctgacgggccaggcagagaagcagattaatcagcaacctgtgctcagctctagagtgtctccaggtagcttttccagtgccctctctacctgtggagttgctgaaatccgcgctgctcgctcagaaaacgggtcaccgaggaaagatttcagcaggaaagagcagcccattcaataattccaaagtgactgtacccagggacttgaggaaccttaaatgcctatcccccaagccccacgactgagctcacagcacccagagaccatcacaatgaaaagtacactgggctgtggaaactcccggggcaggaggaagctctgcctccttaatcagaggatggaagccctcccttggaaacaaacatttcaatttggctgagaaggacacagcagggaaaaagcctccaggactcacgtgactgcatttcctaactcttcatccagctttaaaaatcaggggatttcctttgctagtctttggggaggagggttaggacctaaaatctaggcctgagtaccctttctctcactgcatggatatttccactctaacaatgtcaacagcagcctttcaaaagcaaagagctacagcctctcagtgccccacatggagtcacgttactgcctgctaggcacggggttttgctccacagcccccattcaccttacttccaggaagacagaccaagttcccacctcctccactttctgtccagaagctcccaccacccccataagctccagacatagagcatatgactcaacttggccaatcacagcatcacattctctggcctgcagtgattcaatcaaatccagtgagaggagctgagaattttgctgaactactgcaggaaaggcacctgctctttgcttgtggatctgaatctggaaggatgatggctggcagccatttgctaccaacagagcctgaggaggtaaccaacacacgcaggacaggagagactcagggtggagacaaatagctcctgaccacatcatctgagcccctgggacccaccatgcatgaaggcgggtctcaatcttctaattccacaagccaataaatcttctcatttgcttaagtgattttgagctggtttttctttttgcttgcaaatgaaagagttgaaaaagggaagagctgaataggggatagagaagaggcaaaggctatgagtaagatcaaacaattatttactgcaagtctactacatgcctggcactgcactctgttcactatgggataccagacacacacatagacccagagtttacaatcttttaggagagatgagacatgagtttgagtgactgtaatataaagaaaaaatatgacaaatgctgtgagcagggaataaaaagttctgctgacacacaaggagtgagagccttcttctggctttaggccaggaaaaggattcatggagatggctcgtagcactgctttgaagagggctggaatttgacaagcagaatttggggtggaaagtggcagatggcccccccagtggaggggacagtgtgagcaaaggtgagagagacatgttctagaatggcagacatcgtgttgacagacaagcaccaggggaaacaaagggcagacatcaggaattctgcagggtcctggccagggccctcccttcctctcagggaacctcaaatgtctttgtctctatactgcagccatattctggctgaagttctgtcatcttgggttgctgagggaagggttttctacaacagatatcagcctgcaaaggattctagcttttgcttctcctggccaccccttgggggaatcctttatatattaagtagttgccatgtgagatctactgccactcaaagttaaacagctcagttggcactctccaaagtctgcttccagcataaacccatgccacatgggcaaaaatccatttgggaaaagactgggaggagcactccagtcaaaaccttacatggtctgatccctgccaacctcttctcactccatggccccctctgctttctgcattccctatggcttccagccacaggacctttgcacatgctgttctctctgtctggaacaccacccttttacctaagcaactccaacttatctcttagatcacaactcaattgccacttcatcatagaagcctttgctcgtggccctccagggctcaaggcctcccagtacaggagttaaagacaagggttccagagtcagaatgcctgcgttgaaattctggctccagtgcttactagttttatgacctttctgtgcctctgttttctgatctgtaatattggctaattaacggagaggcttgataatggcaatagtgttggcagataacactgaatgaacatgagctaccatcatatgatttcagagcaacttgtcctgcctctctgcctagtcacagttgcaagttaatgcattcatgtgatcctttgattaacgtctgtctttgccaattgactaaatgccctactattaataggtagaacaatgtctggttttgcccacctctagcacttagtatcctgcctggcacgtaatagatggcttaaaaatatttcagaaatgcaggtatgaataaaagaacccagagtggggaaaataaggtcccaaatattcttatatttgcagaaaccctgacctcaaaacgtcactccaaataaccaaggagcaagacctcaaaagttgcaaacatctgtggtttcaaagatgaataaaacaagttccaaaagatgctccagccactgaattcctctttagcaattcatttcctgaaaagtggacatgaggctggagtaaatgtggccagccaaccagatgcaatgctctgaagttaacagaagtttgtctgatgtgcatcaaatgactataattccttttctagtatccctaacagttacagagaggtttctgtgagtgtggcctttggcccagattttaaataatattatgctttgctgcaatgctgttttctgagagtttacatctttggggtatgtttttaatatgcgcctcataatgggccaaattctcctctgagatccaagctagatctcccaagtacagactatgttatagatctaggggtaaacagtggtttccatgtcaaacttttgatccatcattattctgtgatcctccaggaagaagggctcagatgcagatgaccaaaagtgggtacagtttgcagggaggcattagtatttccctttgcaaaacatgttagtcccacagcaaggtctggagacacagttgggcaggctgagagagcaggagacccagatgctggagccctcaccttgggatttaccaaggcatgtggctccaactgggtattggttttccctggagcagggcatggccttttaaccagttttccctttttcatgctcccttaaaccagtccagcatctccctatgggcctggaccacagagatgcctttcttcctgactcctgagccttctgaaagtttttccacatttttctccttccaagaaagcaatggttctccaactcagaggttctgatttcaggaagcatctgtggagtgtagctctgagaagaaagcacccaaagtggtgaagagtagtgtgtgcatgcacttaaggcccatgccctcctagggcaggactgaagccatagctccaggtgcctgtaaaatccagaactcacaacctcagggttcctacctctctacctcattttaggtctcaatagctatctgtttagcaactaagttgttggtttccaccatgctacaaatcaaattagtgacatcagacaacacatgtgtccccaagagacctggcccatgaagtaagactggaagtccccaatggatggggcctgggcactgtgctgggctagactgtcaggggtgcaacctagatccctgcaaaactccccatggagcggcctcagaggacaacaccctcagtctatccatcaatgtcctccttgcctttggcctctctccactggagatgtgaacaaagagagaacaagagagattaatttctttttaatccttcctttctagcaagggcttgacctcaggctttggcctgtttcagcttctccccaggcaagaccatatttcacgctgaatcatcagtttctggggaaacagagcgctagcccacagcgtacggatggccatgctatcttgaaggagcccacaggggctgctcagacattatctcatccatccctacccttggagcaaggtgggagcaaggagccgttatcttggttgggctgctgaaggaactttagcccagagacaaggtacttctccggagtagtgcagtaccaggcccttcctagctccaggaaaaccctcagcagccccttgcttcttgggccagaggaaagcatggtggtgaggaaccctgcagaccttgactactcagctctgccactatgtctcaagagcagccataggtcagtgaacaggtgtggctgtgttccaataaaactttacttaaaaaaacaggcagtgggctgacattggctcacaggccacattttgctgaactttgcccctagtataaggctatttcttgctcaagaaatgatcttagaatgtcaggttggagcaaggtttctcaactgcagtactattgacattttaagcctgataattgttgtaggggtctgtcccatgcaccttggtctcctggagccctaagctgccatgtaagaaattgcactacccagagagaaaccacaggagaggctctgagagtacatggagaagagggtcccagaggtgcccagcctgcagctgaccccaccaaggcccttggcatgtgactacagccatcttggatgctccaacccaggacagccaccagctaagtatcactgagggaccacactccgtgtccacatggagtcaaacttcccagcttagtgctgatggaattcctgacccataaaattctgatatgtaagaaaatggttgtttaagccaccaagttttgggggcatttgttatacaacaagaggtaactggatacatttcagcgaagaatgagaaaaatctgtcatttagccaaaaatcttaccaacctaggttagaaatctgatcaaaggggaactaaatgatcagaaacccactgtggtggcagaatattaggtcactgtcttggcagattattggcccagtaagcccctaatattcctttagtgagtacacggaacctcttctcccaacaagactcggcctttttggggagggccctccacacctcctcttcatggcttgggaaacctgaaagactggctcatcaatatatcgatggccaaaggcaaacatggcttcaccagttcaggcagaagctttagatgatgtcggcacagtcacagcagaaagctcaccaaactactgctgcttttctttaaaaaaaaaaaaaaattaagagcaagaagaaaaactttgggctagaaatcagacatcttgggatttctatcaccatggaagatgacaagctatatgacctttggcaaatttctttacttccctggtttttcattttttccgtgtgtccattatggctttggacaagctcagaggttttcatatctactttttggaagcccacagaaacccctcagaggctgtgggtgcatttctgtgggttagagggtaggtaagagggaagacttggcaaacggggctccaagtcctctagcttcatttcactcaaaggcatttatgggcatttgtcagaacttaatttgaaactgaaagctaaaccatgcctgcacatcactggtcttcacagtttgtaaggtccttctagaatcctcatccctaaattctctgcccctaattttgatggggaatgaatgtggcatttttgtgtatctattttccccactgcccttttcagaaaggtaggcatggtgggctactcgctttttttcttgccctgtatccatcctcccttctaataatagcacccccaatttactctgggaaactatccaaggtctactctcagtccatgacccatctgagtgggagcatgtgagcagacctggtctattaaaatgcagcatccccttggccatgccatattattaagtcatgaatgggcacagaacctaagccagcccaatgagagtctgccctgaattttcactggaaccatcataaaagtggctatctctttgtggaattgtagaatgctagcctggagttgacagaagccatcctgccacctcaatgtgaaaggcagtttaagaatgaatcccacctaaaggagtggaaagccaagtgaagaagaaaatacagcatcttgatagcatcgcctgggctgctggattgagctatacctcaaggcaataggtccttggattttctagttctttaagctgaaaaattctcccgctgccttctttttcttttttgagacggagttttgctctcgtttcccaggctggagtgcaatggtgtgatccctgctcactgcaacctccaccttcctgggttcaagcgattctcttgcctcagcctcccgagtagctgggattacagttgcccgccaccatgcccagctaatttttgtatttttagtagagacggggtttcaccatgttggccaggctggtctcaaacccctgatctcaggtgttccaactccctaggcctcccaaagtgctgggattacaggcatgagccactgtgcctggcccgctgccttcttttttaattaagctaatttgagttgagtatttgtcacttgaaactaagtatcttagctaatagaagaagtaaatacagtttaattgagtctgggatgccatataagaaaagtccaagtgttttgcatactctgcttgcaaagaaaacaacctcccaggttggtggcctgagggtttgtgcaacaccaaagaacaccaagctcagccagcccaattgccctcccatcccttttctttttttttcatttctttccagctgcacggtcttttatggagcccatctttctaagacattcaaaatgacatgctattggaagacatttctgtccatgctaatacctgtgtttaaatttttttgttgttgtttaaaaaaaaagatcatgatatgatagcaaatgaatgttggcaaattgccaactgacaggtgtaaaattttatgaacatgcacattccaaaggaatgtggaaataagccatccactgtagtccagtttggcagaaatattacaaaaatataagtttggcatatattgtaattcatttaaagatgcttaaaaacccatccatcaaccttgcacagaaggtcaaagaaacacatgaatcccaaataaacagcaactgatgtacaaggaaaaggcctgaatatcagctccagataccagagagactgtacacatatgaagaggatgaaggtgctgtttggaaggctgagcttctaaaaccttcattggtgtttaaaaagaaataataatcatttcttagcagtaagtaaggtggactgttgccctctgcgtggccatcagaattctgctcctctgggagaattttgctgaagaattggtgagtatgcatcctgagtgtctttccttttttttttttttttttacttcaaggaccatatctgcaataatcaattgctctcacgtatttggtacctggacactcttcactttgtcacaagcatgaagaaactaacttacttcttcccagccccaggatgggctcccaactgggacttggccagtgtgattactcaacctctggtcacagtgatgggttcaaggttgggtaagtgctccatttgagtcttccatgagatctgataagagaacactgagagagagagacagagacagtgacagaggatcccttcagaatccaaagcagaaagggccacggaacgtggagaaatttctatctttcccccagccatctaaagggagcttcctgtagaagggaatgagtccaacatgcagagagaagcagagaagagagatgaatgcaacaggggtgggagagatggaaagatagagagatagacaga

SEQ ID NO: 544 - DNA, 40001 bp, Homo sapiens
cgaaaaccacctgccctaggacttgttgcaacgccactggaggcactttaccaatgggaaaaatgcggaggtgggaccagaggaaggcaatgcaacctggcattcctggggtgctctgttgagaccacactgtgtttcaaaggttttcaaccagaaggccaagaacctccagctccacatgccttctgcctcccacccacccgcttcctcatgtaatataaaccttcctgacccctgtagacaggtgggtctgcaacccttggagatacaatctctcaaaccctgtccaatcctgccaccctatgatcatgccactactgttaataacttttcaaaagtgttatttaggtcactgtgatattgagctgacagataataaagcaaattggaaaattaaatatcatcgatctctaaaattttgaaaaatgtgtcctgtaggtagagtcaaaatatagaatatttaaactaacatacaagagtaattgtataatcgattttctaaaaaatcccaaaacacagagcttccttacttctgccttatcagtagatctaatattaaaagcagtctttttaagaacttctatactcagatttctgcaaagatgcatactagagtataatatatatttttgttctaaataacttttaagcaaattcatgtgttgcaaattatattggtaaaatgcttctaacaccatgagagcagtaacatgaaaactatcactggaataagaaagacagaggatacaattctttgaaatgaaaggggagaggagagggggtagttttacactgttatccttgctaatgtccaatattcattttgtttgtcgagcacgttacccagtccttcatgtcatacagaccctgctcagagttaccacagtagaaccaccatgaatacaaatatatatatactaactttacgagtcagtggatggcagctgtctcccagtttgcccataggtgtgcaaatccttatgctcttgacccagatactgacagcacagcacatgcctccaccacattgggagtccttgtcacaagcctgaaatgtaataaacaaacagataaatatagataacaggaaagactcaggctaaggaaacctaaaattagcagtgaaatgccctttaaatatctaaacacttggactttaataatcaggtatattttttaaatgataaccttcatttacttgtatatagctattataaaatctgatcagaatagctatttctcatttttcgaaagtgggctaaattctagcccctggattatgaaaatcttaaataaacataagatttttttttaaatgaaatcagctctctttttccagtgctttatggctgaattggctttgaacttgaagaacaagactatattactcttatactacacatggccattaggaactacataaatggaatcacaagattttgtgactattaactgcagaatacactggggccaatttaaaaaaagagatttaaatagtctctaaatctggcatgaaacactccagacccataaaggcactgatgtaaatttcagaagtgctcattttccccttcaaatatttgcattttggttcaagagacttgacgtttctcacaccactgacttgctttttcaccattttctctttaaagaagtctcatagtttgaaagtggacagaccaagatgcttgccttatgttactcttccttcaggtgaataagctgcaaagagcaaattactggcttagcataaacatatatgtacattacaaaatcagctaacaatcctgtaagatccatcaaattaagaaatgcaagtaacaggtgcaattgtcaatagtaattactcaagtcacctgctttcaatataaaagttgtaaatacatacaatgaaacaatcaactatggaggaatttccatactctagtaaatagaaataaataataaaatctaaatctatttgcatgaaaatggatctgaagaactattattctttcctagaaccaacaaaaaatagaatgctttgtttgaaccgtgggcagtaatctgttttggtagtgataagataaaaacatcctgtactatatatgtaagaaactaaaacctctatcatctaggcacaaatttaaatgtacaattagtggaaacaactaaaacagtccttcaaaattcttagttttgaggacagtcataacttctcaagatataaaaatatgggtacattcttaacattatttctcattaaaagtaaccaactattttgctttaaagttcatttacttccctcattagaatttatttctcagtctatttaaacaaagtatctggataaaagctaaaaatttcaccttgaggtgtttggattttataggacaatatgtaaatgtttcaattttccaatttttatctgcatgccagaaatcatgtatatgtagccattacatcccataaataagatgtctagtcaatgatcttttacaatatagttttaacaaatctatgtgggcatataaatcaatttcaaaatacctacatacactacccaaaaaactgtggatgtcaggtgaaagttttagccagcattttatttcaacagatgctcaatacctcgaattttgaggccccatgagcttttttttatgaaccaatcaaaaatccagccaaaatcttttaaaattcaatcacctggatgtttaacatgctatacacaatgtatcttgataagttactgagtttttcatttgaatccagatggttcctgtcatggagacataactacattttattgccctgttgctttagagacatttttaaaattctctttttgtaacactgagttaaaataacaacaacaaaaacagcacacataactatataataagcccagtctaagcctctctaacagatagacagccaatgtgataaaattttattttgtaacaaaagcttcagttcttggaaaatttacaaagagttgcataggtttatatatttttaattagacagctgtttcctaatgcccttcatccttaacccattgcaaatctattcagatagtgttgtcctgtgaatggaacaaaaagatacttatattgcaaagggatcttgggctcagaggattaggagaaactttaaatgagccagcaggagaagagggagaaaaaaatccaatcatgtttcaattctcatgtattagaaagacctgcaaaaagtttttctcaaccacatggactggcaaagctatgcaagtaattttttgaaaaaatctcttttctaataaatatcacagagcttacagttaaatatctgttggatatatacaaatgctgtcatagcaaaaggactttcaaaattctataaacctaataactaatatagagaaaatagagcttgattttttcaagacaaagatacttcctttaaagtcaaatgatattatctatgtatcaacatttcaaacatagacgttttatttaaatcccattatgtgcacttaaatatttgaagtaatttaatgaaggtgtgaaataattcctcacttaaaaaacagtaaagaagttgaacaaccaggaaatgatagcagttttgccttgttaatgtaaactagactatttagtattgtactgcaaacccaattttttcagatccacacaaaattgttgagagtgggagagaactgaactagttcctacttacagaaaagatgaaaacatcgtctctaagtttaaacatctacacagcaacctactccatcattatgctggagcactggaggtgctttgccaggaattagaaatttaaaacttttatggggatacctcaagaccctgagcgcgggggaaagccccggaacccagaaggaagctcccacaattgcttttcaaagcgctcacatggccctggaccaagcgatttcaaagggtttctgcggaggacgcatcggggagcaaactctttgactgtaggattaagactctgggcacttggggaattcgtcttggtcctttgcatttcaggaaggggccgtcaaattttaaggttcgaggttggagagcctccaaaagtacttgagaagactcagagagaaacttctttcagcctaacagaagaaaaatgcgaggagtgaggccgtgggtgatgagggagaagtaagcgggagaaggtggtaataaaggtggtgggcgacatccttgtcactgtttcttccaggacgcgcccagtgtccccagccgtctgctgcttttggatctgggtattttcccaagtgcaccaaggggcgacaggggcaggtgtccccgcccagggcgaccctccctttgcctctagcctgcccttcagggtccccgtcccaagccccctgggcacatcccaggcgcgcatcaggggcagacaggtgcgcccgggccgcttaccccggtgatcacggcggcgtccccagcgcggggcgtgagcagcagcggcggcagcagcaagaggagcaggagtggggcgcagcacaggctcctcatggcgccctcgggactgggcggccgccggaggcagttgggggcgcggggcccgggtgcgctgggtggagcgcggagcggcgggcggacgggcgcggcggctcccgcgagcctccgggccgttataaaggctagccccgccgtgactcacgccggcgcccgcccggcagcacacgcggggggcacggcgcgggcacacaccccacgccccacgcgcacacgcgcgcccgcctcggcccggccggctcccagacgagcacgtgctatgcgcggccccccgcgcccccgcctcgggcgccacgcaggcagcgctcccggcggggcgccccgctctgcgccgttccctccgccgtcgcccagccaccgcctttcgcacgcgccggaaccgcttttgtggtctccgagacactcatttgctgtcctggtttccaaagctccacgtgctcagcgccgaaaacttgcaaatcatttgctgtacagatgtttaggggtcgcctactacgtgcggggcgctgtggacacatagggggcggggggtgggtgagggggacacagcagcccctgaatccattcgtttgttcagcaggtctatactgggcgcccgctgcgtgccaggtactgccaccggctctctcctcacggtggaataacttaacagagaagacagacatcaatcaaataccctggaaacgtggaaggcaggggaaagaacaaagggagagcaaaatcgccccaatcccacatcacccgcgacgtgaaaggatttgtccttccagctgcgggactcctatttgtttatttcaagtcagaggccttccctttatgcccacatctgttcccgaccctctcctctgattttcctcacatgtatttcctcccctcttcagccccgcgccagctccaggcacagccgttcagggtgatgccaaagggaaatgagaacgcctggtttcgagtgccagcctgaggccccttaagccctaggtacgcagctctctcttctttcttaaactttccagcccaggaaaatcacccttcggttttacagatgcgatagggcgttattgtgattccttcattcacgtaaacatgaattgagtgtctagtgggttccaggcacaccaggaaagaataagtgacagatttgccctccatctctcatcctagcctggctccaaaaactgcagcctgtttccctcaacaaaaatgacgtcaagaatacctagatgtgaccacaccgaacttgcttgcccgttttgggaaacccaactttcttcctgaatagtcagaacctctggctttcctggtctcttaagaaccgcaaactattgaaaagcagatgcgtctttcagcctctttaataaatgcagtaaggagagttgggacagagttactttcagactgtggggctcccccgtgccaaagcattcagacgaaatgtgggggatagcggggggaaggcaggcaattatctgaatgttaaacagctgaatatttggaaaccccaatctttggctgatttttaaaaacctttttcacacgtgttctcatgtttaaaaaacgccttgaacagaaaacacaaaaggagtcaaacccttttttcaacttaaaaaaatgttaaaattggactcacagtggagtaagtagaaacagtagcaagtgacagacttgtggaaagtttccttttccagtctccatgccaacgctagctcgggaatgctgccgggtaaatgtaaaaaccagtcaacatggattttaacattcctatgactttcttttaatggtctatttcatattcgctactattgaatgccagcttgggtattccctgcttcttcaagcatagaaaatatgatatgtctacacaggaaaaatcagatttcaaaagtggctggcttcttacacagctgtttggaaaacagtcctcataaggctgttttgaaacaagtttaaaaaaaagaaataagtttggaaacacttaaaaatagggttgtttagtttcatgttcttttggaaattttaattgctttaatgctttaggagagaaatgaaggctcttgatatgtcatctttgtatctgaggccaagtttgaaaaatgaagtctgacttcaattgttataaagggaaaaatgaaaaaaaaaaagagtttggattagtccattaaaaaaggtagttgggacaacttagcaacaatgacatagaaatgaaacagtagtttattgattcttttctattactgtaacctgttgatattgccacatgatcacttctgcccaggcataactgtattaggtgaaatgagccttgtgtgtgtaaagtgtagcctaccatattccagcagaccatcaaggctcagcttaaacgaaaatgcaatctaggagcgtctatagaacccaatgtttgtgagacaggctgatcaggattggaatcctgtgtgaccactgggcaagttacacaaccttttgaagcctctgtttccggtcttgtaaaatggttataaaataccaacctcatggggtacaacccctatggaatttaataatacctgcaaaatgcttatcacagtgcctggaacagactgggagctctgttagggttacctcttattaagccttattatttggtctcccctgacaatttcagccaatgctgatataagtcttttctgtcctgcccactatattagattgtacacttttcatgattaggatccttgtgtctaattttctatgcatccctcttggcacacagcacgataataggcatatggcaggcattcagtaagtgaccagcaacaggaatatgtcccatgaaggacagtccagagacagttacgagaagatcatatacagtacagactcatgtcatgtatatgaatccgttaaaggtagtcaccaaaaagcaagagagatggaagctttacctggtgcagatgattcagcctgtctctttacttgggggccacgtgactgaaatgaagtgagctgggagacacaggcctgtctcacggcagtcaatttgggactcaggctgactgataaggctccatttcaacatgtgcttcatgattgccagtgtagtggcctatactgtgacccctagcaagttattttcaaggcctaagccctggtacctgtggacgtgaccttatttggaaatagggtttttgcagacgtaatcaacttaagatgaggtcatgctatattagggtgggttctaaattcaatggctggtgtcttcataagagaaatgggagggagagctggatacagagacacaggctagactccccccaccccaccccccccacacacacgggagaacatcaagtgaagatgggggcagagattggagcaatgcttctacaaggcaaggaacaccaaggattgccagcagccatcaggatctgaaagagcaaggaaggattcttccccagatccttcacagggagcacggccttgtcagccccttggttttggacttttagcctccagaaccacgaaagaataagtttctattgttttaagccacccagttgtggtgatttcattatggcagacacaggaaactaacatagttgggtgcagccagagggttgtacaccagctttctctgcctggaattcatgcctgtcacttttgctcactttttagtgaccaaaacaagccacatgacaatctgtcttcaaggggacagacagtgcaagtctgtcactggtttctgaagacaacaaggtatcaggtgagcagtgctatattctacaggaaatgaatcattcatggcttggactccttaatgagcataatgaactttgaattatattagtaattgctattataaataataatgtgtaatttcctttgtattttttctagtacagcattctttataccagaattatacaaagactctgaaagtgagtaaatgtgtaagctaatattttcttttaggtgggtagaaaaccataatttattcattcaacaggtattaactaagacttactatattccagatattgtgtgcagcattgggggtacgagggtgagcaaaacagacatgaacccagccccctgggagcttaccatctcatgggaagatgcacatgaatcaaataatcatacaactttataattacagaagataaatttagggtcactatgagagagcatatgaggaaacctgaagctttccttacagttctggaatatgggatgagagctgaaggttatgcagaatttaactgaggtgaagaatgaaacagggctgggtgcagtggctcatgcctgtaatcccaacactttggaacgccgagagaggaggatcgcttgaacccaagagttccagaccagcctggacaaaacagggagaccctgtctctacaaaaaaatttaaaaaattagccgggagtggtgacgggcgactgtaatcccagctacctgaagaatcaaggtgggaggatcacttgagcctgggaggtcaaggcttcagtgagctgttattgtaccactgcactccagcctgggtgatggcgagaccctgtcttaaaaaaaaaaaaaaaaaaaaaaaaaaaaaaaagaataaaacagcagacatggaggatggctgggcattccagacagtgcagacaaaagggtagctaatgtggcccaaggaatgtgcctaaagcgaagtctggaacaaatacggagccagagggatggcagggatcctttgcagggtcttatgtaggccacactaaagatcttggtcttcatggttggtcggggaaggagaaaaatcataagaatggggcaagtgtgacatgagcagctttcataaggaagacctccctgcagtgtgactcaacctgtccacatcccaacaccttctggcaacccccaaacccctttcactgaaggcaactctatccttccaaagatgaccctggagtcatctttgacccttctcattctctcacacctaagacccatctgtctgaaaatcttgttgccttttgaaggcaaatctactttatattattatattatattatattatattatattattatttattataatataattatatttgtgataatgtaatattttatatataaataaatacaaaataaaataaaacagaatatattttaataataaaccctctgtcatgctacccttcttgttctgagcccctgtcacctccagcctggattactgtcactgtcattgcctcaagactggcctcccgggttcacccttgccctctacattctatcatcaacacctatttttttttaaagtaagttagactctttgctctaaaccctgcagtagtttctcgtttctctcgcagagaccttcagatctttgactttgtttactactcctacctcttgtcttcctgccagctctgctcctgccacactgcccccctggaggtttctagaacactcagggcatgctcccactttgggaaatttgtcctggatcttctccttgtcagactgctctttccccaaatagccacatggcagactcccttgtcactttcgaatgtttgttcaaatctcacctttgcaaggaggcctatcctaaccacccttatttacatttgcaactgccccagcatgccagttgccttttagtccttttatatttcacttttccctagcactaagaccttctagcatattctattacatattacgttttatctttgttgccttactgcccccacctccccacacatacaccagaatctaagcgccacaggataagggatgttcagaaactttgttctgttcactaatttatctccagtacctagaaagatgcctggcacatagtaggcacttgataaatatttgttgaacaaattacaaaaaatatagagaagagattggagagtggctgagagcaggcctgatgagaggccatggcagcggtccaggtggcctctgctaacggtgttggcagcaaagagggagagaggtgaacccactcacttaaaaagtagaacaggtagagagctgggcgtgatggctcacaccggtaatcccagcactttgggagaccaaggtgggcagatcacctgaggtcaggagttggagacaagcctggccaacgtggcaaaatcctgcctgtactaaaatacaaaaattagccaggtgtggtggctcatgcctgtaatcccatctactcaggaggctgaggcaggagaatcacttgaacctgggaggttgcagtaagctaagatagagccactgcactccagcctgggtgacagagcaagactctttctaaaacaaacaaacaaacaaacaaacaaacagcaaaaaaaccaaagtagaacaagtagaatttaccattggttaagataaaggctggacaagaaacgtcaagattcaccttgtataactgattgacagtgcagatggatgctgaggtgttggcaacctctgggtatggggaaaggcaatcagacagacccggggtacagagaagatggtggctagagctaaaactcaggcaattttccccttaaaattttcagatttcatataatgtaggcacagtggtaagaatttagatcaggggctggcaaactgagacttactgcctgttcctgtaaagaaagtttgagtgggacccagctacacttgccaatgttttgtctaaggctgccttcacaccacaagggctgagtggagtatttgcaagagaaactatatgacctgcaaagttgaaaatgtttactctctggccatttacagaaagtttgctgactcatgcattagatcataaagagcctagagttttattattgcccctcgagtaaattgtttcccacctccttttcctaggtctgttctgggctgtccttttgaggctctctctgtttactggtggaattcatctgctttctgagttgtgggaatttgcccaaagttctggctcactggtggaccccttgcatgttcaccttgttatgtgtactttcatctcaattgccagttatatagtaagtgctcaataaatgtgttggtagaattggggaaaggaagcaaatgggtcttccatctgccatcttgcaatgaaagcctgacacaatctcagctacataaaggaagagaacttctgttactcttttacatgaagctctagttttatttttaattttttaaaaaaaatttatttatttattttgagacaaggtctttctctgtcactcaggctggagtgcagtggcatgaccacagctcactgcagcctcttcctcccaggctcaagctatccacccacctcagcctcccgagtagctgggactacaggtgcgcatcaccacatctggctaatttaaaaaaaaaaaattatggagatgggtgtgttacccaggctggtcttgaactcctgggttcaagcaatctcccaccttggcctcccaaagggctgggattacaggtgtgagccactgtgcctggcctgctctggttttaaaaatgattccagcttgtctgagggcttactttgtatgtaccttcttcgtatgacttctaattattttcacataataggtgggtctggtaatttcctagctaggtcccatttgtctttgtgtaaatgatttttcatttagaagggttccaaaaaagtaaaatagatattcttatttttttcacccttcatcttttatcactgttctattacatggtggcttttcttgttaacaaacccataatatcagtctgaaatatcttttaaatataataactatgctttaaatgtgacatgaaaaatgaattgcttttataattctaaataagacatctattttaatcttttcaaagctgatgatttctctttatatttaaaaataaatcaccaagattcaatttgaaagccaattgtctatggaggcactaacaattatttggtctattcaagtgataatgtaaaataaagtttacctatttttaaatagttgaaatattaattcaagagaaagactttttaaaaaaaaattagtataaaatgcgtttgaaataatatgagggatcaggatgaacatttggttctaaaagatttaggttttattcattacaatgttgactgtatttaatatctatttttagcattgaaggtgagccttaaggctatgtatcatgtacttcattaaaaggaagagattgttatgcaaatcggtagcatatttgttaactttccagagagaaagtctcatgcagaaaataactttcttggccgggtgcggtggctcacacctgtaatcccagcactttgggaggccaaggcgggtggatcacctgaggttaggagtttgaaaccagctcggccaacatggtgaagccctgtctctactaaaaacagaagaaaattagccgagtgtggtggcaggtgcctgtaatcccagctacttgggaggctgaggtaggaaaatcgcttgaacctgggaggcaaaggttgcagtgagtggagatcttgccactgcactccagcctgggcgacagatgagactctgtccaaaaaaaaaaaagaaaagaattttcttaagaggaaaaaccagggctaggtaattacttctttattattttaggtcaacatttattagctagcccacacaaattttatttactaatttttttctcccctaaatttgaattgtgtgtgtatatatatatgtatatatgtctgtctgtctatctatctatctatctatctatctatctatctatctatgtatctatctatctatctgtctatatttttttttcctgagggaaaggacttggaagaaataataagacatctgggtataggaatttataggcacaaaccaattacaaaaatctccatttctaaatgtaaaggctgcctctttctatgcactgcatatggtaagtactcaataaatctcaatacatcttatataatacctccagttaccctatggggtagctaccaccacaattcctattttacaaagggggaagtaagatttgcagagattaactgtgtcatacagaatcacagtaacttcgaaatagtagagctgggtttccacccagttaggtcttatgccaaatacttaactattacagcttctccttgaatttatatgctttacttaaatattgccataaaaaatttagatagccaataaccaaaaggaagaaacaatgactatgatgtgaattttcctcaaacttatcttaaaacctgcctgtttccctccctctcacctctttctctctgttgctttctctctctttcttctctgtctctttttacaactcagagatcaagatttaaaaacaaaatggcagagaacaggtacaattctacacatgtgaccttttgtctggaggtatgtttaccctcagaggaatcccccgaagaagttcagaagagatactatttttgtgagtggtaagaaagtgggccatccgtgtttctgctctgcaggttcatttgtcagcgttctaagtggggactgggtgcctttgctctcataaggtgagttgtctatcaaaggaatcctccctgcttttttaggtggcaagatcaattagagtgagcctaacactggagactgaggactctagtacagcatctgccagggagtgtgtcctcttagaaaaattgtgatttttttatgattagatagagacctcttaggagccataatttgtattagcacattaaagaccccgagaggttctgcaaaaggaaactagttgtaccaacttggtacaactcagcatttccaaaatatttggttacagagcactttttgcatgtgccagggataaaaggctaggcaaatctcaatcccttatcttgaccacatccaagccttaacaaaaaacccactcatgtagaggaatttagaggaattggttacattttgaatgtgtagccaatcttgaatgaactcattaatcaaatacagaaaatgatgggataatctaattcatctaacttgctttacaaatgaggaaactgataatccgaaagatttaatctcataggaaccaggtgacagagcaggaaataggccactggtctcctgcctcgaagttctagtttttcccaaccatactggctcctctttgaggtgtggggacccctctacaaaacagttataaacacactttccaaaacacaggagactacttttaggaaggtctcttccatatatatcaagtcattgtgatcacctgttccactgtcctcacagttagaagtggccatggagtgtgtggttgcatcctggatctctatccactgaagtcatttatttttttcacacagtttggcagagtttgggtttgctaaatgtatacgtaagtattatcaacctttggctcacgaattagcaaaaaggatagcgcaggtttgagcgggaggggactggaaaattaattttggtaggataagacttcacctagagaatcctaagtggcagattgctaactcttttcatttgtttacttccaaaatgttttcgagctgatggatgcaattcgccataatgaaagtatttccaagccctagccaatgatccatggtaactgtgctttcatgatcttgttacagcattctcccttccattttcttatgtgtttgtctgtttaataggcccccatcgtaatagctagaggtggaggagtagagagagggagagtggtcaggaggtgagtttactggggtgcttcagatagaactgttttccttgctgagagaatgaggttccagaactcagccttgactgtaagttatgattttcctaaaggctgatgtaaacccccaaatcctatctcggcatcaaccgattccggttaatcagttattttaaaatgaatcaattgttagtctgatttgtaattgatctcttttacatctagtttgtgtgagccagtagatttcaaactttttatttttggggtggaacatccaagttttgataagagtcctgtccaacaaaacactccctggccaggcgcagtggctcacctctgtaatcccagcactttgggaggccgaggcgggcagatcacttgaggccaggagttcgagaccagcctggccaacatggcgaaaccccgtctctacaaaaaatatgaaaattagccaggcatggtggtgggtgcctgtaatcccagctacttcgggggctgaggcaggagaatcacttgaacctgggaaatgtaggttgcagtgagctgagatggcaccgttgcactccagcatgggcaacagagcaagactctgtctcaaaaacaacaacaacaacaacaaaactgaaccaaaaacaaaaccaactctctctgatttcctttcatttgtggttctttcacatgtaggagaggaggagctgtgaaggaagaacacaggcaatttaattcaccagagatataccgcctatcactgctatgtgcctgcaggcactgtgcaataggtgctgtgagaatagtgcagtagctgctctgtacgatgcaagttgctaccagatggttctttttagagcagcaatttcaccattaccacattcaaagtctaaacctgatttcctaaactggcagctcagctcattaagtctacacccctcctgaagagaattcatggttctccgtgactgattattgaaagtttactctaattataataagccatgacatcaagtgagctcttgaagtataaaatgtacaactaccctgcagtagtctttatattttgagcactatttttatctttctcaaacattaagataaatttaataagcatttgagcaaattttggctttagcaatgcatcatcagaatttgggggttgtagcccattattcccccttccccttcccagggaaagtgcaggtttaacacacactgaatcatccgggagacataggccgcaaatacaaacaggcagaaaagcgtcttggtctggcgtttgaggtctgcttgttaaagtctttcccatccattcatatttagagagtgctactctggagtcagatttggtagagtccaatcccagctctgccatctacggtctatctagccttaggaaagatatttaatttctcagagctccagtcttcttctcaataaaatagagtgaataataataatacctacagtgtaggattgttgtgagaatgaaacaaaaatatgtctgacacagtgtaagaacccattaacacatttgccgttatcagaggaaaagggtattgtgctaacgtcaatgtcctggttttgacaatgtactctagttatgtaagatgctgttgtagtggaaactatgggaaaggtactcaggaactctttgtataatttttgcaatgttttgtgagtttaaaattattttaaaattgaaaaagggatgtagggaagaaagaaaaaagggaagtcccaggagtacaacttggcaatgctgaccaccatcaggccagtggaactccagcccaggatgtgcctgtctggctcccgggacaggcaggtccctcttgatgctgggcaatagcacattcagaacacacagaccactgccattggcctggctctgactcactgcagccgtttgattatacatggacttctggtggccttgccagtggggagaagtcacgggagccagcggcctgaatgccaatccttgggcagtgaaagtagtaagggttttcacggtaaatcaatagattgacattctgattcatgacccaaatggaggagacctctggtgctgacgagtcaggctctgagtctgcaaggctgagagagaccctggattatcgtcactgggtcaaggtgaagccaccttgtgaggcctcttgggagacagccaggaagccttgcccagagatgcctctcctctccacccctcatatgaagggctctgtgctttttaggttctggttttaattactccccagcatagcacagtacagctcaatagaactttctgcaatggtggaaatactccatatccatgtagtccctagcagtacggctagtcacaagtggctgtggagcacttgcaatgtggctagtgcaactaaggaatgaaattttcactttaattaaatttaaatagccccatgtggctaatgactactgtacagtacaggtataaattacaattttgctgcactactgtgaagattcttgaaatgtaaggctggttaagagcttgaatggtaggaggaaaaagcttaacccacaaagaaatatcatggatggcctgcttttatggaaggtatgttggccaagaaaacacattatccagttcggataaaaatgataatattaatagcaaacattaaaataagcatttcatggatgacagaaattgggctaagtgtttaatatgcattatcttatgtaatcctcccaacatccccaaacagttatgattataacaacatcaaacatctatggagcacttgccgtgtgtccagcatggtttggcatcctttcatgctttccctcatttaatcttcaaaacctggtgagatgaatactaacactgcctcatttataagttctgtgattttgtgcaagtttcttaacctcaaagatattgaaatatataatgttaagataaaatataagatgtatatgtgcataaaaaaataacaataggctaggtatagtagctcatgcctataattttagagctttgggaggctaaggtaggagaatcacttgaggctgggagtttgagacaagcctggtcaacatagtgagacttgtctccacagaagtaaaaaacatcagccaggggtggtggtacacacttgtagtcctagctactcagaaggctagagtgggaggatcacttgagcccaggagtttgacattacagcaagttaatagtgcttctgcaccccagcctgggcaactgagggagatcctgcctctaataataataataataataataaatgccttgtggccaatacccagctttggcatttgaacactgccagggctttggaagcctgtgtgtgcccctccccacatatgcgtttttccttagccctagagctaagcacttttctgagtgcttttgtgtgtttaaccatttcctaatttgttcctcatagttttgcaagctatgtacagatccctgaaaaaaaaacatggatttttctttacttcattgcacaaatatctctgggctatgaacatttctctaggttcttgcagaacttgacttttttgacttcctcaggaatctttcaattgcaagcaatgaaacccaactcaaactggcttaagcaaagggaaagaatttacatcctctagaatcccagaggaccaggggtaggttcaagcttgtcttccctcgtggtttgtgttggcttgggttggtctctgtttcatcctcctgtgaggtagtcccaacagctcaggcaccctctctgttcctcatttattggaagtagggctctaactcctctccccttcttccaaccggttcagcagaaatccaaggattgagtctctgtggaccattttgggttaggtgttcattcggaatgaatcactctggccacggggatggaatatgctgattggatgggcttgcaatgtggaggtgtctgctgatgctatacatatgggggtagctccactctgaccacctgaattgagggtaagtgggggtggttctcctaaggaaaataaaggttaacaaaggaagaggggatggatgctgcagcggcaaaggcaagagccgtgtatcccacttctgagcaaagcagggttactctgtacacacccatcagtgaccgacgtgccctttgtatctctccaggactgaagaagcaacataactgcccgtaagagggacttctcaacctcttaggaaaacacatagtgtcttaaacatgaactgttctctttcccaaggaaaacattgctgaggactttatctttgggttttcatttttttataccatcctctttgactctataaatgtactttatatgttgaaattggatagttatgtatctaacttcctacttgatgactacatatattctctatataccagaacgagataaaaaagaaattagtaggtgctatttcagagacttgtggcacagagatcagcagaaaaaaagccagaaacaaacaaaaagcaacccatgattactcataataaagatcaccactgaacaatgagattttatggaactaaaattatgatatatttatagatcagtttatttcgtttgccacagcaaactagtttttatttttcacatttttctctgtgcttctattagaagccatggaaacaacgctctcctttttttttcttatgcaaattgattcacctcagcatttactgaccttttcttggcatattctctttgactctggtcatgtcagttgtaaaagcatgcaaagaagctgataatgaatgctttcagaagataacagtgtaaaaacctgaccttgaatcaatgatagcacaattactttatagaattatttaatcaatgatgattttcctaccttaaaataattatattctttaacagaacctctggaagaaaaaacatagtgtgcctcattctttttttttttttttttttttttttttaaatggagtctcactctgttgcctaggctggagtgcagtggtgtgatctcagctcactgcagcctccacctcccaggttcaagcaattctctggcctcagcctcctaagtagctgggactacagacacacaccaccacaccctgctaatttttttgtattattagtagagacggggtttcaccatgttagtcagcctggtctcgaacttttgacctcaagtaatccatcttctacctcgatctcccaaggtgctggtattgcagccttgagccaccgtgcctagccaggatgcctctttctatagacctattttccccaaatttgcatgtaaatcacatttttgtaaatggaatcatattttaaggtccagcataactcaaaaattgtgcagtgaatcatggaatgattttaattttaaaggagaaagaaacttctgggctttcttgcataagcgtctccatttatagatgtggaaattgtggatgtattagtgggaaatgtcttagctaaggtgcatttatagtgaatttgttctgtgattgatattactatatatttttctagttgccaatttttgttttcgatgtttaattaaaggaaggtagtagacctgtagaaccaaaagaagattattttttcagcttccttacagtttggatataatttgtcaataattataaagtttgtagataattaaaataatacttgttgaggtgtttttttccttggttgcttgatacaatgcgttttttaaaaataactaaaccacaaatataggagtaatatagcttgctgtcaattaaaattatttatttaaattgacaagtaaaaaaggtatatttcatatacagcatgttgttttgaaatatgtatacatgcggaatggctaaactgagtgaattaccatatgcatacctcacatatttttgtttgtttgttttttgagatggagttttgctctgtcacccaggctggagtgcagtggcacaatctcagctcaccacaccctctgcctcctgggttcaagcgattctcctgcttcagcctcccgagtagctgggatcacaggcatgtgccaccatgcccagctaattttttgtttttgtttttgtttttggtagagacagggtttcaccatgttggccaggctggtctcaaactcctgacctcaggtgatccacccactttggtctcccagcgtgctgggattatgggtgtgagccactgtgcccagtcattgttattaactatagtcaccatgttgtacaatagatctcttgaacttatttctcctgtttaaccgaaatgttgtatcgtttaaccaacatctccgtcactccctcattccttcctcccatcaaaaaacaaaaaaacagaaaaacaaaaaaacccttctaggttttaaatatctttctgagagaataagttcacaggctaaaccagtgatttgcaactggggttgatgttgtcccccaggggacatttggcaatgtctggagactttttttgtttgtcacatctcgggggaggtgctactgtgggtagaggccaggatgctactaaacaccccacactacataggacagccccctacagcaaaggagtaaccaccccaaacatccatagtgctgagattgaaaagccctgggttaaatgaaccagctttctgcaggtgaagactctcacagagatcataagccatgccctttcacttactgtgttgagtgctcctttattagagtgtcacaatcatctctacctctattaaaaagctagtgtgagaagcctcttccctacttttgcatttaccctctgctgcttcttcctgtgaaattaaacaagtgctctcatctctctaaggccaatccttcctctaaggcttggagaccagctaggattaagttcagctgcatgaaacagaaaaatctaacgtcctctggctttttaccactggtattgtattcctcacataaaagcaatctggagacagcagtccagggctggtgcccatgctccacgatgccatcagaggcaggggcttcttccatcttcccacccagccattcttggaatgttggtcctcacacatagctcctggtgggggcaccatggctgctccatcaccagcacggggcctatgtctagttggggagtcaggggaaggggaaaggttagagtgcttgcaggttgagaatgtctgcctcttcccaaataggtacttacaaaattgcactttatttatttcctatgctgcatttattgcatttgataatggcagatataatggttaattttatgtgtcaagctgactgggagaagggatgcccagatagctggtaaaacattattattattattatttaaaggcagagtctccctctgtcacccaggctggagtgctgtggtgtgatctcagctcactgcgacctccacctcctaggttcaaacgattctcatccctcagcctcctaagtagctgggataacaggcatcagccatcatgcccagctactttttttgtatttttagtagagatggggtttcaccatgttggccaggctggtctcaaactcctgacctcaagtgacccacctgcctcggcctcccaaagtgctaggattacaggcgtgagtgcctagcccctgactattaccatcttttagggaccttgtagcagccactgctgatgctcagctcagaagccctcacattcctttaccatttccatgctctcctactttggctgcattgttcttttgctatgtcagtgggacctgcaacagaactgctctcaggctcccagagaggccctgctctgcttgtgcagagggccagaaatgccggagtgcttttttctgcttggggtagccagtagccaaggacctgctaacccagcagaatgaaagcccagctcctttattctgactcaggaaaaacccttagatgcagttgactctccagagctccctgcaggatcaggtggagtctggcctttggtttgagatcgccactctggtgggcttcttcctcttgctttgccgtgttcccctactcttactttgcccagtgttcccaggagaccctgccttcataaatcattttcacaaaaatctttatctctgagtctgcttccggggaccagactatgcctttttaattcacccagtgcctagcatagcacctgacacatagtgggagtttgaaaacttcttcaagactggttgaaaaatgcataatattaaacccaattaaacaaacagtcctgttggaaagacacttttgaagccagtcaaattcagatgattcagtaacaattagtaacataggtttgattctttttatttttttataagacagagtctccccctgacgcccaggctggggtgcagtggagtgatcttggctcattacaatctccatctcctgggttcaagcaattctcctacctcagtctcctgagtagctgggattacaggcgtgcaccaccatgcctggctaattttttaatatttttagtagagacagggtttcaccatgttggtcagcctcgtctcaaactcctgacctcaatgatccacctgtcttggcctcccaaagtgctgggatttacaggcgcgagctgccgtgcccagccttacataggtttgattctatctagcagaactcaaattcaaaataacctggtgaaagttgaatacttaaatttaaggtcacagatcactacaatatgacagggaccaggcatttttagtgtgtacaattcttctatcagcttaggttcctgctcagaaatctgaaagtctcgccccactacatgccacaaaccgttttttttcctttttttcttttcttttcttttttttttttttggagacgcagtttcactcttgttgcccaggctagagtgcattggcataatctcggctcactgcaacctccatctcccagtttcaagcaattctcctgcctcagcctcccgagtagctgggattacaggtgtgcagcaccacacctggctgatttttgtattttttgtagagatgaggttttgccatgttggccaggctggtctcgaactccttacctcaggtgattcacctgccttggcctcccaaagtgctgggattatgggtgtgagccaccaagcccagccaaacccttattttttttaaggaggttgtgcacactggttccccagaagcaaagcatcaggtaatgttaacttcggttattgcaaatgatggctggaggtctggggagagggattgatcatactgggcacctgcatctcctgtgcaaatctctcctggggcctcaatgcttacgcagtttgctccatacacccttggtttgagtggaccctcccctggctcacaggctgcctttcattgttctgggtgctctcaagcagtgatgccactgtggggcatggtgcctgacccctagagcaatgcctcctccaggccccagagagctctcccctgaaaagtcaaggcttgaaagaaggaagcctgccattggctgagaactggaattattacaacccccaatgctggaggtgggacttgcgggaggtgattggatcatgagggcgggtttctcatgaatggtttagtaccatccccccttggtacagtatagcgagtgagttctcacaagatctggttgtttaaagctgtgtggcacctcccccatttctctcttcctcctggggtggccatgtaacatgtgcctgcttccccttcacattctgccatgattgtacatttcctgaggccaccccaaaagcagaagccagtatgcttcctgtaaagcctgaggaatcatgaaccaattaaacctcttttctttataaattacccagtctcaggtatttctttatagtagtgcaagaacagactaatacacccattcttgactttggagttagattagacttctgaagttcaaatctcgactctgctacattcaagctgtgtaactttgggcaattcactcaatccctctcagccacagtttcctatttctcgaatgtagtttccatgagggactgggtcttggtcttttcctgctgttgctatattcccagtgacaagacagtgcctgaagtatggtaggggcttcataagtattttctgaggaaataaataagggtatttgtgaaggctgatggaaatgatgggtagtatctggcacaaagcaatcacttaatagtatctgagtgactatctggcacaaagccagatctggcacaaagcaatcactcaataaatgctagctataaatatataaaatatacatatgaagatgtaattttattttatttcttatatctggtaacatagtttctaaccacaatgtaatgtgttagaattcatcctctctcatgcctgtaatcccagcactttgtgaagctgaggcggaaggactgtttgagcccagaagtcggagactgcagtaagctgtcatcatgccacagcactcttgcctgggcaacagagtgagatcctttttctaaaaactaacaaaacaaaacaattatttccaaaaatttaaaacttaaaaaaaattaaaaattgagaagttttttaaaatatgaaaaaagaggcatctccatattttctgagagcaatagtacattggtgaacactgattgccccgcatccattcacttgtgtctttcttcctaacacaactccgattctgaccaagtatagcttagaagaatgtgacccgagactctagaagtaaatctttttttttttttttgagacagagtttcactctgtcgccaggctggagtgcagcggcacaatctcggctcactgcaacctctgcctccccggttcaagcaattctcctgcctcagcctcccaagtagctgggactataggcacccaccaccatgcccggctaattttttgtatttttagtgagacggggtttcaccatgttggccaggatggtctcgatgtcctgacctcgtgatctgcccacctcggcctcccaaagtgctgagattacaggcgtgagccaccgcgccaggccaggagtgaatcttaaggaggctattggcatgtgccattcccccatcacctgcctgcatgactcattggtcctgtgactaggactggttcaatcaaaatgaaggaaacatttatattacacacttggagatgtggtttttccatttttgaccaggtagttgagaacaaagaagtatgtagctccagttgccactgacaactgtcttgttattatgaggcacttggaaatgaggcttacaacatcatgagaaagacggagagagtcagttatctgacgacatctttcagctactgatggtgccactccttccagttaggtaagataatacatttccttactgtcttattttttatttatttatttttgagacaaggtcttgctctgttgcccaggctggagtgcagtcgtgtgatctgggctcactgcagccttgacctcccaggatcaagtgatcctcccaccttagcctcctgagtagctgggactacagacgtgtgccaccacgtctggctaatttttgaagtgttttatagagatggggtttcaccatgttgcccatgctggtctcaaactcctggcctcaagcaaccctccctcctcggcctccaaaagtgctgggattataggcatgagccactgagcccagccatttcattattattattattattattattattattattattattattattattaagacagggtctcattttgttgcctaggctagagtgtagtggcagcaagagggctcactgaagcctcaacctcccaggctgaaataagcctcctgtctcagcccctcatgtagctgggactacaggcatgcgccactacacctggctaatttttgtacttttttaacagataggatttcactatgttgcctaggctggtctccaactcctgaattgaagccacccacctgcctcggtctcccaaagtactgtgattataggcttgagccaccatgcccagccaccttattttttatgtcatttaggatgggtttttccaagccttacagccagaaatatactacctagtgggctgcaaaattatgtaggagatgaaactaaaaatgtcttcttcgaataataatagtaatggtagccaatgccttcttcagcacagtgtcaaaacatatgccaagcccttcagctatattagctatttactctctcaacaatcctatgaggtggagactattatttacttcatgtttcacatgaggaaaccaggtatatgtcaagttacatacatacacacacactaaacccaaaacaggtcagtggaagagctgggatttgaacataaaggtctagttttggaaccagacttatacctacccatgaaacctaaccatttccatcaatagatgaatggataaagaaactgtggtatgtatacacaatggaatactaagcagacacaaaaaagaatgaagtcatgtcttccatagcaacatggatggaactggagaccatcagcttaagtgaaaccactcagaaatagagagataaataccacatgttttcgcttataagtgggaactaaataatgtgtacacatgggcacagagtacgcaaagacagacatggaagacttggaaggatggggtatggaaagaagtgtatgatgagaaatttcttaacgggcgtaatgtacataatttgggttgatggataccctagaagccctgacttcaccactacaaaatctatacaagtaacaaaattatacttgtactccataaatttttacaaacaaacaacaaacccctacccattaaactatactttaaagtatttacttctatgaagattcatagtgagaaagaaaaaaatggaatgtaatatgcttcagttttttaaaaagtatactaaagctttcatagacaaaaattgaacacttgcaaaattttcttgcttgtgtaccttttccagggaatttgtctccttttgaaaacatgtattcgtttatccaatcaaatatttattggacactacgtgtcaggcattgaagcaggtgctagagtacatagtgaataacttcctgccaggtggagaagacaaacaagtaaacaagagggataagccctttcccaggaaggcacagtgtgccatgggcatctaaacatggtacctgaaccagtctgatgcaacagtcgtctaaaaaaatgcttcccaggtgagacctaagatttccccaggaaagcggtgagaggtcatgtccaaaggcctggaagaggaaagaaagaatgtgtcacatctgtgacactgcaggcggtggtagctaggaaagggttcagtacatagaaagagagatgaagtcagtgatgcaggcagtggccaagaagttcagctcttgtctaaggccaggtcctccagaaagtagagcctgagtcaaaaactaaagtgctaacaattccggaggtgcaagtccaaggtttaaaaggtaagttaaaaagggaagtatcgcaaataaagaagccaagcatggtgaggagactgtcacacactgctgtggggccaccatgttacaaggagctgaaaagaggcatagcaggtggcttagcaggtgagtctgcctgggacatgggactgctctggaaaggctgtgggaagaaaccctgtcttttagtaggccatgaaaatagaaagaaggaggaattaatctgcccagctcattctacctcttgttttcccttatttagggagcatccatggggagttaatttccccacacttctgggttgcagcatctggtgcttggaggctgcccaggaagccagatgtcatgctccatcatgcgacatttcatcccattctggaagtggagggatgactcaaagcagaggttggtgtgtagactcaaccggcccacggcttcaacttgggccccaggcagcttgggatgttcatccatggccaagctgagcttcttcagaaatgaagaaattgaaagaatctgcaatggtacataggttaatgtccgatagtctttttccctgagagaagctataaagaacatcaagcctaggacagccccaatcagatgaagagctcagacggttcatcctggctgcagggtggagatggattgaaattagcaaatctgaaagtgtgtctgtcaccctgtggcctggtctaagggagtaagaatgaggatgaagccaggtggatagatctaagcaatattaaggaagtcagtttcactgtattttgtaattaagaagatgagaagcgtgagggagaggatggcacctgctttctggcttaggcagctgaggagtagatggtggtgccactttctgtgatggggaatggttgagtggggtgcgtggagactaagtgggatgctgagctcagtgttgaactaattgaatgtcagaagcccaaggcacatccaaggagaagtgtcctaaggcagttggtggcactagtctggagtttgggagcaatgcctcagctggagacagtttttgagtcactggagtatatgtgggtaatgcagcaggcatgagggatgcataagatgcctgaaggcgaatattttaaaaagaagagaaaagggtagaggacccagccctcctgggctcctcagtgtgaatgcataattagtacactaccagatgaagggaagattccagaagatgcagagaaagcacggccagaggtgaccccagggcaggagcaatattttggtgagtgagcaacagtgagagatgtgcaaaggagtcaacttaggaaaagcgtgagagatgttcaatgaacttagacatgaggaggtctttggtttcctcaggaagggcagcatcagtagcgtggtggaatttggggtgagtggaagcaaaatgtagataaaccattaatcttttatgtagggattacttataattcaaagcagttactgtaattcagaatgatacaaaggtaaataaattatagagcaagtaagcattccagtaggttttaaccccttatcctgctttacatttctgcatagcgtatttgacaacttgaagtgattgtatttgtgccactggttgctgtctgcctctcctatagaaggaagaaccaatcccagcactttgggaggctgaggtaggtggatcacaaggccaagagatcaagaccatcctggccaaaatggtgaaaccttgtctctactaaaaatacaaaaattagctgggcgtagtggtgcgggcctgtagtctcagctatccaggaggctgaggcaggagaatcgcttgaacctgggaggcggaggttgcagtgagccgagatcgcaccactgcactctggcctggcaacagagcaagactccatcttaaaaaaaaaaaaaaaaaaaggaagagaagcatgaaggctgcagctttgtcttgttcactcctgcagccgcagtgcttggcccaaagtggccaaaatgttggttgaataaatgatagagagaatctgatgaaaatacataaattaaaaaagaaatcataatttgagctatatatgtacaggctatttacaaaataattatagataaatgttcaaatgaaaaagaggaagctgtgaagatgactgtaggacatctcttgttttcagcctcccagatcttctggtaatttaagtggaaattgataatactaaaagattgtcatgaatttcaaaaaggcttttctaatctacaactcccctgtagacttttataaagagatttctgtataaagattttgacttttataaagagatttttgttaccaattagatgctagactggaaagtaatcaacttagggaaaaatatataaatataaatgtgtatgtgtgtattttttttcatgattttaatcaactaagagaagtagagtttttacactaattttgaaggttgcatatttagaatcttgcattttattaaaggcaatatcataatacttaacatctatgccagagacctgcttggttatattatatgaagagaggcatgctttttatggaatcatttctaaggaagtggacattgaaatgacaattccaagaaaaatgctttcctttgtctaatttgtttttaccccttctttacaggttttttatgttaccatgctttagcagaagtcaattaatcatatattttaaataaaatgtttcataatttaccaagaccaattctgtcagtagcacagtatgctagatgtgtattcaatttagatgatggtgaatcctgatctctaaaccctgtggtttcagtgataaggatggagtgtgcaaacatggaacatggaacatcttcttaaaaagttaagggacagtcttcttcatgatttcagtggaagttaagatggaaagggtaccacttaaagtatcttaacagtggaaggagaaaagcaaaattcacagcatcagaaacgttcagggaaattcatttgtccttgaataagtttcacaaatatagatgtgaaatggttaagaagcaacattccagttttgggtaagttaggctgcagaaacaaatataaccccaagtcttaatggctttcaaccacagaagtttatttttagttcttattatatgcctgaactggctttagaatttcacctcagtatgacagagtagatttctaagagcctggcctgttcgcaggcaacagctctgaactccaaacaaaatactctggagagcgagcaaaaccaggcagattttgggagggagtcaaaacagggaagagggattatcagagggtgagtttcccattttcatgacttcagtctgagattgggctgcagacagcatggatgggcaaaacccacgagaacatctgctctttttggcctgaagaaccaaaggttctggggcaaccgctgctgctggaaagtgacgagagaatcccagagatgagagccagggcagaggagcctcaaaagccttctgtgcataaatattgccccaattcctgacacctgaatgatctgcgcatggggcagactcaaagcagcttgtaggtcaggcttagagaacagaattgagatctgagctgcggccctccatacacaagagagaactcctagtttgagcctgtctaagttaattgcctgctaaaacaaaaccatcaacattctttgtaagaatgtaacagaatcaagagtttctacaacataaccacaaagaaggcaggggaggaaaaacaggaacaaaagatggcagggtggaggggcagggacagaaaacataccaaataatatcactaactgaaatcatatggatatttacctcagatattaatattgcttctatcacagcagagggagaagagcagcaaggaaagaggatgatggcccttaaggcctctgttgataagtaacagcaatcgttttcactagcatttcctcaagtcccaggtctgggcctgacttgcagtcatggggcaggaaatgataatcgattcacagggataatcgattcacagtgaaactgccatcatctggtagattgtatcattattcaaaaataaattatttattcaaaaattatttattcaaaatttattcaaaaataattattcaaaaattatttatttttgaataataatacaatctatgtacaataaaaaagaaataatttttgaataaataatacaatctaccagacgatggcagtttcactattaggaaagagtaagtacttatagagtcaatgacttctgcataatgagaaaatttttagagagtatttgctctcctgacaaaatccagtgttatctatgtaaccacagccagctcagcagccaattgcctggttgatccataccccttctcagagattctgtctcttgctaagtaaatggcacaaaaccacttctgtggccacagctaattagaccatgggttggatgcctgaccaatgttgggccatttagatttccaaatcccatcaacccgtcagtgcctgcactgagaggccaagcaaagccagggttgagatggaagagtctggccttataaaggtgaagagagaaagccaactgcggagagaacctcctgtgttgtcgagataaccctataagcttttgttaatttaataggtgaaattaatttcagaggatttgcaacactccaaagggcaccattcacatggtagtctataaaaatgacactaggaattcacttaaactacagtgtgaatattgcctctggagttgtgcaatgctgtggtgctgggtttctgtcgctagaaaagaagtcttcccttctgctatttcagatagagagctcatggaagacacagtgaagagacagaaacatcattcttggggtaataggcaatgacagtagtaattttgctgagcacattgaaagagaacaaaattccaaattgcttcttggatctgtgcaacaccaaatttggaacaggaatagctagaattatggaaatacaatagacagagacaaaacaaattgtgaactttgactactcacagacagacagcattttttttgcaacaggtataagcatcccttgctgtaagagttgattctgatgcagtaatataccatttatagttatttgataatgcctttctactttcaaacatgagagtacaatccagtacatattttatgtatacatgtacttttcattgactaatttgtctacatgtcttattcctgaatgggaattccacatcaaatagctttacttctttgatttaccttccaaaattgcacaaaccttctattagtttcactttgcaaactagtctccttatttagtgaaatatctaaatataagttttacagcctcatatatttcagagttgttgccttcatcacataatgttaaaatatgccatatgatcctaatccatacaattcaaaacagtaatacaaaatgtatagacaaatgctctcctgctgttttaaacaccatttagcaagttttatagttgaagggtttgccgacataactattactttcctattatggtgagtatatgaatatttcttatagaaagatgcttctatagccaggcacagcacggaccactcaaaagccaaggccaagccctttgcttgctcttaacccctttgcagtattcttttgaagcattgtatttaatagtacagcaaactctcaatttcctagacttgcagacagagataaacagcaaagaaagttctccagtcattttccagtcattggttctcatatctatactcagaatgtgcatgtgaattaaatttttttctacaacattaagtgttctctacgcatttactatcaagtagatactttatgtctgtgatgacgaaataagttatattagataacaaaagtatctttagatcatgtcattgtcacctaaattcagcttaagaaaaaaagacttcgacaacacttcttagcccatctttctttgtaatattttagcctgttgtcttagacagttgaaaattacagtatgatacaacaaagcagatgagttgataaatgaacttgaccattctttgcaaaaagttaaaagcaccatgtcaatttaaagtgttgttattgctgataattaaggagacaaatatcaccagttgaggctaaattcaatctgttacccagtggcacagattataaaaatattccttcaaagctcttttgaactcttaaattttagaaacagctttgcacataaaaggaaattgtgaatgctggctaattttggtttgcccgatggttctcggactggtttaaatgtccttggcaaaccctcagataagcttcattcaatagtcacagttatttactggaagaagcctgattggatttgctaattccataatatgcacagtgataggaaggagaggtcttgaaagtccatttgtaaacagctgtttccctcaactaacgcaaaagagatttatttccctcaaaaaccacaattggtcaggataccttggctaatttcactctaagatgttaaaattgctcccttctgccaggtagcccctgtggcagaggattgggtggtctccatgttttttgctgtctacttagcttctgtctgctgtattgcaaatagctttgctgaagcagttcaacagttcagcccaggcaagaattacaattagaagtggtcagctgggtgtggtagctcatgcctgtaatcccagcactttggaaggccgaggcgggaggattgcttgagcctcggagttcgagatcagcctgggcaaaacagtgagacatgagtgtctacttaaaaaaacaaactgccaggtgtggttctgtgcttgtagtcctagctatgcaggaggctgatgccaaggaggttgaggctgcagtgagctatgatcatgccactgcacttcagcctgggtgacagagcgagagaccctatctcaaaaaaaaaaaaacaaagaaagaaagaaagagaaaaaaaaggggggacaaaatttgtttggcaattagtatctctcaatagcctgaaagtgtttttaaaatagccacataaatatttctacatcacctggcattgtgggcatactgaagacagatcactccattcaaaacctttgaatactcaaacaatgacagcatttacttgtactggagaagtgagggaggcacttgagtaatcctgcctctgctacacactagctgaatgacctggggcaaagaagtcactggcttgttttaggctcagtttcttttttgtaaaatggtggttggtaatagggattttctgaagaataagtaagatcatatctgaagtgttaaacagtaagtagaaggggctcaataaatgctagctgccattatcccacagtgtattagtcagggttctccagggaattggagccagcaggatacgtgtacataaatacccgtgtgtgtgtgtgtgtgtgtgtgtgtgtgtgtgtgtgtgtgtgtgttcatataagagagatatattactctgtatcagtaactcactcttagctttaagtaactcttacttacggatgaatacagagttacatatctctcttatatgagtatacacacatatatacacacatagatgtgtatgacagagagaaataaaaaggtgggagagagattgagattttaaagcattggctcatgcgatagtggaggctggtaaatccaacatctgcagggtggcccagctggctggaggccttagggaagagttggtattgcagttcaactttgaagacagtctgctggcagaatcccctcctccgcgggggaggtcagtcctttctctcaaagccttcaacttattgggtgaggcccactcacattattgagggtagtctgcttgactcaaagtctattgatgtaaatgtgaatctcatttaaaaataccttcatagaaacacctgcaataaggttggagcaaatatctgggtaccgtggggtagtgaagctgacacatgaccttaatcatcacacaaagtgacaagaatctagtgcttcgttcacctcctttgacaatgaaaaacaaaaacaacaacaacaaaacagagaatatagtgctttgtggatgccagacactgtgcgagacactttccatatattaattcaccatctctttcaccacaatcgtttgaagtaggtgctgttattatgcccattgtaaaaatagaaaacttagcaccgagaggatgaatcatctgcgcaaggtcatactgccagggatttgtgctcccgactgcaacaataaactgtcagctccatcaggacagagcccatacgtgtggtacctgctgtgcctagcacaatggatatcctaacagctaattcattcaacctcttggattccttcagacaatgagatattttttctgaatcaattagctgttttgtttttggttttgtcttgtagatgaagcctcaatgtaagatatactttgtgagtctgaaatactcccaggcaattagtgacaatgtgctgtgggaatgaatttggatggcatagtgaatgaaggcatgcatacttcatttaagtgtggatacaggttttaaggagataatgtaagtttccaagttgacttgttcatgtcatggaaatggcccaggcagggagaaaacctggagttactataaaatatgtattaagtacaaacatcccatcagtgtaaaatttttgatcatgcattcccaatattcgtatatgtatttataaattacataatgggcagggtgcaatggctcacacctgtaatcccagcactgggggaagctgaggtgggtggatcacctgaagtcaagagtttgagaccagcctggccaacatgacaaaaccctgtctctactaaaaatacaaaaattagccgggcatggtggagcatgcctgtagtcccagctacccaggaggctgaggtgggaggaacgcttgaacccagaagtcagaggttgcagagagctgagatcatgccactgcactccagcccgggtgacacagggagaccctgtctcaaataaaagatataaattatataatgcacaattgcaacgatgcataaatgctttataatgtatacacaaataatgaattttgaaaaggatgagataagaaataaatgttaattgaaattctacattctttttgattttcacacttcagtaattcttcttgtgccctccccactgtggttttaattgacttagaatcttgtgtaattgaaagcttttcctgccatacaacttattgagaaatgaattggcttgccccattgacaccaagtattcaatgatataatgtagctcagcagaagagcacagtgagaattaaatgagataatatgtgcggcacttgttgttatcacaagagatgccttattgcagagttgctaaagagcgcagactccagaggctgacacctgggtgcaaatcccagcttcaccatgtactagctgtaatctattaaatgaggtttttgtggggattaaatgaattaaaaacaataaacaagtaaaattcttataacacctggcatgtactaagtaagcactatataaacattattgggtgcaccacaagcacccataaatgttaactgttcttaattgtaaaaaccaaaaatgtaatgacatacactgaggtcatttgaccttcatccttttcgctttgttcaccccagggctatacgataaaaatgttctgaatgatgactctgaagtactgccacaggattccattcatttgagtacccgtcacaatttttgctacatctgagtaccacccgtaccatcattaatatttgtctttaaatcaagttgggcttaacaccaagatctatttcattatttccgagagcagtaatattggtgaaatcatgtatttgatgtgctataacatttattttcctaaaaatatatggcaataaacatatagccattaaaacatttcccaaaggaaatcttacattatacaatccttaagtcgtgaatgtttcaattatatttattctacttaatgagatacaaggatataagaacacgttttctatttaaccaagtttctttcaggacaccctagttccctagaagtttaatgaattaggattctaatgttttaatttttgatacttgatcatttttattaattattattattatttttgagatggagtctcgctctgtcacccaggcgggagtgcagtggcacgatctcggctcactgcaacttccacctcccgggttcaagcgattctcctgcctcagcctcccgagtagctgggattacaggctcatgccaccacgtctggctaatttttgtatttttagtagagagagggtagagacggggtttcaccatcttggccaggctggtcttgaactcctgaccttgtgatccacccacctcagcctcccaaagtgctgggatgacaaggctgagccactgcgcccggccaatacttgatcattattttcttttggatgaaaagaatttcagtttcttttacttttcctcactgggctatttcataataattagattttatttaaataaataagacctatatacaaagtttgatcattgttatcacaggggaactacaagtgtcaggttaaattatatcaaattaaccagtttccccatgcatgcatatgatagacagattagagaaaaagctaacctacatctagaatgccaaaagagaaattctaccatattcaaattaaactgattcctatcaaaagtgtacaattcctaccttgaaacagattgtaaataatgttccaagcaattctgagctaaagtgaatcagatttttttttttttaagagacagggtctcgctctgtcacccaggctggagtgcagtggtaagatcatagctcactgtaagcttgaactcttaggcttgagctgggcctcatgaagagctggggctataggcacatgctaccaggccaggctatttttaaagaaaattctaattagttcagccactgtgaaaagtagtttggagatttctcaaagaactaaaaagagaactaccattcgacccagcaatcccattactgggtatatacccaaaggaaaacaaattgttctaccagagacacctgtacttgtatgtttgttgcagcgatattcacaatagcaaatatatggaatgaatctagctgtccatcaatggtggattgaattttaaaaatgtagtacatatacactaatggagtactacatagtcatagaaaagtacaaaatcacatcctttgcagcaacacggatgcagctggaggtcattatcttaagtgaattaatgcagaaacagaaaaccgaatattgcatcttctcacttataagtgggagctaatccttgagtacgca

SEQ ID NO: 545 - DNA, 40001 bp, Homo sapiens
tgactcggtgtcaggaccagaggcgccccctacccccgccccccaatatctactttcagacatattgaagtcctaacctccagcgcctctgcctaactcaaggagtccccccatctctttcccattcttttatgcccccacttctactttttctttaaagcacttatcaatatctgaaaatatcttgtttctgggtttactgcttgtattccccaccccaaagagtggaaactccttaaggatgggttgttgagagaccccaacacagcggctctgtggttcccttcaggcctaggggtgctgaggggcccggtgcttccccatcctttctcggcctccttcagtcctgctctcacctttgtaaagagtcatcttcttcattaaactcgccttaattacccccttctaatgggccacctcttccctccctcgggcctgactcagatttgaacttgacttttgtgacagtggaggctgcgctgatgatggatgccgaatcatcaaaggccagtcctgggctctggtctgagtgtctgggtagtcaccacccgcctgatcagcaagcgccttgtcatttccctccgccgctggcactctgtaggcacaggcattatgaattaatgcatctctaaaaattaagcactgaatccggccctttatttatagctcattttacaaatgtgaattaaagtgggccagtcttatgacataatcaaatttattatccccacttgatagcttggatagttaaatacttcagtgaataaacttagaattcattaagtctcattttctcatatttcatatatttgtaatctactctcttccctggcagttttcaaacaggaaaattaagcctggctcagaaatttatgaatgtattcttctaatattcctttaatgagaaactcataggcggcttcctaagcgagccacccacggagctaacctatgtaatgtgagctaccttattgtgtgaatccttcttcattccaattttcttttcttaagctctcattagctctggaacaccacctaggagaagttctatagaaacacagcgaggagggctaacttttcacctccaggttgatattcagaaggtttggtcatagtttatgtgcttagtgctccctgttgattattaacagagtggaattagagcttttgagctcctaggcaatgtggtactctctgagatagtttggaaatcagtttttctgtggggaaagggagtctacatttctagatgcagactaaatccttctaaatccatcctgttgccacttgtgctgtgtcaggtaccactttggaggtcctgttaactactgcaggaaagagtgggggggaggagagaggggagagaaagagagggtgagagtatacggcacatacccagctggcatttgaggagatcttaggttatccaagtagccctgttaagtgtgcctaaaattcaatatcacttcaggatcagctgtttatgttgggaatggtttgcgtggtaggactgaggagttagagatgttctaaaactgttacagccaaacatttttggcctgaaacttaatagacagagctagaggaagtagagtccgttaacaaatatttatcttctattctgtgcaatcctagtcttagaagctggagatgcagctctgatcaggcagttaatgcttacatagggcttatgatgggctgggagtagttctcagtgttttatattaactccacttaatccccatggtaccctgagaagtaggtactaatatttttcccagtctacagatggggaaactgaggctctgagaagttaacatgctcaaggtcacacagccagtaaatgggaggagagagaagtgactccagagttcgtgttcctaaccactttattagtcagggttctccaggaaacagagcaaacaggatgtgtatatatagaaaagacagatttattttaaggaattggctcacgcaactggggagatttcagccccaaatctgcagggtaagctggcagcctggagagccaggaagacctacagtctgagtccaaaggcagttggctggcagagttccttcttactcaggggagtaagtcagtctttgttctattaagtcctttgactgattggatgaggcccacccacaatatggagggtaatctttttactcagagtccacccatttaaatgttggaatctccgccaggcgtgatggctcacacctgtaatcccagcaccttgggatgccatggagggcggatcacctgaggtcgggagttcgagaccagcctggccaacatggtgaaatcctgtctctaccaaaacatacaaaaattatatgggcgtggtagtggacacctgtagtcccagctacttgggagactgaagcaggagaattgcttcaaccgggagacagaggttgtagtgagcggagatagagccactgtactccagcatgggtgacagaagaaagactctgtctcaaaaaaaaaaaaaaaaaagaaaagaaaagaaaagaaaaaaatgttaatctcatccaaaaaacaccttcaccttcttcaccaaaaaacacctcagaataatgtttgtccaaatatcggggcactgtcgcccagccaaggtgacatagaaaatcagccatcataacccctgttgtggatttagttacgttctttggaaaatatacggtgaactcctaattcccagtacctcagaatgtggccttgtttagatacaggtctagggacatgtagacctgtatgttgcagacatttagttaagatgaagtcagactggagtaggctgggcccttaatccaatgtgactcatgttctcaaaagcagaggagacacagagcagaaacggccaaacgaagacacacagacacagggagaaggccgtgtgaggacagaggtggggactggggtgtgctgccacaggtcaagtgggagaggtgagaaaagatcctccctggaggcttcagaggtggcaccttgctgacaccttgatgcgaggcttccagtctccagaactgtgagagaatatgtcgtgttaagccactcagggtggggtactttgttatggcacccctgggaaactgatacaactgctatgctatgggggtctctcaacaacccaacccttagggagtttacactcttggaggggtggacaatcatcacgagcctcatgagattcacaaaagaccctttcagtgccacgcttgcagggtgcaagttttatgcatatggtggccaccttccctgctggaagggtcaggactcagaaaagcagcacctttagaagatctttactattggggttttattatagggatttggccttttgcagtcgtaagagctggttccatagtcccagctgtgtggcagcccatgtctgtgtctgatacaggaacctgaagtctgcaggccaggcctttgactaaggaaagatgggcagaaaatgggggaagaaagataaactgaaatccttgcagtgaatgtcctggcggaggtcagacactgaggccgtggcagaatggactcagcatcacccgacttgtcattgagggtctttccattatgtcatggtgcctctttagaagcctggaactttttttcttccaaaataaatctcgagggcttcactagatctgtaggaactagaaagtgtcaatactcaatgagctttagttaaaaagtgatcttcttctggaatgaaatacagcaaaatgcatatagtagttatgaagtttaaggacttagagtaatacaaaaatttcctattctgctatgttttctaaatttcctataatgatcgagaatgcatttaaaaatgaaacttaaaacaacactattattaaaaggaaaaagagaagccttgatgttcatctacgctgggtatccttctcaagcaggacagatatgaacttgctggttagctggtcctggctgacagttatttattttgagacaaggtcttgctttgccacctaggctggagtgcagtggcagcctcaactgcagtgtcaacctcccgggctcaagtgatcctcccacctcagccccccaggtaacagggactacaggtgtgtgccaccatgcccagctaatttttgtattttttgtagagacagggttttgctatgttgctcaggctggtctcaaactcctgggctcaagcgatcctcctgcccgaagtatggggattacaggcgtgagccactgggcctggccctggctaacatttaaagcaagtaggaagcctgtggttttagaatttgaggaagttcagaacccacatttcgaaattacatgtctaacttctggtcttatttgaatgtctacttccttccccctcacctttcaacctctgttttacataaggataaggcaggtttaggaccagattaacctaaccaaggaagcgtaggagtccttagatccataatttggttggtttaacattgggtcagtacctgctggcttctgagtcaatcatgtattggtgctagtaactaagttactaagtaacagattctatagccccctcttcttccccatcctttcctgaaattagcccaacttattcctccagacctgtgtttttcctgattcagtcattcattccatcaacatttactgagctcttactgtgtgccagagactatgacaggcactgggatgcaaagatgaaaatggcatgatcctggttctcaaggggctcacagatacatcatcaactcctctgtaacagaggctacatttgagtgagcagtgaagcccatttgttaagtctgggcttagctatcatactgcttggattcaaatcctgacttcacttctttctggccacatgactttgatgaatttttctagtcctcatctgtacattataggcaataagggtggcagtacaagtagctaatcttcgttgtacccttactaggttctaggccctgagctctttcatgtggattattacctcctttaatcctaacccttgagaatatgtttattgtccccatcttctatataagcaacttaggtttaagagggttaaattatttacaagcaaagtggttggtggggatgaggatgcctacctgctgtgtgtgacaagccccgggcctgtccaactctatctcctggggcagcacccacctggcccttggctctgagctccaggggtcaacaatgacatgaagtacagcaatccaatgcaaaccacaaaacccaaggtccagagtgtataaattaaacacgtaccccctgcctgagagaataacctccccgtgattactgcactgtgaacaatgttggccttcagaagggtttcctcccttcctatcctgttcacactcacacaggattattgtctgttgggcctgtggcaaacccataagaagaacccactcctccagagtgctggccgtggttttagatccaggctgctggtgcatgccacctgcctaggtacccagttgcaggatttactgtgccaggtgtgtcccaaaaccaccctgagatgctaacactgacagatgtgtttcatggaaaaatatataggctgctacacatgggcaaggagagagggaacagagaggagtagggggaaaggggggaaggagggaaggaagaagaggaagggaggacaggggagaaaagaggagggaaaggaaggaaggggagaagaggaagggaggagagagagagaagggcagaagcagatcagaaaggagaggactgcaaaagagtctgccccatccctgggcctttaaaagtaggaagcagtgagctgctgtatggtattaaaaatttagtttcagaacagatattttccctgtggtcaaaggagggaagtaaacttacagacacggtctcggtcctgtaggggttatgatggaggcagaaggaagcggagacagtgttgaaggaaaaagtccaagttccacccagcagggccaaacccctctcctctcttcctgcagaaacaattcctccatggtcacccctctacacaggaaggtgccccagcatccactggacaagtgccacacaagtgtgggctgctggtctaattgtttgttaccaagggaagtacagaactgagaggatgggattggaaacttttattgcaatttaatgctattgagatagctgtgatcgtgggacttactggttgtggcacaaaccagctagggtggtgttgaacttgaacttggagggtgagttgcatgtggcctgagctatgtgttgttgctcatgcacagacacaccatataccaggctgcaatagtttgagcagtactgttgtagaggttatgcaaatacctctatggtcactaagtggctgcgcctctctgagcctcagtttccctatttgtacactggtgataaattacctatgtccaagggattcttgagacattaaatgtggatgatgcacatcaagtgttcagcacagtagctggcacagagcttgcacttaattaaagtcagctcttgtcacttggtcatggcgaatacagccttcaaattggcttggagcagtgtctcagcacgacagatgtctgaagaaatgagcccagtctttcaggcttgacccagagcaagccagggatccccaagtacaagacagaggggctggtcagcagccaggggatgaagatggcaaagctcacccccttggctgggaacaagcaaatcgatggtgaaggaaagcctcaggtcctcaagcgctctaaaagccaataataaaatttaaaaatcaatgaggaagctgacggcaagccgatgacggggccagaggccaggaatgatgtgtctccaagtgaggagcaggcagacagcccaggcggcagggcttccaaccagaaccccagacccagagccccgagcatcctggcgcagacgcctgggatttggcagagatcctgcatccctggacggcgcctccccacggatgcgggaagcacaagtgggaaatgaggctgtccaaggattaagacccagacccccagtgccgtactgttctattcttcctgtctttggaggagtgcagccaaagcctgggaaatcatattttacaacattgatcccagctgcactttttttttttttttaattggacaggcaatgtggtctggcacagagagattcaaagtatttctcagctgaggggttatatagattcatttatctgtgcaaacatttcttgagccccgtcaatctatcagggactatgatgaaataggacagtctagaaataaggttctaaccatgagttcgtgactggcaacggagacagtggatgaataaacacttgccatccagtgtggcaggtataatagctgctttagtgagcccccacagagggtgtgggcaactctatccggggcagaggtgggtggagacactgctgaagacagcccggtccttgcctgttcacactcgttctcgggacacggtgggcagtgggctcacggtggctgctcacggcagaagagggaagtgggctcattggactatttcaggaattttagtagtaagtgtgggaataaaaccttaaatgggccatgaaagctgaaggaggagaaaagggagatgcttaggatataggagaaaggaagagagaaagagggagagagaaggggaaagtccttagtcccagttttgtagttctgttcccttggctgtatttggcttctgtttttgtgaatttccgtaagtttctaccaggattcctgagaataagcaaccttgactagaagtagtgggagtggctctctgatcctaacaacccaagcagtcctcacaaaactctaggagtgatcctggaaggcaacattaactcacacaaatccaatgtagtctctcaccaaaacaaaacaaagagaaaagagagaaataacaatttgagtattgtggctgatgtcatccttctgcttgagtataaaccttggtgtgagtgtgtacctggagaagtgaccctgcctgtccctcggtccatgaacttctcttggtttggggacaggagaaagagagaaaaggagagaataattagcaaaagcacaaatgagcatcccccattttcatttctattgccaaagcgaatcatttatttcaactgaggcacttggtaaattaaagccacatgtaagtttattgtgttgatttcatgctgtaactcttgagagcaaaagcacccagtctcagccttgggtttgaagaactgaagccggtaattaactcataaggtcttaaactaacaaatgacttcctttacaagtgaagtgtcaatcgaatcttgattcatgaagtcagtaattggccttcttggcttcacatttagtccagagccatcggataaataaatacattacaacatgtccctgaattgcctctttttcaaagataaatgtcagacgaacagatcaaaacccaaacccaatatactagacctggactgtgggagaatgggtagaaagacaagaacaacattcagagatcagaaagatcttagggtttctgaatgacttatctactggaattaaaaacgttttctctgagctgttcagggagaggggacagtcaggtgcccaggtgcatcattttgttcattttaaatgtgctaagtggagccgtgagaacggttgccttgtgggccaggcagagttcacaatttaacagctggcaaggtgtgagcccagtgctaatgcacacaatattttcccccatctaagtgcacagattgagcccctgcagaggcttctctggaacagatcgacattcaggctctgacctaggcttggcaggtttcaagaaaggactatagaagactctgcccccagcaagtaaaaactgagcagccctcagcaacttacacatttatctcacattgcaagatttaagtctgccatagcttagatgtttgtttccagaaacctcatgttgaaatttgatccccagtgttggaggtggggcctaatgggaaatgtttggttctgggggggcggatcccttacaaagggctcagtgctatcctcccaacagtaagtgaattttcgtcttatttaacaactacgagagctggttgttcaaaagagcctgtactgcagtaggactatttaaaaaaaaaaaaagtgaaagagagagagagagagagtccggtacctccctgctagatctctccccatgtgatctctgcgcctgctggttcccctttgccttctgccatgagtggaagcagcctgaggcccccaccagaagctgagcagatatcagcaccatgttgcagaatcatgaaccagataaacctcttttctttaaaaattacccaatttcaggtatttctttataacaacacaaacagaccaagacaaagtctaaccctgaatcaagctcatttgtgaaattaacagtaaacattcattttcctgctgaaaggatccaaaacatgtcacttcaaatgatgccgctttggcataaggatgtttttgaggtgaaggcaactgagaatcaagatatgcaggaagagagctcatactttctgatttcaaaatttaccacaaagctacaataaccaagaggggttggtactaacataaggtcagacacagaagccaatggaataaaagagagtacagaaataaatccttacatttaaggtttaatttgagacagggtctcactctgtcgcccaggctggagtaaagtatcatgacttcagctcactgcagcctcaacctcctgggctcaagcaatcctcctacctcagcttcccaagtagctggaactactggcacatgccaccatgcttagccaatttttttttttttttgtatttttgtagagatgtggttttgccatgttgcccaggttggtttcggactcctgggctcaagcaatccaccggcctcggcctcccaaagtgctaggattacaggtgtgagctgccacacctggcccagattgattttttgacattcttgccaagacaattaaatggagaaagaatcattatttttccacaaatagtgcaaaagaatgaagttgcaccctttcattacatcatctacaaaaattaactgcaaatggatcatagacctaaatgtaaaagagaaaaaaaactcttagaagaaaatataaaagaaaaatcttcatgaccttagattaggcagaggcttcttagatataacaccaaaagcataagttacaaaagaaaaaaaatagattggactttatcaaaattaaaaattcttctgcttcaaaggataccatcaagaaagcaaaaagacaacccacaaaaactgaagaaaatatttgaaaatcgtacttaataagggacttatatccagaatatgtaaacatctcttataataaaaaagacgactcacaatttaaaagtggacaaaatatacaaagaaatatacacagggccaagaagcacatgaaaggatgcgcaacatcattagccattagggaaatgcaaatcgaaaccacagtgagatttcacatcacatcccctcgggtgatcatcaacaaaaagacagcaaataagtgccagtgaggatgtgaagtatggtatggtgaaaagaaataaggatggtacctgagtaacatctcaagaagggtgttaaactatatgtagagtatggtttcacatatatacatataaaataacccatctatacatatgtggatgtgcatacatttggatgtaaatacctaaaaggaggcttgggaaggtgtgcccagagctctgaagtcatttattctgggaggaaggggaaatcagagcaccaggaaaggggtttttggtcatttttatttacttccacattctttcactgtactcaacaagcatgttatctcatattaccagtgtaataaagttttggaggagaaaaaaaaacaaactcccaataagcgatgtacaaggaatcgtctgcaggtggcatggatatttggagaagggaatcatcatcatggtctgacaagatgagggcagaaagttggtggaaaagttatttgatttggagagggaaggttggatggcacttggccgggcaaggagttgaggatgtggaaatttagataggaatggagtagcattgtgatgagtccagtaccgcccaggtctcagtgttccacagcagtggtcaccaacctttttgacaccacggactggttttgtagaagacaatttttccatggaccagcaggggtgggagatggttttgtgatgattctagtgcattacatttattgtgcactttattcctatgattattacattgtaatatataatgaattaattatacaactcaccataatgtagaatgagtgggagccttgaacttgttttcctgcaactaggcagtcccatgtgggggtgatgggagacagtgacagatcatcaggcattagattctcataaggagcatgcaacctagacccctcacatgctctgttcacaatagggtaggattttctatgagaatctaaagcttcagctgatctgacaggaggcagagctcaggtggtaatgtgagtgatggggaacagctgtaaatacagacgaagcttcgctggatcacttgctactcacttccggctgtgcggcccagttctgaacaggccatggactggtatctgtctgtggcccaggggttgggaacccctgttctaaagtgcattcattaatcagcttatactcattattgctctgttctcatgaggaaaccgcaggcggatctgtcagtatcagataagattttacagaagaaaaaaaggcaaggaagacaggaagggcaggagagagggagggaggaagggaggaagggagaaagggaagaaaggagaaggaaaaaaggcaggcaggaaggaagaccaaaaaccaaaaggtgaaactccagtgtcattttaatgaccagacctgttaaacaataatgaaaagtgttgaaatttctagaattctctggattttatacagttcagttctttcctctgagagaagaaaactctcatagcaaccaaaatagtatcattttccttgctaattctgtttttggcatcaccgtctagttggacttcataattgggtaaaagtatctttcagaacagtctgcagcctggagttgtggcttccttcacaaagaagtgttgcataaagacagaagaacacgtctgacctcacctcctgggtcatctttagtttgatctttgggatgattcaggctcaagtttctagttagttttggccttgggcagctcataaagagcccggctttgctttcaaagtatccagatgcagaagaattaaccaagtctgttgtgcatatgcactaggtgcaggtataacctaagtcataagaatacccatccatggtttctggaaactttttgtcacttcactcatactcctggggtggaagtgaaataaatgacaagagagagtccttggaggaacaggattgagattactccctgaaaccctcgatttcaaagcagggacaacattagtaaagaagagtcaggcccatggtaccaaaacattaaaaaatatatatatatgtatgtatgtatgtatttcaatagcttttgggggtacaaatggtttttggttacagggatgaactgtatagtggtgaagtatgaaggtgagtagtgtacattgcacctaatacgtagttttttttttttccttcaccctcgtctcgccctcctcattctgagtctctaaagtcaatactctgtatgcctttgcacagccatagcttagctcccatgtataaaggaagagcacatggtattaagacattatttaaaaacttggtctgggccaagtaccatggctcctgcctgtaatcccagcactctgggaggccaggtgggaggatcctttgagtccaggagttggaggctgcagtgggctatgatcatgccactgctttccagcctgggtgaccctgagtgataccctgtctgtaaaaatgaaaacgaaagaaacaaagcaacaacaaaataacttggtctgccgctaaatatggacttgctggagtcacaatcttgtttaaactaattggtggggtcccaaactccatcaagctaaaggaattcagacattcagacagcgtgagtatccatccctttgaattaaaagtgaaatctttgctttgcaacaaacaaacaaacaaaactcaatcaaacctatgttgtaagtagtttcagctgtggggtatgcttttatcagaagcagagaaaaattagtttttaaaatgcaagcattttgtaaatgagactgagagatgttttggttttctttctgagacgaaagcatttctaaatagttgtccttgaacctggattacatttcttcttccttgaaacccaacagttgacattgataaagacaatataaacaggttgcaatctactgcaaggacatcactcccaaccttgaatatattttaagggcctttgatcaaaggaggagaaagtaagcaaacaattcaatgtaatacccactacttggtttatcccagtgggcagccacagtgagcaacaatctgataccactctctaacacacctgtactacctcagtggctgacaagttcaaattaagtcaatatgattgcagaaaattaatttttccaattcttggctgttgtcactttccccttccatgaaaattaatgcaaaaaattcctttcaagttattaatatgaaagaatagcccaacttttatgactgaaaggcttaccatcatatctttaagaataatgatacaacttaaatattgggagttgtgcgggaaccacttcccttcataaatgtggcctgaacaagatggttaaaacaccagttaatctttatattcaaggcaaatgaaaggaaaagacttgcagataaattattttctctatagccagaagcaaagtgtgtacaataaagcacatactcctcaaataacaagaataaatctatttcatttttccccttgcataccatgcttattgaactagggccttgtttgacaagctctctgttctgatataaacagtgcaaagatgaacacagttcttcttgctcatgattaatatatttggggaatcaagtctgaatcacttaggtaaatcatttcagtatattcatggtaaggacaaattttcaccctcttatctgaagtacagtctttcacttctattaccctaaataactacagggacttttacctcaaagttattcctaacaagagaaaattttccagtgatgtattatctttttaatccctaaaggtagaagatagaaaatatacatctgggatgtgaacaggacatagaaaatctactgaccaaccacgaaaaatgttacaggtctgtggttccaagaagctgagggaattgggggcatgcatgcctgtttagatgagagaagcaggccaactgataaataaaacctatgtttggaatacagctgagttcccttttataatatgtggggtcagggataggtttttcatttttttaatttttatttttttattttggaaacagggtcttgctctgttgcccaggctagagtagagtggcatgatcatagctcactgcagcctcctgggctcaagtgatcctcccacctcacccctctggtagctgggactacagccacacaccacccatgcttggctaattttttataaggaaatggtctcactatgttgcccaggctggacttgaactcctggcttcaagggatcctcctgccttggcctaccaaagtgctgagatatgggtatgagccattgtgcctggcctaggcttaactttagatatttactagttataaagggagaatttgctaaacaatcagtataaacaagaaaccagaatatttacctgtatcaaagaacaaggtggaacctgagcctcttgagccagcaacatgcagaattcaaaagactgagcttctacatgggagccacggcttaggaagagtgaacatttgcttagtactttacggttgcaaagagcttcccgctaaggcatcttgtttgattcagctcccatgtcaaccttgggagaaaagatttttttttaaaaaagaactaggctgggaatggtggctcatggctgcaatttcagcactttaagaggctgaggcaggaggatcacttatggccaggagttcgagaccagcctgggcaacatattgaaaccctgcctctaccaaaaattaaaaaattaactggtacgcacctgtagtcccagctactcaggggggctgaggtgggaggatcacttgagcctgggaggttgaggctgcagttagccgtgatcataccactgtactctagcctgggcgacagagcaagaccctgtctcaaaaaataaaataaaagaactatattcattatacagatgaagaaacatagccatacataacagacctaagacaggaacccagatctttgaaacctaaatccactgtacaaacttttgtcccgaaatagctccacagcaggtcagccatcctctctgagtgtgtctccatttgtaatgtgggaataacagcatcttacaacagggttgtcatggagataggatgagataacttatctgatgggtatcagttaagatgctttaggctataaagtaaaagaaaaatccagtttagcatggttttaaaataaagcaatttattggatcctgggcctgaagagtttacagtgaaggagggggaatttcagaattgggttggtatagaggtagctggtgagccaggatggggcttcatttctcaggcagtctcctgtctccgccttgctctgtgtattggccttgtgcccgggctggctgtcttcatggcagagagatgactgttgcagctccttggctgcatgacttctcctctacagcacagcaaagaggacggcttcctttctcccaaccatctagccgagtcctgagctctgctgtattgcatgaacagccccactgcaacaagtaactggcatggaacatggcaaggagtgtggctgctaccccaggggatagcagaggaatagttgctgtacaggcagccaggatgacggccatggtgtgtgaaacacacagtacggtcatgaagcacaccagcccttcgaaagcactccaggtgtcccagcatttgatgctatatttctgtcatcctttttttaaatatatgaagcagattctttggtcggcagcacttataagccttattaaatgttaatgttaattatcttaccaggtaacatttactgagaacttactgtgtgcctggcactgcattaagcattttgttaattctcagttaatcctcactctggccattgtggtaggaagtataattgttcctatttttacagatgaggaagccgaggcatagaaaggccaagaaattgcccaaagtcatatagagagtcaattgaggaattgacactagtcttgcaatctgatttagagatcgcttttttttttttttttttggagacaggaaatctcattctgtcacccaggctggagtgcatggcatgatcttggctcactgcagtctccacctaccaggttcaagtgattctcctacctcagcctcccaagtagctggaactacaggcatgtgccatcacacctggctaattttttgtatttttagtagagacagggttttaccatattggccaggctggtcttgaactcctgacctcaagtgatctacctgcctctgcctgccaaagtgctgggattacaggcatgagccaccatgcccagtctagatcccattcttaaatcacaatctggtccatgtttttttataaagcagaacagcatttcacaagagatcctgtaacttatacttttcactttctccactggtcagtttagaacatcattccattacccacgtcatatcattagtgttgtacttagaaactgtctattccagtgggatgttaatcctgagaattacatcatcaaagaaaaaaaatgatagtcccgtttgaggacatcagtgtggaaaacacaatctacctctctaccagtagatgccaagagggaaggttccacacaacctctccccctcttctcccacatcatctcaccactgtccccatatcagctgcattcacccccttgatgttctgtgaccaggaaaaatgttttgccaccttgcatttacagttcctcctttccttaaggtctctgctcaaaaatactcttatgagagaagaaagcctcatctctcctatgtatagcaccgccttctatctcctgtgctgtgttactatgattacttttttgtacaggatttagctccatttgtcattagacctatcactgttgattgtctctttgtattccctcactagaaggcaaatactttcacagagggactgaagccttttgttcactggtaggtctccagcactagaatagtgcccggcatatgcttggtgctaatgtagatcaaacaaataaatgaatactttatcacatttcttagagatttataatatccagcataccaaaagctcaaagaattcctgctcatttaaaatgagtgttgcccaaatctgaccatttaacccttttggtgaggaaaaaaaagaaaaaaaaaaccctactaacgttacaaataattaaggatcactggaaatcactttgggaaactctgaactgccatcctcccattttacaagtgaggaacccatgcatctgaggagtccggggtgcttccaggctacgcagggaaccagtggccctcaggacagagcccagctctccactccctgttctggatacattggctccatcccctccccaagctgcactgattgaagatcagtggggctaattatactggacacacaaatcaataaacccatcagtgagtattaatgggccatctattctgtgcccagccattggcacctgcatcatgacaccgtgaaagctctgatgacacttttacgggagatacaatttttcaagagctgctgattgattccttgaagacaggggttcatggatagatacattttcctggacaggtttggcttcattgatccttgcgacttgctcatcccgttcttgccattctattttttatattttattcccattttcacctccttggtacaattattgaccgaatgggacaagaccttctttgtgacctatagaaaatgctctacagcatatatggggaaaaaaatgaagttgctgtgtggagagagctggagagaatgccagggaccatgggcccttgcagctcagtccctggatttttcttgaaaggtagcacctccccaacattactttctcgcctcccactctaccacaattggactttgtcccctctcctccaaagcagctgctcctgtcaaaagcacaatgtcttcctccctgcaaaagcacttctcagactttatcttacttggccatccagcagctccagacacaactggccacttcctggtctttggaatgcttccctttcttggcttccggaatacctcactgtcgttgatttcttcttacctcactgacctttctccagttcccagtagtggctcctacccctctatattctcatctctaaatttgggagtgcttagggcttggtccagacactctccttttcccagtctaggtgctttcccaggaagactgatgggatcaatagctctaaatatcatcttatcagctgttgacttccgaatctgtatttccagctttgttctcactcccaccacacacacctctccaaaatcgtgtaaccaaatgactacttgccttttttgttatgttcccttgaacaattacttaatctcctcagtttcctaaatggaaaaaggtgtaagtactaacctcatagggtcgttgtgaggattaaatgacttaatctatggaaagtgcctaaaccagtaagcacgaagcaagggacactaactgcagttactccacctctccactgaaatagttaatggatatacccaaacacaattttggatttccccaccctgcaccccactccaacctccagggtcttagtgtcttgtcactcgcatgtgggacccgtaataactccaacagggatgacacaaggttcaagaggccgaaggagagacctggaggcagccaatgagacctagggttttaccagtgggaaagctacgtacagcgatggcccagcaacaacagtcaagctgggcaggaaaactgcaactgcttaagggtgcagttcacatagcatcctcacttagcatcctccccctaacaacctccacctggcaaccttcatttaacccaaaacaaaggcctccatccactacacggccatgttctacaggacaggctgggagtgcaggtgttccttatagacaaggaatgactctcccggtcggccacgtgcagaactccgaacacacattcaggtgtgtctgccatacagggtcatcctcggggtatgtgtaagttaaattattgctatcagatgtgtctatcagacagtcaccattgtcataacaaccacaaactaaaaatctcaaataattagaaaggttcaagagccatcgcttgtgaagaacatctcagggtgggggtgacagtcagccctgttcacccatcattgcatccagcaagggtcctgtgcctcttcgggctctagtgggatgaggcataaatgctacaactcagtgaacccaaaccccttgttcccccagacccaggaaatgtaaacctcccaccttgcatagtctcccctatttaggtagctcagtcctttgccagccagagcttggattttcctcctctaaaagatttgttttgttaaccaatcctctgggacaagggaaacttgaggttccatgttacaaagacctgcttgtcctcttcagagaaggcgagggagaaaaagtttgttcttctgggctaagcctaagggaaaataagctggtgaatttctcactttattttcagatattcttgccaagaaggaaggcccaactattaaggggtcaggagggaagcagggtttaggaggattgatcaggaagggtttttggagggcttggacattcttgccctctctgtcgacaaaggaagtcgagatcgtgtgaccaggacagtgagctgtgagcacattctctgtctgccaagacatagacacctcccaagccttctctaggagggcagagaggagtctccaagcctgttagatccaccagttaaataaataggacacagttcctccacaaggacccctgaccggtgaggttcaagtgtctctggctggactggatgtggttacagctgagttgacttgtggcccgtgccctgcacgccccgtatcagcctcaggtggaactctgcaggtgtccactgcaggaccactgcaggagtttgtgctcggtccacccaccccagtctcccgctctgctttctagcaccttcttgtggccctgaacctccaagagtcacctgtcccaacacctttgcacaacctgttctttcagactgtgatgcaaccctggaagttcctgaatatactaacccaccttcctatgtgtattcagccatttattggagaccaccaatgtggcggctgctgtgctaagcattggtggaaagtcatttctgcacacacatttgatgccctcaagatgctcaccatctggagcccgggccttcaaccttagctgcacattgcaatcacctggaatcatcagggagaacttctgatacctgagtctcacccctagagagtgatttcattggtctgacatgtggccaggatatggggagtttaaaaagcttccagctgattctagtgggaagagctgagaaccactgatgcagaggtcagatacgtgagcagttagaataggaggcgaaagtgctgagaggtgtcccaggggacactgcagagggtcctccccgagcccaggtggaggaaggaggtcagggaggcttcctaggggaggtgaccgctgggctgtttcaaaggatgagtagaagtgtattaagtaacccaggatggggttattgttggggagagagaatgaactgtagaaggaggaaggaaaaatgtaggtagttaggtaggtaggtaggtgggtggaaagtgaattggacactgtgcaatatgagagttcaaaggttctgagtggtaagataaggagctggagaggtcagtaggggcaaaagcatgtagagccttgtatgactttaacatgaaggcaatagggagctgtcatgccaaacccctatcaactccagtgggagtggcaccatgttcatgagatgaaagaaaagacccagacctggggttttattaggggcttaacatccaggggagagagtccagtggtagcagcctggacaggggagctgcaactgcttgcaaaaggcatgcaagtttatatagcatttttacttggcaccctttccctaacacttaagccaaaacaaagggcctcgatcccctgtacaccctgtgttccacaaaaaggaataggggtttagatgttcctcatagagaaggaacgaatctctgggttggccactcttgggttccctagctcacaacacacactcaggtgactcagccataaagggtcattctcatggtatgcttgttattgttctcaggtgcatttaccctaagggagccattgagggattgtaaggtgcggtggtagagcgggatgagatatggattttggagccatctcaggcagctgtgtagaggatggattgcctgggtaggaggggagggagtgatgggaatctgttaacattaatagatcctctagcacttgtatccctctacaaatacctcataataaatggataccattttaccccggtgtatggtaggcagtcacagtcacacctgacagcaatagcaatcactgcctcagaatgaccctttatggcagactcacctgcatgtgtgttcagagttcttagcatggccaacctggagatccgttcctcatctatgaggaacatctgagcccccggcctgtccagcagaacacgggctgtgcaggggattgaggccctttgttttgggttaaatgaaatttgcgaggtggaggtgttaggtggagggtgctaagtgagggtgctatataaactgcctgctttttgcaagcagttgcagttttcctgctcagcccaccaccacggaccctccctgtaaggtttcccctgatgaaaccccagatcttgtttatgggctctgggtctctttcttggcctctggagcctggtgccatccctgttggagttagtaggggtctgacatgacaccaaggcatagcctgggccatatacagaggtcagccatttatatgcatcatccctatgaggttgtcatcatccccatttaatggatggacaatccaagttaaagaacttgcctgagactcacagggctagtgaggtgactgagtggaccccaactcagcaaagccagcactcctaaactttaagcatttgtcccttcccactgcagactgcatagtgtcctaagcgctgctagcatcactcagggctcagctaatgtttgcattttaatgagggccttctcttaccttaaagcaatgacttttcctaattgatccagatgtctgatgccccagtggcacaatctaaggatataaaaccgacttgcccccagtaaatcattctgacttgcccagaaaattcaaaggcttttaggcacatgtgttcatcagttctaaactcaaggcagatcaccaggacaagatggaaggacttgagctaggttaccacatctcctggtcctaaatcacaagggagagcagcttattagagatgcagatgctccaggcctgttgaattaggacctctgggtctggcatctgggaatccacaccgcataagcgccccctaataacagcttagagcagacagctgcttcagctcctgtgtcttcaggagtgggggggtctcctgaaataattgttccttccccttccttctgcagatcatcttaaaggatcccgtgtgcacatgatttttgaagcccaacatctctcttaaccacctgcaaatctgcaggtcttggtacacagcctgtttcccatgactgctcctgtccagcagatcaagtgacacgtgcagtcccaggtagaagcaatgggggagtgcaaagcagatgatcaagaagtgaggggtggggcgaaggtaatttgtagctgacaggtaggtgagcctttctcctttagccaaaatggactacagcttgagtctggcctaatttccttactcaagtgcttaagggcaaaaatctgtgtctgcagggctcaaggttgctctcgcgtggtaattgcatggtgggatgccctaatgaaggggtgatcagcaaagcctctgaggattgcttaggttttagcaacctggtcgcagaaggatttgctttgaaaactagaataagttgcctgcctcagcagaaaagacttttatgtagcaaagctaacaaggaaaacattgtctgcaaccgacccaccaaatacccagccatatgcccctggtgacttgcctttaagaaatgagatgctttgatccccagccaattcctgctgctctaaacttgaatggagttttgctggccaagctcttcattcaggattgtaatttagtacagtgaggatgaaacagttccttagaactcactgagatactaaagtctccagaataagggcagaggagtggcctttgtcctagagataggcaatgacctgctcagtcctgtccacttacgtgcagatctgcctagacatctcacagtgccaacctgttgcctctccaactggccacagtccacaacttccttctttctgggaaaggcccaaggagtggttaatggatctttttcatcttaaacctgaaaaagcgaatcaaatgttcaaagaccaaaacgtgtaattacaagtttgatctaaggtaagactcaagcaagagaaacgactccctggaataagtattgggagagatttccttgcagagcattaggggagggcaggttcccatgtttggggtggaataatgactttttgttatttttaaggatcttaaaatattttattaacctcatagtgtcaggcctctgtgcccaagccaagccatcgcatcccctgtgacttgcatgtatacgcccagatggcctgaagtaactgaagaatcacaaaagaagtgaatatgccctgccccgccttaactgatgacattccaccacaaaagaagtgtaaatggccggtccttgccttaactgatgatattccaccacaaaagaagtgaaaatggccagtccttgctttaagtgatgacattaccttgtgaaagtccttttcctggctcatcctggctcaaaagctcccccactgagcaccttgcgacccccactctgcccgccagagaacaactcccctttgactgtcattttcctttatctacccaaatcctataaaacggccccacccttatctcccttcgctgactcccttttcggactcagcccgcctgcacccaggtgattaaaagcttttattgctcacacaaagcctgtttggtggtctcttcacacagacgcgcatgaaacatagtgcctgacctctgtcaccaagtgagtagtctgtgttttgattcccaagcctaattcaaacaggtaaacttactaaaattacatttggtcatcactacagtgttttctctaaccacttcccaaattcgccctttttattagtcatacagtaacctgtataatacatagcttatgacttgtctttttggtcctatgagtggccatacctgtccccgaggaaggaagatacatagttaggtggaatgtttggttcagtgtccacctgattgttcagcctatggatagatcgaggcctaagtgttcaagccacttcctaaatggtctagggcagttcccatggcaacaccacctcattgacataaccgggttctcatttaccagcctacaatccaggtgagctttcctgccaccaggtggagactgactcaaatctataaactgggatattctctgcatatccaagaggcagatcatttgagagggaaaaagcacacaaagataggctagtgattcccaaacatgactgctcagaggtaccaaaggggcacttgaaatatacagatggctgcctgtagatgacattaaaattattgtcttgctgaatgtgatcattgcatttgtgatgcagagtgatttgctttagaatattcaggcacgaataaaaagagggttagtccccatggaaaataatgtcatatgcaaattaggtaattagagagcatttgctgtttctaaagatgtgggcagggcttagggaaatcaaaaaagggtgaaataagcaacactagggaaaccacaattcttagacctgaagtgtcaaggggcgggaatcgttaagacgctatggacagatgcaggctgccagggaaggctggctgccttcagctgtgccctggggtggagggacatagccattgccaacgcccaaggaagggggagccagagaaatgcatggcccaaccttgctctcctcctaatttccagtccctgctggagacaaaaggcaagggaacctggtgaaaacagttgttgagttcatccttcctgaggctcagagcagggtatagtggacctgctctgggggtggcgaatgaagaacagcctgcataggatagatcaaacaaatacaacaaagccttggtgactattgaagctggccaacgtatacttaacggggccattgcctttcttagtattgagtctatttgtactttttcatcattaagttaaaagcaatgcagattcccaggcctgactccagaactagccaatctgaatctttatgacatggagcccaagaatctgggttttttaaaaaagatcctcaggttttagcctctcatctaatccaagttttttttttaacagcaaactctgtaaaaagaaaaattgagtccctgtagaagtgacttgttcgaaaatcacagagtcagcggtagagattggacagaatggaagaaaccagtcccagaagagttcttagtaacaacgtcagaggcagcaagaatactatggctattatagccacgttctgagcgctcactgtaaagagtttaaaacaaggcccagtgcataaaactactcaacaaatcatagctgttattcctacaagttgttttaagtctggacaaatttctgaggtcgctatttccttttttcttccgtttcaaacagatgaagaaactgaaatctagataagctaagccccttcctgggtgtcactctagttactaggttttggacacaagcctgtacaattccaaagcccgagctgttaatgtggtttgtaggagaacacactctcttctgaagtctagactatgttggtagcaccatcttcactttgcttctccaagtccctctttgggcttgtgggtctgtagtattattgcatcacgcatcacttttcctacacaattggagcagcagtgagacttttctaagttcctcgagggcagggactgagccttcatagagctagccagcctcagcatcctgcagtgccttgcacccagtaaacacctaagggacgtttttttgttgactaaatgaaacaaagtaaagtcaacccttaaacatgcacagtagggccaggcataaaggctaatgcctgtaatcccagcactctggggagctgaggtgggagcattgcttgaggccaggagtttgaaaccaacctgggcagcagcatagcaagatcccatatctccaaaaaataaaagtataattaaaaaagaatagcaatccacccatttgccatgcttccattttgtaccttggtaatcaaagctaatagatagtcaaagtccttgtcaggcctggtaaattatcaaagttcttgttaggcctcgaaacaattttgaaatcctcaactgaggatgtcattcagccacaatttatgagttggactgggcttgtgagataaattttatcgtgctgcctctttgtagcaggctttttaaaagttgttacccttcatccaagaatgttattgtttgttgaaaataagatcacagatctcagattcagaagaacctaatccaggccctatgtgtaaatgttggctgagtgcctttgaacaaatttcctaccttctctgagtttgaagcccttggctgtagattgggaatgccaacatccattcatcatggttcttacaagaattaaaggagaaagcatttgcaacaatacctgatacaatccgaagcatcatataaatatatgtttgttatcaaaaacaataatgccactggccttatgggagtagatgctagttattctctgtgatactaactttataaatgtagtggtggcatcctgggtagccctaagtctttcttattaacctcttgttgatttatcatccataaaggtaggaaaatgttctctgagcctatttattttatactttctatgatccatttgccccgtccgggagggaggtggggggatcagccccccgcccggccagccgcccggtccgggaggtgaggggcgcctctgcccggccgcacctactgggaagtgaggagcccctctgcccggccaccaccccgtctgggaggtgtacccaacagctcattgagaacaggccatgatgacaatggcgtttttgtggaatagaaaggggggaaaggcggggaaaggattgagaaatcggatggttgccatgtctgtgtagaaagaggtagacacgggagacttttcattttgttctgtactaagaaaaattcttctgccttgtgatcctgttgatcggtgaccctacccgcaaccctgtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggccgcagggtcctctgcataggaaaaccagagacctttgttcacttgtttatctgctgaccctccctccactattgtcctatgaccctgccaaatccccctctgtgagaaacacccaagaatgattaaaaaaaaaaaaaaaaaaaaaaagaaatatgaggtccataagtttactgtcttttgcatgaagtagattctccttttatctgctaaaacaatcccctagttagagcaaattctcctgctgtttcagaacttcttgcttatatatggtaactacaatcctttatctaaaactcttggccaggctgggcacagtggctcacacctgtaatcccagcactttgggaggctgggacgggcggatcacctgaggtcaggggttcgagaccaggctggccaacatggtgaaaccttctctctactaaaaatacaaaaatgagccgggtgtggtggcgggcacctgtagtcccagcttctcagtaggctgaggcaggagaattgcttgaacccgggaggcggaggttgcagcgagccgagatttcgccactgcactctagcccgggcaacagagtgagagttcatctcaaaaaacaaacaaacaaacaaacaaacaaacaaaaacactcgggccagatgtgttatgaaatttaggattttttgaatgttagaaaggcaatactctatgtatgccatttattatttaacaccgatcattgaactcattaatccttctacacaggaaaacattaatattcacattaagtggactaaatagattaagttacattatgccagacagagtcgggatgaatgagtttagtttaggctcaggtttggtcatcaaatgaatcaccaaaaaaaaaaaaaaatttgttttcagagctttctggatttcagaatttcagataagggaatgtaggtctcggcttctgtatttcacagggaggagtagtccgagtaggtgtctgccaacaaggataaaattagccaggatcccaacaggcagaagttcaagtgcacaaaaagcaacctcctcttttcagtaactatgcattccttcctcctctgcattcctgcatgctgctgccagtgctgatgtgctagaacatagcttgcatcatgtcactccctgactcaacacccttccatggctcgctaacattcagccccttagcctgacacacaagacctttagtgatctaacctctgactgactgactttaagtctcatctcttggtcttcctccagaaatcacctgtaattggcagatcctcgacactggacacttgcagcgcttgggccagctctgcctggcatgttcttgtcctccccttcatcttgctgaaattgcattcaactaccaacaggtggctctgaggttaaccctttgctgacacccacacttccctgcacacagctgggcatatggttctgtgagctctaatccagaaggcagctgctctcccccaaaccaggctccaccagcgagcggacgctataactctgtatcaccagtaccctgcaccatgcacattgtaggcactcaaaacacacagagatgatcagaccacctgctaaagggtattatctcctacttaatactccttagcagcttccagtgcacttagaataaagccccacatcttaacaaggcccgggttcatcaggtctctgcctaccttgccctgttttatctctcagtacctcatcttcccatccatggtccagctacattagcctgtttagtttatggggagacctacgtccctccccctttcacatggttagcccctcctcatcctatatctttcaacataggcatcactccctgggagaatggcgttcctttgtttcatgtgatagagggatccgactccccacacaatatcctttctgccttttgtccttggttttagaatcatgattttattttagggtgacatgagcccagttaaagtctattatttccagcctctcttgcagataggtggccatgtaacagggttctgatgaggacatgtaagtggaatttgattggttaatactcacaggaaagctctttaaaggggtatagcgttttgttcttcagccttcctggaatatgaacctgatgcctggagctcctgtggccatctagcaccatgagatatgctaaaaattatgggccagaggaccgaaggggcctgagttcctgatgactgtagagtcgctgtaccagccatctctgaattttatttatgagagagaaaaactgctaatatttaaaccactgtgattcttaaaaatggaaaaaaatcctgcaaatctaatcctaccattatgttattatctgaatttgtaattaaacatttatttgaaggattatttggttactgtctctctcccagtagacagattgttaatagcctggaggataggcgcaatatggatttttgcttacactgcgacatggccagtgtgtagtagctactgaccaatgaaacaaatgccatcttattttatatcagctctggaagcttgccaccaggtccttctgtttagatctccaagcttgcatgtattagtctgttctcatgctgctaataaagccatacctgagtctgggtaatttctaaaggaaagagatttaattgactcacagttccacatggctggggaggcctcacaatcatagcggaaagcaaaggggaagcaggacgtgtcttacatggcagcaggcaaaagagtttgtgtaggggaactctcatgtataaaaccatcagatcttgtgaaacttattcacgaccacgggaacagcatgaaggaaccacccggtgattcaattatcttcacctggccccacccttgacctgtggggagtattacaattcaaggtgagatttgggagaggatagagccaaactatatcattgcagtttgcactgcatatagaaatgatgactctcagacacttgaggtaagaaaaagaattcctacaaataaagattcttccgtgcatctctcttctttcccaagtgtctgctgctcaggaaagttccagctggcacagttccatctctcttttatcatgctcctcttgtgccattattctctcgttctttctgatctaacgagtctgaactgcttatcctgtaacgtaccatgcttttccctttctcccggtctgtgcatgtgctgttccttcctggaactcattttacctctctagtgcctagtcatccacaggtctccgtttgatggcgcctcctccaggaagcctttccagtccctgtaagcccaggcccttccctacagtgctcccgggcctccccactctccattacagcatttacaacactgtattatgtcctctatcctctgtattgtgagttgaattgtattctccaacaagatacgttgaagtcctaacccccgaacctgtaaatgtgatcttacctggaaatagggtctttgtagatgtaatcaagttatgatgaggtcattagggtgggccctgatccgatacaaagtgtgtccttttgagaagaggaaaatctgcatatagacagacacggagggaaaacgccgtgtaaagacggaggcagagattggagtgacgcatctaggaatcaaggcatatcaaggactgctggttcctaccagaaactaggaaaatgcacagagcacattctcctccagagggaatgaacctgccaatgccgtgattttggacttgtagctattagtgtgagagaataaatttctattgttttaagccacccaatttgtggtactgtgttatggcagcccgagtaaatgaatgcaccctataaggctaaaaactgcagggatggcgatgaggctgctcttgtcatgggaagccctgtatccatctcttctcatttctaagcatccgatcttggccatgattatcagcatcactgatggttttgcctgggtaccatgtaggcctttgacctattattgccatctctaggtgacctcatgagagacacttttccactggggcccctgagtgtctttgtcctcccagctgttcctcccacccactccacagcacaagacctaaacctctgactgcatctccccactcctcttggtaagatccatactgttgaaacagcgaccgctaaaccaccaggacaattcctttttcttctagaatcctccttgactcttccagaaacttaaacattggctgactattcctgccaaagccccataaaaccatcagcatgtgctcctggcatctcttcggagccttcttaagagtacacagtattgtggtttgaattgtgtcccccaaaaacctatgttcaagtcccaaccctggtacctgtgaacatgctctaatttggaattagggtctttgcagatgcaatcaacttatgatgaatttataatgaattagggtgagtccttaatccaacatgattggagtcttcatgagaggagcagaggaaccgagacagacacacagatgaggaggcggccatgtgaaaacacggatgcccaggaggaagagaaacacgtgatcacagaggcagctatgggagtcatgcagctacgaaccaagaaacaccaccaattatagcaaccaggagctaggaagagaggaagtggccctgctgaccccttgattttagactcctagtctccagccttgagagagaatacatttctgttcctttaggccactcaatttgtgagactttgttatggcagtcctatgagactgaatatacaaatagaccatggccagacaacatataaagccgacctctgatccacaacctgaagcaaccagcccaggaagccaatctactgcctacagcaactagtccagaaagttagcctcctgtctgtagtaaccagcccaggatgccacacaacaaccgctgtagcaatcagccccaagtggccaggatatcatcagtaactgacagcttccccaacttgtgtccccatgttcaacttaggcccaatcagaggaagccaaagatgcacgctagcccatcacataggattgccccacttctcgttagcccacctcccatgccaacaacctgaatcagggctgaaatcttctccttcttccctttacaaagctttctggctcctctgcctgcttttgcgtctctgtcaaacacacatgatggtggctgactcccttcctgtagcaagctcgggttggtctcatttgggtggaaggcaactaatgagaattgggaaatgaatacacccgcatttttaaataaagtcttagactaacagtgtcctggttccttctcatccacacctttctctgacgtcattttaggcagttttagagaggtgagcttattttgaacgtattttgtgactcattaaatatctcattcaccataatctccccagtctctggctgaatgccaagcagatagcaagtgctcaattaataccttgtttaatggaattgatggttctcttttacctgcctgggtagagatcacctggccagagcatcatacttcacaggggaaagctgttgtacagaacaggcacggcctcatgcttatttaataccctaataaaggagctttcccactagataatgtgatccggagtggacggttaatcacagctggtcaatatttatgaggccagaaacccagctgtgccgtatgagttatttacaagccaattctggagcccataagcctgcctgtgagacccacctgttcctaggaactggagctagtgagaccgccaaggcgtgaagtagagaccctgtcctcatcccagcaattcaaatgacaactcagatgcccccctgctatcttcctggagcagtaggcatttcttttgaataaaaagctaagctttggcttttcttcactgcaagcttcaacactccctttaccaaccccctccaggtaatcacagcaaaaacagaaaaatcagacaagcaccaggtaccctaaggcactggtttttcaacctggctgtgcattagaagcacctgggggtgcttgttgatactgcaagtactagagtctcacctagccctgcaagtggggctgggtactggggcttttaaacatgctgggtgcctgagatttggggtacctgaaaccaatttacagattcactctgagaactgctgcttctaaggcccgtggatttaaaagcaaaatgccacacatgtgggcattcagactaattgtggagattcttcagatcttgaaataagacatatctggtctatgtgagaagcagcatggaatcataaaaaagctcaggctttggggtctgagagatgccctgcctggttctgcatcttcccagctgtgtggctttagttgtgctgaacccctcttaacctcagcggattcaagacgctgaagacagagccggcaaaggagacatgagattttatttggggcttccgtacaggggagagtccagcagcagcgggctgggcaggagaaccgcaaccccctgcacacaacatgcagtttatgcagtattttcacttaacacccttcccctaacgacctccacttggcaaccttcatttgaccccaaactcagggcctcgatcccctgtacggcctgtgtgccacaggacaggccaggggctcagatgtttatagatcaggaatgatatctgggctggtcacccccggattccctagttcggaacacacattcaggagcatctgccatacagggtcagtctaagggtgtgatgaagctattgctattaggtgtgtttaccccacagcacatcatttgcactctctgaacctgtgtctttaccataaaagtggataataaaggttattgggaggattcatgagtttagcacaaggaagagggaaaatatagcaagcacctacctgttcccagcaatgtaccagacaacggagataaagtggtacataagaaacagcccttgccctcttagagcttgtagcctagtctaagggacagacatgaaataattaaaacaaacaggtcattgcacgtgtgataaactcagcgaaagaaaagcatagcatattaccggagcgtgaaactgatgaccgtgagctcctctgagggtcggtgataggacatccaattagagagctgcagaggaggaggagtaccaggccatggaaggggttggaggctagaaggggctttccaggcagagggagcagagttttcaaaagtcctgtggcaggattgagcggtcaggaagctaaaaggtattctagaaaaccctttgcgaataaagtttaaagcttccccaatttaaacagaaatggagccctgcctaaatgtaaaaggctactaagtagaacttgcttattgtggcagacaagctgtggggttctggccagttgtctgcatccgtctctgagaattcttttccttcagccacgggggaaggaaggccccttcagcctaatgggacctgcgtaagcccacccctcttctgcagctgttcggccaggagcgagctttggttggcttcttgccgcttaaatatttctctctctctctctgaatcaagaaacagagatgagagagttggccgtttagttactttaatggcgcaactttagaatgtctagacttctgcttcagagagatgcctggctcctaccttctgataaggctggcaggtgagcatttccttaaattccactcaagtagccaatgtgagtaggttatcattctttataactaaacaacctctagatccttccacctccacctccacctggggttctacaaggccccatgggctaggaaagcccggcattcatcaggttaaatcccaccagatttgtatctcttctggtcctggtcatttccgttgctgaccccctggaagaatgagttcctgtgaatggcttcacggtcgtggctctcaggtaattcccatcagatggtggctggcaggtgcgacaagtcgctgtggagccgcacactgggattgctgaagctctactcacagtgtcccgacctagcagaacattccctagcaaagaacagggcctgacataactcccttccacacctcggctgatattcctctaaaatggcaaagcaaggttgtacatccacaggtccctgccgtccacggaccccctacccaacacagtgagactcttctgaggcccgggaagtggttgggaaaccctggaggtgggtaggatgggatttaatatttactgaacagttactctacaacaggcgtagtactgggtatttttttttcagttgactctcactgtcacctgtgaagtaaatatcttttcctattttacagtgagaaaactgaagttctgagtttaaaaacatgttcatttgcaattatgtagctcaaattacaatccacctatgttctgcacctttcaatagccatgtgactcacccttttaatgaaagcttcagggaagtaaggtaaggaccctggaactattgcaaagacggacaaaggggctgcatgatagcagacctccagagccatgatgacaacaagaagggggatgttttcaccccacacccctagaggaacttaagggcagccttcttctgtgtgtgtgtgtgtgtgtgtgtgtgtgtgtgtgtttagaggataattaaaaagaaaaaacatatattgtatcaacccattctctcgctgccatggagaaacaccagagactgcataacttattttgttaaaaaagagttttaattaactcacagttccacatggctggggaggcctcaggaaacttacaatcacggtggaaggcacctcttcacagggtagcaggagagagaatgagtgcctagcaaagggggaagccccttataaaaccatcagctctcatgagagctaactcactgtcatgagaacaggggaaaccacccccatgattcaatgacctccacctggtccctcccatgacacgtggggattacaggaactacaattcgagatgagatttgggtgggaacacagttaaaccatataatatatatagctgcatatctatctatcaatcatctataatctatctgccctcagaaatctcaattcctgactgttcaggagaagatggagaagagccacataatgtgggccttcgagtgattctggatgggcagtgtgccttttaaagtggttgagggtgcactggtttctttttattaatctggaaatgtagcaggctgtggtaccatatcaagagccccagactcagtcagaagcccttggttccatttctgatcttgctctttcctagctgtgtgaccttgagcaaatccttatcttctctgatcttcaatttctacctttgtaaaattgtactaataatgacacctaacttaaaagctttttaggagggttattcccctcatttttgcaagcgaggaaactgaggcttagacattcattaattcttcctatagacattttttatttttgagatggagtattgctctgttgcttaggatgcagtagagtggcatgatcaacagctcactgcagcctcaaattccagggctcaagcaatcctcccacctcaacctcttgagtagctgggaccacagacacgtgctgctacacctggataattttatttatttaatttttttgtagagatagggtcttgtcatgttccccacgctggtcttgaactcctggactcaagcaatcctcccaccttggcctcccaaagtgctgggattcgcggtgtgagccactgcacctggccacagacgtttattgaagaatgatataatgggagggacaaagagaagagccagataaagcaggtctttgagtgatcctgaatgggcagtgtgccttttaaaatggttgagaaacgttgttctaaagatcaaagataaaatagagagaaagcagagaagagtctgcaatgctgagcttcagggacctcaatgtagacctccaaagacaaagacatacatattctgtctggttcctggcctttcaggaatcttgggaaatcctgggtgaaactatttcatttctggacaataggatggggttgtgtgtgagtcagggtcctggcagaaaaagcacaaaggggtgattaaggaggtgttcataaagattcatcttacaaatggaggtataaggaaaactgaggaggaacaaggaagcacagcccagctaatacagagaggagctgcttccctttccacagatccagtcctgaagggctaaagggaaggaacagtttctggaactaacaagagccatgactccaacagtggagctgagaggaactgtggccttggaaaaaggagcatggcctctgcccttggctagggactgaggaagtcaggaggaagaaataacccaatctctttctgttcccctcaacattctcctattggtgcctcccattggctgaatcagaatagaagctggaaagtaagggagctcactgatgcagccttggagatcagtcccacctgagacacggaatggggtggaaaaagtgggagaatgcccagcacaactccttacaaagaagaagggtacagaagtccattttagaaggcaaggtctatgtatgttggggaagaaaactactgagaggccctttagctaattgaaaggagaaagtggttccattggaagggacaatctggcattccctaatggccacatatcaaaggaaggctttgatttggcatctcttggcacatgtacctgtttggtattgaaaagtcagttccagaaagcaagacgtgaatcaactccccagtaaagagttagattggattgccacttgatattctaaaagaggtgaagaaatggaatgtttatctccttgaaacttatagaatgttattttgtggacactgtggtgcgtcacctagtcccccttcaggaatgagggacttacaccctgactgctggtagcccgatgcagggactggctctgatgagtccagcaggtgggtgttgtatccaatgactgatcaaggtgcggaggtaaaggcccattcccttcatcccaactagggttgacgctgaatggccagcccagctccagagtgccccttgggggcatttagccatcaacagggtgcattgcaaaccagcttctccctctgcccagtccagcttccttctcctcctttccttgggtataaacctcaagagcatgtggggcacaccctgtatcccagagtctacttcctgacactcccacaagcacagttattagaagctcccttattagcaatccttaaaaacaaaaccactgttgagagttgacaagcagtaacaataacagacatctgtgaagcttcatacttcactcagcactcatcactcacttagtcttcccagcaatctggaaaggttggcagacacttggaggactggtgccttccctattttattgtctcacaaacaggatgcccagcgtggatgggtatcagcaaaatcctgttgtaggcagtaattagaaaatttaggatgatgattgccaaactgtttgatgaaacatgagtacgctaccagatgttaacaggtgttctgttttaaaaagtgggagtgatgtgtagtcatatatttttggaaaagactaaaattggtttcttggctgggtgtgatggctcatgcctgtaatctcagcactttgggaggtcaaggcaggaggatcgcttgagcccagagtttgagaccagactgggcaagattcttgctgtctctatctctttacaaacaaaaaataaaacaattagctggttatggtggtgtacacctgtagttccagttactcaggaggctgaggcaggaggattgcttaagcttgggaggtgaaggctacagtgagctgtgatcatgccactgcactccagcctgggtaacagagtgagaccctgtccc

SEQ ID NO: 546 - DNA, 113723 bp, Homo sapiens
tttgtggcctaacatatggcctatccttgagaatgattcatatgctgaggagaagaatgcatatgatgcagcattagaggaaatattcgttaaatatatattaggtgcatttgttctataatgcagattaaatctaattttttttgttgatttcctgtctgaatgatctgtccaatgctgaacatgaggtgttaacatctctggctattattatattgggggctatctctctctttagctctaatggtatttgttttatatatctgggtggtccaatgttggacgcatatatatttacaattgttatatcctcctgctgaattgacccctttatcattgtataatgacttcttttttctcttctttatggtttttatcttgtaatctttttttgtctaagtatagctagtcctgttctttatttgtttgccttttatggaatatctttttccatttctttattttcagtctatgtattagaggtggtgtgtttgtgtgttttttataggcaacatatcgagtcttggttttttatccattcagtgactctatgtcttttttttttttttttttttttttttgagtcacagtcttgctctgttgcccaggctggagtgcaatggcgtgatctttgggtcactgcaatctccgcctcccaggttcaagcaattctcctgcctcagccttccaagtagctgggatgactggcacccaccaccaagcccggttaatttttgtattttcagtagagacggggtttcaccatattggccaggctggtctctttgctaggctgctctcgactcctgacctcgtgatctgcctgcctcagcctcccaaagtgctgggattacaggtgtgagccaccgtgcctggctcactctatgtcttttgattggagtgttagttcatttacattcaatattattattcatgaataagaatttacttctgccattttgttatttgttttttgtttgtttttggtcttctctttcttctttcctttattcctgtcttcctttcattgaaggtgtttttctctggtgatatttagttttttgcttttgtgtgtgtgtatctgttgtatgttttgttatttgaggtttccatgagtcttgcaaataatatattatagcccagtattttaaatcgatgacttaacactgattgcataaacaaataatcaaattaacaaataaagagaaaactaataaaaattcaaccttttaacttccttcccctgctttttaagtttctgttgtttttacttgtatctttttgtagataagatacaagaggtccaaaattagatctctgtagtctctgacttaaaaagttgttgtagttattatttctcattggttcattttttagtctttttactcaagatataaatagtttacacaccacaatgacagtgttgtaatattctttgttttagtgtgtacttactattgccagtgagatttctattttcagatgatttattattgctcattaacatccttttctttcagactgaggatccccctttagcatttcttgtaggactggtttggtgttgataaaatccctcaggttgtggctcacgcctgtaatcccagcactttgggaggccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaatccctcaggttttgaaggatagttttgctggatataccattctagggtagaagtgttcttccctgagcatgttatgcatgtcatgacaccctctcctgacctgtaaggtttccactgagaagtctgctgccagatgtattggagctccattgtatgttatttgtttctcttctcttgtgacttttaggattccttcttcatccttgacctttggaagtttgattattaaatgtcttgaggtagttttctttcaattacatctgcttagtattctataactgtcttacacttgataacagtataatgttggctatgggtttgttgtagatggctcttattattttgaaatatgttcttttgtattagtttgttcttgcattgctacaaagaaatatgcgagactgggtaatttataagaaaaagaggtttaattggcttagggttctgcaggctgtacaaaatacatgatgctggcatctgctcagcttccggggaggcctcaggaaacttacaatcatggtgaaaggcaaagagggagcaagcacagcatgtggccagagcaggagcaagaggaagaagtggggaaggtgccacagactatttaataactagatctcatgagaattcactcgctattgtgtggacagcatcaagggaatgatgctaagccatttgtgagaaacctgcccccatgatccaatcaccgcctactagaccccacctccaacactggggattacatttccacattagatatgagtaggaacgcagattcaaaccgtatcatctttcaatgcctaatctgttgagggcttttatcatgaagggatgttggattttatcaaaggctttttatgtgtctattgagataatcttatggtttttgcttttgattctgtttatgtggtgaatcgcatttgttgacttgtgtatgttgaaccaacattgcatcccagaaataaaacctacttgatcatgataaattacctttttgatgtactgctgggtttggtttgctagtattctgttgatatttttctgtctatgttaatcagggatattggcctttttctattgtgtctctgccaggttttggtattaggatgatactggcttcatagaatgagttagggaaatgctgctactccttcattttttgaatagtttcagtaagaatttttattactgatttaatttccaaatttgttattggtctgttcagatttttgactttcctcctgattaaatcttgggaggttgtgtgtttttaggaatttaattatttcctctagttttcctaatttgtgtgcatagcatgttcataatagacctgaggatcttttgtatttctgtaagatcagttgtgagttgtttttgtcatttctgattgtgcttatttggaccttttctttttctttgttaatatagcttatggtctatcaatcttgtttattcttttgaaaaaccaatgctcgctctcattgatcttttgtatggacttttgttctcaatttctttcagttcttctttgattttagttcatttttttcttctattagctttgaagttggattgttctttttcattctagttcctccagttgctcttttaagttgttaatttgagagctttgtaacctcttgattaaggcattcagtgctataaattttcctttttacacatctttagctgcatcccaaaggtattggtatgttgtatcactattttcatttatttcaaaaaattttttgatttctgtcttaattttattgtttacccaagagttaatcagaagcaagttgtttagtttccatgttgctgtgtagtttttgagtgatcttcttggtgttaatttggtcaatcttagaatatgagaaaaatgtatattatgtggtttttcagtggagtactctgtaaatgtctattacgttgaattggtcaagtgtcaagtttaagttcagaatttctctgttagttttctaccttaatggtctgtctaatgctgtgagggtggtgttaaaatcccccattattattgtgtggccatccacagttttttttataagtcaagaagaacttgtttatgaatctggatggtcctatgttgggtgcatgtatctttaggataattacatcttcttgttgaatggacccctaaatcagtgtttactgccattgtttatccttcctgattgttattggtttaaaatctgttttatttgatataagaatagaggctcctgctcttttttgtttctgtttgcttggtagatcatcctccatccctttactttgagcctgtgtgtgtcatcacatgtgcagactgttgggtcttgtctttctgtccagattgccagtctatgccttttaagtggggtatgtagaccatttatattctgggtaatgtattgatagataagattttgatcctgtcatcctgttgttggttgtttgttttgtagatttgattatgtagttgtttatattgtctgtgggctatctgtttaagtgtatttatgaggtagcaggcttttgtcctttgtttctatgtttaccactttgttaagaagctcctgtaaaggtggtctggtgataacaaattcccttagtgcttacttgactgagaaggattttatttctcctttgcttatgaagcttagctaggtggggtataatatttttggttataattttttttgccttaagaatgataaaaacaggtccccaaattttctgtcttttaggttttctgctgaggggtctgctgctagcctgaaaaggttttctttggaggtgacccaacctttctctctagttttcttgaagatttttttcttttgttttgaccttggtgaatctgttgactatataccttggggatggttatcttatatagtctcttgcagaggttctctgtattttttgaatgtgtatgtcctcttccctaccaagtttggggaaactttcatgggctatatattcaaatatattttccaagttacttaccctctatccttctctttttggaatgccagtgagttacaaattttgtctctttatgtaatctcatatttcttgaagcctttgttcatttttataattttttttaaatgtctgtctgagttgattcaaagagctggcattaaagctctgagattttttcttcagcttgatctattctgcttttgattcttctgattgtgttgtagaattattgaagtaaattttttagtttctgaagttcaatttggttctttctttatatgactatttaatctttcagcccttggattgtcttattggattccttgcattcgatttcaactttctttttgatcccattgagccattgagctattttggcatacagattctgaattctatgcccatcatttcagtcatcttactctggctaagaactgtatttgggagactagtgtttatatttgtaggtaaggaggcacactggcttttggagttgtgagttgttgtgctgattctttctcatgtgtaagagctatcattcttctaactatgatgtaggttgaatatagtcagttggcttcatttctgggtgttttcagagggtcagcactgtacaaaatgtttatttgtggctggatctttgcgttagttttcacaggcaatgcatactggtaaaatatattgttgtattttgggctgccctcagtaggtggtgcttaagagtgttagctggcagataggctatgatatggtttggatttgtgttcccacccaaatctcatgttaaattggaggagggacctggtgggaggtgattggatcatggggtggaattcccccttgctgttctcgtgatagtgagtgaattctcttgagatctgatgggtttaaaatatatggtgcttcccccttatctctttttctctcctgccaccatggtaagatgtgcttgcttccccttcatccttccaccattattgtaagtttcctgaggcctcccagccatgcttcctgttaagtctgcagaactgtgagtcaattaaacctcttttcttcataaatttcccagtctctggtagttctttctagtagtgtgaaaacagactaatatagagaactggtaccaggattgtgcagctatgaagatacctgaaaatgtggaatcaacttggaattgcataatgggcagagattggaacagttccaagggctcagaagaataaaagaagatgtgagaaaatttagaacttcctagaaacttgtttaattgttttgaccaaaatgctgatagtgatatggacaattaagtccaggctgaggtagtcttagatggagatgaggaacttttcaagaactaaattaaaggtcacttttgttatgctttagtaaagtgactggtgacgttttgcccctgcctgagagatctgtggaactttggacttcagagagatgacttggggtatctggcagaagaaatttctaagcagcaaagcattcaagaagtgacctggctgtttctaaaagtgaacactcatatgtatgaacaaagaggttatctgaaactggaacttacatttaaaagggaagcagaatttaaaagtttggaaaatttgcaagctgaccatatggtaaaaaagaaaaacccattttctgaagagaaatacaagccagttgcagaaacttgcataagtaaagaagacccaaatgttaatagctgagacagtggggaaaatgtctccagggcatgtcagagaccttcacagcactcctccattcacaggcctggagacctaggagggaaaaatggctttgtgggctgggcccagagttctgctgctctgtgcagccttgggacttggcatgctgcatcccagctgctccaactccagctgtggctaaaaggggccaacatacagctcaggctgttgcttcagagaatgcaagccccaagctttggtggcttccacatggtgatgggcctgagggtgcacatttttcaactttagaaattctgttttattccttttgattatttccctctatttgataaatgtagctaataggattctgaattcctatttactgttatctataattttgttgaacttcctcagaacagctatttgaaattttctgtctgaaaggtgacatatctcttttctttccatgattggtccctggtgccttttttagttcatttggtgaggtcatgttttcctggatagtcctgaggcttgtggatatctgtcagcttctggatattgaagacttaaatatttattataatattcttggactgggcttctatgcacctgtccttcttgggaagactttccagatactcgaagggatttgggtgttataatctaagtttttgctctctccagccatatctgcattagggagcactccaagctcagtaacactgtggctcttgcagactcacagaggtactgccttggtggtcttggatgacatctggaagagttttctggattatgagttagagactcttgttctgttcccttacattaccccaaacaaacagtctctctttttgtgctgagctggctggagttgagaaaggggtgacacaaacacccctgtggtcactaccattgaggctgtactgggtcagacttgaagccagcatagcactgggttttgcccaaggcttacaatgaccactgtctggtcactgcctatgttcactcaaggccctaggcctctacaatcagcagatggcaaagcaagccaggtctgtgtctttcctttctggttggcaagttacctgagccccagagggggcccagagttgttgtctgggagccaggggtggagttgaaaaccctaggaatctatctactgctgtattctactctggatgagctggcaccagagccacaagatgaagtctttccctcgcttttttccactttccacaagcagaggagtctctctctgtggccaccacagttgggagtgtgctggataacacctgaagccaacatgttcctgagtctcacaaaaggcccatgatgagtactgcttgtgtatcactgctgctatttagagcccaaatgctctttagtcagtaggtgatgaatctttccatgattgagtctttctcttcaggtcagtgggtttgttttatttatttattttattttttaataattttttttatttcaattggtttttgaggaacaggtggtgtttggttacatgaataagttctttagcagtgatttctgagattttggtgcactcatcactcaagtagtgtacactgtacccaatgtatagtcttttattccttgccaccccccatcaccccctaccctttccctgggatccccaaagcccaatgtatcaatcttatacctttgcatcctcatagcttagctcccacatatgagtaagaacatatgatgtttgtttttccattcctgagttaattcacttagaaaaatagtctccagtcaagtagctgtgaatgcaattattttgttccttttttcttttgatatttcatggtatatacacacacacacacacacacacacacacatatatatagctcacattttctttatccactcattgattgatgggcatttggctggttccatatttttgcaattgcaaattgtgctgctataaacatgcctgtgcaagtataatgattttttttcctctgggcagatacctagtagtgagattgttgatcaaatggcatatttacttttaggtctttaaggaatctccacactgttttccatagtggttgtactagtgtacattcccaccaacagtgtaaaagtgttcccttttcaccacatccatgacaacatctatgattttttttattatgacctttcttgcaagagtgaggtgatactgcattgtgattttgatttgcattttcctgataattagtgatggtgagcgttttttcatatgcttgttgactatttgtgtatcttcttttaagaattgtctattcatgtctttgcccattttttgatgggattttttttttctcatttgttcattgtagattctgggtattagtcctttgtcagatgtatagactaaagattttctcccattctgtgggttgtctgttagctctgctaattatttcttttgctgtgcagaagctttttagtttaattaagttatatctatttatcttttttgtttgcatttgcttttgggtgcgtggtcatctatttatcttttgtttggttgcatttgtttatgggttcttggtcatgaagtctttgactaagccagtgtctagaagggtttctctgacgttttctcctggaatctttatggtttcacgccttagatttaagtctttgattcatcttgagttgatttttgcctaagctgagagatgaggatccagtttcattcttctacatgtggcttgtcagttgtcccatcaccattgtttgaatagggtgtccttttgctacttttatgtttttgtttgttttgtggaagatcagttgactgtaactatttggctttatttctgggttctctattctgttccattggtgtatgtgccgatttttataccagtaccatgctattttggtgactatggctttatagttggaagttgggtaatgtgatgcctccagatttgttctttttgcttagtctttctcggggtatgtgggctgtcttttggttccatatgaattttaagatcattttttctacttctgtgaagagagatggtggtattttgatgggaattgcatggaatttgtagattgcttttggcagtatggtcattttcacaatattgattctacccatccatgagcatgggatatgtttccatctgtttgtgttgtctattatttctttcagcagtgttttgtggttttccctgtagagatctttcacgttttttgttaggtatattcctaagtattttattttattttttttgcaactattgtgaaaggggttaagttcttgatttgattctcagcttggtcactgttggtgtatagcagagcaactgatttgtgtactttaattttgtatcctgaaagtttgatgaattcatttatcggttctaggagcttttggatgggtctttaaggttttctaggtacatgatcatatcctcagtaaacagtgacagtttgacttcctctttactgatttggatgccctttacttcttcctcttgtctgattgctctggctaggacttccaatgctatgttgaatagaagtggtgaaagtgggcatccttgtcttgttccagttttcaggggacatgctttcaacgtttaccaattcagtataacgttggctgtgggtttgttgtagatggctcttattaccttaagatatgtcccttctatgcggatcttgctgagggttttgatcataaaggggtgctgtattctgccaaatgctttttctgcatctattgagatgatcatgtgatttttgatttaattctgtttatgtggtgtgtcacatttattgacttacatatatagtaaaccatccctgcatccccagtatgaaacccactatatcatggtggattatctttttgatatgctgttggattaggtttgctagtattttattgaagatttttgcatctatgttcatcaggtatattggtctgtagttttctcttttagatctgtccttccctggttttggtattagggtgatgctggcttcatagaataatttaggaaggagtctctatctttctctatcttgtggaatagtgtcaataggattagccccaatttttcttttaatgtctgataggattcagctgtgaattgatctggtcctggactttttcttgttggcaattttttttattaccatttcaatcctgctgcttgttactggtctgttcagagattctatgtcttcctggtttaatctagaagggctgtatatttccaggaatttaaccacctcctctaggttttctagtttatgtatgtaaaagtgttcgtagtagccttgcataatcttttatatttctgtggtatccattgtaatatcttccatttcatttctaattgagcttatttggatcttctctctttttttcttggttaatcttcccaatggttaatcaacattattttatttttaaaaataaccagctttttgcttcatttatcttttgtggtttttgttttttttgtttgtttgtttgtttgtttcagtttcatttagttctgctgttatttttgatttttttttcttccactgggtttgggtttggattgtttttgtttctccaattctgtgaggtgtgaccttagattgtctatttgtgctgtttcagacttattgatataagcattcaatcattcaatgctatgaaatgtcctcttagcactgtttttgctgtatcccagttttgacaggttgtgtcagtattatcattcagttcaaatgattttttaatttcatcttgatttcattgttgacccaatgatcattcaaaagcaggtttttaaatttccatttatttgcatggttttaagggtttctttcagagttgatttccaattttattccactgtggtctgagatagtacttaatataatttcattttcttaaatttactgagacttgttttgtggcctatcatatggtctatcttggagaatgttccatgtgctgatgaatagaatgtatattttgcagttgtggggtagaatgttctgcaaatatctgttaagtccatttgttgtagggtatagtttaagaccattctttctttgttgactctatcttgatgacttgtctagtgctgtcagtgcagtattaaagtcccacactattattgtgttaccatctatctcatttcttaggtctactagtaattactttataaattttggaactccagtgttaggtgcatatatgtttagtattgtgatattttcctgttggactagtccttttatcattatataatgtccctgtttgtctttttttactgctgttgcttcaaagtttgttttgtctgatataaaaatagctactcctgctcatttttggtgtccattttcatggaatatcttttccacaactttaccttaagtctatttaagtccttatgtgttagatgagtctcctgaagacagcggaatcttggttggagaattcttatccattctgccgttctgtatgttttaagtggagcatttaggccattgacattcaatgttattattgagatgagatgtgaggtactattctattcatcatgctatttgtaacctgaataactcatttttttcaatgtgttattgttatataggtcctgtgagatttgtactttaaagaggatctattttggtatatttcaaggatttgtttcaagatttagagctccttttagcagttcttgtagtgctgggttggtagtggtgaattctttgttagtctgaaaaagattttatctttccttcatttacgaagcttagttttgctggatacaagattcttggctgataattgttttgtttaaggaagctagaaataggaccccaatcctttctagcttgtatggtttctgtgagaattttgctgttaatccgataggttttcctttataggttacctgatgcttttgactcacagcttttaagattatttccttcatcttgacttcagataacctgatgactatgtccctaggggatgatcttttagtgatgaatttcccaggtattctttgaacttcttgtatttggatgtctagatctccggcaaggccagggaagttttccttgattattccctgaaatatattttccaaacttttagatttctcttcttctttgggaacaccatttattgttaggtttggatgtttaacatagtcctaaactttttggaagcttggtttattttttaaaattctttttctctttgtctatgatggattgggttaattcaacagccttgccttcaagctctaaggtcttttcttcctcttgtttaattctattgctgagacattccagtgcattttgcatttctctaagtgtgtccttgatttccagaaattgtgattgctttttgtttatgctatttatttcactgaagaattttcctttcatatcctgtatcgtgtttttgatttctttaagttggatttcacctttctctggtacctcctgattagcttaataattgacttctgaattctttttctggcaattcagagattttgtcttggtttggatccattaccagtgagctggtatgatcttttgaagggactaaagcaactttttttgtcatattaccagaattgttttactggttccttcacagctgggtagactatgtcagagggaaggtatgggattcaagcactgctgttcagatttttttgtcccatggggtgctccattgatgtggtgttttcccccttctcctaggaatggggcttcctgagagccaaactgtatagattgcttttggtcttctgaattgagccacccagaagagctagtgggctctgggctggtagtggggagtgtctgcagagtcctgtgatgtgattcatcttcaggtcttgcatctgtggatgccagcacttgctccagtggaggtagcaggggagtgaagttgactctgtgagggcccttgtttgtatttttgtttagcacactggttttgtgttctttggcctccagcaaggtggtggcactttcaagagtgcatcggcttcagtcctacagggaggaggaagcaaactcaccctagggacacctgggtaagtattcaggtttctcaggcagtgggcagggccatagacctcccaagagattatgaactttgtttttagctaccaggacagatagagaaagaccaccaggtgggggcagggataggcatttctgagctcagccttagcttgggcagggcttgctgcagctgctgttggggttgggggtgtggttcccagtccaatggaattatattcccagagggatttatggctgcatctgctgggtcatacaggtcaccatggaaatgggggaaagctggcagtcacaggcctcatcccattcccacacagcctgcagtccttaaggctggtctcactcctctcatcttccccaacagtaccaattctatttccaggaagctggtgaccagggctgagagcttgccccagaccacgagcctccccattgtgaaagcaagcagactcccagttttccagcatctcagggagctgcagcagtgatccagtttctttaaagggtttgtggattctctcggcactcctggtatgttcctgcaatagttcatggagcaaaagttcgtaatgtgagtctccacatgctgccctttctgtccaagttggggaagcaagctagtcccgcttcccatccatcatcttaatccaagtcagtgggtttctttctagcccagggtgtttgtagaaatgtcatccaagaactagggcttggaatgttagagtctatcccagagctatgacctatgctccctggggttggggtaagagtgatgcaggctctcccttggccactccagctgatgttttactaggtcacatgcccctcaagtccactagctctgagcccagcaccgcaacaggttttgcccaggaaatttttgtccttgtggactggactgtctttcaagtttatttagaaccccagagcactttagcctgtggtggcaaggcttgccagaactctggttctgcccactgagatgggtgattctctctggctaggaatggtctaaatgttccctctgtgggcaccaggtgagttttgcctggtgttgctttcactgtgacagggcagcactgagttccaatgcaaagtcccacaatcactgtgctctccttcccctaagtgcacagattctctctcagtaatatgtggccactgccacaggaagggagagggttggctttggcaattcaagactgtctttcccatcctctgtagtgcctctttctgtgatataaagttaaaactaggtactgtgatcatgaacctgattttttgttcctgtgaggatgtcttttcgtgtggatagttgtccagttcggtgttcttgcagggaaaatgatgggtgaaggcttatatttggccattttggaaaacagagttttaaatgtgatatttgactccttcaccttctcaagattgatgtatcttccaatctgctttgtacttttcagatttccatttatcttttttttaaaaaaagttaaagcaaattttaacaggaaatagcttataaaaatggagaaatttataatgagttgccattgtatatgagaacttcctaaagttgaactgaatttcagggaaatacaattccttaagaaggtagttaaaatttcaggccctctttgatcaacaatttgtgcctctgttatgctctgtagttattgaaaaccaagagcaagttttcctaatatactagctacgatttcagaaaactgtcaatctcatcatgtttttattatgggaagggatcttaattgcaacagaatttttaaaagaaatagacaggagccatatggaactttatccattttctgccaagaaattgtcttctattgcaaaagctatagacatctaagatacatagaggaatttaatcctttacatacaatgatgcatttgcttgagtgacattgattggaagtatagaatgagattttttaaaaattttatttgcttatttattttttatttttttgtttttttgagagtctcgctctgttgcccaggctggagtgcagtgacgtgatctcggctcactgcaagctctgcctcccgggtttatgccattctcctgcctcagcctcctgagtagctgcgactacaggcacccacccccatgcccagctaattttttttgtttttttgtattttcagtagagacggggtttcaccatgttagccaggatggtctcgatctcctgacctcgtgattcacctgtcttggccttccaaagtgctgggattacaggcatgagccgctgcaccctgctgagatttttatttttaagaaattatttaaatgttatggttgtgaattgagttatcccaagtggatttttctgatcattggatttctaatttacttttatctagctttagatttccattcataagcacacttcaagttggcctcttaattgtcaacttttacaagattttgtgtgcatctgtgtgggtggggttgcttaaactggaaaaagtagaagataatttatactttgaaaggtatttgaaacatatatggttaagagtaataacttggttccagtaagttatgtttttctgaaatcacaacatgaaactgaatattagcattaaataaatctaagaatattattaaatttcatatgccaacttgtgatatgcaaattatagattgcagaacagaggaacaaatgggtaacagctccatgtaagatggtagtgttcaatagtgtaataagaccagggaggaaggaaactctgggaaggaggctagggtttagctctgaggaagacgcatcttctcttgttaaaaaataccagttagaatggcgatcattcaaaagtcaggaaacaacaggtgctggagaggatgtggagaaataggaacacttttacactgttggtgggactgtaaactagttcaaccattgtggaagacagtgtagtgattcctcaaggatctagaagtagaaataccatttgacccaacaatcccattactgggtatatacccaaaggattataaatcatgctgctataaaggcacatgtacacgtatgtttattgtggcactattcacaatagcaaagacttggaaccaacccaaatcaatgatagactggattaagaaaatgtggcacatatacaccatggaatactatgcagccataaaaaaggatgagttcatgtcctttatagggacatcgatgagctggtaaccatcattctcagcaaactattgcaagaacaaaaaaccaaacaccgcatgttcttactcaggtgggaattgaacaatgagaacacttggacacaggaaggggaacatcacacaccagggcctgttgtggggtgggggaagaggggagggaaagcattaggagatatacctaatgttaatgacgagttaatgggtgcagcacaccaacatagcacatgtatacacatgtaacaaacctgcacgttgtgcacatgtatcctagaacttaaagtataatcaaaaaaataaataaacctagaaaggaatctgaaaaaaaaaattcaggctgcaaagaatacactgaacaattcaccatctttctcagaaacagaactgactaggtgtggtttgacctattttatatttgtctgttaatttgtagttgtgtctttatttcattgtgatataatatacctccagaaaagtacacctatcataattgcacacaatggtaaggtgttgtgggaagtcagggaccccaaatggagggactggctgaagccatggtggaagaacataaattgtgaagatttcatggacatttattagatccccaagttaatacttttataatttcttatgcctgtctttactgtaatgtctgaacataaattgtgaagatttcatggacacttatcacttccccattcaatacccttgtgatttcctatgcctgtctttactttaatctcttaatcccatcattttcgtaaggtgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagataaccttaaactctgaccgccggtgagccgggcagaacagagccatatttctctttcttcaaaagcaaatgggagaaatattgctgaattctttttctcagcaaggaacatccctgagaaaggaatgcctccctgaggttgggcctctaaaatggcccccttgggtgtggccgtcttttatggtcaagctgtagggatgaaataagccccagtctcccatagcgctcccaggcttactaggacgaggaaattcccacctaataaatttttggtgagaccggttgtctgctctcaaacactgtctcctaataggatgttatcaatgacaatgcatgcccgaaacttcattagcaattttaatttcgccccggtcctgtggtcctgtgatctcaccctgcctccatttgccttgtgatattctattaccttgtgaagcatgtgatctctgtgacccacatcttattagtatactccctcccatttgaaaatcactaataaaaacttgcggttttgcggcttgtgaggcatcacggaacctactgacatgtgatgtctcccccagacacccagctttaaaatttctctcttttgtactctgtccctttgtttctcaaactggccgatgcttagggaaaatagaaaagaacctacgtgaaatatcgggggtgaattttgcccaatatctggctgaatttcccctgatagtaaggcttggaggttgttgtatggagggagcaggggcccatggagaagtgacagaaggtcttaacctgggttgaaaagtgtggactttcaagaaatagaagcagatgactttcaaatgcatagtagaggataaagaaacacaactttaattttttagagtggcctatatattttgtttggaagcttaaattctctgttatcacctggtagtggccatccctgctgctgtggcccctcttactgttactctgaccttcacaggtctttgggaacttatcactcattgttgatggcatttttcttctgtatagcagtctttgcttttcttcctatcatcaaacagattaagaatggacactctcctcatctgtcttacaattctttatttagagactaataaagcgtttcattccttgtttcatataaagtctttgtgttaaaactcttttatttatctctgtctttcagtttctcacagtctttatagagtgtgtagtttgacatgagataacttgaacaatacgtacaagtcagcaccacaaatcatcttttgcagcattcaattgcaaatgaccctaaatgacacggaacaccaaatggtaggctctcttaccttagaatgagttcctggatcattaattagaactttcaggaatgaatatgggatagattagttatccatgttgccctaggatagacattccagtatactgatagaaaaacaaaatggtaaaagtaattcaaagacaggtttgctgtgctgcttttctttttcaaaataaaattctccttttctctctctttccaaattagcagatatgtgaatgaatgtgtgtgtttgaatggatgacttatacatcctgatgtagagcttcataggaatgaatttcagtgaggttttctaatacacaagaccacatcaaagaaaaagaaacaccctttaactgttgtcattcacagagccatggtgaaataattggtgaggcaaaggtagtaaataatccaactgttggggtcattcagacctaaatagactttctgttgaagtgacctgaagtttccctaattctttctctgttccaggtgtatagatcctgtcttagaaatgtagtgggaggttaacatgtcaggctgtgactttattctgtccctggaataaccaagaatcttttagaaagtcaatttgccctcaccaggaggactccactgaagtacagaatcattgtctactggggaaaagttcctctgaagatggatatggctcatttctgtttcgttagcagtgcttcatagaagatgatggataaacttagttatttgttgcttttcttattaaaggctttacccatttcttttcaatgtagaagaatatgggagcgtgaatgtgattgctgagatttctcgttttcagtagctcagggatctccactagagaaactgaaggcatctgctttcaatactcatgtctgtaaaaccatcacagagagggaaatgtgtgaaccttcagactccagacactgctgcatttaaaaagaattgttgctatgaatattggaatattttccttctggtcactgcttatgacttatatgtacggcagaagattggggcttgctcaggcatattacacccactcacgaattctgagttcaaaaattttgtgtttaaaaattagcctccttgattagattaatatgcagaattgtcaggtgttttaaaacaacgtgcaagttatgtccacatgattaatgtgaaatgaaaaatctagccaaacttcttgttctcacacacagtttccccaaattagagcatatagacttccatttttgtaaaataattttgcctcaaaacaattttaagaaaaaattgatctgtttccctactttgcctttctaaatctgcctcataagtaatggaattttaaaagatgtgacagtcttatttaaaatgaaatgaaacaaaatggcataaaataaaaaaaaatacccaaactttcctttccttttagttaacagtatttgtgatggaagttgcctgggagtgagtctccagagaccagttctgtggggtggaggtgaaatcatttaaccctccttggcctttgtttcctcacctataaaattagggcactagagaaatgatgtctgtggtttccatcagttccctccctctagctttaaacactataatttgcttttctctgctatgcacacggcactgtctaacattccctggggaatgatactttcagcatcgttttcaaatagtattcaagagagagaaaactccaaggcagcagatccagcattttcaaattttaaggctcaactgagaagaaaagagttcatccagaaaagggtataaattccacttgacttacatcgtagcactttccacacacctccattatggaagaggttgacattaaaaagattttcccatctttaatggctgtgactaagagtcttgattgtacaatattttggcttgcacttcatagttccctcaatgtccccatctatgtccatgggtagctctctaaatacagcagctgtgccatctgtttcaaatattatttcagccctcactgttttgggataaatttcataaagtgtattgcatacacacacatttaattgaacaaatgagaagcctttccagtttaaaaaagcttcctaaatgacaagaagtgtccaatttccattcaaatggttacttcggggctttaaaatgtgtgaattcatctaacagaggctggtcgtgtgttttgaggcagatggcttgattctgtgaagaaaaaaattaagtggaatttactatcaatcttattttttttggcaaaagactgacataataaagatgtgtgtattactgagaatggtttttaataatgattctaccttatgttttcccccaagattatggttaactgactaggaaaatctatttagagattttatgtttatccataatgatcagcttagagaaaaaaaaaaagaagaagccgcctgcaaacagaattgctgaaatacaaaaggaaaataatgctctacaactttctaaaggagtccaaggcaaagggaatgctaaagtttattttgtttctcctgttaaatagttgtgaagccaattggagatttttgaggaaaggagaagggatttcacatcttgtgagaatgttttagagtaatatcttcagtgggcatgataggtgttgtgtccaagacactttttatatttaagaccggaagtcttaaaagtgtgtcactggaattattcacagttactagtggtgtgtattctcaaatttagactcatattagcacatgtcaaaattatgtcaaaagttctatgctctaagaatcctttcttttctcatttgtagtttgcagaactgactgagctcctcattagttcttgattagttaaaacaaagtatgtgtctcatacttcttgaatatggtggttcaggaacctaagcctaagccaattggctcagagcttcatgtggcagtaattacagatgattcccaacttacgatggttcaacttacaatttttcaactttactatggtgcttttagctgtgcacattaatgataaatactcatacaacattttgttttcatttttagtacagtattcaaaaattacatgatatatttaatattttattagaaaataggctttgtattacattattttgcccaactataggctaatgtaaatgttctgagcatgtttaaggtaggttaggctaagctataatgttcagtaggtcagctgtattaaatgtatttttgacttacagtattttcaacgtgtaattggtttatctggatatagcatcatcataagttcaggagcatctgtatcggtttagaggtaagcatatgacctaagttgtcccaaaaagtataaaagaaagagcatttatttgagtgctggagaaaactagttttttctctcccagtggacatgaagaggaaaacatttagccttttttgtcactgagaacctactggaaacataaggggagccaactttagaataaaatagagtgtggatagcaggatgaaagtagaaagaacctgtggctttgacgacatagttgagcctttaggtcccctgccctgcagtccattatgcttcagagtctctcttatgtagtcaatacttattgttagaacatttcttattgttcctaccatttgagtcaggtattttgatacttgcagctaaaagcattccaacaggtacacttgaggatgtggtttagggtgaggatgtgactcagggtgaggcaggctcagacatgtacaacatgagacctctcaatcaagggtgttgggtcttctcccttttctgagacacatattatttttgacatgaaggacattggctggaagaaaataatgctacaaatgattattaaattaatgtgggtattggaggctatgcagtggagcctaaggcttttatgtattctgagattgactgaaggtggctattttctcgctaaaccagtggttcttaaagtggtccccaaacagtccagacttctggtttcttcttacacatgtaaataacttagaaatgtctcacctgtcctcaccacaagaaacaatgtagttcaacaactcttcttagtctatcagggaattgaggtgacagggtaaattgctatttgggaagctgaagagacaggcaaatagaatcacagcttgccagaaacacaaacactggagctagtaatgggtaggagcatttgagtgtttcttaaaggtaaccgaaaaattgctgaagctgagtgtggacaagcttgagagttaaaaactcttggaacccagtcttaggaggacctggacctgtcatgcttttgtgagatttatctgtgggatcctgtcttagtctgttcaggctgctatgacaaaaataccacactgggtaacttataaacaatatatatttattgctcacaattctggaggctgggacatccaagattaagtctccagcagatttggcatttggcgaaggccccatttctgatagatagtctctcttgcagagtcctcacatggcaggaggggcaaacagtctccctcaaatcttataatgtattcattctcatgacctaatcacctcccaaaggccccaattcttaatataatcaatttaggggttaggttttaacacatgaattttgggggtacacacacgttcatatggtagcagattcctaccagattcttttagtgaagattggagaaaaatccccttgtggttttggcagggcaaaagtaaccattttgaaataagcccggtgtgttcttcatatcaaagtcctgccctgaaggaaaactagtttactagactcttatcttatgtggaggaagggcaattagacaaccgagtcctctgtaccttttctgcctcacataagggagaaaaaaaggctaagaaagacttctgaaggtcgcagtccgaggactcaggcccataagaaacagcaatttaatcataatattatagaatgcttccctcctcaataccatcacactacaccaataggtctcctacgtaataacagtgaattacaacttggatcactgaaagacaaaaactgtatctaagaatgagtttctagggaaacccaaagacaacatgggagacaaaaacaaggtcgccggtggtgattgaagcctctgacacctatagctgtaccacacattaaattcagcctaactgctaggcagataaacatataaactcacattaaaggcctatttacttcagttcctattattcaataaatcatgtccagttttcaacaaaaaattacaacacatgtcaaaaggcaagaaaaaaacaaggtaagcaccaaaaccagactcagatatagcagacattatggaattactgagtatagtcccaggataagcagtatctccatcacttgggaatgtgttagaaatgcaaatttttggatctcatcctaaacctactgaaacagaaactgagggtggggactggcagtctgtgttttaacaagcactccaggtgactgtgtttgaagatcactatattaagcagatgtaaaatttgtaatttcttccttttccttacttagatttcttagaaatagtatggtaacaaggtgattcaaaatgtaaaagactcactgaaaacattgttgtgattttgacttttagttttgctaagcaatatcattgctaatgaagagtttcggatgaccacatgtggtatagagttaccccagctgtgtttgattgtgtcagacttaccatttgacttgggaaccttatcatcattgtcaaccttgcagacagtgtttaagttcagatatacagctcatagatctcccatccaggaggttaaaataatttctcagtgctgggttttcaggccctagggccctagagacttttttctacattggtttttatgaagggaatttgggaaaagggagaagatctttacatgcgtccttttaaaggcagactgtgttattatcttgctcttttagtttactcagtcagtgctcacttgccctctggcctgatcacagttttgtagccaccggagagtcaattgttaagcctaatgatggttgctttgaactcctctgagactctgatgtcataggtttccttttaggtttttgatcacagttttctgtcttaggttgctcttgctcacacactggctgcctctcccctcttggtgcctgatgttcggtgatgataaatgttttcttatcaagcccaagaagagccatagcttgctattacttgcagaggcctcctaatttcacattggaaaagctgaagtctggggtggggagtgtgtgataatttgcttcatgtattcatttgctcgaaaatacttaatgagtacctactctgtgtcaggcaggaatcacagaaacatgattagaataaaggaattgttaattcctatgccagtactgcttttataagtgtatttgaataaaaacaaaatgaaagaaactaaatcagtgaaagtaatacaataaaaataaatagggaacaaaaaaagaaaaataaagagaaaaggccacttgggagctaagtgccttcttgattactaagcacatacgtttacttttctttccttaatgttccaccagggcgaaaaataagcaaacactaaagcagcactaggaaatgtggaagagtgataccagctgaagcaaaacatttctgaatgatataaagcagataggatttgtttgatgaaataaccaaatagaactggtaggtacagttaatacaaatgaaagagagtagcagtggaagaagaaaggagtttgttcaattttaaacagaactttgaaaagtttggagatttttggaaaagcccggggatcgtaattatgaagaggtaaggaaggtattcaactttgtggcatttgataggaaggctaatgaaactggggtgtttcaagcacctggaaaaagcatttccacccagttccaacagaactggcacgaacagtttgaaaggtaataaagaagcagatggattctgccactggggataggcaagagatatttaaagtgagtactggaattataaagagaagtggaatggtgctcctgggtaatgtcagctgccaacacggctaaacttgctcaccttctaatgaaaaactcccatccactacatgactgcgtttttgtgtctcccagaattcataggttgaagctccaaatcccaatgggataatattatgagatggggcctctggtggtaattaggttatgaaggtggaatcctaatgacaggattagtgcctcataggaagagacgtgagaaaaacttgcttcctctatctttgctctctgccatgtgaggacacctcaagaagatggcctcctgcgaaccaggaagcaggccctcgccagacactggacctgccagcaccttaatcatgaacttcctagctgccagaactatgagaaataaatgtttgttgtttaagccttgcatctatggtaatttgtcatagcagcctgaatgaactaagatactgcccagctcgctaactatagtcatggcttctatcatttgtaatcatgttcattatcaaagaagctgtaactttcacactagcaacctgtaaatataaatgaactacttataaatataaatgaacaactcagaatttccatatgttgaagaaaaaagcgtaaaaataagccaccaaacgaaacaaactgaagtaattcttgaaacaattgaattactggtgaaatatagaaaaacttactgaaacaatttaatttgtatcttaagagatatttgagggacactgcattcacatagttagaataggccactaagaaaaagtaaaaaaaaaagaaaagggagatttcatagaaattaaaataaacatatacttattgaaacaaatataacagagcaattgatgtggaatgtaaagtacttaatttccaaaagtgtttttcatctagatggacaagacttgtcacgttggagctaatttttgttcagaaaaaggccacttgaatgggtacattaacccactgtccaggtgaaagaggacaataaggaggaacttggctaatgaaagctgcctttaatctgattttgaaatgctgagttggttactggtgagatgggaatatttgcatgggatagtattatgagatggggaaagagttttccaagaaggtcaacgttttcccttttaaggtccaatgttgttagcacctctgtcactgttcaagtttatgaaatgtccagtggcttagtagacaaaactggagcatattctttgaattcttgtgaaattagggagagaaaggactacctcaagaaggagatgccaacctagttatgtgtcagctagagagcaattgaaaaatacaaaagatgtgactaaagtcatactccctaactgctgaagtatattacactaattgcctaaatatcaataataaagatcagagcagaaataaacgaaatacaggctagaaaaacaaaagctcagtgaaaccaagagttggttttttaaaaagataaacaaaatctacaacctgttagccagactaaagaaaaaaagataagactcaaatttaattataaatgaaggaggagaccttacataaatacaaagtatcataagagactactatgagcaattataggccatcaaattggatatctaaaagaaatggataaatttctagaaacatacacaatctgccaaaactgaatcataaaaaaatagaaaatctgaacagaccaataatgagtaaagagattgaaactgtaataaaaaacctcccaaaaaaacaaaaaacccaggatctgatggcttcactcatgaattctactaaacactgaaagaattaatgtcaatccttctcaaacttttccaggaaatgaaagaggagaaaacacttccaaactcattttttgaggccagcattaccctgttaccaaagccaaataagaaactacaagaaaagaaaacttcaggacaataaaaaatcccgaatattagaatggatgtggttgaacgccaaatcggttttatggaagatcaagccaaaaggttttcttggaatgtagtgcaataagacagatgaaaattgtcaaagaaacttggaaggaatgatgtcattcagtatatgaggtttagatattcacaaagcatgtaaaatatttagaaattccaacatcttcctgataaaacttgtaaaaggagaagccagacagaataggaggaatgacataatccaagtaataatagaagaatatctttttttccaaactgagagacagtactgtttttttttttatttaaaagaattagaatacaaaacagcaatattgcattaagggacctatgaatatcggggaagaatttatgaagtcgtaggagaaagaaaaagtcttgcaattttctagagagtaaaaacagattatctgaaaaggaagaaaaatcagaatgacattggtgttttctaacaccaaatgccagaaaatatgtagccatatctataaaatcctgagggatttgaatattggattctccattaggcaatctattactcaagagagaaggaaaagtaaagacaatttgaaagatagaaagttgaacatcgttgaaaaaattaaaattgctctagtatgttctttagcaaaatgtaagaggaaaccagaaaagaagacatgggatatcgtgaataaaataccaaatatgacttatcaataagtctaagttgtcatgaactatttgcacaaactatgtgtgagtttaatgcagtcgttaactaagagtcctaaaataagagagacacagaagcataataaaagtgttacttggaatactaatgtaagtcattgagaggtttcttgtaataaaaacttactaagtataagcacacatctaaaggtgatatatcttagaaatagaagccaagaaaaaactattatgaattcaaaattaagctgaaaagagaaattgattgtatagtaaattaaaaacttattaaccaacactccaagattatatgatgagacagtacgttattattaataaccaatattatttgaggacttactacatgacagatatgctgctagatggatactaacgttgtctccacttatagatgagaaaactgaggacagaaaaattaagtaatttgcttagagccatcagataggagggagcaaagacagacaatctaacttcaatcatgctctaaatcactactctaatattatctcctcagcctcttattggaatatagattgttcaaaaatgactccataataaagagaaactaacactcctgtcttatacagtctgcaggtatttgtccaacatatgtcagatatatttattttagcctgtatactctggagtatcagtaacctagtatcacaaaattctgtgtaataagttgcctcaaaacctggtggtttgaaacaactatcattttttctcatggatctgtgggtcacctgagaggccttgtgctaggcttgtcttgcctggaatgggttgtcccagttccatgtgtctctcatcctcatcttgggacaaacaggctagccagggcataagctttcatagcatgacaaagtcacaaaagagcaaacccaaacatacaggtgctttacaagccatggtctcatcacacctgttaacattccactggtcaatccacatagctggggaggaactggaaagtcatatggcaaatactctaaatgcaaggggggataataaattaaggtcattaaggctttacaaaataatcagtctgcttcttttgtagttgtgttggatgaaataacatattgttgctcatgtgttcaaagaaaacttttcttaaccaaaatgatcctttaaggataagatggtgagattttccttccagccaagtattgagacagccgtgtgcagcaactgagaaggaaaggtgaggacagtcaaaaaagttaaaagatttaaggcaaatatatctatacctatatttagcaggaaggaaggtggtgcatgcacataagcatgctttttctgattctaggtaggggtttcagagttttacaagcagtgggaagagcccttgctaaaatagtctggagattagctttttgccctaggtctgccactagtaaaagacaaaacttttctgagtggccattttcatatcattaaagttggccccagacgatctatgagattcttttaagtcctaaaactttaagaaagatatttttaaaaatgaaatatgatgatggtataaattggaagttactgaaatgtgttttataaaattaggagcagcagttgaattgtaagaagcaataacagcaaaggcagagcaagatggctgaatagacacccccagcagttgacccctgacaggaacaccaaattgaaaaactatccacacaaaaaagcaccttcatgagaaccaaaaatcaggcgagtgatcactggttttaacatcatatcaagaaaaaaatgcactgaagaaggtaggaaatacagccttgaattactgatgctacccctccccattccctggatgcagacatgtggcatgaagagacaatctgtgtgcttcgggaaagaagagcacatagactgtggaactttgcattggaactcagtgatgccctcttatagtgggaagcaatacaggacagaactcagtcagcacctacagatggagaatttagaccagctctagccagagtcaaatcgtccacccagtagttggaacatgagttctggcaatccctgccactgtgggctaaaaggtagtgaggtcctaaataaaaggcaatcttggaagacaatctagaccataaggacttgaaaggcaaacttgaaagacaatctagatcatatggactgcaattcttgggcaagtcctggtgctgtgctgggcccagagtcagtggacttggaaggtatgtgacatagtgagacaccagctggtgcagccaaggaagtgcttgtgtcagctctcccccaatcccaggctgcagtgaagctcatagcttcaggagagactccttcccttagcttgaggagaggagagggaagagtaaagaggactttgtcttgcaacttgaatacctgttcagtcacagtaggagagggcaccaggcagattcctgaggcccgcattccaggccctagctcctggataacatttctaaacacactttgtgtcagaagggaaccgattgccttgaagggaaggacacagttcttgaagtattcattccctgctgcctagagagatcttggactcatcagtagtggtatccaggcagtacttgcagtgggacttaggagtgactcagagctgtgctggtttcaggtgtgaccccgtgaattcccaactacggtaacaatgtgaagagaccccttctgcttgcgaaaagataaggaagaataatggggacaatgtcttacagcttggttaccagctcagctgcaatggagcagaggaccaagcaggctcctccagttcccgattccagaccttggctcctggttgacttttttggccctaccttgggccaggaggttccattgccctgaagggagagacccctgcctggcagcattcaccataagccgattgaagagcctttggccttgagtgaatattggcagtagccaagcagtacttgctatgggcctgggatagtggtggccaaaaggagaaactcctatgcttgaatcttaaaatatgtcagtggcatgacatttaaagtggaaaggggagggaagagtgggaaagactttgtcttaagcttgggtaccaactcaattgtaatagaatagagcaccaggtagatcccaaaagttaccaaatccgggccctgtctcctggacagcatctccaaaccttctcagggctaggggaccatgctgctctgaaaggaaggacacaagcctggctggatttttacctactgattgtagagttctaggaccttgaatgaacataggaaataggcagggagtggacagtgtgggccttaagtgagacccagtgctgtgttggcatttagtctgaccaaagacagttccagtggtaatggccaaaggagtgctcatgtcaccatcttccagctccaggcagctcagcacagacagagactacatttgtttgagagaaagtgaggaaagaacaagagtctatggtcatccagggaattctcctggctctaacccaagaccgcacaggttgtacctctataagtttgcaagagccattcaattactgggcttggagtgtcctgtgaagctggtatgactgcagtgagaatacctaaatcacaatgcccaagtcactttaaatacctggaaaaccttcccaagaagaaaaggttcaaacaagcccacaccgtgacaaataaaatgagtagctaactcttcaatgcccagacgccaatgaacatccacaagcatcaagaacatccaggaaaacatgacttcaccaaacaaactaaataaggtgccagggaccaattctaaagagacaaagatatataacctcaaacggagaattcaaaataactgttttgtagaagctcaatgaaatccaacacagaggaggaattctaatcctgtcagataaatttaacaaagagattgaaataattaaaagtaatcaagcagaagttctagacctgaaaaattcaattgacatactgaagaatgcataagagtctcttaacagcagaattcatcaatcagaagaatcagcgagcttgaaaattatttgaaaatacagtaaaaagagacaaaactggaaagaataaaaaagaagaatacatcctgcctatgagagctagaaaatagtctcaaaaaggaaaatctaagcgttactggcctaaaagaagaagcagggagagcgatttgggtagaaagtttattcaaagtaataataatagagaacattccaaacctagagaaagatattaatatccaagtacaagaacattatagaccaccaagcagatttaacccgaagaaaattacctcgaggtgtttaataatcaaactcccaaagtccaggataaagaaagaatcctaaaagcagcatgagaaaaggaaccaatcacatgcaatggagctccaatacatcttgcagtagacttctcagtgaaaacgttacagagcaggagacaggtgaagtttacactgagaaactttaaatatgtctctggcatgacatatttaaagttctgaagaaaaaaagatgtatcctataatagtaaatgcagtagaaatatccttcaaacatgaaggcttaataaagactttcccagaaaaacaaaaaacagaggaattttatcaacaccaggcctgttctacaagaaatgctaaaatgaattcctcagtgtgaaagaaaagtatgttaatgagcaattagaaatcatctaaaggtgcaaaactcattggtaatagtaagtacacagaaaagcacagaatattgtagtaatctcattgtgatgtgtcaattattcatttctttagtggaaagattaaatgatgaaataaccaaaaataacaatgaagacaacttttacatacatagagagtacaataagatataaatacaaacaacaaaaagttaaaaagagtggggaagaagtttgtgttgagtctttattagttttctgtttgctttcttataaaatcagtgttgttatcagtttaaaataatgggttataagatattatttgcaagtgtcacagtaactacaagttaaaaaatatacgatagatatgaaaaaacataaaaagcaggaaattaaaacataccaccagagaaatcaccatcactagaaggaagacaaaaaggaagaaagaagagaagaccatataacagccagaaaaaataagaaaatggcagaagtatgtacttacttataattaataatactgaatgtaaatgaactaaactctccaatcaaaagacacagagtagctgcatggataaaaaacaagacccaatgatctgttgcctataagaaacacacttcgcctgtaaaggcacccatagactaaaaataaagggatggaaaaagatataatggaaaccgaagaagagtataagtagctatacttatatcagacaaaatagatttcaatacaaaaactgtaaaaagaggcaaataaaattattatttaatgataaaggggtcaattctgcaagaggatataataattttaaatatgtatacacccaacacgggagtactcggagatataaagcaaatattattagagccaaggacagagacagaccccaatacagtaatagctggaaaccattaacacgccatattcagctttaggcagatcatcaggacataaaatcaacaaagaaacattggacttaatctgcacaatagaacaaatggacctaatagatatttacataacattttatccaatggcttcagaatacacattcttctcagcatatgggtcattctcaaacatagatcatagttaggccacaaaataaatctgaaaaaattcaaaaaattgaaatcatatccagtatcttctttgactacagtggaatagaactagaaatcaataacagaggaatattggaaattggacaaacaaatggaattaaacaatatgctcctgaatgaccagtgggtcaatgaagaaagaaggaaggaaactaaaaaacttcttgaaacaaatgaaaatgaaaacactgcataccaaaacctatggaataaaacaaactcagtactaagaggaaagtttatagtagtaagcacctacatcaaaaaacatcaaataaaaaacctaataatgcatcttaaaaagctagaggagtaagagcaaaccaaatgcaaaattagtagaagaaaaggaatagtaaagatcagagcagaaataaatgaaattgaaaggaagaaaacactacaaaagatcaatgaaaaaagctgtttttaaaaatatagacaaaactgacaaacttctagctcgattagccaagaaaaaagagagaaggcccaaacaaataaaatcagagataaagagggagacatcacagccaataccaaagaaatataaagtatcattaaaggttacatgagcaaatttataccaataaattggaaaaccttcaaatggcatattcccagacacatacaactttccaagactgaaccatgaagaaattcaaaaccagagcagattagtaacaagtaatacgattgaagccataataaaaactcttccagcaacaaaaaagttcaggacctgatgggttcactgctgaattttaccaaagatttcaagaagaactaatacagatcttacacgaactattctgaaaaattgaggaggagggaatacttccaaactcattttatgaggtcaatattactctaatatcaaaaccagaaaaagacaaatcaaaaaataaaactacaggtcaatatatctgatgaacattgatgcaaaaatcctcaacaaaatgctagcaaaccaaattcaacaacacattaaaaaggtcattcatcatgaccatgtgcatcccagggatgcaaggatggttgaacatatgcaaattagtcaatatgatatatcaatagaatgaaagagaaaaatcatatgatcattttaatcaaggctgaaaaagcatttgataaaattcaacaaccattcataataaaaactctaaaaaaactgggtatggaaggaacatacctcaacacggtataaaccatatacaacagactcaaagcttgtatcacactaaatggggaaaaactgaaagcctttcctttaagatctggaacgtgacaaggatgctcactttcatcactgttattcaacatggtactggaagtcctagctagagcaatcagacaagagaaagaaagagcatccaagttgtaaaagaagaattcaaattatccttgtttgccgatgatattatctagtgtttggaaaaacctaaagactccaacaagaaacttagaaccaataaacaaattcagttatactgtaggataccaatcaacatacaaaaatcaatacctttcctatatgccaatagcaaacaatctgaaaaaatttaagaaattaatctcattcaaagtagttacaaataaaatgcaatatcaaagaaatgaaagatctctacaataaaagtataaaacattgatgcaagaaattggagaacacccaaaaattggaaagatatttcaagttcatggattggaagaatcaatattattatagtatccgttctacccaaagccatcttgaaattcaatgcaatccctatcaatatagcaatgatattcttaatagaaataaaaaaatatcttaaaatttacatagaattacaaaagacccagaagagtcagtgttatcctgagcaaaaagaacaaaaccagaggaatcacattacctgacttcacattatactacatagttattgtatccaaaacatcatggtactggcataaaaatagacacatagaacaataaatcagaatagagaacccagatataagtttatacgtctgcagtgaattcatttttgtcaaaggtggcaagaacatacactgaggaaagaacagtctcttcaataagcagtgatgggaaaactggatatccatatgcagaagaataaaactagactttgatcacttgccatatgcaaaaataaaatcaaaatggattaaaaacttaaatataagacatccaactatgaaactactaaaattcactggagaaactctccaggacattggactgggcaaagatttcttgagtaatatcccacaagcacaagcaaccaaagcaaaaatgaacagatgggatcacatcaagttaaaaagcttctggacagcaaaggaaacagtcaacaacataaagagaaagctcatgtaataggagaaaatatttggaaactactcatctgaccaaaaattaataaccagaatatataaggagctcaaacaaccctacagaaaaaaatctaatagtctaatttataaagggagaaaagatattaatagcgatttctcaaaagaagatacacaaatggcaatcaggtatatgaaaaggtgcttgacatcactgattatcagagaaatgcaactgaatactacaatgagatattatcttaccccaggtaatatagcttatatccaaaagataggcaacaacaaatgctgacgaggatgtggagaaaagggaaccttcatacactgtcggtgggaatgttatttagtacagccaccatggagaacagcatgcaggttcctcaaaagactaaaaaaataccatataatcccgcaataccactgttagatatatgtcccaaataaaggaaatcagtatatcaaagagatggaactggacatcattatgttaagtgaaatatgccaggcacaaaaagacaaatattcatatattctcacttatctgtgggagctcaagaaggtaaaacaattgacctcatggaggtagagtgtagaatgatggttaccagaggctgggaagtgtattggatgaggtggggtggggggagtgggatgtggggataattagtgggtacaaaaatacagttagatcagttagatagaataaataagatttagtatttgattgcacagcatggtgactgcagtcaacaataatttattgtacatttaaaaataactaaaagtataattggatggttgtaacagaaagaataaatgcttgaggtgatggataccctatttatcctgatgtgattatgatgtattatatgcctgtatcaaaacatcccatgtaccctatgtgtgtgtgtgtgtgtagatatatatatatgtgtgtgtgtgtgtgtgtgtgtgtatataaccctctctatatatagggtacatgagacacaaaaattacatatatatacctgctatgtacccacaaaaattaacaataaaagaaaacatgttctctaaaatgattaattataattgagcaattactattgatgtaaggatgggtagatttttttgcatgaaactggaaagctcaattcaaactggtgttcctttttgaacaaaaggcaacagcaaggtattctaaattattttggaaatcagtactaggtgaatcatgagtagaaaagcctaaatattatagaactaacattgagttacaagtcattgactagtctctgatgcaaagcgatatactaaagtaagaaaataataagtatagaggctttaccttaagatgtgttcttttcagttgacactgtgtcccatgtacttcctttattgtattatggcagcctatcgttaccatttgttgtatcaactcaaaaggctagggccatattccaaacatctccaccttcctctaaaaagcagttataaatccacaatccactaatgtacatgtatatacattatagattaggttaacatacacaaaatgacttgcttcactaactaggagtagcaatatatcatatctcttttattttgccaattaatcattcaaacaacagtagtttcctattagcaggaagtctaacatttcctgatggagtgcttcttcttccttgtcattccgggttgttcagctggctttctcaggccaaaagctagcagtcatatttccaagataattgcaaatttgcattaatcttctacgtatagtttcttattgccatatgatgccactattgaagcttagtcctgtccagttccataaatgttcaccagtttgtggtgatacatttctggtctaagttcctacattgttttccctgcactcttgggtttaatgtagagggttcctggttaagattctgagttctgtagtcctgtgaactgaatttgaatattgcctttgcttctttttagctgtgtgactaaagtcaagttattgaactttctgagcctcagtttcctcctctataaaatgaagataataatagaacttatctgatagtggtgttgtgaaaattaaatgagacaacacatatcaagcaaactgcctggcacctccaagatttgcaggaaatgtgtgcccttactatcactatgactgctactattattagtgatgcagtaatcctttccaggaggatagcaacatttcaagtttgctgtagtgcaaagcttagtgtcttcagtattttcctattggagagaaactggggtctctatgcaaattagtctaccttgagcccatggctctccgtactgcagcaattgacctcctgtttgtacatttctccaagaaaaatgggaaagtttatgataggcaactcatggataattaaatttgaatggtcagtacatataatcttactagtaactcaggaaaatacaaattggataaaaacgagataattttctatacccaattcatctacaaaaataaatttctgataacatcaatctgtagagttgtggcacaagggcaaacttcatgtgttgtaggtgagagggtaagtcattacaaccatttcagttcacactgtctcgaagttttagggaaaggaaaaataaatgtgatttattcataaactagaacattacatagtattaaaatgaagtgtgtgtgtatctgtcaacatggatacatttgaaaagcataatgttgagtaaaaaaataagcaaattgctaaaggatgtatagagtataccatttgcatacactcataaaacacacaaataagtatacatacatatgtgataaaaatattaaaacatacaggctaatattatataccaatatgaggatgttagttacttctgggaaatgagggcggcagaaaggaggaacagagtgtgggcgcagtggctcatgcctgtaatcccagcactttgggaggccatggaggtctgattgcttgaggttaggagctcaagaccagcctggccaacatggtgaaatcccatctctactaaaaatacaaaaattagccaggtgtggtgacgggtgccagtaatcccagccactcaggaggctgaagcaggaaaatctcttgaaccaggaggcagagtttgcagtgaggcaagatcatacccctgcaccccagcctggacaacagagtgaaactccatctcagaaaaaatagaaaggaggaacagagaaccgagaggggttatagctctctatataacattttatttcctttaaaaatttatggctatattgtaacatgtagtttgttacatatgtgtgatgtaggtaacatctgttacatatgtgtgatgggttcataggtatacataaaatcaatttttctttctgtaaacatcaattatttaataacatgacataaaataaagacaattggaaaaatagctcttttaggctttgagataattagaaaacacttggggaagaataaaattagatagctacttcatatcatatattaaagagaattccctgtggggtttaaattttaaataaaaagaaagtagagcagaagataatgtaggcgattatttgtctgatcttaataggaaaactttaagcatatagacaagagaaatttaggcaaaaaagtacattatttctacataaaattcaaagctctgctatgtccaaaatctataaacaaaatataaatgatgagctatttaaattggcattgttaacaggtaaaggatttgtagaaacaatagatataaaattatcccatgagaaaaatatgattatgacaccaacagacaattttcaaagggataaataacaatgaccaaagtgtgaatgtgttcaggaacatggttattgactctatgcctctcagctccaaattagcccttcagcacctgctccaatataatggactgcaatctttttttttcttttgaacttttaggttcaaggggtacatgtgaaagtttgttccataggaaaattatatataatggggctctggtttacagatagcttcgtcatctagttaatcagcataacaccgaatgggtagtttttcaatcctcaccctcctcccaccctccactttcaagcaggccctggtatttattgttcctttccttgtgtccatgtgtactcagtgtttagctcccacttataagtggaacaggtactatttggtttcctgttcctgcattaattcagttaggataatagcctccatccatgttgttacaaaggacaaactatgcatttgacaaaggtctaatatccagaatctataagaaacataatcaaatcaacaagcaaaaaacaaacaatcctattaaaaagtggccaaaggacatgaacagacacttccaaaaggagacatacatacaaccaataagcatatgaaaaaaagctcaatatcactaatcattagggaaatacaaatcaaaaccaaaatgagatacaatctcataccagtcagcataactattaatattattaaaaatcaaaaataacagatgctggcaaggttgcagagaaaagggaatgattatatgctgttggtgggaatgtaaattagattagccatgttgctccaaaggacatgctctcatttttttttatggctacatagtagtccatggtgtagatgtatattttctttattcagtccaccactgatgggcatttagattgattcagtgtcttcactattgtcaataatgctgcaatgaacaaaatgtgcatgtgtctttatagtggaaccatttatattccctttggtgtgtacccaacaatgggatttctaggtcaaatggcatttctattttaatttctttcagaaatctccagactgccttccacagtggctgatctaatttacactcccatcaggagtgtgtaagtgttcccttttctctgtgatcttaccatcatctgttattttttgactttttaataatatccatgctgactgtgtgagatggtaactcattgtggttttgatttgcattgctctgatgattagtgatattgagctttatttcatatgcttttttgttgcatgtatgtcttcttttgagaagtatctgttcatatcctttgcccattttttaatagggttgtttggtttttgcttgtgatttgtttatgttccttatagattctggatattagaactttgtcagatgcatagtttgcaaatattttctcccgttctgcaggttgtctgtttattaagtttcttttgctgctcagaaactctttaattaggtcttacttgtcaatttttatttttgaaattgcttttggagcctgcatcatgaagtctttgccagggtttatgtccagaatggtatattctaggttttcttctagggtttttgtggttttgggtttttacattaaagtctttgatccaccctgagttgattttcatatatggtcaaaagtaaggggtccagctaaaatcttctgcatatggctaaccagtcattcctgaagcatttattgaataaggtgtcctttctccattgtttgttattgtcagctttttcaaagacaagatggttgtacatgtatggctttatttctgggttctctatcttgtttcagttgtctatgtgtctgtttttgtacccagaactatgctgttttggttgctgtagccttgtagtatagtttgaagttgggtagtgtgatgcctccaggtttgtttgtttgtttttgatttggattaccttggctgttagccaggctcttttttggttctaaatgaatttcagtcaacagttctaattctatgaaccatgtaattagttgtttgataggaataacattgaatctgtcaattgcttttggctgtatggtcattttaacaatattaattcttcctatccatgagcatgggatgtttttttcatttggctatgtcatctgtggtttctttgagcagtattttgtaattctcattgtagaggcctttcaccttcctggttggttgtattcctaggtattttatcctttctgtggcaatcatgaatgggattgcattcttgatttggccctcagcttggctgttggtgtatagaaatgctactgatttttgtacattgattttgtatcctgcaactttgctgaagttagtttatcagttcaaggagcatttgggcagaggttatggggtattctagatgtaaatccatattgtctgtaagcagggatggtttgatttcctctctccctacttggatgccttttatttctttctcttgcctgattgctctgactgggacttcctgtgctttgttgaatagaaatagtgagagtgggcatccttgtcttgttccagttcttaagtagaatgctttcagcttttgcctgtttatatgatgttggctctgggtttgtcataggtagctcttattattttgaggtatgttccttcaatgcctagtttgttagtgatttttagcatgaagggatgttggattttgtggaaagccttttctgcatctgttgagaggtaatgtagttttttgtttttagttctgtttatgtgatgaatcacatttattaatttgtatagattacaccaaccttgcatcccaggaataaagcctacttgattgtggtgggttaaccttttggtgtgctgccagattcagtttgctagtatttgttgaggatttttaaatctatattcattagggttattggtctgaagttttctttttttcattatgtctctgccaggtttcagtatgtggatgatactggtctcatagaatgaggtacgaaggagtcacttctccttgacttttagtaatagtttcagtaggattggtaccagcatttccttatacatctggtggaatttggccgtgtatctatctggtccagggcttttactgattggtagcttttttattactgattcaatttcagaactccttattggttgttcagagtttccatttctccttagttcaatattgggaggtcttgtgtttccaggactttatccatttcctctaggttttctgtttgtttgcatagaggtgtttgtaataatctctgagggttttctgtatttctgtggcaacagtggtaacgtcttctttgtcaattttgattgtgtttatttcaatcttctctcttttttaaattagtctagctagtggtctgtcaatcgtatttatttattaagaatcaacctttggtttcattgatcttttacatattttttctcatctccatttcattcaattcagctctaattttcattatttcttttcttctgctagatttggatttggcttgctcttgtttttctaattcctctagttgtgatgttaggttgttaatttgagatctttgtaactttttaatatggatgtttagcactatatattttcctcttgacactgtgtttgctgtgtctcagagattctagtatgtcgtatctccgtttcattaatttcaaagagtttttggatttctgttttaatttcattgtttgccaaaaagtcattcaggggcctattgtttaatttaattttcatctaattgtatggttttgagagatctttttggtattaatttctatttttattgcactgtgatccaagagtgtggttggtatcattttttttgtaaatttgttgagatttgtcttatagctcagtgtgtggttgattttagagcatgtcccatgtgcagctgagaagactgtatgttctgtttttgttaggtggagtgttctgtagatgtctgttaggtcagtttggtgaagtgctgagtttgggtcccaaatatctttgttacttttctgtcttaatgatctgtttagtactgtcagtggggaattgaaatctcccactattattgtgtggttatcttactctctttgtaggtctcaaagaacttgttttatgaatctgagtgctcagttttgggtacataaatatttagaatagttgagtcttctcattgaattgaaccctttgccattacgtaatgcccttctttgtctgttttttaaaatcattgttggtttaaaatctgttttgtctgaaattagaatagcaactctagccctttttgttttccatttgcttgataaatttttcttcatctctttactttgagcctatgggcatcattgtacatgagatgggtctcttgaagacagcatatagttagatcatcctttgatatcctacttaccactctgtgccttttaagtggggcctttatcccatttacattcaagtctattactgatacgtgcagatttgaacctgtgattgtgttgttagctggttgttatgtagacttgattgtgtagttgctttatagtgtcaatggtctataaacataagcacatatatagaccatttttttttttggtggccagtaatggtctgtaatttccatgtttatcactttcttaaagacttcttgttaggcaagtctggtgggaatgaattcccttagcatttacttgtttggaagttattttacttctcctacacttagaaaacttaatttggctgggtataaaattttttgttggaatttcttttcctcttttaaaatgagcataatgtcaagctttgttagtagattagactggagggacattagtagggtaagggatgttctgctgggtctggtgctatgttttgtttatgctgctgaagttgcatcatgagccagttgtgcaggaatgtcagtacatacagtgtgctatgcctcagctatatgcccacagtgcacaccctctcagtgatctcacagcctcatcatagacttgttttacactttcatgtggtcctcctaatgcagaaactacatagtgcaaaatgagcctgcagaggtaccctgacaacccctgcatgcccacccagcaaccttggttacttgtaacctgaagggttgtaactcatggcttttccagagtgacaccatacactccaggtctgtgtccacagtggcattgctgtatttgctctcatacctgcccatccaccagctttggctcagctgcataccagaggcctgcttcctacttgctgggtgactgggaccaactctttggattttcaatgcactcaggaaatttcacatttcatggcaaataatttaatatgagcatactattctctttttgacttttataatcactcccagatagaatgttccatacccattatgcaacagaaaggacttgattctccaaaattaagtaattttgacttaagacatttttgatttatttgtaaatctttaccaagatttacaataccttaagaagaaaacacaaatactgctagtgatattcacttaaaaaactgcttacttatttgtattccaactgtagtaagcagatattgactgaagttggtatcaacaatcaagatttattgaccctaggtaaatattatagaaaataatatcaaggtcagtactggctcaagagaccattgatcttgtgtgaaggctaaaatttatcaatatttccattatagcactacctcatattataaagatttcttttatgaactgtagtcttcaggaagtttatggttcattctgaaggaggatgagaagaccatttagaaactgttagaattatgggcatgaagactaaacaatagtgtagtttagtggaacgtcacaaattgtttcctaaaagcacttttgcagtttatttttattttggtgattgcatttttatgtggagtgtggctggtgctaggatggtgctgttgtcagccatgtagaggctcatggaagaaatgtacagggaatcaatagatttaagaataaagatggcagagcagaactgggaggatgagcagagctgagaggagtcatttagatgttcacttgtaataatacttccctgttctgcataactcctttatgtacagttctactgtagtttgcagggttatgtcacaaagcggaaataagaaccacaggcagcagagggcaccacaaaaaaaaatatccttaggaaatatattcatatttttactgcagagagtaaactgatacatatgtattaaaataagattttgatagccagtgcaaattcttatttttgaaatcatgggcttacattaaaacaggactgactgctgccagaaatgagcaagaaccatcagtaccaaatcattaacaaagaaagacctatgtaaatttacaacaaaaatttattgaaactttcctgtaatcctcctactacagaatctaagaactctcaatagcaaattgtattgaaaaatatgctttatttgatcagcagagtgatctttcaaaagtggattattctaattgtagtttacctaaagaaatggtaaaaaaaaatttacagtggtatagtctttcagcaataattagaaaatcaatctttcagcagattattattaagataattgtggacatatatagataatatatatgtggtgttcacatataataagggagaagcctatgaggattattaaagatatgtcaattatgtataattcaaatatgtaatttcaagaaaaaaaggcaaatactattacgggtcaaacacagaagaaatacaaattctaatacacgtattaaaaagtttactttagtgataaccaaagagatctaattataattagcattaataatgtgattttttaaaaagacattccaaattttaataatacagaaaactacctagtgttggtaagaatttgcagaaaatggggtttttcacataatctcttcagtgaagtattagtcaaagctgagagaaagaggcttttgaccatgcaattttatttccaggaatgtatcctaagtaaataacaagaaattaagaattttaagcacatgatggtttactgtggcattattgaaaataataaaaattttaaaatactcaaaatgtccaacaattgttgagagtggtatcccccatgggtcctgagtattcatccacattcttggaaagtgttccagattgcaaggcttatatgttttgtgttctgagtagcttatgtagctagtcacatagtcaaatgagtaggtcaaggtgaccacaacctgactaccatgtaatttataacagcacatgccttgagaggagaagccctggcttatgtgttgctggctacagtgattggcagattgtcaaaaagcctcagacttttggtcctgggttcttctcttgtaatgcaatctttttttgtatacaggtgtcagctgaaagcatggtacaccttcctgggacttgacgggaggggaagacaatgcaaatatgcagatgattctatttcttgctgttctgtgagtgataaaatcttttttctcctacttacagtcttgtgtcttctgtcaccatccatgaatcagtaacaggttaactttttggcttacaagtagggtaaaaatctcagactcttcatggttcttgacacaacagggacttcactagtaagttaagtgcatttgaaagaggactaagctgctgttgaaagttacggtcttgaaaaatactatcaatatacaaaaatgttcatgacacattgattagagaaaaaaatgacaaaacagtacagtttgatatatatttttaaaagtatgtacatgcgtggaaaaattctagaagtgtacgaaaaggtgagtaagagcatcttaaaaacaattgcttcatgtttttcattcagtggttctcaaactttattgtgcatcagaagtctgttaagatactgcatgctcagtgtcagccccacagattctgattcaataggtctgggtggtgcccaatgacttgtatttctaacaaattatcaggtgatgctgctgctgctgctgctcttcagggaaccatactttcagaaccatcattttagtctatgtggtagttcagtgtactagttatagacatgaactctggagccagcttccttgcatgtctgtctgatcctgccatgtcacagtttgactttaagtaagttttaaaattagtcttgcctcattttcttatctggaaaatggggataaaatctccattttagtaagataatagcactaaagccataaaaattgacccacaatgtctaccatattacaagtgctcttattatgttgtgtagacatcataaatatattaaaaccaagaatgttactactggttttttgtgttatagctatggaccattgtagtgaacagagtataagataatagaatcaggcacactgtgtatactgtcacctatggtatttaatttactcatctataaaatggggcatcaacttctctcctgcagtttttggaaggcttcaatgcaattacatatatgaaatacctgggaagtaacttacatcagttaatattgattctcctgcttctcacaccacttctgaccaagcatcacccatatatttatcaaaaattcataatcacttatttgtttgaatgttctgaatgtttttgacttcagagataaatagcccaccctcttgaagcttacattatatggggagaaaattttaggtttaagactagaagctagaaagactagagcattgtaatggaaaaggaatattaggagtgagaaagtttgatttatctgctattctgctggtaatttaatgtttagtgttgagtaaatcttttatctgtgtttaactagtaaagtgagaaggttgggtatatatttctaagatcctttaaactcctaacagtctttcaatttaaaacttctaatgctttataaattaggtgtgaaaaactgaaataccttgtggaccagccataatagaaatttgtgaaatggctggcttgctatagagagtggtggagatacaaccacttggagagtgcatgcctgtctaaagacattaacattaaaattgtttaaaaaatatttagcctgcttttaaaaacacttaaagagctttgagataatcatcttctaaatacttgtagttggaatagtgagaaagaatggcattctgcctttaagcatgaagatgagttaatgctgcaaaacagaatatactagctctgttactgattaactctttgcatttctcatttcaatgcaaactgaaatcgtagtaaatgttgagcaagatagatggctaaataattttaaaaatctgtctacaaagagtcagcttgcgcctgaggttagaggtgtgaggtagagtgctctatatttgcactgcaggtcgctgatatttgaaaggcacattaatcatgttattaatgggtaataataaagaatcaaagtatttttattatacatgtatagagattatgacattgagttcattaaagcaaaaatatcctttggaagacgacttacagcaaatggcagagatcatgaaaagagatcgtaaaataaaagatcttgcttcttactaaaaaaattttgtcctgaaaattttcgtatatactactttgctggacttatgattttggaaaatgagacagggataaaataatctacttgcatccttgctttgatttaactcagaatgtttcggttttcacaaactagtgtaaattaaagagtaagaatgtcaaacgaatgttggttgtataaaatatgggttacttaggagaaaaaaattcactttgaaaacatctacaaggaagaaggcttcagacctcaaaaacaatgccatttggcatcacttttgggttttttaataatattaagaataagttttttccactaaggtgttagaacttcagaaaattattaaaaacattttacatttaaatatacattttacttttaaatttatttatttatgtatgtatttatttatttatttattatacgttaagttctagggtacatgtgcacaccgtgcaggtttgttacatatgtatacatgcgccatgttggtgtgctgcacccattaactcgtcatttgcattaggtatatctcctaatgccatccctccccctgcccccacccatgacagtttaattttactgacagtttaatttaatgacagtttaattacgtttaaatttgactaagaggccaggaagaaatctcttaatgttgaaattttgtagtaaatatgtttgattattttttaaaggtattgaaaacacttctaaatttgagaactataattttagcgtaatttagagcatacttgttatcacatcagcatgttgcgtgagtaatattttacttacttataccttcatcaaggtatatcgacatgaaataaactgcacatatttaacatgttaaatttgatgttatgacatatatgtatacacattaaattatcacagtcggtataatgaacattgcagcacaccctgaagtttctttttgcccttttgtaattctcccctccaacttctctgactctccttctctcccctgccgtccctctggcacgtctaataggattttgtcatgggagctctttatagtcccaaaagacacaatcctgtatgacataatcccaaatgttgaaatccccaaatctcaaaatcctagaaatacaattttggaaaaaatttaaaaaatttgtaaaaagatatttgtttacattttttaaatggatttatttgagaaacatataaaaacatgacaacacttcataggtcactttatgcaataaagtaggcaacaataacatacatatttttgcaagcataatacactgaggtatactattgacagtcacatgggtataatagttatgagcagatgaactacatccataaagaaataggtgaaaaaccaaaatgtatacaacctattactatgggtgctaattgtgtgtacctagctttataattgcagtcatctgaaatactgtgatgcacaactgaagtttttgaccagctcaaccaaaagccagcatcaccactgagccagccctccaaagacccaggatctcatgaattttatctgtcacaaatgcaaatgtacaaaaaggacatctcttcacttactgaggaagtttcaattttttaatgtatatgcatcatgtttacatacagtcaacattatgataatgcacttccatgaaggcacttttgcaaaaaatgtataaaatgaatttgaactcactaatagtccaacacaatttatggctccagtattggaaatgatgcaaagatggaatacacagcatagtgaattgtaaaaaataatgctgacaatttaaaatagtgggaaaaatgaaataaaagaaaaaaataaaaaactgaatagaaaattcaacatacgaaaaagggtatgacgaggtgacaggatagattatgggcaattgcatgcagacaatgtataagaggttgctgatcttcatgattattaactatattttaaggccttacaacatgataaatagctgcttttttttcttttttgacatagccattggagaatacattcacactcattttctatgtggtatttctctttttgaaattcttctgtgatttgatatacactgaaactagtatttctatcttctatgctatgcttgtatgttgtttttggtacttgaaaacccactttgcatgtactcatacacagaccacaaatttggtggaaataatactggtgatcaaatagcaacaccattgcataagtgccttcttatcctaccatgcacataattgttttaaagccagtcagtaacttcactggcttcttcaggcaaatgtggttttaattaattaaaatctcttgggaggtcatcagctagaaggaatgtcaacgcaggaaaatggcacatttttaaactgcagtttttatcattgccattatctcatggccaatccactcatctgaattttctaacaaatgcattgggttgaatggagcaaaacaaactttactggcaacactttgaaactcacttttagaagctttggtcacatctaattccaaatccatcattatagtttgcggactcaattgaattttttttctgcatttagacaataacgtggtaataagtcaatcaaacatgatgcaactattttgtgattgtgattctgggggattttagacattaggaagtttagacagtaggaatttggacattaggcatttttgatcttctgtaatttcagcatttggcattatggtgttcaggattgtaccgttcagaaaatgatccaaatccctgttttatgggctagtttgcaaattctagaatttaatatagatgacatcatatagtatgcactcttttttgtctagcatcttcaactcaatgtatttattttgacattcattcatgtttttacccacctcaacactccatttctttttatttctcagtagtagtttattgtatgggtatgctaaatttgttcatccatttgccatttagtttgtttacagttttttggctaatacaaataaagacaaatattcttttacaagtcttgttgtagatactggctttcttttcttgtgagtaaataattaagagagttgagtggctgatatgataggtgtaagttatattttttattaactgacaaaccatttaacaaagtggttgtgccattttaagttacaacagcatttcatgagaatttcagttgctgttcattctcaccaactcttagtagggtctttttaattttagtcattctattaggtgtgtagtggtatcttattgtggtcataatttgcatttccctagtgcatgttgaacatcttttcatgtgcttatatcttctttggtgaagcatctgtttcaatcttttgcccatttttaaattgggatgtttattttcttattattgcaatttgtgtctttcaaggaattggtctgtttcatctagcttatcaaatctgtgggcaaagacagttgttcataacattattttcttaatccatttaatgtccatgagatctacagtctctctttcatttctgatatcagtaatttgtgttttctctctattattcttagttagcttagctaatggcttattgttttctaagttcattatttttaatagataaataataattatatatatttatgagctataataggatgttatgatatacatatacaatatagaatgattaaatcaggctaattaacatagtcatcacctcacacactaatcttttctttgtggtgagaatattcaaaatctatacttttagcaattttgaaatatacagtacattattaaaactacagtcaccatgctgtgcaatactttaccagagtttatttctcccaattgaaatgctgtggtctttgactactgtctcttctttccctgctctcccctaatcccagtctttgggattccagtctctaaccaccattctattctctacttctatgagttgcgcttttttagattctacatataagtgagataaagggttgttagtttttccatccctggattatttcacttagcataatgtcttctaaatttatttacgctcttgaaaatgacagaattttctaccctttaaaggatgaatagtattgccttgtatatatataccacatttaaaaatatttatttatttttgatacataataattgtaaatatctaaggagtacatatgctattttcatatatgcatacaatgtgtaatgaccaaatcagggtcatcagaatacctgtcacctcaaacattcataatttctttgtttagggaacatttcaagtctttccttttagctactttgaaatatacaataaattattgttaactattgtcatcctactgtgctatcaaacactagaatttattccttttatcttactgtattttcatacccagtaaacagcttcccttcctcctgccctccccactactcttcccagctttttctaaccaccacctattcttcacctccatgagatcaactttttctttgctcccaacatttcttgcaaggcagatctctggcaacaaattccctgaatttttgtttgtctgagaaaatcttcattttgccttcacttttgaagaataatttcataaggtacagaattctaggttagtgggtttttcctttcaacattttaaatgcttcacttaattattttcttgcttgcataatttctggagaaatcagatgtaattcttagctctgctcctctatgggtaaggtgtttctaactgtgccccaccccacaccccacccctttggctttggtcaagattttttttttttatctttgattttctgaagtttggctatgatatgcctaggtgtcgttttttaagcatgtatcctgcttggtgatcttcaattctctggtttaatgtttaacattaatttgggagaaattctcagtgattattgcttcagttatttcttctgggcatttctctctcttttttttttccttctgttattctcattacatgtacatttcacctttcggagttgtcccacaggtttttgatattctgttttgtattgttcttttatagctggaatccaggttgaggactatcttttttattagctttaagtaaagtaactaacaccttttcagttggtagttgatgcttttttctattctgacaccaacttattgggtacctttggataagttaaattttctaattttcttcagttgcctaatgaagggttagagtaactgacattcttgtggcacagaaaaacagtgcttatatttcgccttaacaaaacagagttctaattttgttctgatactaatttccttatattgttagctgacatatatatatatatataacaaaaatatttctaaataaaaaataatagttaacatttattgaacagttactcattgtgaggtgttcatgcaagcacttcacatgcattgactcaggcctagtgggtgagtattgaaatgtctcccttttacaggggaatagtgagtaacagggaggtgaagtaacatgcctagggtcactagctggtggatgctggaatttgggttcaaatataggcaattgggtagaaagcccacaattgtgtcaactattttctcctgatgtataagactatttaaaattttctttattgagaaaaatataattccatgaattaataagatcttatgctttaattgtaaaaagaaagctttatgttaaacatttggttagtttagtatcttggtatttttttttcaaagaactgttaaaaagtttcttaaaatctttttacagcatgtttaagtctcttgtaaataagggtagtgggtaaaaaatattaattaaaatatccaccagtattcttttcaattatttggtaatcaaaaattctgataatatttcagaattttcttaagtattcttcttttaaaatcaactaattttatatttggcaattctcttataagtttaggcaaatagtgtaaatgaggcagagtgctttgtcaacatgatcatctaactacagatactaataattaaaaagggagaggataggtgaaaggaaaagaaatcctacacacagactctgttttatttatcttgcctatactaatcctatatttcacaataatccctaaatattcctagagaagactgaggtgtaaacaggtaaaatgattgcacaatctcaatgggtaaaaagtagaagagaaaggatttttattcttgttctgatgccaaaccccttgcttttggcaccagactgatgtgcttctttatgaagtgaaaatagtgacattggctggctgaacctgtctgttttgacagagctaagagtggcaggtaggtcaggggcattgtaagtgcctctcaagaagatacaaactactccacaaaaaataaagacacctttgaaatctaagatatccagtctgtcaaataagaactttctgacccttctttcctttgccttctcctgttccaacattaaccagaccagattcagtacaatgagtgaggaaattgaaatcgaggagcaaggtggataaataaagatgaagattccaactcaactgttcccttaagtgctcttagttggaggaagggagaagtttggctcaaatagctgcaagtaattttgttatattagacaggactctttgttgcctaaaagttgctagaaaagctgtatgtttttatcaggggtatcatctagggctggagaagatcaagtttccccagtcagtagtgagaaaaataatttgtttcttattttatttgaatgtagctatttcaataaacagcttcattcatacatattattttctgttacagaaatctgaaaattaggatatgccttcaaaagatttacagaatgaatatacaaattatttcaagatgaaggaaaaccatctaagattccagcctccgtgaattctagaaatccctgctaatttctaacctttactcttctgtgtacctgcagctactcagtgtttcatttttgatggtagcttctttggacaattgctatttgtgcagtgcactttattttgtgttcctcattgactgcttattattcaatgattttttaaggatcaagttatcttaataattattaaaagtagatttagagaggcaaggccaaatatttctcctttccttaactagtaggactttataaaaatctatttgataatgttctcaacttttctgcttgtattgcgtccatagctcaagtctgggtaacatattgttttcttttcttcaaaacggccatgtccaacagagtttctgctgctacagaaatgttctacatttgtgctgtctgatatggtcatcgtgtgccactatggagcaccacctggtatgcatcatttgctatggagcactaaaatatggttcatgtgactggagaactgagtgtttaatttgaacttaattttaaattaaactaaatttcatataaatttaaacagccatatgtggctagtggctaccatgttggatagtacagctatagaaaattcatttctaaaattgaataaacctctgtttcccacaaaactctccttgtggacctctcattttgttgcatgcattcattccactttaaagaatatttcagagtagacttatttctttttctctttttcttagaagtaaacagataagcaagccttaatttagggaagaaatgcttttgcaaaagctcagtatttcaggccaaagtgtccatttgtctttagtaatatttggctttgaaatgttgttgctgttggcactaaatgaaggtttaatttccatgctttggtgatggtatcgatgcacattagcagtgtgtgcggtacacacagcgtcaagcaaacagccacatgcatcaaggtttgtgcttaacagtcctgcctcaggatccctgtggattctttgagtatccttttaaagactctactatctgttctatgagaggaacagatgcatctttctatatagtgcagtcagcaaagttcaggagaggggaggccagatgctattcatatttctttcagagtgtagcgtatatcagtggtacttaaaacccgtcttctcaacagctagcacctcttttttaaaaattggtttccattttggctgtttgagatcaggaacaatggagctttcctttgagttaatttctttcattgattattggccttttaaaggcagtgctttaaggtatactcgtatttttattttaaaacctgtttttcagaagtttctatctttatgaggaaaacagttgtcttatctgtagtcctttgaaaatgagatgatgattttatatcaaagtagatacttttgctcacagtattatctttctttcagaagtaatgtgtattgtgtaccatggataaagggatgagaaaaaaactaagtatacatccataacttattacatatattgtgcatgcatgtgcacacacacacacaaacatacaaatcagtttgatcctgcaagtggaagcaacttcattagaatacacctgtatatttgtatgtgtgtaaatatataagacagaattgcttttatttcatacatgacataatacttggcaaaacaattatagggaattgaacaccactaaaatttagctttagtgtatattttcttaagaaaatatgatttcttcatacaatgtcaaacttttcttggtagcagatatgattagtccctctggctttttttcctcttctgattggccccttaattctcttgggcttttctagtgatagagagctcactactccaccaggtagcctatcatattgttagctagcaactgctttaagaaaactgtaaatattagagctgaatttccctccttataacatctattcattcattctatttttgaccattttggtaagtatattttgcttaaaagatctgcatataaaggtcagcatgcaaaccccattgtatttatgtatattagcaacaaacaattggaaaataaaaaaatttttaaaatatcatttacagtaacatcaagttacataaaatacttaggaaaaatttaacaaaatatacataagtccatgaaaaccactctaagacatttatgagagaaattaaagatataaataatgaagaattatactatattaaagtcacagcagatttttttgtagaaatagatagtatgctgcaatttaaatgtaaatgcaaaggtcttggaaagaatttaaaaaggaaagaacagtgacaacataaactgctctagtatagacgacagagtgagaccttgactctaaaaatcacaaaaccaaaaccaaaaagaatggccaataaacatataaaaagatgctgcgcatcattagtcattgggtaatgcaaactaaaaccacaataagctacaactatatacttcctggcacgatgagagaatttctttggattggcaaagatgtggagcaattggaagtctcattcattccttgaggaagcattaaaatgtgcaactattttggaaaatattttggcagattcttttaaaatgaaacatacacttaacatatgatcaagcaaacctactcttacatatttaatcaagaggaaagaaaacatatgtctgcacaaaaagatctgcacaagaatatgacagcttgaattattatagccctaaaatgaaaaacatccaattgtcaacaggtaaattgttaaataaatcatggtatatggatacaattgaatagcactcagcaacaaaaagaacaaagtaatgatacatgcaacaacataaatgaatgtcatgctgggtatgaagaacccaaatgcaaaagagtatatatactgcatagttccatttatattaaattctagaacaggtagaattaatttgcagtgatagtagatcagtggttgcctggggacagggatttgacttagcaagggttggtagtaaatgttttggaatgatggaaatgttctagatcttttttttgtgctagtaatcatctaagtgtccacatttgtaaaaattatcagtatacttaaaattggtgaattttattatattaaaattatagttcactaaattttgttttaaaaataaggctaaacattcttttttttgacagaaagaacttttcagagctttattttgatttcatgatttggatgaaattgaggtaggaggcagtacttgactctggaggcggcgcttggacaccagatcaaattgaggactaggtaaaataggggtgaggtagaagcagagttccataagacacacccatcagtgtgccatgtcagtttaccattgccatggcaatacccagaagatactgcccctttccatggcaatgacctaatgatccaaaagtcactactccttccatagaaatttcttcataaatgacctcttaatgtacatgtaattaaaagtaggtataaatatgatagcaaaactgccctgagctgctaccctctgcctatggggtagccctttgggagcagtcgcagagctgtaacaccactggagctgtaacactgatgctttaataaagctattttcttctatccctgacttgctttttcagttctttcctggacaaagccaagactcagcttgcttgccttatatcaaaattgttaaaccattattagaattgtttttctgcttgtagcatatgataactctagtacataactgatatcattcaactatttacaaaattttacagttaatgaagccaccccactaacagctgtcatttcacctttcataagtttgcaaaagtaagtgaaattaatttagaagaagtcttttgatcataataaaaagttatgcttcatagagttgtacacgttaaactattgtctttgatcacattttcctgaaaacagctattaacttttgaagtggatgctgatgcttcttcagcagattctgatactttttgtttttcaaagacgagtcaatgaaatcactataggtccatatgtagatgatgaacttgagaacacattgcaaattacatgtccatcaccaattttcttgagaaacaggatttgaattcttattttttaaaacaaacatgcatttatgactttttagtttctcatgaatgaaacagttaattgaaaaataagctaaaatgcattaccaaacaataaagtaaataggtattcaataaacttcaaaatccccgtggttacagtgttcagactactctttatacagcagaacatctcagcctgtatccctcacgtgtttcacatacatctagcataggaatgccccaattgttcacagaccctgctacatggtagtgtggcaacttcttgtgtttctaagaggaaacctaggaatggctctataggcgtgtgacaagaacattttctcagggccccactttcaggagggcctgacttttggttgaaaactgtgctgtcatcctcttggaattcttcataattttatttttgaagtcgtgttttgtaagtgaagtctgaggggatagtaaagcatgcgtgtgagcagagtagtaataaacaacaaaattagatggaagaaaataaaagcaacgtgtttttaaatgtggcagaaaattctgatgtagttttcttgctaatcaggaccgctagcagcttttattttcctaggctgaagcgtagttcaaagggtacattttgattctggctttgctggtttttcgagattttaaatgtcttcttgttttggtgggatagctgttttgtggattgtaaagctgtgtcatatttcatatgttctgtgaaaggatagccatgttggaaacaaactgggcatattttcagaaaacatttgtctgttgattgacatttattttttttcatcgaaattgatggttttgaattataaaagtagccaaagttactgtaaaaaaatactgaagtgcatgacacaaaaaaattgaaaacccagactcttacccctcactatcccataatttggcttcctagagggagctagaattaatggttttgtatctcttcttttggaatatatctctctgtgtgtatgtgtgatatactgtaacttgcttttttattctcaacaacatattgcagctatccttccatgtcaatatgtaagtatcttctgtagtttatggatatactataaatttttaaaccaatcccgaattggttgtttctaaatttttaaaagtaaataaccggtaatgaacagattttttttaacatttatcatttgtaatacactttaaggacataaaatgacagaaaggacataggggcatgaaatagctgcattttattgtaaattgttagctatattatgaaaatcaagcactctacttctgcataataccaagatagcatccctccctacttactggctgagaatcctgctttaggctaattctccagatctgaaaataaagattctactgcaaggttctgctaaggatgacaatcatgaatttgctttgatagttgcaaatgcaagtaattaaaagataggcccctgcttccccttctttcttgagttagtgcttcagggcaaaggatcagaaactcccctgcagagctgccctaacaatgtttaatgagcactagggaaagcttagttttttatgcctaaggcttcaccacttttactgagtagtaagatcagaaggattgcagcctaaaaggtgttcttccttatgactcctgtacaccttcagattccacacacgttgaggctctcattaaggttgcggttgtgatgcctgcctcaaaggaggggattgacagttattatgatcaacagggctgacagtttggattttggctttttcagtggtgttgctttaatattcagcacaaagtcttccagctgccacctgtcctcactcatctgtagactggaggtctctccagtagggcctggccttgctcctcctttgaccactgcctggccgtcctcattcccatcctggggtgagtcattatctctggtcctactttgtatcaaggagttcaagaaggtttttgttctatttggacacttgcttttttctgacatcagctgaaatctcaatgacttcacaaccttccctccctcccctactcatcaacctgggtgccaattgattccaagtcctctgaagaattctgtcgtctttctttgccttcttttagatttttttccttaccctctctctaatgtttgtgtttactttttgaacttttaatcaatatcaaataaaaacaaatctagacttaagtaaggagatactttattgcaagagggggaaagagacctttgcaacagtggaagggacactattgcaatagggagaatgcttgggccatgagatcggcaagcatctgaaaggttggtcagataagccttgtcttttagagggaggaataaacaaggaataacaagaactagatgtgaggaaataggatgagtgagtggctgtgaaaagccacaagacaagtgaatgttttacaccaaggtcaatatgcttttgggaagggctctatgctggcccagactgaggctggatcaatggccaggggcctggaagaaggagagaagttaaccaatggggacaaaacagtcaactaatcattcataaggccaagaacaggaagaggaatttggagcttctgcgtctgatcttgtcatacgtagacaagaaggggcatctatgagtcttgcataagtcatgtggggaaggatatttctttataataaggtggtttccatggagagatttaacagtcgctgtttcccaggatcacagtgttcacgcaaagttcagtgttgctgttggtcatcctcattctttgtccccaatgtgactattcttttcagaaatgtggtttctgactccctcatgcctgcacttgagattcactaggcttatcattacctctctcagctcttgtcttacctaaatttttttctttggaatttctgttgctattattttaaaaaatgttcttaacttataaaagagtgatgaaagtatgtaaaagaaagtggagtcaattccactgaagccacaggaactgagagcttgatgggtggctttccaaatgataattggtgccaaagaagtgggaaagggtagggcaggataataatcatttttcgtttttttacatgattaagtgaaggtttaaaatacaaagcctttggggagaaaaaggtaattttgtaataaaaatgcagcacatgccgatggcctaagaagtatgtaaaaaattacagcaaaaagttactgactctgcttattcactcccttattttagatccattatccagaaacaatactttttatgttttcacttatttattctgttagatactcccatatcttttattaatatgccaataaaatgtatctttctttattaatctaaatagtgtcattaattccctgataggccggcactacatagtcctatatcctgctcactgctacttttagtccaattgatgaatggtataaatatattgctatgattatagaaatatttttattgaaaaacaatatactattttaatgtttcttttcctgtgtggtttttgttttgtttcctgcagctcaccattaccttttatttcacttacattcttttttcacagtttcagttttctcaaattctcattatatctggtagttcacttccacattttaccatgatcctggagtcctcttttgcccttctccactctgtaccatggaactctagataagcttcatgactgccatgtaggtttttcttctctatttttttttttccaagttagatcctctattttcttgtcttctttcttggtttactttctccttttgcagaagtcacattttaagtaactttctatgaaaaggtgatagggaggtacattgtttgagttttaaagtatctccattctgctcttttatctaaccagtaatttggataggtgtaggggtctaactacaaatcatttttccttacaactttgaaggcattgctttgaaacaatggctttctagcattcagcatggctgttgaaaacgctgctgtaatttccttgctacttctttgttgatggtctgtttttcctctggattcctttaaatactctctttatacttggtgttctaatatttcacttaaatttgtctgggtttggctccattttcattcattttgcagggcccttgatagggccttcagttctaaatattgtttctgtaataactttctctcctttttttcccaatcttttctccctgaaattcttttaattggatattattctttctggattaatcctctgtattgctcatcagaaaagattatatcttatatctcatttgcttattgtttgatttcagggagatttctgtattaaataaaactttattgttaccttattgatgaatttataatttgggtgattgcatttttttatttctgagaaatgatatacctttttcatgttatttgtttttataattgtcttctcttatctgtctggagatactaattagtactttttagaattatatattgattttgtttgtgcctgttctctgaattagctctctttttcctctggagtaattttttccctactggcttatctctctatctctgttttgtattgtaagttttccttaaaagtttggtaacttcttcctctggagtaatttttttcttattggcttatctctctctctctttctctatcttttatattgtaagtttgccttaaaagtttggtaacttttgattgtctgtttctatttataaatgatacaataaaagatgggtactagtccattgtaggtgaattagatttttccattggtggccttatttcagagggttgaatggagatctgatcattatgctgtgggattttgcatgtgccaagatatctctgaggcatttcggttttttcaggaagaacattttgatacattgctcagggcaagacgcttagctagtgagttttgatcctcagatgtcaagtcaaacttgcatatactaaatttcagtttatctcgcagttttcagtcttcctaagtacttgacatttctgagtggtaagcctcttgggattctgcagagaaagtgattttccctcacctgtgtgcccttctgtgaatgctttaggttacattttttctgtcctccttcctcagttatatacctgtgtgcagtcctcatgttctagatatttcttggaatgcattctctattctttcctcccatagccctaatctatggatgggtatttataccttttttattcctatggctttatttactggggtcttggtaaagaaaggagataataatagtcaatctgttacttccaaacgtgaaattttgggtttttcaaagttttgtccttgcatcactaatttactcagcctagtcgaaaacttgatcgtcacaaaaaatttgctctctaaatatatccattcaggaattcacagcaaaaacttggaaatgaaagttgtgaaggagttaaaaatataccaccccgaaatatgctaccctggcatcttgactattttgaattaaaagcacttaaaaaaaaaacccagcagttgcaagatcattctgacctttattctgtttcttgaaagcagtaaatgaagttcccatgtgaaagatgccttctttaaagcaaaggagagtagcattcttataatcaaggatggaaagttgaagctgagagaaatctgcacagacaaatcttattaaactgacccttatcttcctggtcacttcgttacccagttaactactccagcataagccctctgccttatcacgtgtcacaacttaatattctttttccattcagtgtgcatgtgattgactttagctgctcctgtggatcttcatttcctcatgagtgcaccagtcaagtaaaacttacacaaataaatgtatatgcttttctcctatttatctatcttatgtcagttttattcttgggcccagcaggaactctaagaagttgaaggtagagttttacagccccacagtggttattatggattttacttagaatatataaaaatttataatttttatttaacattgacatcatttgacattccgtgtggacattccctaaactcacaacaacattctggaatctgacattttccttcttacaacctcattacaatgtttgcatcttgtaagaggcaatgtactgggagtgagatgcctgtttttactgcactcttgttaagttaggtgatttggacatattgttaaacatctattagcttaaatttactggagagattagatttttaaaaatcatttttaaattctcttcatcactggaatttcacatttctctaattctaaataagatgggatatttagcctgcattctagaggccagtcaaatgtcaagaattgtgacaatgtctggcacaaaatgggtgttcaataaatttgacttaacaaaaacaattagaattggaatctaaattcactccttcaaccaatcaatgagcgagagcgagtgcttacagagcgctttttttttttttttgtgccaggcataattctaagttggggaagaagcagtgaatagagaaagcatgagggtctgccctcatgcagcatacattctagttgaaaaacacaggtaataaaatagtacaaaaatatgtattcaaaacaattatggtaagggctatacaggaactaaacaaagtaagcaaggcttagaagatgatttgcaatttaagatcagatgcccaaaaaaggcatctccggggatgtggtatctaagcaaagacctaaatgacaagaaggagcctggtaagagcagagctaagagagagtgctccaggtagaggaaagatttacctcatgcaaaggtgttgaggcacaaacatttggagtgctgagaagctgccattttcagtctagtgatgagggtgaggttgaaaaggtaggcaggagacagagtatgaaaattttctaaaccaaagtgaggaatttgaattttattctcttcaatgtggcttgttaggagatttttaaggtacatagttacacgaactgatttatattaaaaaattataaccttcttagctatatcaggaatgaacccaatcactctatttacattacaagctactctcatctgacatttttcatctctcgtttgcttaatttttctccttagtatttgtcaccatctcaaatgctgtatatatttacttattatttattgtctgctgttccaactagagtgcaagttctataatgattaggatttttgttgttttcacattcccagcagatggaaaagtctctagcacattgtgtgctcatagtaaatatgtattattgaattaatccatggatttttaggggaggaccaggctgaagtagagcaagaagatcagatacaaagctacagtaagaatatatatgagatatatagagttttagacaagaatggtaggaatgaaaataaagacaagtggaaaaattcaaactttattttggaggtataattgacgacatttgatgattggttgaatgaagaaaaagtgggaaatatgaggaatcaagaatggcttgtaggtttttatctagcaactgattgagattatggaataattttctgaaataggacagttagaggagaactatatttttgggaagatgttagtaagaatcaagactctcatttgatagccaagtgggaatgtcaagtacacaactggttaaataatctagcactcatatgagaagccgttgggagatagaaatttggtacttatcagcataaagatgggctatataaagctactgatgctaatgagattactgaggaaagcacaaggctcaggaccaagaaatgcatgattctaacatttaattgtgaggccatcaaaggaaatggagaagggcacttggatattgtgagcctagggagagctctagggaagaaaagcaaaaatggaagtcaagaaagtcatgaatggccctgttgaacgcagctgagaggaaataagataactcagaagtgtgcattcatgcttgataagagcaagtgaattgtactgattggaatgaaacaaattagaaatggttgaaagttgtattagcctgttttcatgctgctgataaagacatacctgagactgggcaatttacaaaagaaagaggtttaatggacttacatttccacatggctggggaggcttcataatcgtggtggaaggcaaggaggagcaagtcacgtcttaacatggatggcagcaggcaaagagagtgcttgtgcaaggaaactcccatttttaaaactatcagatcttgagactcattcataatcataagaacagtgcaaaaaagactcacccccataattcaatcaccttgcactgggttcctcccatgacaagtgggaattgtaggaattacaattcaagatgagatttggatggggacacagccaaaccatatcaaaactgaatcagaagtaaggaagaaaacaactttcattgtgaataggaggaataaagacagcaatagaaaaagagggtatattatttaggaaatagggggccaactatgggaataaactcttcaactgacagtggataattgggaggtgctctgtgggcatgatataaaaacatattaaaatataatattttatagtatttcatatcatatattttgcatcatataatattgtatgatatttcatatcatatttttatcgtacatattacattatatatttatatttttatatattatacatcatattttatattatatatcatattttatgatattttatgatattttaaatcataagaatatgatttaaaaatatcatctgaagagatatttttatatgcctcagtaatcaaggctacttaattttattatttattaagatatcttcaactctaatgactgcaatatcagatgggtggcatctgaattatctgaatctctgaccctgtggttactgtcacaagggagctttgtctagaatcttggctcttcttggtacttgaaacatgactctgagcttatgtttgttcatctactgtttgggaataagactaatgcccaccacacagggatttttgtgacattaaatgaaataatgtctctatgaattgacttgaattatttatgtctgtacaaaagataaaatgagtatttactgaaatatgtatgactgtacccaattggtcatagtgcagcttttattttcttccctaaaacagtgttagataaaacatgccttgagggaagaaaactacattttacccctatttgtatcctcagtactcagtagtgtgcttagctcagaactggtgctcatatatgtctgctgaattaaaaaaatgaaacaccaggcaattacctgtaaattgtaaagcaagagagaattaggtataactacattagttctggttttgtagttctgcccctgatatactggaatagggaatggttccttacaaaggatccatttggcgcttgaatgaaaaaagttgcttaggaacacacatgtgtagctgtctttcgtatctacctgaagtcacacaatggtgtttttgcttccaatttccttaactgtttcattattattcacccataactagtcagataatttgttgtcattttacctctaatcatattttgagaccaacatttcatttcagtcttgaaagttcatcaataaaggctcttggatttgattctgaacattttagtcctttaccacatgttctaaatgagtccattgtagttgttgaagattccttgaagaccaggcattaaacctatcaggaagtcctaagaaacaagacccaagaaagtgctttccattgcctcaacttgttagaattagggcagaaaaaatgacttaaggttttggtctaggtgtttgtctctgtgtgttcatccatcttattttgtcattaactttccttcctcatacctgctgagccctccttatggtctctcctgtctaaagtcttgtgtggtttaagatacgaaatggaagtttcagcaatacatttttctcagtctgtaggaacaggtctgtagtttaattgtatcctgcacagggagacacatggacctttgttaataaattagatttggattagattagtttagatttaacagaaataatctttttcatttgagtggaaacaatttaaattaatgagataaaatatttaagttcagcatttatctcttgcccattgcagggtttttgcatctaataagatcaaatatttaaaaaatgctatgttctctaagaaccagaaaaaggacactgactggcatttagagaatattgatatatctataaaaattattacagagtttagtggggccagattatgtatttaaaattgaatacataaatcctggatctatatcaaatgttggcatcatgtcactatagtcgattaggtgaaattggttttcagaaatatatacatggggtagggtgtgggttatctcttcatgtattagatttatgatgttgtatagtttggcaacatataataataccttaaaacattcacatcatttaatttcactcttgaggataaatctagagtaaaaaataataaattccctgccacacttctaaaaaccaacacaaccaaccaattccccaaattccagaaacatttaatgtagtaatagtttaaaatattgaaaaataaaaacaatgtcaatagtcaaaatagggagttaggtgaaatatgaagccattaagaggatgtatagtgaagtatttgtagttctaggggaaaagcttatgttgcagtattcgatatgaaaagctgtacacaattttaaaatgcaaaacagctccactaactaaaacataccgcagagaaaatagatcagaaggaaattcgccatttatcagtgattgtgtctggtgattttaatttttttctttataactttgtgtgcttagttgttgttgttgttttttataatggacgagtgttactattatcatcagaaaaaagtgaaataaacttgtgtgtaagcagctcagtttagcgatgatgatttatcctctgacatccactggtcactggtgatagccttttgatgtggtgtcttcctgtctgaaagtatttcccatgttctttaaaacctttgatcccattcattctgaaagcagcacaaccttgcaagtcctgagtttgcagctttcttaggggattttcagatgtgatttttaaaaattagatgtatttcataaaatgttatttttcttttatatcttgaaatgtatttatgctaaaactttaatcacaagcctagtattggtttggtggttattaagttattgataaatgtctgacaatattaagttgaaatttttttttttagttttattctgaaaatgacctaaccttccttggaaaagtaaacttcatctttaactgagattgacactgggtactacgcgacaaaattgttagtatgctccacctacctccaaaaaggatttggtacagaattcctgaatatattactgagctgtctcatggaaaatcctaatttatatactcacctaataactctttattacataataatcactattgcacttttcaaactttgagacattttttcattcatgtcaaattgagtcatttttttcattcagcaaacatgcaatgagcacctgttatgtaagagatgtgataacaagcaatagatccaatattacagtgtatttaggtatgtcaagattctaatccatttggtaaaatcacaataaaaatgaaatatgcatttcgattatataagtgcaaatatacttaactatacaagggtagggatttttgtctgctttgtttttcctagctcctagtaaatagtaaatgttaaataagtatttgttaaatagatgaacaagtgaagtgtactgattatgaacctttaagaggcatgtggataacaagaaggagacattttgtcaaaagtcctgaaaatgggagttaggcaaaatgaatgtgaagggcagtccactgactcatggctaattcccaaggagaatggagggcaagcccacttctgtctatgctgccatagtttgttctgtcattgctttctctcagtgaactgctcccacacatctcccagtccatgttgcagaggtgcctctctgctagtgcggagaatttgctccacaaccttatacacaaatcttgcacaatgggatgctgcctgtttctcttggtccctccagaaatttagtgtaaaaaccagtctttccatctttgctttgcttccattctctttgggagttaggcacaagaaaatctttttaaaattagctcttaaattcataaacagacaatagaagacaaagaagccctttgattaatgataaacagtggcatccagcaatcttattctttagtatttacccaagagagatagaatcatatgtccacaaaacatttgtaaaagactgttcccggcaactttattcataatagcccaaaatggaatcaatctaaatgttctgtaagagaagaatgaataaacaaattgaggcatatacatacgtacattagaatattatacagcaataaaaagaaatgaactactgatacatgcaacaatgacatgtttctcaaaaacattatgttaaataagaaaggtcagatacagaaacatgtggttttgggcataatgttattccacttacatgaagttcaagaagaggtaaaaccaatctagggtgatagaaagcagaaagttattgcttgagggtggaggggaagggaggaaatgactggaaagaggcacatgagaattttcaaaggtgatgaaaatgttctttggtttagggtgacatagccatatacaattgttagaacctatcaaaatgaacacttgagttctgtacattttactctatatatgtaataccttaattttttaaaatgagaaaataaatattttgcgaattaaaatataagataaatccatttaaagtaatacgtatttactaagcatgagtatcctggctgctgttcaaggcgctggaagtataaacatgaacaagacatagtacctcccctgatgaattcataacctagaggggaaaacagatgtggaaaaacagatattaaccagtattttattcacacaaaacttttcagaatataatatgtttccagaatataatatgtttccagaatatacccaggtataaaatggattatgttttagaactgtataatagtcatcctaggtaaataattttactattgtatgaaaaatcttcagtctgccaaatctgatagttgtgtcgtggtagaaagcctgtagcatggctcctgaatgtgttcctatccttgtggagaccccttccacaatgtaccaggtttgatatgggtgactgataacatatgacagaggtgagggtaagtcatttccaagattaaggtataataaaaaataatggtctctgcattatggtctttcctgtctaaagtcttgtgtagtttaagaatacgaaatggaagtttcagaaaatacgtttttctcagtctgtaggaacaggtctacagtgtaattgtgttctacacagggagatacataggcctttgttaataaattagatttggattagattagtttaggtttaacagagacgatcttttcatttgagtggaaacaattgacattaatgagataaaatatttaagttcagcatttatattctgtattggctactctcatgcacactctgtctctcatatctcattttgggagaaaccagttgacatgttatgaatactcaggcagccttagagtgacccaagggaaaagaaatacagacctctgtccaatcgtcagtgaagaagcgggacctgccaacaaccacatgaataaaagcacaccctcccctgattagacattcagaggagactgaatccctgctgacttcttgactacaacaacctcctggaagaccttgagccagaccaagtttagctactcttaaattactaaccgacaaaaattataaaataataaatatctactgctttaaactttgagatagtttgttgtataacaataaataaccaataaatatgatctttcctaaatgtacaagatatgagttcatgggttagtgaatcattcctgcttttaaattgaacatctcaattttcttgttttactaaaatactagtcaatgactaagaaccaaagatttataaaaatatggtacacctaattcttataataacttatactcagtaaatcgtgtacttactcaaaaaaattacccccgaatgaaaacttatggtatatgtctattagatcaatgcaaaagtaattgtggtttttgtcatttaaaactaatggcgaaaaccgcaattatttttgcaccaacctaatatctagttaccaaactaaaacaatacaaaactataacttaataaaatttaactgcctctccaatatgaaaggtcaattttgtattattgaaatgactaatgaaaaagcaaatgaaaattagagtgaatttaaattaataatcataaccttcattttgaccttcaaaatatataatagagttccaattcattataattgagactgtgacttcgtttacaaaaaaacaaactgcagaagtaattggactgctttttaaattaaggcaacaaaatatgaagttttagaatagctgagattattgctctgccacttgaagatgaccagtctttacccccttgaatctttagatttaaaattataccacttattagaggtattaatttagtctaaactcatttcttcattgagaaaacagatgttggtggctgtcacaggaagtatttgatgtacctggaagcataaagtgatctttccttctccagctaaacagaaagtaaagaggatgtagattcttgcctgagagtatttaccagggcttccccctagagcttggtagctaaagccataaacacttgactgggtaatgggatcaattcttatttctgggagtctgaaaggggattatggaaagccactaagatgataagtttcatgttactccttttttggttccagaccagtgattctcgaatttggcatgcattgaatcatatggcaacctgtgaaaacatagattgctggtgcctatacctagaggtttgtgtatagtaattgcaagatgtggcccaggaattagttacccagtgatgatgctgtttctgctgtccagggaccacattttgagaacaactggtctagaacgtatgatttctgtttgtctttgggagagctgtgcttgtgttggtggtcagtcttcatcgaggaagtggagcctgccaacaaccacatgagttagcgtaaaagcacaccctccctgatcagacatcccgagggactgaatccctggctgacttcttgattacaaggtcttcttggaaaaccttgagccagaccaaattaagctattcttaagttaagatactcttaaattcctaactcatagaaattatgcaatagtaaatatctatttatttagcagtgaagaggaggaagctaaactacatttcttagacactttggtagttagatgagttctggtcaatagaatccgcatatggtcttaaatgccacttgcaggtccccctgccctaaaacatctcaggtaatcttccatattgtcaccctgtcactctttgggcagctgaatgaaaaggattacgtggagggaaggctttgagaaaagcctttgcatgcttgtttcttctaattattcttctcttaagaagactatgggacataatcttcccataatgaactatgtgttatatgactaccaaagtcatgaatttggcttgggcaatagcatgcctcagcatgtagaagtgggtatataaaaataggcacaagtatgtcctgaaaaacacatgtgagtggcatgaaccagtagatcagatgctccacaccttactcttgctacacgtctgcctatctctttacccatacctatagccttatgggacattccctatgactaattgacagaggaagaaggactatttagccttatttatagatactactgcatcatatggtgatgcaagtaaaaggtcagctgctctagcactaatgtgccctgaatactgtgggcagagctctgaatactttgtttacttgcctgaaaagagaggtagcaaaggtatgtatctaaagtaatcacagggcagcaagctaacagtttgtttagaaggaacttagaaatcacaagcttgatggattgctgaaaagcaatctagggaagacttctgtggataggactcttgcaatggggacatagagaatatttaaatcacaatattcaaatactcaatactcaaagggaagccatttgagtaaggtttttgataatgaagtagacaagatgacctattccatggatgtcagtcagccattcctgtgcttgctttaatgggctaatgaacacagtggctatggcttcagggatggaggtggatatgtatggactcaaaattaggggcttactttaccaagactgaactgtctgtcatcaccactgagtaactaatctaccaataacagtgtctacttttgagcccctgataatacaccactgtctgggggaccagccaaccacctggtggtgcattgatcacattggatctcttccatcatggagggggcagcaatttgtcttcataggaaaaggcactcactctgcctttcttgccttcaatgcttcttctaatactatcatctatgattaattgaatgcctcaaggtatcacacagaatcttgcttttgaccaagaaagatattgtacaataaaatagcagaggtaatgggcttaaatccatgtgggagtcaggagaaggagatgctggttttatatgatattccttcactgcaaaacacagatggcctgacagaacagtggaatggcctattagattcatagttacaaagctgccctggattacaacacttaggaatttgaggagctgtcatatgcaatgcaatataagctgtgaaccagtgactaatatgatgttatttcttcaatacaaagaatgcttgagtccaggatccaagggattgaaatagagtggatttattcactcttacccaaaatagtcctctcacaaaatttatactttctccttctgcatgttttggttctctggttaaaaaactattatttcttaaaaagagaataatcacactgggagactaagcagggctccatttaactggcagttgagattgctacatggttacttcagccttctcaggccattgaatcaacaagcaaataagaaagttgctttcctgactgtgatgactcatcctggttatcagagggaaacagggtttctactacaaagtaagaaagagtatgtagaactcaggagatttttaaaggtatctcttggtacttccatgaccagtggtaaaagttaatggatgataatagcaattgaagtcaaggccacacatggctcagaccatgcaggaatcaaaacatgtggcagagataagcacatggaatgagttgtggaaaaaataaatgaccagttacagaaatgaggatggtgataactgcatatttttttctttgtttattatatactaaagaatgtgttaatcatttctcctaccccattttttttgctattttatgtaagttatgtgactggtggctagccctttgtctagtagggctgccatagcaaaatagcacagactggtggctcaaacaacagaagattttatctcacagttctgaagtctaagagttcaaaagcaaggtgccatcaggcttggattttcccgaggcctctctccttggcttgcagatgggtatcttctcacttcatcctcacatgtgcttttctctgtgtgcatgcacccctggtgtctcttcctcttcctctaaggacatcagtcctattggattagggccccactcctctaacctcatttaaccctaattacttccttaaaggccatatctccaaattcagtcacactggggatagggtttcaacacatcaattttgggaggacataattcagtccttaatatcttataattcagtatgtacaatattaaataacaaaggatactttgagaatagacatgaacatcaacagagttggatacagtgaattatgggactcgagaggcaaatgtcttctcctttaggtgaaaggatgaacctgcttttatttgtgtaaggaatacattcaccaagttaggtgaaagcatactattgttttttaattttgttgtttcaaaacttagatattggtaaacaggtatgtatggatggtgagtatccaaaggttaggactgaatgatactgaggatcatcccagtctgtctaagctatctctacaactacttttctaggctcttctcagcaggcctctgattaaattctgccaataagagacatttgtgtaattcttggaaagtggaagaaaagaagaagctattattctttagtggtgactatggacaggtgtgtggttatcatcagaggtagatatgatataaattttgtctcattctaggccacttcttgagaatcggctactttaatggtgtgggctgctgagatccttcacgggggctttcctgtgatccatgcattctgactcctgaaagctagcagtggcctttcttatctttactctccagccattctgatggtaatcttcttattcatctcaatggctttccttttcatgacctaccctgattgatacaattgagagcatatatagttatgcatgcagctgatgaggagattgtaaaaagagtggcccatgagggctctatcttatatagatttatggtataaaactttgaatgttatgagtcatcactgattgaccctttgaaggccctcaggatattgttccagaattaatgactcttaagggagagactttcttgctggaggcacataggtgatttttgttgagaagaatccttggggtagttagtagtattttcctaaaggcaaatgggggtaaaagaaggtgggtttttataaaatagagaaatctgatgtctgggaagccaaaaagaggtggcattaaagcaaacttgttttgtgtttctctcttgattattgaaaatgttttatttgtgacataatttaacttttcacattctatgtgctatttcccttgaattacccaaacttttcagtaaagtctatttgatggtgttgccgagaaccgtgggacaaagtgagaaagtaaagtgtcatttactgtctcttactatcatcgcattccgtttgtaaagtgtcatttactgtctcttactatcatcgcattccgtttgtaaagtgtcatttactgtctcttactatcatcgcattccgtttgtaaagtgtcatttactgtctcttactatcatcgcattccgtttgaggggagtgtgcacctaactccaggtggggatcagtgggaaacagtggcctgtggaagagtgagaaacagcacagagaagggcgtgatgttaatgagatcatttggtaagggagtgagactgactttctgctttctaaaaagaaaccacagggagctgatctttgagagcatggggttggatacttgggcatatgagtaaaataaaagaaatggattagctgccttctaaatccactttcacttttaagaccctacagttttataacccctgagcagaaccctccatacttctgatctatttcagtgccattacttaaggcatcacggtagctggatgtatttcttttgaaacttggtccttgaataccgtgtcttgattttccgtctcttgaatctaacaatcggctagtggaaatgggaatctcagatgtaaaaataaaagatatattttatgggtcaggttttacaatgaatgaggatcttgagtataaaaatttgaagtaaattacatggttaatcatggctgtagtgtcttgttatttgaattgtctttctttagtaactggtctcttaagcagcttctcttctaatagatcctcatgaggttaattagatcactcatttaacagtcatatttggcttactcaatctttgcttgcttgtcctcagactcatttagtagttcaaagtcaaacttgctctcttgttacctaaattctgacttcatggtttctaaaagttttccaagagtaaaacttggaaatcacgttttacttaaaccatgtttaaaccagtttactttaaccaagtaaaacccctttttgagactaatatgatccacctggacaaaaaaagctatctgcttccctcttatatgccttttctagctgattagcctctgaacaatagacatactctttttttttggtggtttctgcatgacctgctccaatcagtccccttaccttttgagctcttttttctctaagagcttttctagttctcttaattcttaatctcagtgtttgtgtagctgagcttccccctcacttgttttatgtcatgtgacataatccagggagtttcagtacagcccaatctagtaatgaaaataactgcttctacaattaaattggtattatgattatgtgtcagggaccaaaggtgaattacatgatagaggctttacaatgaaattgcataatgttatagctgcaagggacaagaagggtccaatctagtgtgattctctcattttacagatgaaaattatgagaccttcacaattgtttagtgccctattagtaactaatgggaaaacatcctgattttggctcactgcaaactctctaatatcatactgctactttgatattgtttttatgatataaatatagagttggtaactttcaaatctcaaactataatttccctttccctgagcaactgttgttaagattgtgtgtcaacagacaaaaatgaaagattttgttgttgttgtttgtaattttaggtaggcaagttaatttctgcccttagtttgatgcagattttattttcttccctgagaattttcctagaatgttctaaaggattatattataatgacttaaggcagggatattttctgaaaacggcccattattctgttactctcctttcaggcaagtttcaattttaccaatttaaattacatggaggatagttattggaacttcatatttggattagctttgttttttgatacctgaagcagcaaccttactaatgaatggagcttgtccggcaatatattggcaactacatatcaaggttggttaaacttagttgtgagggctttcaataatgggctactctagggctatgcacaaaagccatatctgaacatgtaaagtggaaaattgaaacaatttatgcatcttgataattcaaataaatgttctaacatttacctcaattactttgaatctgcaagaaaatgcgttcctatgtttgaattagtctgaaaatggcctcagagttttattccaatttacatgtccagatatagcttttgggaaatgataatagtgatggcttccattatgttccaggcactattaggtgattttaatatattatttctaccctcataccaactccacaagctaggcattgttattcattcccattttacccatgaggaaactaatctcatagaggttacaggatttatgaacagcttgaaatagtaaatttctttgaagaaaattggcaaagtgatgaaaaaagcaatacatgttgttaagtcttggcgaataaataaatgctgcaacattatttattggtttgaacagacaagaagttaaagcccaaagactttgcacctccagtagtcttcactcctcttgcttggccatagtgtgatggtgattttggattttgccttcctttctttgtgactttagatcattatttccatgctttctttttctttttttttaaaagtttaattttattttccaaatctttaagtgaagaagtcgaaaccaaaagattaaaaaaagtgtaccctctataaaataacgtatgtcaaaataccaagttacattctttttctaaggtaataatttgccttagaaaattccaagctatactggaatgcattaacttgctacaattttgacagaggcagtctgtgtgcacaaatccctcgaatactgatgggactgtgattctatcctgaaaaaagaagagtctgaatacaaattttagagggctagaaagtgtttaatgtctcattgtttgtatcaagattctaaatcacattcaagtcaatgactctgatcttcatatcaatgcacaaatggaacagaagataaaagccaggaaagctgttctctgagtagaacactgattttgttctcatgttaccagcaagagaccatttgggatatgtaagccccaggttgagtgcttcgcatttgttagagctcctcaatgtttgaaatgggttttccctttagggagcccatccatttggacaagtgctacatcagatcaaaagacatgggaagaggtattttgtgcacagattgaatttttttttggcaacataacatagccttttagcacaacattgtctattctctactgattgttcttttctttctttttttttaaaaaaatagttggagtctgttttccaatagtgtcaggctttttttcatgtggcaaattggctagcagccacctggagatcatttgaaatgaaagctggtgttaagggatttggtttttcagctccagttgctattattttctagattattaaatgttaatcaaattgctcactgtattaaaattattattctaatttttgtgttatttactatttgggaaacacaatataaacctttaaaacttttagttactatgatattctttttaaaatgtcatagaaatactaaaataattatgtctgtagtttttagtctctttaggttcagtggaagtcagtatcatcagcatcttaagtgtatcatcactttaaaattttttcacgggaggtagtctgaacccaaatcgctactttaattataaagaaaggttaacccagcaataggaagtagtgaccacattttatttccaaaagctgatgctgatccatttaaggtgaacattgtttgcaagagctttgaacacacaaattcctggccatgctgtgcagtgaacaaatcccaagtggttggagactgcaccaggaagaatgccattgtgggggagcattaagaaatgaagaaagggagggaaaaagtgttgttctgctttcctctatcatgcatttaggataattcctggcatgactgattcggttttcccctgctgtcattagcaatcgttgccaatcatggttaatcatctacttccaaaatgaaaagagatttggctgagatgcagttggaactacttctgctgcatccctggggatgttactggaaatttaacaaattcctgtttccaaactactgtcttctgatacgacataatggaaaattggagcaattattcagataatatgtgcaaacagtaaattttcaagctcagttcactgaagaaaaatctcaatctctgggttaaagtcttccctgacttttagtacttcttgctagaaccattattttttttggaattctacttaatttatgtttgaatctctctacatcttgtatcccacagtgcctgacatactttagttgctagataacattttattgtttgtagctaattattttctttgtaaatatgaaactgtatagcatagtagttaagagcccaggatctggagtcagactccctgggttcaaatattacctcctccactcaatggttgtgtgacttgggattctctggagcctcatttctttatctgtgaaatgggcatagtaatattaccatttgtaatattagcggtattcagttgatataaacctgtgtgccagttgttaaaacactgaaattcttccatactatttggtaagtagttgcagcctcaagatccctgaatgcttccccttcacctcactgcctcaaagcacctttgcccaccacagtgattcaacaagaaattatttgctcaggagagggtctacaggatgctgcttcagcattatgtttagcatctgtcctcagaggttagtgcccatgttgcacgtgttaataaaggtttttaatattattctctttatagggttcttttggattaaacgagttgatatatattgatgtttaggatagtaccaagtgcctattaagcactgtccatattcctcttattgtaaatagatagtaactctctcttattataaataaatagtaacttatcggccacgcgtgttggctcacacctgtaatcccagcactttgggaggccgaggtgggcggatcacgaggtcaggagatcgagaacatcctggctaaaccagtgaaaccccgtctctactaaaaaaatacaaaaaacaaaaaaaattagccgggcgtggtggcgggcacctgtagttcccaggtactcgggaggctgaggcaggagaatggcgtgaacccgggaggcggagcttgcagtcagccgagattgcgccactgcactccagcctgggcgacagagcgagactccgtctcaaaaaaaaaaaaaaaaagaaatctcatataagtggagtcatttagtatttgcccgttgactggcttgttttacctagcataatgtcctcaagttttatcatgttattatatgttgcaaaattttcttcttttttaaaaatggataatatcatatatacatgtatatatgtatcactaatcatcaggaaaatttatatcaatatgcatcatatgatcaaattcatgtcatatgtatatacatgtatacatataaagaacacatttttatttatccatttatttattgatggacatttagattacttctacatcttggctattgtgaatggtgctgcaacgaacataagagtgctaatctcttccagatcctgacttcagttcctctggatatatacgcagaagtgggattgctggatcaaatgtgacactggtcctgcacagcaggaaaaccaactcacaccacttgcacttccagctggaggaacagtctggctgtactgcccaaggtgaacttgcccttgagccagtcaaactgctcgaaacatctcccaagggagagaagtccttgagccactgagcaggccacatgcccacaggctggtggaacaaactgtgtgctcacagccaaaactttagaaacagtgttgtgtggcttaccactagcagatatgcctctaggccagctaagtagctgtgcacctgcaatcaggacctaagaaacagactcatggtcactcctggcagacacaccccctcagaccaactgagtagtcttgcatccatgttctgggcctgagaaacagtcccatgaactgttcctgataggcatgccaccaggatacttgagcagccttgcactaacatcccagacctaggaaacatctttgggggccaccctcagcagatacacacccaggtgaaccaagaagccttgtagccatgtcctaggcctgcaaggcagcaggatgcccacatcttgggtctgagaaacagcctaatgggatgcccctggtaagcacagcccaggtcagctagcaaccatgtgcccatgtcctgggcctgagaaacagcatgatgggctaccccaacaacaactttccacccatgcccctggctagagtaacagcctgtggttccagccccagtgagccagaccccaagttggctgacccacaatgtgcatgcatgcacccctgatctaagaaacatcctgaggagtctatccctggcaaagccacacaccaccattgcaaactctctcagcctaggccatgagacactcgtgaatgtcactagtatggattatagctggagaaactatatggagactacattactgcattcccctagaaacaaagccaatgcaacccactcaacagacataccaagaccctgttaaattagtgtgttttttctatgaagcctactccataaaattagaagaggcaactgttctaccagatgcacagaagacaacatagggacacatcaaacatgaaaaaaaaaaaggacacattcaaaggaatgtgataattcttcagtaacagacaccaattataagactatatacaaaatgccagaaaaagatttcaaaacaataatcttaaggaaattcaatgagctacagataagatagatagacaatccaatgaaattggaaagtattaatgatttaaacaatcaacaaagaagtataaaaaagaaccaaacaggaatcatacagttgaagaactcaatgaatgaaatgaaaaatacaatcaagaacttcaacaacagacaagaagttgaagaaagaatgtctgaatttgaagacagaattattgaaataacaccggcaagcgaaaaaaaaaaaagaaaaaaaaaaagaatgaagaaagcctacaggatatacaggacaacattaagtcaacaaatacttgcattatggatatttcagaaagacaagagaagggtagaggtgtagaaaacatatttaatgaagtaataattgaaaacttcccaagtattgggaaagagagagaggtgtagatccaggaagctcaaagaaccccaaatagattcaatccaaacaggtcctctcctagatacattatagtcaaactgtcaaaaggaaaataaaaatacaacatatcaaatctatgggattcaacaaaagcagtactgagagggaagtttatagcaatgaacacctttttcaaaaaagtagaaagacttcaaataacctaacaatgcactaggttcaaggaattaggaaagcaagagcaaaccaaacccaaatttagtagtagaaagaaataaataatgatcagagcataaataggcaaaattgagcctaaaaaatacagaagatcaatgaaaagaaaagttgcttttttgaaaagataaacaaaattgaaaaaccattagctagactaagaaaaataaagatccaaataaataaaatcagaaatgaaaaaggagacataacaactgagaccacaatgatataaggaaatattagagattgttgcaaacatctatacaatgctttgggagctgaggtgggaggatctgttgagactgggagtttgagaccagcctaagcaatatagtgagacacatcatatttaaattttttttattttaatttttaattttatttttccacaagttattggggtacaggtggtatttggttacatgaataagttctttagtggtgatttgtgagattttggtgcacccatcacccgagcagtatacactgcacaaaatttgtagtcttttatccctcacccccctcccactctttcctccaagtccctgaagttcattatatcattcttatgcctttacatcctcatagcttacctcccacatatcagtgagaacatatgatatttggttttccattcctaagttacttaacttggaataatagtctccaatctcatccaggtcactgcaaatatatatatatatatatatatatatatatatatatatatatatatatatatatatatagtgtcttatatatactatatagtgtctttttctactcgtcgattgatgggcatttggattggttccacaattttgcaactgtgaattgtgctgctataaacatgggtgtgcaagtatctttttttgaataatgacttcttttcctctgggtagatacccagtagtgggattgctggatcaaattgtggttctacatttggttctttaaggaatctccacactgttttccatagcagctgtcctcatttacattcccaccagcagtttagaagtgttccctcataacagcatccatgccaacatctactgttttttaattttttgattatggtcattcttgcaggagtaaggtggtatctcattgtggttttgatttgcatttccctgatcattagtgatgttgaccattttttcatctttttttggccatttgtatatccttttttgagaattgtctattcgtgtcctttgcctgctttttgattttttttttctgatttgtttgagttcgttgtaaattctggatattagtcttttgccagatgtatagattgtgaagattttctcccactctggggttgtctgtttactctgctgactgttccttttgccatgcaaaagctttttagtttaattagatcccagctatttatctttgtttttattacatttgcttttgggttcttggtcatgaaatccttgcctaagtcaatgtctagaagggtttttccaatgttatcttctagaatttttatagtttcaagtcttagttttcagtccttaatccatcttgagttgatttgtttataaagagatgaggatccagtttcattctcctacatgtggcttgccaattatcccagcaccatttgttgaaaagggtgttattttcccactttatgtttttgtttgctttgtcgaagatcagttggctgtaagtatttgggtttatttctgggttctctattgtgttccattggtctatatgcctatttttataccagtaccaggctgttttggtgactatggccttatagtatagtctgaaatcaggtagtgtgatgcctccagatttgttctttttgcttagtcttgctttggctatgcatgttcttttttggttttgtatgaattttagaattttttttttccaactttgtgaagaatgatggtggtattttgatggggattgcatcgaatttgtagattgcttttgggagtatggtcattttcacaatattgattctacccatccatgagcatgggatatgtttccatttgtttgtttcatctatgatttctttcagtagtgttttgtggttttccttgtagaggtcttttgactcctttgttaggtatattcctaagtttttaatttttttgttttgcagctattgtaaaaggggtttagttcttgatttgattctcagcttggtcattgttgatgtgtagaagagctactgatttgtgtacattaatcttgcatccagaaactttgctgaattcttctatcagttccaggagctttctggaatagtcctcagaattttcaaggtaaatgattatatcgtcagcaaacagggacagtttgacttcctctttaccaatttggattctctttatttctgattgctctggctaggacttccagtactatgttgaagaagagtggtgagtggccatccttgtcttgttctcgttctcaggaggaatgctttcaactttcagtattatgttggctgtgggttcgtcatagatggcttttattacattaagcattaaggtatgtcccttgtatggcgattttgctgaggattttaatcataaagggatgttaaacttcgtcaaatgttttttctgcatctattgagatgatcatgtgatttttgtttctgtttgtgtggtgtatcacatttattgacttgcatatgttaaaccatccctgaatccctggtataaacccacttgatcatggtggattatctttttgatatgttgttggatttggttaactattattctgttaaggattttagcatctatgttcatcaaggatattggtctgaagttttcttttttggttgtgtcctttcctggttttagtattaggatgatgctggcttcataggataaattagggagggttcctttgttctatatcttgtggaatagtgtcaaaggattggtaccaattctttgaatgtctggtagaattctgctgtgaatccgtctggtcctagacatttttttgttggtaattttaaaattaccatttcaatttcactgcttgttattgggtctgttcagggtatctaattcttcctaatttaagctagaagggttgtatttttctaggaatttatccatctcttctaggttttcaagtttatgtgcataaaggtgttcatagtagccttgaatgatcttttgtatttcagcggtgtcagttgtaatatctcctgtttcatttcctagtgagattatttggattttctctcttcttttcttggttaatcttgctaatggtctatcaattttttaaaatcttttcaaagaaccaactttttgtttcatttatcttttgtatttttttgtttgtttgtttcaatttcatttagttctgctctgatatttgttacttcctttattcttctgggtttgggtttggtttgttcttgtttctctagtttgttgaggcatgaccttagattgtctgtttatgctctttttatgctctttcagactttttgatgtcagtgtttaaggctgtgaactttcctcttagcacagccttagctgtaaccaaaggttttttttttttttgacagagtctcgctttatcacccaggctggagtgcagtggtgctatcagggcttgctgcaggctccacctcccgggttcaagcgatcctcatgtctcagcctcccgagtagctgattacaggtgcccaccacctgtaatccacaaaagccagaaagttaacttgactcagctccaggtaaagtcagaaacttctcccacaaacagatcttcagcttcttccctttcccacttccacagctggggcactcacagtatttcaggtgtctcccaggtcctgtaggagcagtctgcttccttcagagagtctgtaggtcctcttgggattgctggtttgtttttgcagttggtctggagctaaaattcacaatgcaagcctctgcatgctgctctgtctggagctgcaatctagtcctgcttcccatctgccatgatcccccatattcaataaattttgaaaaaaaaatccacagccaaaagaagtccataaaaggctagcagattgctgaagagtgtttctgatgttcgtagcctgggatcaagtggcttaagatgtgtgtttcaagatgggtagttgattaggattggccagattttgtgacattatctgattggtagagaaagtcttgcaaagtgaatgcttgcttgataagtgtgaacagttgattgcctgctaggagagctgattgcttagatgagtagactgtatggataagtgagtatttctgaagcaaagattgatgtattttattggattgcagcattatcttctggggcaaaaatgtcctgtgttacattgatacttgcacctcctgtatctcagtcctgatagataaggttatggaatcacatggcctcaattctcaaatactatggaagaaagaaaatgtagaacatcagggtaaggagactgggatgccacagagggggcaggttacagtgtttaattgaatgttcaccagtggtcttgtggtgaaaatgagattttattaaagacttgcaggaggtatggatgatatcaaagtgtaatatatggcttattgtctacttgattaaatttctctagatttagcctgggtccaagtttaatgtaagctaattactccttagaatggtcaagaaaattctactttgtccttaactttttccaaatatttataataaaacatatgtttgcagttttaattttctgttaattgcctcagcacaaagctttattctaattgaagaaacttggttgaagtgtcggagaataggaagcttaaggaagggtgaggtgtgcatttaagtattcatcatggggtcatttttgagattcttctttttatctcttcattgctttttaactaacctgaggatgctctgagtctacaaaagagacaatgtctcttctaacctgcctttaatcaatcctctctattaacaatgtcccactggaaacatccatttaatgaccaactgttaatttttgtttttgtttaagaacataccatgttcttcaattttgcttcaactttagaatgtttttagaaattacgtttaacttttgcattttgagaaccattatttcatgctatagatgacttttcttctatttaaaatcttagtgaccacttagcaggcagatttgcattgttcctaactagtattataggaaaatctatcctgaaatgaacctatttgattgatcaatagctaaagtaagccaagtggacaactttagttcttttttagaagccacacaattcaaaaactagataacagcaaatcaatttttctaatttataattcagcaagataattttttgaattttaattttattttccggattaagtgttgttatagcaaagctaaaaaaaaaacacactgaagtctaatgttaggtttattcttgaatcataaatagatttttctatattgaataaatgcacactttccactaaccataaggtaattaaggcacactgtgtaatgtggacttttaattcaaagagacaacgcatatgctaaatcccatcagatgtgggctgaagaaagaatgcaacttctgatttcatttttttctgcagatatcagtatataaattcattcaaagccaacaaaaaaagagttttattttcctctcaataaagtgtgagttatgtttaaagcaggtactggagtggtaatttgcactgctgaatgcacagtgagtatttatttaatatatgttgagtatttaattaattgacctccattattgcagttcgagaaacagacaaataatacatcatccggagtttcgtccctggctctttcacataagtttatgccactcagtttttcactaccatgtatcttccaacctaatgtattcttgtgaatctgggcttgagatcagaaataaagaaaatttaatttaacatgaaaaactgcattttcagacttttttaattctctgtaaccactagttctatattttattaataatattgtctttgaattcatgcattttacataattttttcctttttactactatttgtggtatatctgtataggttgccacatgaatacctaccattgattacaatctttctaagcctcataataactctatcattattcccattttccagataaaaaagctgaggattaaagatataatgtaagttgtccagtttcataaataatattattaattttttcaaataccccttatgtcagaagacttgactcaacttgacattaccattaggattgccctgttgtccacatccattcaccaaccatactgcctcccacttcttcagggagagtggcacatttcatctgagtggggacttagatcaactgaaggccactcttcacttcattcttctttggtggataaacctaatttcttcttttcaatcaagaggcatttcttaaatgaaaaaaacaaaatcaacgagcttgggtaacagagtttcttaatgtccttaggagatgcagaacccatgctcagcagagagctaagaatctttaatgccttccaagagattgtctgttggaattcagtctgtatacagctaagccagattcagtgtgcttgtagtcagaaatcagaataactttctgaatctcacacatgctttttgttgtgcaactctcagaggctttctgtagagggtacagcaacctagctaattccatgcaaacttctgcagcaaagaggttcaagagaaagaattattcagggtaacataaataaataaagactccctttttgttgcttatatatgccaacaaaaagaggactattataaaatttcatgtaattataattactttatcattctaacaaaatctattagctaacaaattccttggccaattattccaagtgaaacagttaccatgcactttggaaaacaagattaagacttttataagtcatatattccatatttacttgcattcttatttttcaactaattacttagttcaacctaatttatcttcatgttcctgccatggggcaaccataaggtatcttgctttgagaaaccatgatacatttctcttaatgccaagatcacttacaaaaatatgattgctacatattcaagttctatatttctacaagttctagcctaataattactcaagcttgaattccttttataaacctgaataagaagtattgactgaaaaataaagtaagcaagtatattttcatgccagaaagggatcttacacttgttcatggttaagtgacaatgaataataaatatgtggacagaaacagcactactcatttgcatttaagaaatgcagttatttccaaatgtgtctacacttactgcaatatgttcctcaaggtccctgtgctccaggtcatctagtccagcccagggcaaagttatagggtgggtgaaatttgccttcatatacaatttcaatttgcctatttcttagtagtgcttttcctgtaattattcctttattctctgctcacgtttttattgtcctgatactttagtgtaaattaagctatacactttttctagtgtattttcgtttttattcttctctttgaaggtgttacaagagactttgcctccaataccaggaaatttagggatccttatctggtgtgtaattccactgcagtattttagtatttattaaaaagtttatttaaaataaatgtataatattggctcctgtttatttcctaaaattctcttattccagattgcactctgactaaatgcatgtttatgtactttaaattaaaggattataatagcttcctgtatgtcatcacctcattcattaattttcccatctccctttactttttttttttttgagacagagtcttgctccgtcacccaggctggagtgtagtggcatgatctctgctcattgtacctccgcctcccaagttcaagcgatgctcctgcctcagcctcttgagtagctgggacgacaggcatgcaccaccacacatggctaatttttgtgtttttagtagagacgaggtttcaccatgttgaccaggcttgtcttgaactcctaatttcaaatgatcttcccaccttggcctcccaagatgttgggattacagccacgagccaccgcacgtggccccatctccttttacgttttaccatcctttctaaacttgacttaatctctttttgttacatttgcacaaatctgttgttaaaaaaaaactttttaatgacaccctgtatgttctaaagaatggcctctataagtacatgaacttgaagtaatttcctgatcttaatgtgttgataacacattaataacattaagaataatgatattcttttattttagattccagaggtacatgtgcaggtttgttacaaaggtagagtgtgtgatgctggggtttggagtacgattgaacagacacttctcaaaagaggacatacaagtggctaacaaacacatttaaaaatttgggatttttgaggaaggacataagatgtcaaaaataaatatcaaagtagataaagaagtcattgggcaaaatggtacatttaagttcggaaacaaaagcactgaattttgaatgtttttccatcttttaaaataatggttaacatggcattgttgtttacaaggatttggcaatctgaataaaaaaattgcccttttctcttagtgcattaattagaagtgccaaataagataaacactccagtgaaatacaatgaagctctcttccttctgaaatgtttccatggtgcccgctttgatttcatctcagtctctcagtctccacccaaaggcattgttttgttgctctaatcattaatattgacatgcaatcattaatacacaagcttacttctataaataggatttatgtattgtcaaaaattatggaagataaaatgctacatataatggcattctaattcactcagactttctttgcttctctctctagctttacacacacacacacaacgtcatactaaggaaatcttgagaagctggcaaacctctatgttcattgtatgagggggaggtgatagcactagtgtatcccaacagaagcagtctttgggcagttagtaagatgttcctataagggaagtgacaataatatctgcaattcacagctcttacacaaaactctgggaatgtatttatgcacatgttatatactcacatactcatttcagcgatctgaagctctatttctctttcatgtactcagtttcctttgagttttcttttcccaacttataccaagacattgtcctatccagaattttcagccaatatagcatattccccactgaatctgcatacagtgtctctaaacagttgagtcagttctatctctccatctacactgactcacatctcagtccccatgcctcttcctggcccagctcctccatagatgaacttgtggatctcaccacttacaggatcttgccatttcagagtgattatttacttcagtgcatctcagactgctcagtcccttgatatcatgccttatttcccagataagccatattttggttccttgataaatgcatgttttgacaggaaatttgatttaataggacatttaaggagctccagtctatacatcccagtatggccaagtattcacagtgggccatcctccttgctgttctgattgaggatagcgtcactgagccactcttactgcaaaacccgtctggaacatactgtccttcctctgatcactggagctctcatattgcttttacattacagtttccggtaatagagaataggataggtcaattgcatctaatttcctgagttcagcatcattctgtgtgcctcaattcatagtatgggcttttggactgatcatcatttcatgttttgcactgaaatcctgcattttctccagagattatttataacctgggaggcttgcttccttatagggatggaaaccaactcctaacatccagcagccctcgctgatgcctattgccaatctgggtttgctttcccagactctgttgccccttaaagcttgttcctgtgcctgcccagctctgtgggttttgtgttaggtttcatcatcaccatttctcacttgactgtcttactgagagtaaaagactaacaagccacttaggccctagacatgagaatatacatcttagttcatatgctggaaagactgatcctatttcctagaaatttgaatgtattatgaggaagagacaaacttcttttttatgaaagtcatcaaagaatggaattatcaagaagggccactttgccctttcctgccactattgtgtctcccttgtctttttaatccagcaggtatttgttcccaaagcccccacctctgaaaatgtacagtgcctaagtatcagtagctactgtctttaaccaaagatgctcaattactgggtggagaagaccttgtactcttcctctaatgaaatgtagttcagtagaatgaagtcatatgaaatagaagaactgcctgtcttcctgagcatcatctcaggctgtttagttactaagctgatattcttcacatccaagcccacggtcttatctttcttagctgcctaagttgctgcctaggttggaggaaaactgtccccctttccagaaagatactacaatctactgttcagaaaaccctgagactatgcagcagagggaattggaataccaatctacttactcctttttttgtatgagggatattatttcttgtaattttaaaaagtaaattcatggaaattacctgggatgcatttattagactgcatttattattagatgcatttattatataaatataaatatatataaatgtatatatttatattatatataattatatataaatctatatatttatgttatatataaaaatctatatatttatgttatatatataaatatatatatgttatataaatttatatatttatatataaatttatatatttatataaatttatatatttatatataaatttatatatttatataagtttatatatttatatatttatatgtaaattcatatattcatattcatatttatatttatattgaaacccgatacctgaaaatatagtagtatttcttaaagtgacacagaaatgaaatttgatacctgaaaacataatggtatttaagaagttacagaagtaaacatattctgaaattagaagcttgatcccctctagtctgtattgtcactataatgggttctaagctatggttgatcttttataaaattgaaaatttgtgggattaatgtgttgataacacttagacatatctgtgacctacatctaatctgaactatttctattctcttctacattatacttatcaccagcaatcttctaaaagtacattcaagaatatgcaatcatatttatgcattatttgagctagataaatgttaaggaatcatataataaattcatatatcatatatatgtaatcaggtaaagaataaaagttataaggtttactaataaatcaattgttagtaattctaaaattaattgtatagaatttgtcaacatttttatatcaatacttgtaaaattcaaattaaaaatatttaatggtggctagcattttttaagtgtttaacaggcattaggtgttttagctccataaacttgtttcatttctacgaccacactatgagacaatcaattactttaagtactttacatggctgttatcaaaaagacaaaaaaatgttgttgagaatatggaaaaaggggaatgatcatacactgttggtgggaatgtaaagttgttcagccactgtgaaagacagtatggagggtcctcagaaatgtatgaatagaactacgatatgttccagcggtcttattgctgtatatatatgaaaagaaagaaaagcaacatatcaaagagatatctgcactcctatgtttactgcagcactatttacaatagtcaagatacagaagcaacgtaagtgtccatcaatggaagaatgaataaagaaaatgtgatatgtatacacaatggactacaattcagttgtgaaaaagaaagaaatcatgtcatttgcagcaacatggatgaaactggaggtcattatattaagtgaaataagccaagcacagaaagacaatgattgcatgttctcactcacaggtgggagctaaataagtgcatgtcatggaagtgaggattagaatggtggttatcacaggaagggcagggaaagggggaggagaggatgaagagagcttggtttatggatacaaaaatatagtcagatagaaggaataagttctagtatttaatcgtatgggggagaattctaattaacaatatattgtttattattatatgtttcaaaatagctagaagaattgcaatgttcccaacacaaagataaatgtttgagataatggataccttaattaccccaatttgattattacacattgtgtacatatatcaatatagtccatgtaccccacaaatatgtacaaatattacatatcaatataaatattaaaagtaagccattaataaaattaataaaataagccattaataaaatattttgcaggtgaggaaattgaaacttagagagattgaagatcttgaacggatcccccagatcttttcaggggtgctggacattgactcctacgattttcacatcatgtggaccttgaacattctaaacacagagccaagaaggaagtgttgctgatagctcattaacatttaggacacctacacaacaccagttcatgttagaaatatgcaaacaggatccaatcctggttaagtattcaatggaagtgatttatcaatcaatacgagtatcaaataggtaaaatgacagcatatgaagctacataaaggtatgaggaagaatatccaataacacagcactaaatctcataaaatttcactccagatcaaagcatcagcccacaaacattacagttcacatggggctgctgtgtcaaaagcagcagcaattatgcacctaccagacattggaagaaaacccagcggggagcacaaaaaatgggtctatttgctaaatcacaattcaccccaacccaggggagtctaagataaaacccactaaatggaggaaacacaataacattgaatgtcttcaccattatcaaggccattaaagggatgtgaaaagcacaacagcaaaccacattcattaatagtaaactagccttcgagaaggccataagaactcagtctcataagtaactagatgtaccttaatttaatttaattggaaggagaagtagaaagtataaaacattaatcaccatctcaggaatgatttattttgcacgtatgcctgcagggacaaggaaaactgtttacttttggtagtcttccaatgcttgcttccttccgtcttgatcatcaagaggctgcattcatacatcttctgtatgtcaatagtcgacaggtcctgacatggccatcctctgcttttgtttttgtttgtgcagccagaatccactaacattcatgggcaaatggtggtgagtctgggatttgcgataatgctattatgcatcagatctctgggccaaaaaaactgatctacagactgtaccagatgctcatgctattattccctgcccccattatataggaatgggcgggcccctttctaagaaaacgtgcctttcatcagaaatctggcattctgaatttcctgactgacacaggtcagtacatatattgtgttccaggagttgaggaaatcattttacctttaagagtgattcagttgttgatctaagatattgagaaaatataacttccacagtcagctttttaacctacttaggtcgatttgtgtcaaggtttttgaaagtaaacaaaaactttcaaacataaaactaaatcgagctatccaggaaataacaacaatttcatccatacacagaccaccatgtatacaccatacactagtaaaatacagcatagcaaacctgaagtcctgggggaatgcagagatgagcttagatgtagtggaatggcactgatttaacctgtttaaaaaaaaatcagaaaataccccaaaataaaacttaatcatagaaaataatttatgaagaactggtattaggtaattgcttgctactcaattttcaaaatgaccaactccaaaatacaattttttgcttcagccttgctgaaactcatgttttgggtggaagtatgcaaattacatgtattccacaatgcacatttttaattgtatacaaataaaaatctttcctcttacagcttttgaggagattataaacatattgtaactaccctattattgctcaagatgctgttacaactctcatgagatataacctttagagaatttcctcctgaaaaacttcagcagaggttattttcattttgttgggtttgatgctttggaagaggacagaaggaattctgaaccaaacctgatattaaattgaggatcaggatagatgggaccatataatttatactgatagatctggtgttttgtacagtttgtaaagtagctctgaaaaaaatttccagaatgaattctaatcaagttttgagtaacagcaaccttcattggaatgagttgttagttctcagatatatgaattcatttttgaagaacagcactcactgagaaccatttttcagtatgtttgctaaaaactcacttacctaaaaattattcagtgtagcaggaaaccaaaagttagacattgagctgaggctgtctgatacgaactttcaaactttccctaatctagaactagtgatgttttgctcagggatgaaatctgtttcctgaattaattcatattaccctggagctatgtgttagaaagcaacaacatcttttgtgcttatagttagtaaacttcaactcaaattaaaagtagtatcagtgtgccaaaaatcattgcaggatgcaatgattgctcatgagagtaaacctaatcttttattaaaatgatactgagcactttttacttcccaggaaaggaagtcaggtttattctctgttgaaaataagaaaaatattgctgcttccaaactacaggtaggattaaacactttaacaacacatctaaaaaatgtttacccattaaaaaattctaaagtgctttttagagtagcagaactagaataccctaaaaagcacaaattgagagttaacaacagtgtcaaagtaagacacacaaccagtatttctctggataagctaatgcccattttgccaaaaatctaaaaattctcactttcttcacccaaatgtattcaatttcctaacaaggatgtttcatatagcctttgtaaattagtgctcttgatcatcctgtggtacctgttattggtgtcctgtccagctctggcttcttgtgggaaagcttctatgcgtgctagaagcaaaagtggcagctggaccagtcaagtctgtggagtgcctggctactgtccctagtgctcgctcaagtctcacagggattgctgacattgccattgctgacaccttaaacttcttaaggagattctgttgggaggaagaaaacttactttgcattctttctttggtaatgccccattctaggcctggagcaagagcacaaggactaggctgaacatcaatttgagtgacattttcaatgctcagcctcaccttgccatcctcatcctggattcatagctttgatcttttactgatgagttacttcttctccctgaaaggacttctcaacgccctggacaaatgtcctcaatctgaaccttggctgttctgtaccaccagtaatctggagcagacatgcctaatcctggacaaaacaacctgacccttgatatagtggtttccattaataagctagctctttacttaccatggctttgtaacatcaacattgtcactacctatgaagatttttactttaaccacttaaggctacaagtcagataaattgtaacaaaaattttattataatagcaaatgctaacgtttgttttcctattgtaggccctacatggttctacattgcattttacattgattaactcatttaatctttgcaataattttttaacatgggtaccattatttccctcattttactaacgaagacacgggcacacggaaattaaataatgagttcaagctcacactaactagattcagagcctcagcgtctgatgactagcaagaaaggggaaagaagaggagtgaagtttgccttcattttattttgttctctagtgttactttcaaaagcagataagtagaattaaaaaatatttctctctcattcaaatgataatgctaaccagcacaaaggtcatgcctgtttactctctccatggtatctgagacacctagtctacctctagtacaaaacacacactctataaatatttgtgagatgaatgaatgatgtaaaaacttttagttgctttttcttatgtgaccttcattcttttttttatttgtcttgttcttgtcaactcgtgtgagcttattttaatttactgtaaagaactgaaaagtatctggattagagtaatttaataatccttgtcaataactcacacagccttctgtggctgtcattgccaacagcggattggggttggttgggtaatgaatcaattaagagggtattttccttatgggatatcatcaaccagactcctctaaggtgtgtaattaggggcacattgaaatgtggaatccatatctagctggatgagtcataattttcactgcttctgtaaggttctttactgtatactattttttaaattatttcttgcagtgagaataatttcaaaaaataatctcttgtatgttgtcaaagctgacaacactgatggaactatgtgagttacatgaaatatgctcatagggtgagttgcaaagctacttaatgagtagtacatatgaaagtcatgctagtctgtgactcctcaaccaaaccatggccatgtggtacaaactgtattttagttctgatctcggtatttggttgattattaatcctataactcaatcctaaactaattaatcataaaacttgatttgattattaatcctataacttgttaaatgtttatacattttggccatcttcaacttcttggttctgagacatcatgctaaccacgttcattaaaagaataatgaaatggcttcattttacacagttcttacttttaaacactttgataccacttaaaatttaaagacaaatgttaagatgaatatgttaaaactttaagacagtacttataattattcttgggatttgaccttgataattcacttatgcttactgtgccctcttctccacttgcaaatgaagtgacagtctcgatccactttccagaggagtcaacaaaaatgattaattgaggccaggtgcagtggctcatgcctgtaatctcagcactttgggaggccgaggagggcggatcacctgaggtcaggagttagagactagcctggccaacatggtgaaaccccatctctactaaaaatacaaaaaaaaaaaaaaaaaaaaaaaagaaaatcagccgagtgtggcggcacacgcctgtaatcccagctactcaggaggctgaatcaggagaattatttgaacccgggaggcagatcttgcagtgagccaagaataagccattgcactccagcctggatgacaagagtgaaactatgtctcaaaaaaaaaaaaagattaattgagccttatagagtaccttaaaatatataattgctttggatataggcaaagcaaataacaaattctaaagacatgtttaagcataactggatgaaaaactcaggatgcaaatagggacctgctaatgctgaacaaggcagaacatatttttgtgtcagttttactattttaagtaaagactatttaattataaaaatcaatttaatcagcaatagagtgattttactttagtgtctaattgtaggggtgctccatagcacaattataacctcctgttgtgctcagctcaggaccaactgtaataaaatgtgacgatagagcagttcccttgattaaagcactttaataaataaatgatagctagatgaatttaccagctaggagggaaaaggagcagatgaaactgtaaatcctataagaacagctttattattcaaaaaaattttatggattatttaaattgtgctctctaattacaatggctgataatgtttcattttgtttaatagcatttgttttgattgtatcattatcacaattaacaagttgctccaatatctaccttacagtatcttcccagtaatgtgaaggataattggatctatgtgaatgtgcttttcttttctgtccctaggaggagatcataatagtcagaaatctggagaagttccacttgtagaaaatttatatttcataagtaccttaccccactcaaaacatttaagatttatctattaacagtttaatattacacgtccacccattctaattgctccctcacaaattttaatgattacacttttctttggcagtatagcagtagagataaattttcaattttttcttcttttttggtaaatccactgcagtgtagagataattttaaaagatttcagtcttctcacatacaagaatgttggggaaacctctgagctgacctgggatcccagtcttccagctctggtttcagaggttataaatggggacagccctcactttctctcttgctttggatggtcccttggagctgatatttatttgtgcaactttccttggttgatttcagggtgaaaaaaaaagtcactgtaacaggagtcaagaaggggcttagaacctagtcatgtgaatattttcaagtttttcttgccttgtgttttttcatcaaatgagggtaggtgtgtgcatgtgtgtgtgtgcgtgtgtgtgtgtgtatgtgtgtactgtaattatattataatcacgaccaagtaaaacatccttcaccagctttcatagagtaactgcagttcctgtagaagggaaaacggtgttgtgctatagtaaaaaggatatgggcttggtattgagaacatttgagttaaaattccagctgtggattcacagataattaacttttatttgctttgcaaattcactaaacctatctgaatttgttttctcatctgtaaaatgggaataatacaaacctcagagggttgttgtaaatattaagtatataaagtatatggaatattatatgcttgtaataagttgtgttctcttctgcttctttgtattccattgtggtggcttaccacaaacacaggaatatgaaaaaaaataacattgcagcagaactatcaaaataagaataatacaaaggaagataaaacaattaggctaaagaaatgcctaatcttttttactgtgactaattgtagtacttagctatcaggttcttaatggacaaggggacaagagaaacacactaggttatattattgccactagctgagaaaaaaaaagacagattttttttttctggaccaacatatttaaaattcagtattaagtacttttacttttattctgtatctcagatttcattaagtttttacttaaaagttgaagatggatattcctgtgatacaaatatggccacctctttttttttttttttttccgagatagagtctcgctctgtcacccaggctggagtgcggtgagtggctcgatctcagctcactgcaacctccgcctcctggtttcaagcgattcttgtgcctcagcctcctgagtagtttggactaccggcgtgtaccaccaggcctggctattttttttttttttttttacatttttagtagagacggggttttgccatgttgtccaggctggtctcaaactcctgagctcaggcaatctgctcgcctcagcctcccaaagtgctaggattacaggcgtgagccactgcactgtccgcacctctttctttaaaaaaggcactgctagcaaataaagggaatcttggtagaagatgtttgcaaggtttgcactgaagcttattctattgtagaaacgatagaaaaagaaaagctgactaaatgaagaacatatgaccagctgatgcttgttttctttcagttcagtgaattcgggactcagtaactccattagtgactgcacccacatagacctttttctaaaagtctccacatttgtccagttgtttcctccttggtccaatgccaacgctccgtcaatgctattgccacccccattctgcctcttccaaaagcctgcatcagtcatggagtcctcttcacctgaaataagtaagtgtgaagacttttgattttgacagcactcacccacaactggtactacaattataaagaaaggtgtaatgttttaaactttctgacatacattaatctttggatttttccaatgagtaattggaattcctggagattttcaggaattctacaaaacataaataatccttgaaatacattccttgtagtatttatgaatatctaaacacattattacaaagataagtgaaatgttacattttatatatttacaaagggctgtagcttatggtgcatatttaaatacttgtgtatacaccagtgaagactactgagttatagctaaataatgtaatattctgaaccttaacaaagttaacagcactacacagaatcatgtgccaaaatcgccaatgttaagatttattttgctgtctaaacttatttcttgggacatcactcacaggatttgtttgaattatgctatgcattaaatttattaatataaattttagttgcaagcatgatttagttttagtagtagacagggccatgagcatacacttaaaacagggcaatagctacaagcaagacacctgattagatcatgaaacttctctcctccttcctcttgtctggttcccagaaatgtcaacttcaacctctctgctctccactggactagtaaacttgactagtgggtttcttcgaaccggtagtgtctctgtgttgattgttatgtttttatctcttgcaagaaatcatcacatctcattttctccactccttgactgattttttttctcccaatgcaaaacacataaattacccaagaaatgctggaaagagattcctcatgatactaggaaatagcttcatttaggacagtagttttcaacccttggtgtcacttcagattcacctggatacttttaaaaaatacctatgcctgggcctccacccccagaaaattgatgtaagtggggtctttttttttttttttttccaaatacaggtggctctgttgtgtagccatgtttgagaacttttcctccaggaatgccccagtgggttactctccattctataaattctacatttctaagaatacacttaaaagcgttttttaattctttcatcacaggcaaatttatttttgtattcttctaaatagtttgtaagtttttatgggaaaattaatttacttttgaaaatgtattcttaaccagtaatttccaaatttgattagtaatttcagaacctaagaggttgtttgtggcttcccagatattttgaaaataaataagataaaatgttatctaaaaatagtgtatgtgtctcatcaccccaaagttaggcttctgaagcaagtgaatatattaaagacaaattgaaatcataatatttaggaggttagtatattaaatattagtacatttattattacattttggtagttataggttttactcaaacatatttttagttattaaagaaatatatatgccaatttagaaagtcaagtcatgaacaattatttataataaaaacaaaacttaccaaccctagactccctctccagaagtatccatttttaatccttttggctgtcccagttgttatcttagcatttttaataagatgtttatgctgttatttcttgatggaatattttttgatgtctatttcttttctgctatgatagcaaagatttagctatctattctcctccataatttcctccatccttccattaaattacattattatttttcagttgtgtactggttacttctgattttaattatatagctccatcattctttcctgtaaattaactgtgagctgggtctcttgactcttcactttataagatgaggatgtgactgcctgtggccttctcttccactgtcccaagtctccccaaatctaccatttttacttttgcatcatcacagttgataaaaacacattccattttacatgtcttctgtattttacctatagattagttttaaaatgtgatagctaatatatagttttcacattcatctgactatagagaattacacatagtaaagcctatcagacatttgtatattgagatgctctcccatttcttcacctcttttgtattctgtcatcatttaaaaaaatttatattaggtattttttcttgactttctttgtcagagaccactacactcaatcatgggccctttttcatactcttaacaatcaggactggctcttggatcaaagttgaaatcctgggacttccttctaggttaagaatcattttctctcatatttcaaaggcattattgtattgctttttagcatccagtatttatggttaagtcttctgttggtcattttttctgacctggtaaattttaatcccttctgaaactttttgaattttcttttttatatttggcactacaaaattttacaataaagtgtctagttgtaatttttcattaattatcctaagcactcacccactatttcaatcttaagattcatgtccttcagttctgagaaattcttttttttttttttttttttttttgtgagacggagtctctctctctgtcgcccaggctggagtgcagtggtgcgatctccgctcactgcaagctccgcctcctgggctcacgccattctcctgcctcagcctcccaagtagctggaactacaggcgcccgccaccacgcccagctaattttttgtatttttagtagagacggggtttcaccgtgttagccaggatggtctcgatttcctgacctcgtgatccgcccgcctcggcctcccaaagtgctgggattacaggcgtgagccaccatgcccggcctcagttctgagaaattctttctcgttttttctgtcgtgattttcacatctttttccactctgctctgatcatccgaactactgtaggttagttattggacctcctggaggatatactgagagagtatactctctcttgtatattttctctcatatttgtaatttttggcaatgttttacaatctttatcttcaattattttataacttattatttgggctataatttttaaaacgtattaagctatattattggattttctctcctggagtctctctctctctctctctctctgtctgtgtgtgtgtgtgtgtgtgtgtgtgtgtctttctgttatatgtatataatactaatttatctctgaggatgttattttcattattttaatgttctcctctactccctaaattatgtcagtttcctccggaatgacattttcctgtttaccactagtttctctattccgtggtgcagtcttgcctccaataccttatgatgttttgctacttaatatatttaaaaataaagcaatattaagcacatcagtagttctctgcacagtggtttttgataggtttattttagagcaattgggcaggcatgtgactattacaactgttaaaaatatcacagttaaaaaatatttctgggggggtgaggaatcaggaaatcctttagagaagagacttctgatttttttgtccaagtgatagatgtctgggtgctacaatgtgatacagaaaggcaagagtttgacttttaatcaatattcctatttttcactcaatttttctcttgtgttggtgttaagaaaccccaaccttcaccctcagttgtataacttcagtttaactcttctgggctgtttcttctttatccccacatcatcatttttgttgtactatctttcctttgttgttcacttcaaggatgtggataatgtttgcacactcaaatgcccatatggcccaggcaggtaattaagtaaatgaggaaggctggtccttaaaaaataaaaatggactaagtatgccctggtgctggagagagtgctactacttgtttcaactatgatttattcttttacaattaatttggtgaaattttcagaggcaaaaaagatcaacacatatggttgacatgtcatcttgactcaggagttgtgctaagtgctaaactctaaaatgaattcattacttcttagtgggagggctttaagtcattactttctgtcagactcctctaagctaccttaaatgaacaaaggttctaggtaaaagtatgtatttgccatgcacaggcaacctcaaggcataccaaaaatgaaacatttattttttattaaaaaaacttcaatgtagaaggccctgaataatctaaaaggcagtaattctaccttgattttgtagtaccatggcagcatgtttcatgtttctttctcatttggaccctagatataaatttagggctgaatattgagacataactcagagaaagtgattttgtatgggtctaggttaacgtggttcatttatatagctttctggttgtatagctttatccaaagatagggctgagttataatatataacctgaggatccgatggatggcatattcttagatggtcacttttaatatcatttctcttttcaggccattagctaatgcaacagagagttaatgatcttattctcagatggatcctgagtgtcatggttttctgatgctgattgaaagaagaattactaagaattatttgctttggatatgtgatggtggtagggttgatagcatattggatattgaaaaaatataagtgtatttttggactggaggaagacctttgaagggatacttgtaaagtaggctaaaaagaaatacttaatgtgttacaccctccttatgattttggtgagtttatcagagttaataaccagatataacttgatggaggcaagagagttaggtctcagtagtttctgtgagatttctccaaggcacctcaaataaacgtacaatctatattaaaaccatgtgctttactcaaaaagataattttaggccctaacaaataaacacacagcgtgctttctactctaactaacttcaaagcag

SEQ ID NO: 547 - DNA, 72495 bp, Homo sapiens
gaaagaaagaaagtatgcatgtttgtgtgctcaattgtgtcatgtgcttcaggattcaacttggacattgcatttcctttagaagtttgcgatgaaataaaaaataaagttaagatggtcttcaaaacagttacgatctgaacagaaatctactttatgtctgaatattttttcactttgtgcttacggcttccatcttagctttttcacctatgctgcaacactattaaatgaggtcattttacatgagtaactttgatatctgtttgttgattcacagcttctctaacttggaggcaggaaaaacaagctaatgacaaagatatttgtataccaactttcaccttagaaattatagtttccaaatactcacaagtaaaaataccacaaactttaatgacttaattaagccagtggtaaaacacaatatatctaggagggtgttagttacaatagcagggaaattatatggttttcagcaaggtggactagaagaatcaggctttggaaccaaaaactagactcaaaatctgattgttccctttaatgaggcttcgctgtagcttactctttctgcaagttaattttctcatgtaaaatggtgataatatgacatattttgagagagaattcagactttgcaaatcttccaacaccatgctagtttcttttctctcacctttgctaatatgagaaagacagactgataaaaccgtgtggggtcaacacccactaaaataataaatgctcccatatgtcactgagtcataaaaatcataaactgagctgttcttcctgatgcatctttaactttagggagtattatttacttttaccatttttgagtaagcaattaaagtatgtattttacgtaattgaaggaatcagtatctccattgatagtaaaatattaccaggccaattgttatttgtatattttttaaaaaccttttaaaagaatagtgcatttgcttgcaaagcaaaagatgctgtgacttaccaacaagatctggctgccttttctgtgttacttattattgtggcaaaagaggttgtaagtgtgacaagaaaatataacataagaacatgaataaacaaataagggcagttgttatgaaaactgattcttccagaatgaggagttaaatgagctctctccttagtaccttcttcctgtttcccaatttttaggctaaagaagacacaaacacttaggcagttacaagagtcctttaaaatcctccatggtatttttaaaaatctctacaattctcttgtattttgagtaaaagctaaattggagctgtattgttttatttcctgagtcttctttttattgaattatttacagtggacatgattgctggtgatgatcacagccttagtcttcatattctagggacaaatctgtcctaaacttctgtcattgaactttcatggatggagctaacagttaatgattggtgtataacaaaaggcagtatccttctaggtagctaatgtgggccaccaaagggtcaagaaaaaagttataggccaggcatgatggctaacacctgtaatcccagcacactgagaggctgaggcaggcagatcacttgaggtcaggagtttgagaccagcctggccaacatggtgaaaccttgtctctactaaaaaatacaaaacttagctgggcatggtagtgcacgcctgtaatcccagctacttgggaggccgaggcaggagaatcacatgaacccgggaggcagaggttgcagtgagccgagatcgtgccactgcactctggcctgggtgacagaactagactctgtctcaaaaaaaaaaaaaaaaaaaaaaaagttatagtagaataattaaagtatttctaaacctaggttataagatttaaaaagaatggtttttagtttctagtttcctgcagtatctaagatgtctacaaggcaacattgggaactggagtcaaaaagttgatgcttcacagctccttggacactacagatagacagtgagaaaacagtcaattgttgtcacatcccaagaacagcaggggattccagttaattttatgtagcgacattgagcctctggattttaaggaccttgctgaactctcaactggtcttcttccctatctgtatctcatggtggcagcagcctctctgtattaatgggaaaacagagacctgaactcagatgtgttataaactgaacttctgtttattgttatcaaatatctttacaagctttctaccactctggacagacgacagatagaaggcaagcttgacttcttactgtgcaaatggagcccaaccaacctaaagggtaagccacctaagagaggttcctcttttggtcctacactagctactagcacatatcaggaggggatatgctgcattaagaatgcaaatatcactttgtctaagggtgtcttcagatgatgccagtaattcataagtgttctcccaccatccagaaagggcatcattcagagagtcctcatctctctaccatcactttcagggtccatcgctagtactcaactctccctcttaccttgcaggtggtaaacaaaagggaagactattaaatttatcacctatatatttcagaaatgtttcttttctctcaatatcatcacttttaggttatctgcttaacaaagctcctacccttctcagagtctaaggatcaaatctttctgtgattcatttcaagaagcttttgtcgaagcactgttatataatgttatgaatcaaatggacaatcaatacatattggatgatgatggataaagtttaagccacagagtaaagactgtgttgttgagctaaaagagttcagtttttatcaagcacaataaataataattttattttatgtgcagatttctgatggtcagatcattgtacagtagagcataattgaaagcaaattccctcagaggccactgaccactggtaaatgttcaaatatataatacagttcaatacgactgtactaaacaggtaataaaatgttggcctttgacctcccgtgactactagtttcagctacttcattaccccatgaggcatgtcctcaggtatgtgcatctctgggtgggcagctattctcttgcattttccagcagtcgtttgccatcagtaggcctgtcagagtcaatgcttcagtttcataactgtaattggattgtctgacttcctattcaattggtacatgtttcttcttatttctgtttcttttaaaaaatcaataaatggtttgtgatgcctcaaatagagagaaatcaggttttaccacattatggaattgacattttcaacatttatttctcaaagaggaccattgggtatgtcagattcaacgcataagttttggattaattgaattgtttggtcccagggatatataataacgtgaacacatttcatgatggaaaccaaagagctctatcatgccccaaactttatgcatatgagtagaaacaattttttctctttttcttgtctttctttcctccactcataaaacccaccactcataataaagttatagaaagcataaatagctttatgtttaaactggaggctgatattgaaaccactaaaacattatgggtgtgaatggaatgtgcacatatatttatatgtatatataaagtccaaattttatatacatatatggactttatacatagctacatatatctacacatacatatatgacacgaagagctgaatcagttaatatatctctgcatttaagagtaaatcatatttgatgcaattctgcaagtacatcttggctccataaaactgtgatagtggatgaagttgcaaaggtgagtaagacagagtatccaccaccaaaagtcctgacgtagaatgaaaatcttccaaaaagaattagtaagttcatatcgtttcgcttttgtttaatagcttggctcctattaggatcaggtttgcaccattgatcgtgtattgacttgaataaaaatacatttcaaaataatgtacagtattgactaaagatgggactacctgcttaaaatcagattcattccacatttcattgctatctctaagtattcattctgcaggaggaagagatttttccactgcatagagaacattatcaaatgtttccatcttcctttgaagcattcactattaactgctgttagaggaaggattctagactgagtgggccattggtttgttctggtaggacagttcctgagttttaatggatatatacagtttggaagaaaaaagaaaaaactaccagagacaaactttaatattttgagtggcacttagctgatatggtaggtagaatttaccaattccttttaaaatttaatttcttgttaaacgtgaaagcttgaagttcagtaatatgaaaataataacatttttcaggtcatgaatatttgctttttaaaatagtttactttactctacttgcaagccagatttccctatttttaagtgagtttattgtgggagtgggaggagttgaattagaacaagactctctacagggtcacaacctcttcagggcttcagtgcaaggaagggatgaacagatattgacagaccaactgtcttataacctgagattcccactcgtttgttattctgtatggctatatttgctttcaacctcaataggcttcattcatctgcaaacttcctgtggcccttgatcaaaaaggctacaaaaaataccatgtcctcatgtgccaagtaaaaatttgtgactatgcagcttaaaagtcggtcatggagaaaatgtttcttaacaacgctttgaactatttaaattagagctttattttagaaaatttactagacagtggtctacttcattttattatactaattatctttagttgcaagaacaatggccattttgtgagttgttagttcaaccatacgttgttatatttgtgagacaaaaatagccaactgtgagcaattttatatggcttgacctaatataaaattttgtgtgctttgaatgtctgtgataaacacagagatgtattcccatggaaaccatgccccatgcatggtgaagcagccaatatggtggtaaggattacactggcatgactgtctatagtccaggaaagtattataaagatgttgcttggagttctgtgcaaaagaaaagtccacgtttaatcaatgtataggtatattaagaaggaaatcctcctatttatgattcaccatgaccaatgtcatagtaaaggctttgaaaaattctgcagcaaattacatcatttagtcaaataaattccatagggtatgctgtgctgggccataaaataccttttctgatcaaatgcctatcagcattttataggaaagcaatgtttcataattctctgtaattcaatttgagaaaccaacacctgactgaaaacttgacacttgtatgttcctgtaccttcaggggttaatgcagtgccttatccatataaggttaaccttacaaaccaaaaaaatgacagctttagactcacagtttgtaatctagctctcatatggtgcatgctgttttaaaggaaattatatctactctcctcatccagcaaactggcatttcataagataagctatgcactctgagtttaaataaattcagatatttttctttgaatacatttcacagccagggcataacattctgaacactgtgacattatccttccttaaaacgtgtatgtctgttttctcatgttaaacttcctttttgttctatctgtatctgtaataattgcctgtgatttctggaatgggtctcatgagggagtccatttttcttcccttagcctctctctaagcacccaatatggaagctgcagcccatggtgcatccatgaatattatcggagaagatcaataaatctaagtccacagccaacagtaattactttctttattctggcagagatggtggcattatttagacacagttgtagagcaagtgacaaacaaggcacctttttgcagactcaaatttctgggatacatttacaacagtggtgaaaaattacagagggatggcaggtatatgtgaacagggctgcaactaatttggccttgggaggtgagattgtcaggcatgtcaaaagctaagcctcattcagaatcctccccactccagcacttctcagatctgtttgcaccacctcttttctccctctcctctagcttcaaacttaccctctctattggcttcatcctctcggaatataaatatacttgagaatctcttctcttgaaaaagaatccaccctcacttccaccttcctgttttctctctccctctctttcgtggagaagctacttgaatgaataccctacattcccttctccacttcctgacctcccatgtgtgactccatccttcatagtaggtaaacattcttgagaagattctcatctgttgtgaagtcttcccttaccccccactctacttctcccacatctcgttttagatttggatgttaccctcaccatggactcctactgtaccttgaatgcttctcgattcagtcttaccattcaagaatgtaatgttttttattttgtttctgttgataagaggtagagcttgtgtcttcatcatctttgtatccggtgtccagggtattgcctgagggcaattatagggacttaataacgcccaaacacatccaacctttttcgatcaaatttgtttctaaagcgagaatacaaaaaaaaaagaaagaaagaaatagaaaagctccctgtttgcaaatgtgctgtgtattttgtgctgtaagcctctgataaatgcagtggtgttatccaattaactttccagtactcaggagagagccttacaggttctgccaacttaccatcgactaatcttaattgtcttttgacctatgctagctgcatggagggtagggggattagtagtaatgtagaacttttaaatattaacattatgtactatgtatattatataaggaaatttgacctctttcagaaaaaagtagcacaagttcatatagtatgggcagtaggactttgctatttaaatcagtaccacaaaatgtttttatatggaatgttattctaactttctggacaaacctgaataatatgtttaaagtttcatattacaggatccttatttataatacctaaataacattttcatccttccatagcctgaacaatattaaatcaatatataaaatcacagtaatcataaaattagagtttcactatgtacactgaggtccttcagtgattaccaagtgctgccaaataacacaatcctacatcagctgtcagtcctcagttctaactcctaggctctggctactttgagatgctatttccaaaaagtcctcttctctggctactcatgtcaccttgaggggcacagctcactcggaaaagctactcttgtagaagcctcactatctgagacccctaacaactcattatcatccctcctcccaacaacttaaagaacatgtattccacaacacaggtcttatgagggcagggcagaatggggtggccctctctccaaaatcaatatgtgagttgagaaaaaaatgagacattttgttctcatcaagaaatctatagacagcagtgatcctagggtccccaactggaaccaagaatatactgacccagagacacatgaggtaaaagttttattcttcagatttttacaactatgccactaaggtattcattcagtcatcctttttgagctggcaaggaaaattaaaccaaatgtttttaaggcttaccatatcatgctaaattccaccaaacttttaaagaagaacaaacatgaattcttttccaacaattctaaaaaaattaaaggggatggaattttccaaactcattctacaaggtctgcattactctgacaacaaaccagaaaaggacacaacaataaataaagaaaactactagccaatatcactgataaacacagatgcaaaaatcctcagcaatgtactaatgatatggaagaggagaagggaagtgctggatagaggagggcatggtccctggctggggctccactcctgggcctgtgcccatgtaccaggtgaggacaggcattcatgttttcctgcctaaatgttgcatttcccaagacaaccctggcctgccacaaccccatcctgtgcctataaaaaccccaagaccctagcaggccgacacacaggtggctggacatcgagaggagaacatcagcagaggacacatgggccgctggatttcgagaggaacacaccaacaggcactggcactccagcaggtcaccaactggcagaacaactgagtgtttggccagggcagtcagagaagagtcgggccaccaagaggcccaattcctgggagaaccatctcccttctggctccctcatctgctgagagctacttccggtcaatacaactttgcactccttctccaagcccatgtatgatccaattcttctggtacaccaaggcaagaatcccaggatacagaaagccctctgtccttgtctaattgagctgaccacaagtcacctatggacagctaaactaaaagagcaccctgtaacacacacccactggggcttcagctgtaaacattcacccccagacactgccatggagttggagtcccacagcctgcctgcctgtatgcttccctagaggatagagcagtggggcactgaagaagtgagccacaccctcaccacatcccctgtgagggggacaagggaaattttcccatttcactaacaaaccaaaaccaacagcacatcaaaaagattatatactatgattaagcagaatttatcctagggatgcaagtaagtttcaacatatgtaaatcaataaatgtatgctactatatcaacagaatgaagaacaaaaccatatgatcatctcagtagatgcagaaaatagcatgtgataaaattcaacatcttttcattgtaaaaactcccaaaaaatcagataaagaagaaatacacctcaacaaaatacaggctatatttgacaaatccatggctaatctcataatgaatgaggaaaaattaaaagcttttcctctaagaactggaagaaaacatggatactcattctcactactcttactcaacatagtactggaagtcctaggaagaacaattaggccagagaaagaaataaagggcatctaaattggaaaagagaaagtcagtttgtctctgtttgcagattacataaacttatttatagaaaaacatagacactccaccaaaaaattcttagaactgataaattcagtaaagttgtgagatacaaaatcaacatacaacaacagtagcacatctttgtaccaggaaaggaaatcagtatgtcaaaattctaatgaatgaactaagaaagaaatcaagaaaacaatcttatttataatagttataaattttaaaaaaccctaaaaataaatgtaaccatggagttgaaagatttctacattgaaagctataaaacactgatgaaagaaactgaagagaacacacacacaggaagataacccatgctcatggattggaagaataaatattgttacaatggccataccacccaaagtgatctacagatttagtgcaatctctataaaaataccaatggcattcaacacagaaatagaaaaaacaatcttagcattcatatgcaaccacaaaagaccccagatagccaacataatcctgaacaaaaagaacaaagctgaaggcatcaatctatctgacttcaaaatatattgcaaagatatggtaaccaaaaaagcatggtattgccataaaaacaggcagatacaacaatggaacagaatagggaacccagaagtaaatccacatatttacagccaactgatttttgacaaaaatcctaagaacatacataggggaaaggtctcttcaataaatggcactggacacactgaatatctgcgtgcagaaggttaaatacccatctttcacgttatacaaaaaccaactcaaaatggattaaagacttacatgtaaaacccaaatctatgaaagcactagaagaaaacttaggggaagcacttagggatattggtatgggaaaatattatgaataagattttaaaagcacaggcaaataaaacaaaactagacaaaagggattaagtcaaactaaaaagattctgcacagcaaaggaaaaaaaaaatcaatggaatgaagagacaacctacagaatgggcaaaaatataaattatttatttaacaaagcttaatatctagaatatacaaggaattcaacagcaaaataaataaataatttgatttttaaaatagacaaatgatctagatagatagttctctaaggaagacacacaaatggccaataagtatgtgtaaaatgctcagtatcactaatcaccagggagatatcaaaaccacaatgagatgtgatcttactccagttagaatgtctattgtcaaaaagacaaaaataagaaatgccggtgaggatgcagagaaaaggtaactcataaactgtttgtgaaaatgtaaattaatacagccattgtggaaaacagtctggagatccctcaaaaaactgaaaatagaattatcatatgatctcacaattccactatggggtaaatatttaaagaaaataaaataaatatgtcaaagagatatctacattcccatgtttactgcaacattattcacaatagccaagatatggaatcaagccaagtatccaccagcagatgaatggataaagaaaatgcacatttacacaatggaatactattctgccaataaaaagagtgaaattggcgtggcacggtggctcacgcctgcaatcccagcactttgggaggctgaggtgggcagatcacgaggtcgagagatcaagaccatcctggccatcctggtggaacccagtctctactaaaaatacaaaaaattagctgggcatggtggcacacgcctgtagtcccagctacttggggggctgaggcaggagaatcgcttgaacccaggaggcaggggttgcagtgagctaagaccacgccactgcactccagcctggcgacagagcgagactccatctcaaaaaaaaaaaaagggggggggtgaaatcctgtcatttgttacaaaacaacattgttgtaactggaggacattatgttacctgaaataggccaggcatggaaagataaataccacatgttctcactcatatattgaagctaaaaaagttgatctcctagaagtggagagtacaatagtggttactagaggctgagatgggtagaggaaagaggagaatagggagaggctggttaacagatacaaaattacaattcaattggagcaataatttctagtgttctataccacagtaaggtgactgtagttaacaataatttattgtatattttcaaatagctagaagaggagattctgaatgtccacaaaacaaagacatgctaaatattcgaggtgaaggatatgctgattatctcagtttgatcaatacacattgcattcatgtatcaaaatatcctactgtatcccataaatatgtaccattattgtgtcaattaacattttttaaaatgtctactgtaagaaaaaaaactaaactaaacaaagcccacttaccatatcagatagattttcataagcaatagtcagcccagttttctggcctatagagctaggaatctatttgtcatgaattacgaaggaagccctctgagagtttatgtcagcaggcaaacttgcctaccatctcctgctatagtattctaaggtgctgaatggaaaaactgggctaatgatgttttcgtttgtattttacatggaaaagctcaatagagatgactgatttcatgacatgagagggctttttcagaatgaaataatgaattgcattcttaatattgtaaatgccctgcctagattttctctaaatcattacaatgagaggcaattccccaatgtagaagggtgtgactgtctccagagaagtggagagtcaatgcatcacccgtgtaatttaggaaaaccacccactttatttcaagtgctttttcagatgatcatgctttttggacttaaattctctggataatttctccacttctcttccctgttatgtgtacatcaaagcataacgacttggccttggacaactgaaaaattaataaccgaagcaagagtttaagaaatccatagtaatgacacaaatgagacctatcaaattagaaaatcaaaatgaaaacacactaaacacttcaaaatttaattagaaaaagttccaagttcagaccacactgaggccattatgcaccagaagcactctatattgaaacctgaaaaggagagtcattttggtgaaatgtgaccttgggaaggaggtaagatcgctcactgcttcttttactttatctgctttttaaggctcaccccttaacgttttatgaaaggcagatccaaggcaagcatctcttcaatttaaccttcacaagagacacaattcagtcttttatttttcccaatgatactgcaatcaacttgagactgctcaccatgaaccatttgaaaatatttttcaaattaatacacaaattatgaagcatacgttggctgctgatccctgtgaaccattcccattgacttttaagtccaatgctgtatatcaggtaaggatgattttctcccttgcaacttaatgggatgagagggaggcttgtgggttatatatgtttagaatgaatcatctttcttttctgccgcccttttcatacaaattgtatatcctccaaacattttatagacttctataacataggagagtataaagaatatattacaagaggcaggagaatagacaagcttccaatcctatgtgaagtttatatggtacctatctttaaaggctttatatattttgccttactacctcacatcttagaattaaacccactttattatgcatttagttctcaagttatctctgtttgatgagcagcattgccaccaaccacatttttatcaataataaagctgagacaaactgaggttcctacaaggtcacacaataagtatagtgactaaagactagtactcaagtctcatatgagccatttaagacaaccctgaagttaagcactgggtgactttgggaggtgtgtgtgacagggttgagttattacaaaacacagcatactcacattccccccaaaccaacttcgttatttgtatagtttctgaacagaaatatatatttgcaaatagttatagaaaaattttggatgcatttctattaagaactgcatgtgtatttccattaaagtcagtgtgtatcctgaaccaagcctgctgcagccttgtggccatctgtcatttagattctcctttcttgactatccttggaagcttctttttcactttttccttggctgatcaaaagcttttacctctcactactggttgttagttctcattcctccatttcataatatccttcaaaagtttagtttggtaatagaccctcatttcaatatccctcagaaaaagcataggaattttttaaatactgctcattgtcttcttctttcttttcttttgaagcaactgacttgcttgacctaggtggttgtgtttctttgatgtatgccagctttcaatgtgttgagaggtgggagtccaagtaccttattgctgggctcctgtgctcatattttaccatcatagacaaggtgacaatttgggatgggagggcactgcttaagcaggcatggggagtggagtgagggccaacatgggctgtctgaaaaaggtcaaagcactaggtctgtccatgaatctgggaatacttgctctgttcagggaaaaaaggctcttctacagggcaagtgcaggtatcataatgtcaagaactgccatttcatgaatagtgccaggccctcttctgagatataataccaagagaaatattatctgtgccatttccagataaagaacctcagcttcttttagaaaaatttacggttatctgaaggagccagaattttccacaatttcttccaggattatgtgtataagcaaacctttatcacttacatacaaacacacactcatacacagttttctaagggaaagcaaaattttggtgacatggatgtggctaatacatgagtagataaaatactacacataactctttatatattattgagtagaaacaaattacggtgtatttttagtgagttatttcaggcacaaaaacatgcctcatggagaatacaacagttgtagtagtgtattataattcaatagtggtttaaatgcaaatgatccacaggtggaatgtccacttcttcccagcttagctgtaagacactagctttttatttatgtcataactcaaagaaaaagagaaagattggggtagctccagagagcccaattactaatatggcttgaaggaccaatggaaggcaccattttttaaaacagttcaccagcctggccagcatggtgaaaccccatctctactaaaactacaaaaatcagccaggcatgatggtacatgcctgtaatcccagctactcaggaggctgaggcatgagaatcacttgaacctcggtggcagaggttacagtgagtcgagaacacaccactgcactccagtctgggtgacaggtggagactgtatctcagaaaaaacaaaaacagaacagttcataaccccagggctgggcatgcattttctctctgtgatcaacccctctgtctgggtagtgaactgaaactaaagtcctcagaccagcaaggatgctagttgtgctaggctattattgcattgctataaagaaattccggagcctaggtaatttataagaaatgaggttcaactggctcatggttctgcaggaagcacagcactggtatctgcttctgggggcagcctcaggaggcttacaatcatggtggaaggctaagtgggatcaggcacctcacatggaaaaagcagtagagagaaagagagggagacagagagagagagagagacagagagagaaagtagcaggatgctacacacttttaaatgaccaggtctcgtgagaattccctatcatgaagatagcactgagctatgaggatataccctcatgacccaaacacctcccaccaggccccacctccagcactagggattacaattcaacatgagatttgagcagggacaaatatacaaactatatcactaggtatctctgagggcccctctgatgctgaccagaagccaggatgtgtgctacaaagacccaggaaagccagggggtggtgctgatagagccaaatacctctcaggataacaaggatagggtttccagatttgatataatacagaacaacttcttccatttccagcttttcctccaccaaatcaaaaggcatcaaattaatgaagctgtggcttgttgacattaaagttgattacaaaaagacatgtttgagtgacaggtaaacaatagcaaaggaatgagtttccataaatacttatttatatatgaagagtatatggtttgtagaataaataaacctgtagtcattgtttcttatttgaagtttgtaacctgtcatcataggttaaataactgtcaggaaagctcatacttgtgatattttaaataggagctgaaattggtgtttccctaaggtaaatggatgtttctaaacattgatagttctttcttttctacaaaaaggtatatgtaaatatacaaaatgagaagtcaaaatatgtattccatgcacagaaagagatcaagaggtggaatggagttggggtgtgaacagaggaaggttgatttatgttatatggttgctctctttttgtagctatttttatatcttttcagcttcctccagattactctagtttatttcctattgtttcttactattgacttttaattgttccctgacaataaactgttttatttaatccatctttgaaaatttcacataaccatatttagggacaaggctttgagcatcttttatttcttccactaacatattgtaccctaaataagtttccctcccaggctcatttactacctccatttgctttgtatttttgttgttgttgtctccctatcttctttgtcctcttctgtaatccattcctctctctttctttcttttttttttttttaagataagagtgttgctctgtcacccaggctgagtgaagtggcacgatctcagcttactgcaacctctgcctcctgagttcaagtgattctcctgcctcagccccctaagtagctaggactacaggcacataccgtcgcacccagctaatttttgtatttttaatagagacagggttccattttgttggccaggctggtctcaaactcctgacctcaggcgatccatccgcctcagcctcccaaagctctctatttttataatagttatgttgacttgttcttctggctgcagctgcagctttttccagttgtctcttcctgttgtcacaataaaaaaatctcttctttatttcctgtctatatgtgttttgttttcatttttttgctttccacatttatccttcccattcctgtatcttcatgaacttgtaaattcttaggaaagcaaaaaaaatataaagcttgaaagtttcaaagtcaaaggaaaagagaaaactcaagcttgcctcagaagagattgtgtcccatttctgcagtagagttcatggaatttgtgcaaaaagtgagaagatataagggaagctgtgctggcttgtgtgtcatttaaattagagagcttggatgttgatattacaccactgataaaggaaatgagacagtttccacttttaatgaaaagaagtgcagtggcaaagttgtctcacaccacaagataagcaagattcaaaggaaggggacagtcattctggtgttatcattccaattctatccagcttatttacataggcctgaaaatgagatgatcccaggatatccatttgatgtaaaaaaaaaaaaaaatcttaacagccccaaaaagggataatttagttgtgctacacacatgggtgcgtgcacacacacacacacacgcacacacacacacacacgcatcccaagaatgacacacctattgatgagagttgaaaacccatcagatatccaaatgagtatgtatctagagttgtctatactatgcgttatatgactgaaccattttcagatttttttctagttttggaagatatctgatgccgtgtagatacagacactatcttgtgggaaacccatagtttccagtctgaacataaccaaataaggatctcatttctctctgtctctgtctgtctctccttctttctctctctgttgctctctctctctctctctctcatcttatagcagcaatgcctaaagagaacatttatacattctacccaaatcccctttacacactggcatatatctttagtgtgcatatgtgtgtgtctgtgtgcatgtgcagttgcacattttgttaagcagaaaagctctagtgaagtatcatcgcctttagaaggaaagaaggactaatttgatttttctgattccaatacatggtgctatcaatgagtggagatagcactgagataatatagaacatgataaacagccagtggaatggcagcattccataataatgccaatgcttgctgtcccatcactcccattgctccgtgggaaggatctcgtaactgataaaccaatagtagcaggcatttgggatgtttcctggagaagcagagggaagcctcattggacatagtttcttgcattttgctgtaatttatggaacacgtggatttttaaatctacaggtaattacgtaaataaaatattgaataagacacaaacctctaggttcccccaatctctgtcgcaagccaaccagctgcccttcccactctacttcttctccacacaaagcacagaaccgaccaacactggaaaagaactgtgttatcacattttctcatagttggatggccattctgttactctgattttgagaaaatcaaaagcattacctttgaggaacaattaacatctatttccagtccattattccttttcaggacaaagggctgtatttcacaggcttttaaacaggatatgaatatcccatcaaatatcagtggtctgagctacagctctggcaccaggcacactgccaaaaatgtgaccaagtttaaaatgattgatgctaaatcacattcctcttaagcatagtctaggccgagtgaggcatacctactcatacactcagtcctcctatctgggaaattcatggttctctcccaacatgagaattatggttttgttcacaatgtgtggaaactagaaaggcactgaacatctgaggtaaaatggaaacaatttagttctgttgaatgtcaccctctgttgttgattccacacatctgtgcatcttttccttatccaaaactcatttaaatgtgctagtttctcctggagatgtggcagataatgtcatgagccctcactgcattcttttttttaatagatgagggattaaaatttgctgtacatagagttacctcttgtttgaaagtccacgtacagtcagataacgtgtttatgctttccttgtaactaaaaaccaactattttggcttggaaattccccactttccaaagaccattgcttctttgccatggttaaccagaacctagctcacacatccactgggaagaaaataaaggctctaatggctgaatgtagccaatgcagcacagaagctcagacctcctagggaagcctgaaaatggtgatacccttctccatttgctgcttgctaatgaggccaaggtgtgtccccctgtaaatcctgacaacctaagaggggtgtgcgattcatctcagctcccttcccagatgacaagcaagttgtaaattgtattccattccactctccactgtttatctgccctgacagtccactgcagctcttgtgtagctggaagcccacagggcatgtgtgacttttctcaagctcttcccagctgtcttaagtgtctctgtccttcttgtatttttctatctgttgcttctttttagaggtccctcttcctctttccttgattttcagtttttctcgctatatgcatctctctctctctccctcagattgcctgtgtcttgcagttttgttaccttacaaactgctacttcgttttatccctgactttcttttctttgaaatacatttttcatctttcttttatagtttatttgtattttttctgtttggtttttggcaaaggagctcagcaactgacccagtaagctaacactttcagaaaatgttgagtgatggaaaagcaaatttttaaaaatctctattactttcctatcttctttcttacttgctgctcattctagatgtcctcatgtctatttcatcgtctgcttttatactaagctttctcctcttaagcattgctttccctacacttatctgctatttcagatctttaaatatcctacagtagtcagaatgggactgagtactgacctgtgagatgcttaccaccagaaatattttgcaagttcaggcttttgaaagaaacaacagaactatatattatgttttatatgtccattcgggaaacttaagacatatgggggcttggcagaaacatcatcaacattggagtagtgctcagtcatttccacagagaacagtcttacaacctatcaccgtcttctagtaaatgggtaccaatgctgatggaaaataaatgggaacaagaaagatttaggaaatgttcccaagtcttttgaggaagactgaattaataaaaactgtgagattattggagtaaggttgtctattcttgtgttctaatataccattgaaccatgacctttccaatgcactacctgtaaatataaaggtatatttaatagaagaaatttttctgatattcagggcttaaaggctcaaatttgcctttaaaatttttttctcccaatactggcaggaacaacatttttagatctcattctttaccttaaaatatgattttcagcccagaaagctttactctaatccaaaataaaatttctgtgctacagaacacaggagcaaagattagattcaactcatctttggcaatcaattcagggagctattttgcactccctcctttttccatacctgccaacacacttcctatggatgcttttcttctcttaactctagagaaaaactggaggtgagaaagtctgtattcaatgaatatggtaggttttattaatgtagtcacagagatgttgcataaattaaaaaatagtacatagttatctttgcattatttttttccttttaagatgactttgtgtatttaccacttaattttataaaaccctaaagaactttttaaaaatcgcatcagataaaataaatattcttatctaaatggagttttggatcttctccacttgccaataattattttaaaatgaatttatggtctagaagtctcaaagacctagttattcttgaatttgttgttattgactagagtcaaatgctagtagttaaatatttagcaaattcttatgaagctagaaaagccatgcataagcagtaaaaactgtaagagatttccccttgggttaaagaataagaaagtaaaaagaccagttcacctgaatcagaaccctgatgtccaatggctcttgctgacactctacatgctgacggaagtttcttgttcctttttttccagttctttttgtctccctattttttctctgtattgaaaatgatgctcattttgcttctaagtgatgaaggagaaagaaatgcctgtttcacagatcaaaagcaggcactgctttagagcaacactggctgaatgtcttacatcataactctctctggctttatccatcatcgccaacattttctcttttgcagctttgagggtgatggggataggtcatatattattagtggaatacaaagaaacacaagggtgtataagaagccctggtttcagaacctcagtgtgccaatacccaaactaacccatagagactcgtagtcttctaagagtatttatttacttgcaagtacttattgagtttctattatcttacctctagattattgaaacagtctcctaattagtctctcagcttctgttctagcccttcttcagtctattctcaactcagcagtcagaatgatcctgttacaaactaagtcattcattcaatcctcttctccaaggctcctcagttcatgcagagtaaaagcataggtcctcatacattgccacacatgatcctccagcatctcttgaacccatcctcatttagtctcctctcacttgctctactatacctcaaagatttcctccttatttttcaaagccaccaggtaagctcccacctcagagcctctgtggctgcccttctctccaccggtttctcccctccttcccctaggcacagtaagacctctcctggagtccctatctaaaattgcagcccctccccctatgttccctgtccccttttcttgctttcttgttccccttagcacttaccaatatgtaccatactatatatttttcttatttgtttattttttatgtttccaactaaactgtaacctccatgaaggcagggattgtttgtttgtttgtttcattcttatatctaatggtgcctaggaaagtgtctggcattaagtaaaccctaaattaatatactctgggttaatgaactggtgaaggaaatccaatagttaataagacagacatggtcactgcccacaaagctatcacaatcaactgggaaagaccatacgcatttaaagaaataaacaatcattttaaactttggcaggtactataaacaatgaacaagatactgaggcagaggatagcaggaaagccgatgtagcttagactcaatggtcaggaaaggccctcctctgggtaagatttgaaggatgagataaaactgaacatgagatggtgttgggatgggggcagtgagcaatcaaagaaccgtcggaatagagggcacagcaagtgaaaagaccttggtgtcctgagatagagaaaaccttgctgtattgaaagaatgaaaaagacttgtgaggctggatctaagttgtccgaagaggaataacatcattgttcacatgtatggggctatactaagatgccagacactgttctgagagctatttctagatctgctcattaactctcctgataatcctatgcagtggatagtatcacattatccattttataggaggaaacagggtacatggcttgtaagtggtggggctggagttccagaaatattccatgcataagcacagagtgcttaaacacacttccttggatccccgacacacccacttaagtgtagaattgaagcgtagaatgggtgtgttgaggatccaaggaagtgtgtttaagcgctatgtgcttatgcataggatatttaaagatcaggcaatatagttgccagaatttatagtccatagtcctttcacctgtgaaaaaaaaaaatgaagtgaggagagcaatatattatcttgacctcacagggaggaagattggcggtacaacttttacacaattacagagacaaacaagtgcagtgcaagaatgaaaacctatcttgccttagactccacaggttatctgccctggatcaatcagggatgcccctgcacactcacaggccagggtccgcatgctctggatgcagggggctgtgtgcacacaggcacacacgtatcttattctcagccacttccttgaaataaccaggaatacaatccaaaaggagtgctttgtgtttctgagaaccctcaaagaagctttgaaagacttgaagagaaatgatcttaacaaaagaacaaaaaaaaaaaaaaaagaaagaaacttgaaagtgaacagaagttctgaagtgtgtgggggtggaagaagctttcttggagaggaacagtaaggagatagctaactcaaagcgaccagaatagcttagcgagctgagaattgagaattttgtgactcggtggttctgctccatagggacactgccggctcccggggagaatgcatcttactctgccccctaggcaggtccagtttctggacttccctggccacacagctggagatttccacatcatatattctgcttgtcttagaaaactgaaggactgattttctgggccttctgactgaccagagagcgttctttgtgagagacacaatagctatctattcctttgtgcagtgtgctttgccaagttccatgagggcagcggtccctgctatctttgtgtaattctgggcagtctgagtcccacaaattggatttacacagcacctgcgagttctcacacaagcccccttgttggtaatatcatttggcatatgtagcaagcattcatttttatcatagtgttaattgttagccatggcagtaacaagccagaaaaaagcacaggcagaaaaaaagccacgtctgctcaattaaaaggggtaaatggcttggcggcacggcagggtgctgcggacacaaagagcaggtaaaggaagtgacctgtggtgttgaagtttatttgtttgaacagctgagaattatctcctgacctaagtcacctccataacaggtggccctttctgtctgagtcccacagcacttggcttgagagagtgtccaatctcattcatgtggaaaagatcaactcttttttccccctgtaaggaaaaaaaaaaaggaatgtgactggctgttcaattgtaatcatttctttgagtgcctctgtgtggaaaggatgctgcctcacctattcctcagtttccacatctgtaaaatatggaaactactacttgctctatttcccttcgagggctttttgggaaatccatacagtaacaaaaaaaaaaaaaaaaaaaaaaaagacaacacattaccaatgctaagtgcaaagtcacaaagtcatgttacaaatgtctacaggagcaaaactacagtcaagaacaatgtcataagatattttaaaattcatggctgtggattatttgttgagcacttgttttgctgtagctcctggtgactgggggatacacactccttgtgaagggctctaggtgtggcatagacagatacctctgcttccatagcagccttcttctgaaccccatgctattacctgctggacagtcagcagtggggcaccatcactgtggcaggtgaagcactctaccccaaagagagagaaaagctgcctttcattgcaagcctcctctccagacacactctggagtcacagcagtttttgtctgtgtggccttgtcctaaaattgctggctgttctcctcatcttcctttctcttggatcagagttagcactgggagaaccctacagggtgattgtcagaccacaggcatgttctggctctgtggtctgataggctgtctgtgggccttctctgtgtacccaagccatctctgattacacacagagtgccagagaaaaacaaaacactttcagtttaggcaaagttgagaaacccatcaaaataaacactgttgatggtcacagatttaaaaaagaatatgtagagagataataggtaaaatgcattgacagtcacagacataggctgcgtggctggctgcccctactgcttaaagcactgtgtgtccggagatctaagtgtcattagtggtatttacgaatccatcaaatgtgcagatttttactttgcagatcaagtaaaataaggagagaggacgagaggcatgctgagactccatgctgcttgaagagaaaaaccctcatttgtattcctaagccctttgccatgaactgctgatgtccccaaacaaaaagaaagctcgtggtttctgttctggtaaattaaaaagccctttagcttaacagcaaagcatctgtctaccttgttatacatatggcatctaatcagaatgcaggaggtcagggcagaggggagtaaagaaagtgaagatattggggtagaaagctaaggaaagtattaaacctaagatttggggagtaaattagtaaggaaatgaattttacaaaagaaagaggagaatagcaaatgagaatcagggaaggtaacaaaaagataacatccaaaagaggagcaagaaagaataaacgggaaaggtgtgtaaaactgaaatgaagttggttgacgatgggaaaaagagaaggatcgtccagcagcagataaagagcagctggggagaacgtaacagattctgatcgatcgtgatgtctggatgagctcagtttcagggctgtgataatctttacaatggactgagctttgctctcggggtttatgatcctggaagaaccacttgattgactcatgattctccaattgatcacttcatatcagcaatctttgcttctatgactcatcaccactcagaacctctcacaaagaagctgttgtgtcttgagaactttggtgatattaattattttttaaagagtatattaaaacttagatagcccctgttgacattccacaaggagaaaaatgccctaaataccaatagctgcctgtgatatcctgtgatagaaaagtaataaaacaaagtaaaaattaggaggcatgctagactgtgcttctatttccttgctgaactaagtcgcagctttgttaagaattatatagcagttggcatgtccagttgatatttacttgcaaaatcatcattggctcttatacagctcattcttgactctgatacgccaacgttccaatctacataaaggtctttggggtagtatgacatgcagtgattctgagtatgctttagaagtctttaggcagtatagacctgacttcaatctagctagaaaggtggaagacaaaactctttttcagctgaggctctttctcagaacagaggcctttcctcctcttcctacacacaaaaaaatactcagcctgggtaggaggagctggctctagcccaatagagcagattatttaccagtttcaattatctgcactaatgctccccttcattggtgagggtaattgagagttgaatgtatttacaaggacagggctataaagctgaaacaattttacaaggtgtggtgcagaaatgaaaaggtagaaaaagagctggtctagacaatgctttttgaaaacatatttcacataactctagcaagattgctaggtcctgaggggaggatgggtatttcagaagagctattagaagtgctattaggttttaggagatttttgtggagttattggacatttcatattttaagttaggatgagggtattatctctgaatccaattcctttctctccttttatttccaaacccactctggtcttcatcctgctgtggtgtgcttgttcccaggagcaatctagcatcccagtggaaagtggccgacctaaatgtggctctccaaagacaaaaaatttattctgggtattgtatgatgacccagatacagtatgatataaaatagaatatattactgtgggtctgataatgtcgatttcaagtttcctaacctagtatctacttatagtattattatttttaggtccggcttctccctttacaaggagtaatgactatgtgtggccaacatatttggctttattactttaactctcaatattctgatttctctttagatcatataaatcttttgcctttctcattaactctcaaaatgagaagccaaaaagttttgttgctgttatagtttgattttttaaagtatacaaatgacatctgctttcaaaaatattgaaaccactgggtttataacttcttgaaataccagttagtttggtgataaaagttaaacgagacaagcatgaacttatcgaaattacaactccttatttgcagcaggatagtttttgatgataatgtccactgataacaatgatgaaataaactacatgcatttcccctcaaggcctctgcacatgctctggggcctctcctctgtgtgtggctggctcctctcatgctctggatctcaccttgaagtcacctcttcagggaagccttctttgactctcctgcctaaatgacattattctctacctcagcactcagcctgtcctttatagtacttgccactgtttctagttgttttatttatttgctgatttaaaatgagtcgatctcatgactacactgtaaattacctaagttgaggagatcatgtttctcacgttcactttttcatcctagtgctagcaatgacctgacatgccacatagtagatgtacaactaacatctacttaagtgaatgcaccaatgaatgatgcctgggttatcaatgtgatgtacacctcttcattcactattacctgctctgaatcccataagtaattagaggttactaggtttttatcagagaaaagagaaaactcttaactttcataaacacttgaaatatttcttttcctttggtactactgctgataatacctatgactgctgagtggttggtgttttccaggcaacttgctttatgagcattcctctatttaatattcgcaacaaacctataacgggtacttttattatcccactttacaggtaaagacacagagagttggcgaggttaatgaatttgcccatataggctattaatcaaggacagactgtaatttaaactcaagcctatctggtgccaaagctcactgtcttacccattgctatctatggtaaattaaaaatttagtgttgtaactatctaattatatgtatcatacatatttactactagatataaagtattatcagaaaaaaagggcttattccttctcattttttatcttcccattcctccccacatttttattaatctattaacatatgtatttaattcttatagaacctagtatagtaatctgctatgtgaatgctcatcaataaatggttctttgagtgagacctccaaagcagcatatgacatggtacatgttaacctttaggtgaggaaaaaagccaaattccctaatttatcttgctgctaacggcaaggttgaacaccaccacagagtatgtatataaagaggtgcagttagctgacgccctcctctgttcccaaaaatgtttaggtaagtttttatccgggaatagtaaaagctccaaaaataagaaaaatcatcctggaaactatatttattatttatttattttaaaattaagtaaaattaattaaatgtgaacccattcacggaccctaaggaaaacaagataacatttttggggggcattaggttttcactgggaattcttctcaagggccctgtagctctaaacagtatcgttaataactccattggatctcatggcacactccctcacaatttcatctgccaaatacataaaatttttgacaagttaaagtatatttcctcacctagaatatagaaattgaaatatttgctgaccatcaagctctcagaaatttaacaagagtcctcatgtcctggatttctttgtagtatgtctcatgcacagcacgcaataaggctctgtacacaatcaggcagaggaaatgtttgctgaatggaatttctgtaaggagggattcatgtcatagcaggatttccactgcaagcctattttaagacagaaaatatttatcctgtctaatcaaccaaaagatcagggtctgaatgttttttaaatctacacctatttctactaggaggcaccatagagcatttgtcaaatcttcttttactttgcttgggtttattaacacaagcaaaataaaagaagatttgacaaatgctatatggtgaaatctaaccaaatagtccaacagaataatggggcctgaaaattctcttttgcacaatagtctaatttttgcccaaattaccgatttttgctctgaatagtacacattaaatgactagaagaaacagtttgaagacatataactgtcctactgttcaaattaactgctgatacagtcattgcaataattgctcccattctgaaagtgtctctgcaaacattcttaccacaaaaaagacattttaagaaaaaaatacactaaaatattctcaatacaaatatgtatgtgtgtacattcttaaatattacagaatggtactgcattcttacccaaatgatactattacttatctaaggaacagggtgatataatacataaggttaattgtgaaataattatgattcatacagtgatctggacagttcaaaacaatggcttaatattttcctgtgaagtaacttttaaataatgaagttattaatatttacttgatttctggcctgcatttgccaaaaaaaaatttaaaacttaatttttaagaggagatgttgcaataaactgaaagataaaatcttttcaaagggagaagtgatcgtgtttcatagtttttcaatagtataagttaacaaactaactaaaacttaagcttataaacaggatggcagtgagctaccaaatataaaaatgtagttatcctgcactgaaagggttatttcttatattacttaattgttttgagcttactgtttcttacctaaaagttttgtttatttatgtactcaatactgaatcagatctccttccacacttcagtgatcaggccatttacaactgaaatatttttatgcatatggactcgaagaggcagttactgaaaacgcatactttcctggcaagaaataatgcaataactgttgaaaataatgctggcaactagtgttttcctttgctgctaaatggcatgaccagtgtcataggagaagataaatagtgtgtgctcattcacttgacatttttagcacctgctctgatctaaactgggtgccctatctggggatttcattttgctaatgtctgcattaatcaacacagtctcacacacacaggcacacaggtacaccacaaaaaaaaggaagagagctctggaagtagagctaaaatgaattatttggggacaaacatatttctaacttcagaaactctgtctttcttttgaaatgtccaaagcgaatggtatattgatttttgcagcacactctgcacttttcactgattggtatcaggattgtgaaggcatccattaagtgagctcaaaatgctctcctagtataaacaaaatccacagttttaatcaaatttaatgtactctgacctatatgtgttttgtgaaagtcagagtggactatggcaacagaattgaaagcatatattacaaagtccttcacctttcagatctcctgaaaggaaggattgtcagaggtattgtctatgtattcttttaagtcacctctgaggaggcagcaggggcatggggaatgagatttgcatttcagagctggagccaacgtcaggttatggagatatgatgaattaaaatacatctgcatctgaaggacaatgagatcctgtggcccagggcttcatttcttagtgtaagaagagcaagagtttcaggtattcacatctcaaggtcccatctcagaaggttcccagcaatgaggtaaaatgctgcctgaatactgataaattctccttgtccaaaagtgaccaagatcttattcctaacacaaatattgttaatggcactcaagcagtattgcttgtttgtttctcaaattcacggagtgctaaggctctggcagttttactgaacacactttactagtaaacttaatactgttagagaatgtttcagtgtaattacttttagttcatttatgaaaaataaatgtattttagtacacaaccattaactttccctagaacttttactgataataatgtctactgccatagacaagaaaagggtcaaatattgtcaacaggattacatagggagaatcagtgaaaagaatagtaagtattcaggtaagaggaaggaattttggagttaattcaagaatgatggggatatggcacaggatcaggggaaagaaactttttgttttgttttttgagagagagtctcattcttgttgcctaggctggagtgcagtggcacgatcttggctcactgcacctccacctcctgtgttcaaatgattctcctgcctcagcctcccaagtaactgggattacaggcacctaccaccatgtctggctaatttttgtatttttaggagggacggggtttcaccatgttggccaagctgatctcgaactcctgacctcaggtgatctgcccacttcagcctcccaaagtgctgggattacaggcgtgagccactgctcctggcctatatattaaccttttatgtaacccaaggcaacacatgcaaactcacattattctcagttttcttatctattaaacttggatgattatatatctgttcaacagttaccatgagaagtttgttaataattatttttatgatgatgtttcctgttatctatacaaaattttaaggtactcaaaatattttctcttattagcactatgctaaccctatgatctagtaaatactggggagaatagtgttcccagaagacacccctttcctctagaaactgttagacagtcatgcagtacttgtgaaggaacagagtagacaaccaggtttggtatcctaaaatcacattggcttacagctattcatatgtcatgataatctcttagttggagaaggaaaataaaatgagaaacagtttcttcttcctgtttcaaggggaacacaatagtcttatctttacattcagctaccttgggtataagtatcagcttttcgtattttgcctttacttttccgcccatgcagattaatgttgagatattcttaacctaacacacacatgcacgcacacaaacacaccaacacgcatattgcactcatccatacaaacgtttgggcttatcaaggtcaatttaagtttttttaaaaatgtcataatatttatgttatctgtatttttatgtgtctgtctttctccccctttggaatgtaagcttgacaaaggcattggtgagatctgaatttgtccattcccttttatataactatttcatttcatgtatatttttattctcaattaacatacttggcttcttatagatatctctatgaatgtccatctgaccctttcatttttagattcttcagagcagagattatacctttttcaattattcaatctgaaaaccaagaacagtatcttatatataatgtacacataataaacatgtctatgattgaattctatatattgaatcactacataataactgattctttgcacagtgatttgcatacacaataaggatataatgattatatttacctgcctagactttacagtaccaaacttgaggtatagatggcagtgctgggcacacactggttaaatgtgttgatgagaaccctagctcaagaaagccattgttccctttatctttctgcctggtcaaacaacttttgcaaaatctggccctgagctctccctggctttcatttagaggtaaaatcaaacactttgttcaagattttctaggataattttcatttttaaggtgaagatattgagacacattcgttctttcaagacaaagttattgacagacattcccagtgagaccaagccgactagcagggttgtacccatacaaatcctccttcctttatcctcctctccttaagcccactttcatccacagaccacagatacaaggactaagacgagggaaggaaagggctgataaatcacagaacaaatggtatacaatgaatggaaataaaatgctgatttcctaatgagaaacatatggttatgactacgtaataaacatcagaaaatgctctttcatggctcccaatagtcataaagtttctggaataaagaggaaggaaagatgcaatttaatcctataacctaaatgtctgaggatctacctttctcaatggggctgtcttgttaatgaactagaccaggtttctttgtgtagctttcacctgattctacgtaaggctttctgccaattgctaaacataggccgctgaaagatgaataaggagggaatcatcagctgttccaccaggtcagaagcatgatctttaactaaagggccagatggcttttataaattaagcacaaaaatctctcatttatgcctttttaaagtaaagaggttaggagttatgtcttatacttctttttaatttttaactctattatatcccttgcaccaatgattgagagttattcagttataataaattatatacttatctttagttaggctatcagactctgtttatacagtagtgacaggtgttaaggtccagagaaaaaatttagggttctggagcctagggtttgcctacacattgggctccttcttcattggttcacatatgctcctgtctacggcttattatttggtatgactctaaaactcattccttgtactcacataccatgtttactttacagaaaaaaatgttaggacttaatacacatgggccctatgaagatgaaaaagctgcttttaaatgtttgttgttgtttctatgaaaactaccacgctgttatgttctagttcacatataaagagttcattctgtttaaataagtggaacaactcacatttatattccacactcaggacccatatgcttggccttgtgctggtaactaggaatataagataacaagacaattcccttgctttcaaggaaatcacactttataaaactttgaattcttgaaatgggtttcagaggttccaaggtcaaattcaagaataagagtttaagaagaaaaagactatgagaaaggaagtgttgaccccatttgcatttaaatagcaggaatagtctcaatctactcattggggaaaaatgtatgttgcatatttttgagatattgcaacttgctctctctctttgccaccccaccctttgtcatgctctgtttttgtgttgaattggcaagaaaaatggctggagggctggaagaagttggacccttcttccttcttccttcttccttctttcttcttcttcttcttcttcttcttcttcttcttcttcttcttcttcttcttcttcttcttcttcttcctcctcttcctcttcttcctcttcctcttcctcttcctcttcttcttctttcttcgggggcattgggagcttaggaggtttgggtggtaaagaaagggttaaatcctggggatgtgggtaaagggtgcactggagctgccttggggaaaaatgtggtctcccactttccatggacactttgttcatagaaaggacaactgctaggaatgaacaaaaatgaacaattagattcattgtacaccttctagtacatttgaggctctgtgatcccagatgcttacatcatttaatcctcataatgaccatatgatagatccattttacaaatggggaaattgaagtttatcctggaaatttgttgagattaatctctatttgattacaaaatttatcttcttcttgcagttttggtgacttggaaatcaccccattatcttgaaaaataacccagatatttaacgtattctataaatccctggaaaatacaaaagagttgcccaatgtagtgcatactctctggtatcatgagatactgacagttcaaacatggtaagctagcctaattaggaaactctccttaaataggtgaccagggttttcttctaaaggaagaacaccatgtcaacattaaggagttcaatatttgctgatgaatgcagtaatccaaagcaacaaaaagttcctgtggaagaaaaatatacagtttgaatgggtctcaaaaatgtgaaaatggaacactgggatatttttaaggaaattttctttcaacatagtgcacccatgagagtgattcattgtcatctggaatcaaggatgaacgcaaacttgccctttcactgaattagtctgacatacatctacaaagagttcaagccctcctctgggttatggtggagcagccaccctcagaggaaattctcaaggctgtttgtaattgcaaaggtcctgctgtgggactggaaggataccactgaaggcaagcctcagcagggctttgggaggcattcttctgtggtatatacaagctgctctccagggtctatgagaaacaaagcccagggattgaagctctaggagctgaaagggagttcattctttgtgcagttaccttaggtaaaaacaatagttccttctcttttccactgttcccatgaagctgttaagctaaatgtccacagagggatacaagtttgtatcctactccgtgctctgtgtattcataaatgattagatggcatcaccaatgtccttccagctcatcagcctttccaaaatagtcctgaggagcataggagaagaaatagagacaaaaatttggatcctcaggtctacaacctggctgggccaggatgtcttttcagggatcattagttagaatacacagttatacatttgcataattctgagatgagaaagactttcctcagaatgacaccaaggtcgaaaaataagattagaaaacaagattaggaaaaatggaaaagaataaaacatttaaaacataaatatgtaagctttcataatagtaaaatataaataacaaattgggaaaagcagtcatatgaacagactttataagaaaaatatgtactgctaaagcaaattaaaagtaaaatatacaaattggaataagttgactatttttctcattaaatcttaatgataaaagcaaatgattttccttatgttgataaaggttttgccagaactgtaaattggtacaagtttcctgaggcagatgtggtaatacttatcaaaagtttcaaaaataggtgtaacatttgggtgaagtaatttctatttctaaaaaattataataaagaagcaattaagaatgttcacaaagaattagttgtgagaatgttctttgtactgttgtttataatgtagtgggggcagaaagtgaacctaaatgtcaaacaatagaatttgagtaaataagttttgttttgttctaagagatggagtctcactgaagtgcaatagcatgatcatagctcactgcagccttgaactcttgagctcaagtgatcctcccacctgagtctccccagtagctggcattacaggtgcatgcctggttaaatacatttttttcaggtccctgtaaagtctgggatgattaaatacattttacagacatctttacaacagcatactctggagctattaaaagacagtgctgtagatgtatatctattcacatacaattgttatgttaattacataatattaaatgaaaaaacccatttgcaaaattctgtatatggcaatttagtttatgaatatgtactaaacatgaaaaaatacacaccataattttcacactagctgtctatggctcgtggaatcagagccattatttttgggaaggggagttctctttttattcaaatgcatttcctaatatttctttaacatgtatatattacttattttttttaaaatattgaaagtaaaattctttaggatttagtctggaaagaaaatccacaacagtgaaatttttttttcccctgctggccttatagaagcataagtctttatgtgcttctgcagaggaaaaaaaaacagaagcaaagtctaacttctagcagctctaattagaatgaataaaaccctacagttgaagcataaccaggtcacagatttgacatcttataaagagcaggcactttagagacataatgtcctgggtctagcctctgtgccttgcttatatgaaaacttgaaaaagtaacagaaattctctgaggcttattttctacaaatgtgataagaagataataacgcttatggcacagggcagtgagaattaaatggtaatgtgttaggaaacatctgttatgtagtaggtgctcaaaacagttttagcttccttccctttttcccttgcagtcttgtttaaggtatcaaaattagagcagaacattgccactgccatgtgggcggggggagactgattcctcgtggactgagggaggttctactaaggagtggggtgagtgctgtgaggcccaggacaaagatctgtctcgctgcaaccctcccctcccccagcacaccaattcctgtatcagcatttgctaggttgctctaattttcctttttatatgttcttttctgtctgatgtccttgaatgttgggagacagaaattgccctgggacttctatgtaatgaaaagagagtaacagtgaggatgctgatgctggatggagcttgggatggccataggctaagaatcctagaagagcctagacaaagaatccttggaaatttcgtataatatgcaaggttcagggaagcaccagtaaatattaacttccaatcctctctctctctctctctttctctctcagcttgttttcctcttctttttctttatattttcttccccctcccctttttctcctttcccttctccttcttcctcttctccttctccttcttctccttcttcatcctcttttcctcttccttctctctttccctcttctctcccttctcctctcctcctcctcatgctccttcatattcttcttcaatatagggggtaattttatttggataaaagaaaattatcagattattctatacttagggcctactgtcatcttcccaaactctgctaggcaacattctctacaacaatcgcttgtctcatacttcttgctttacttagaaaacacattcatttcccaaaggctaattaaagaaatataaaagttagagttacagtttgtatattctcattagcaaatcaccaacccaggggacaagaacaagttaggagcatctctaccaaaaatctaaggaattgcaatccatgtaaagacactacgttaagtgttgcgtgtgttaccttctttacaaattagagtcctcactgctggattgaggctggcctaatgaagttgtaaaatgaagatatattaattctttacctggtgcttttattaaggaaagttatctaaatcatttaatgaaaatcaactaaatgtattacctcctacattaggaatacagtgacacagaagaagaaaaacaactcttggataatgactctgggcagaaaagggagatgagattgcaaacaaaatatcccaaaataggtttggagagaaaatgagaaagaaagagtcttggtgattgaagggaattagaaatgatagaagaaggggagatacatagctctctcttggttgattatcttgcactgaggaatttctatgagaacggatctagggaagtacaacttagtccaggttagatgactttcagaggcaatttctgcatagaactagattcctcagtattcagaagaagtatggtagaagtttgcccggatggcacaaactggaatgcctgtatgagctgatttaccctgactgacgttcagattgactgatcggtaggattttgctgttattcacccacatctccagtttgtactagcctagaaaccttctatttgatgacttatttgtcccattttgtctcaaatacatagaaggggcgaaaaacattattctagtgggaggtttctgtcacttttgttcattctgaatttgtacagaaggtaacacacacaacacttaggtggcatctatatggttgttatttcattagatttctagtagagatgcctctgacctgttcctgttccctgccaaaccaattctgagagcctgattaaggcaacagggtcttgaggtcaagattccacaagccaccgttgactaattaaatatcacaacgtaacagctaaacttcctctttgtagcttcagagactccatagcacaaatcttccccctaaatcatataaacttgataaataaagcagcatgcatataactgagcatatattttgaaatgcttctaaaaagtagaacatcaatttaaagcattaaaaaaatgttagacttctttcttttttttttttttttttttgagatggagtctcgctctgttgccgagactggagtacagtggtgcaatctcggctcactgcaagctctgcctcccgggttcacgccattctcctgcctcagcctccctagtagctgggactacaggtgcctgccaccacgccccgctaatttttgtatttttagtagagacggggtttcaccttgttagccaggatggtctcgatctcctgacctcgtgatccgcctgcctcggcctcccaaagtgctgggattataggcgtgagccaccgcgcccagcctagacttcttaatacgtatgcctctgatagactgccactttctcctttaatgataagtttctatttgcctcaccccccccaggagttgtttgctcttgagtaggacctatgcttaaatttgtacctgccactgctgacactactaccaaatcaattgttcttactaagttagtatcttatccgagaaagaggcactgggttttcttcatcattcaatcaatctctagaggcagctttcagtgtctctcaaattctatcagtaaattgaagtttctcctgcctgaactgcaccctgacctcaccccttggtgagggtgccccatatctcatccatccatgctcagacaaatgtcacagatctctaattcaactcttattatgtcatcgtaatggatgaacaaatgaagtgaatttacagacagcaatcctgggcttcccgtctttgactctcgatgtatgggcccctcctgctgcatatttacatacaattagcaataaagtagggttctcacagttattttgtttctttgtacataaggcaattttagtgcctttatatatctagtatgttcttacactctcattcactcattcatttaaaaataattttgctcaaaagctgaagatgcaatatttatgatcgaggagatttattaggacaggagaaaatatcagatgaaagttggatgactggtacaaagtgctgcagaaattttgaagaaagaaagaatataacatacaactgagaaacaatttaggaaatgctactttcaagtacttaatttcattatgggtgcctgtctcttttgctatcataagacaaatatagacccaaagcacaggacacaagcattagtgaacaacttgggaaagcagcattttccagagtgtgctccacagaaatcctacaatgtatttcatcgaaaaagattccatggccactaaatttgggaagtgccacctaagcaaccctctctcttgtgggtcacagtaaccatcagtatattaaagactctgaagttgtgcacttaaaacaaaataaaacacacacacactcacatacacacacaaccagaaaactgtttccttccttccttccttcttcccttcctcccttcctcccccttcttcttcccttcccttccctttctctttctttttgacagtctcaccctgttgccaggctggaatgcaatggcacgatctcggctcactgcaagctccaactccctggttcaagtgattctcctgcctcagcctcccaagtagctggaaatacaggtatgcgccaccacacccagctaatttctgtatttttagtagagacagggtttcaccctgttggccaggatggtctcaatctcctgaccttgtgatccacccgccttggcctcccaaaagtgctgggattacagacgtgagccaacatgcttggccaaaaaatttcctatgtttaattttgatttttcttcccttttgaaacgaatgcatatagtattactcttaggagtactatttacttgtttaattcatttattgccatttctacatatcactgtgctggtgactctgtgcatgtatatgcagggcagaatatgcattaaaatcttggaagtgcaagttggcggaggatgaatagaatatgtgctattggaatccaccacaggatttttaaccttcttcctgtaccaacccattgtaaatgccttatacagagtaatagcagaacactatggcaaggggagtgctccaataaatatctgacgggaatgatcttccttcacagttagtattaatatttgtttcattgtctttattttaattattttccattacctttctatgaaagataaagaagagacatttgtatatctgtaaccttcaccaaatgccacctgcctggtaaatgtcagcagtccccagggctttgtcctgggtccctcctcatttgcatcctcactgaggaacatttgtctccttccaagtcttcatttagtacctcattctcttggcattctatcacaagccctacacaccagtggccaggaatagggcagctcaaaccagcacacacacacatatttctgtgactttactcatgtttctacatcatcagagttgccctggttctcactcatcacctgtcaaaataactttcatctttcaaggtcgacagagccgtattaacatagcggtcaagaacgtgtccaacctagactgggttcaaatacagactctagataataaccttggaataatgttggtacctagctcaggttgaataacatttaacacaaataaaataaaacaaaagaaaatatacttccaaaaacctttctctcataaatttattagagttattaggttggtgcaaaagtcattgcagtttttgtcattacttttaatggaataaaaaaacgcaattacttttgcacggaccaaattgttcttctttggcaatcccctagcaaatcaattcaacttctgttattcactgacaacattgttttttctactggctgcagcttttcacaagtctgtgccctctcttcactgctataaattgtgagcgcaccaaggagaagactgtcaagtttacctttttgctcatattgaaagtatgtggcaataactggcttccacaatctgtgtgttgatttggaaaatgaagattgaggtacaagcaaaaaaaatcagtgaagcaccatttaatacagaggggaacagggcatatttggaagtgaacatttatttctgaatccaacatcagtattatctagttggctaactttttaaattttttatttaacaaatgtacaacatatttaatattgtgatgtggacttggccctgtcatctagaaaggccttagcacaggtagtttaatgaagtgtcaggtgagaagctgtcccatcccctattaagcaatgtattgtctaaatgagtttaattaccatgcaaattactaggagctcatatgcccaaggcctacaacatatcagatggcaggtctaagagaaattcagtaggctgtgcctctctttgtagtaatgcttttacgtaatatagaaaaaatgtcaatgtaacaagaataaaatgctatgattcttggcaaatttttaagtcagtgaaatcactggtaaaaattgtagtggacttataagatagttgatataagcaagtcactttcaagaatagctattaacttatttgttctcctttctctaaaaacatactggaagtgactaaatgtctgaatcctgcttctacacaaccatgaatattttggaaaaggctacaccactcatgtttatggggaaggccttggggtgtgggcatggactggatctgaaaataaaaggtttatatcctgggtcagcttactaaatgtgatcttgaacaggtcactcaacatctcagagtttccattttctcttctgtaataaagactagtgatgccatctttaagatatagactaaatgatttaaagtattttcaaaactcatgcaaacataggtattatgccatagacaatttttaaaagtgaaacaaaagatatattcctgttttcagcctctatccatagacagagtttgggtctgtcaaaatgttaaccgcagtataagaccaatctgaagtgctgtcagactaatggcatctttacctatcctgaactgcatggttctttcacacacacaggcctgacacaaaacagtatatcttgtaagtgctaaataaatatgaacaagatgagactgaagttttattactactactcatttgaacatctttccaaatactgaccaaattacaatgtaatagaatgtgaccgtctgttatctaggaaaaaaaaaaaatcacctaatgctttaacttttacaatatgtctaatctattcagagccaagaataacctgggagataagcacatgaattcagattggatttctaagagatttttagcaaagtcttcaccaaatgtgcctagaataagtcatatcttctgagcaataccccaaagagggatgattctacaagagtttccaaactttcttgactgcaaccctcagcaataaacactgatttataggtaatgagatggaaacatggcttattacttatatacataaataaaacaaaaatattttactatttgcaatgcactctgatattttctatcctatcctacataacattcaaacaaaatgttatattttagtttacttaaaaagtatgtggttgacaaactgttgatgaattctacatcatcagggttgccctggctctcactcatcacctgtcaaaatagctttcatctttcaaggtcgacagggctgtattaacatagtggtcaagaatgtgtccaacctagactgggttcaaatccagactctagataataaccttgtttgggaaacaccgtgttgtggatccagcactgtgtaggcatataactatttcatagtccatttgcttatttggagagatgagaaaatcaggcctaggtgttcatgaaatgcatccttcaaagactgagtgagagttgtcagtggtaaaatggcactttgcagattacaaaatccagcatgaaccatgacttcaataaagagtatttgttgcattttgtaatagttgtatgcaaggtcaaaaggactaatattgtgcttgattttctcctttgcctctgcaataactgaaaaacaggtatacacatgggtaaaagaaatattaatatggtgtttcaataacagctcaataatttgattcagtacactgtattggattcttttctgtttagttggaactaatgggtgcaacttaaagacagttaaatatatatactttttaatttgaaggaaaaactttttcttttttatttaaaggcattgaactgaggaatgtgctgtcttatggcctagtgtttcttatctgcctgtgtcaaagcagtgcctgaaaaaggatttgcaagagctttaatggagaaggttccagcactgggtcatggagtagaagaaatatctaaacctgcactgattccagttctgtagcaattagtcacatgtggctattgagcacttgaaatgtggctagtgtaacctgaggaactaaattttcaggttttaattgtatgtaaatgtaaacttaaatagccatatgtgattagtccttaccacagtgtactatacagatctagaggaatcaatgtattggctatttgctaagtaaatgtgacaatttttgatacctcatattatcataatttataatgcatcccacatactaaaaagtgatctgggatccatgaaaagcagaaattacaggattcatatatttaaaatagaactattttgagactagagacaaacgtattgccagctttgggttttagtttttacatctctcaatgacaaataggtttcttctgattctccagagagactgctgactgcactgactcttattagtggccttcaagaagtcctgctccaaatttcagccactgcttgtatatacaattttagacattgaaaagaaaattctgctagttccttgaaaatggggctgtttatccatttggattgacacaagaaattaagacagggaatgtttttgtgaagttggtcatgtagtatttgtatgatgggactcttctaataagttcatttaatcttaaaaataatatgcaataggctgggcatgatggctcatgcctgtagtcccagcattttgggaggctgaggtggtcagattgcttgagctaaggagtttgagaccagtgtaggcaacatggcaaagcccaatctctacaaaaaaagaaaaaaaaaataagctgggcatggtggcatgtgcctgtaagtcccagctaacttggaaggctgaggtgggaggattgcctgagcccaggagtttcaggctgcagtgagttgtcatcctgccactgcactacaacaagggtgacagagtgaggaccagtctcaaaaaaaaaaaaaaaaaaaagataagataaaagaaaaaaaatgcaacaaaactaaaaagaataatgatctaaaatttgtcaaacacagcaaaacaactgaccttttaataataatttggttgcatccaattttctccatattccaagaaactcttgattatatggcagttttattgacttacgagaaaaacccactccggatataataagcaatttgtgatatgcacagaatagaggtgaatgcacaaggataaactgtatgctttagcaattaaatccagggcatttaagggaacagctacactaaagtatagataatcaaattgaactaaggaatggggtctttccatgatattcccagtgagcaacagaacgtcatggaaaactccaatcagtatttcagtacctctttcttgcatgcaaacaaatcactaaacggcaaatttgatgtcttttacatcctggaactccaggctagagacacccctgtaaattccctgtgaggtgggaaattttgcctgagttgcagtcaactctggggtttgagtattcatgggacaggctgttatttaataggttcaggagaagaatttgagggaattccaagaattatggattttacaggcgcgggaggcacctaaggataattgtgtagaattcactgaggactaggaaatgatgttgacctctgagaatcaaagtaggtggatgcagagataatgtgtgtccaacagccacctctagaaaaaagccaggttatgatatttataaaggtgagaacaaaaaggtttgagaattctatataactttcatcaagatgaactaaggaaagcaatgcagcagtttgattgaaatgtaatgaactggactccaggcaattattgtgtatcctgtctagtgaaaaactgaacaaagtgaaaaagattagcttggactgtagaaaagggaaaccaaagggccagaatttggtagagtattgaacactggctgagagaagatagtctctgtaccaggaacttgcccaatttctgtgatagctatgtatacattatagcaaagtgtttaaaagctaggatctactgccagattactaattccttaaccttggagaacttattttcatctctgtgactcaatttcatcttctgtaagtgattataatagcatccatcattaggtttattgtataaataattgagttaatatgtactaaccatttgaaatagcactctcaataaatgtttattattatcaccccagagatagatacattagacatgttaatatatatgcaactcatacaactaattatctctattttaggttcaaggatgctaagtaattcttcgacccctgaagattggcctataaggagggatgcaccagttaggcagatatcagcattgggatacttatatcactctaaatttgcatcttggcattttggctcatagttcagtcttttgtgagttttattatcattagtcagcctcctaaatccaataactctagacactgataagtgacatttggaccattgaggctgagagctagacccagaactggtaaattcactaacagtatgctaaaggtaaaatctgttggcaaatagctaaaaagccatctgctgtagaccttgatctatcttctttcaaatatcagtaattcactaccaagattttaccaaatgccaagtagtttcaaattccccccaaaataaaaaggaatagattatcttagagatatttagagttacagaagggttacacttaaacaaaacatatcaatcattaagatttgccctgtcttgtctaatacttgagggttttgccactacctgaagactaagtcctgaattgatacacacaaaacagtacacaaaggaatcagtgatttttagtccagtgatacctagctcgtgattcaagtcaacttatcagtgtgctaaagcatactcacctatcccagtaaccactatctctccactatctctatttatgaacagaaatgcaacaatctatatttttagagtatgggcctaggaatttgtgatacagaatttttttaaagaaagaaaaatatcatatatatacttccattgcaggtctggcagcagatagctgttttgccactttctggaaaaactaatggcttttgatataccctccactatgtagtatatttgtgaaaattccagagtctcaaatgcaatttccaagactgttctgggccttatgctactaaccatgcaaatatccctcagctgaaaaattttaaacacatcctggggttgggtttatgttggagaagctctcacaggactatcggcccaggattatattgtagcccctaagtaggaaaggttttgtttatgttgcctctatttacatgggattttctttttttgaataactcaaacccaattataaaggagcagaactgagcctgtgagatatgaccaggctgccaaagaggaaatcgacaaagactccacaaactaaggagacaagagcagctgttattctggcaaggagatgcaacttgccaaccttctgcccagcggtgccacaccagtggtctgaacaataagttgagtttacagcctcccctgtgactatgccagtcacattcaagaacatctgccacagccttaatgacagagcctatgggaacttaatgagtaccccatacacctgtgcggttctacgagacagctgtttcccactccgccacctcctttctcagtccttcccatcacgtgtgctcactgccccatcttccccataggatacagctgactctcataccggggtctgtgcttttgtgaggatttcatttatctccatttacatggcacttataggcagtagagataaaaagcataatatctttcacactgctcaagcttcacagtttgctatgcaagagggtgagtgctggagactgagaaagtcaatcagaagaatcaatggtctaagagataaggggacaagaaggaagaagatgagaagtgctgctactttttctttgccaacaactctcagacacaaattagaaattcacaaagccatggaaacacttcacagtttacctctgtaggtatctatgaaattgctttggtcaaagcattttctggttgagaaagctgcctagtggaagacctaacaaaacaaaaaacacaaaacaaaatgcaagacaaaacaacttactaaaaatacttttaaaattctgagaattctaattacatggaaagtgcacaatgttagtatagtgcatgatagaaagaatctcaaaaactgtatgacctttggcaagttatttaacacctctgagtttccatttttttagtttgttaaattaggataattacttagatttggtaaaaccacaataaataaattatatatgttatataaagtgttttacataataactagcacaaccaagtgcttgataaacattattattattatcattattattattgccacatcaagcccatttcttatggctttactgtaaccactaaaaaatgtgttcttgttccatattttacagaataaatcattcttttaatgacaaaaaaggtgaaatatcccctagagagaaaaacctaaaaataatgatctcatttgttatgtaaatcaaaaggtatgagcttgaattttgtagatatatgactaacagaatgtagaaattcttcagtcattcatttcggactgtttacatatcagaagcattatatgttctatgataaaggccacgtggcatggcaaaactatgacaatattagtagtttatgttaaaaagaaatagtcccccatatcactagactgcactgtccaatatggtagccactaaccgaatatggtagccactaaccgaatatggtagccactaaccgaatgtgtctattgaacatttgaaatgtatctgctccaaattgatatgtgctgtaagtataaagtacacactagatttctaagatttagcatgtaaaaaagaatttaaaacaacttattaacaattttatatgaattacatgttgaaatgataatattgggttaaataaactatattatggaaataaattttatctatttcttgtttgttttaatttgtctactagaagatttaaaattaactgtctttctcctatcatatttcttttgggcagtgctgctcgggactaatgattctcaatggttcttatatatgcagtaatattttgtttataaatgtcacacaaggagcttgaaaaaaatttaaacccctggtctttcagtgattctgactccaatggccaaggaatttgcattttcaataagaaactggatatttcaaatgcagatggtcactggaccacattttgagaaacactgctatagactaaggtttctttagttgaaacatgatgttatgaaacacagatatgattggggggatgtttatggacagcatctagactaatatgaaggcagaaaaagagagggagaatcaagatggtagaagatgcccattaacctgctttcaggatcttctccctaataagtagtaaatataagtctgttactttttcccatattctagtgccagtggggatggaggagtaaagtctgcactgggccaggtacggtggctcacacctgtaatctcagcactttgggaggctgaggcaggaggattgcttgagcacaggagtttgagacgaacgtgggcaatatagtgagaccttatctctctggaaaaaaaaagtctgcactgcgaggacctctcaccagtaaattttaagatttgaaggcaaggtttacaaggctgtggtgaataaaagtgatgacataattattttcagtggtaactaataacattcttctcatttaacactgtcacttccattactactgcaaatcggctggtggtgagaggtataagtggtatagatcaaatctggagaaagagaaatattccatatagcctccatgtcccacttctttcatgatataccttagccactgtccacatagcaattacattccaggcactgggcaacaaaatcacaatcattcatggttgctgcagagacacagagcctctcctgccatgtccagcataagaggctctttcttggctgacacacaaaaaacctttcaaatataaagaaggagagactctgagggaaacaactcattcatcaaaccaacctcatccgccattaacatcacacctttttttgagattcttctattaccaatgcccttttatttccttcctaccaacttgatgtgtttgcctcaacaagtactctttcctcacagtttgctttgccgttatgttattgtatcttttgatgccttttttttttcgtccagcttacactagatgcaaaactgataaagttgtgctgattggatggtgactgcccaatcccagaaggacatccctcccacaattgcctttcaaagttgtcaccctcctatatgacgaaactatggcagtagctgggaatttttttttgcagtcaggtttaatcttcattttgctgaccaagccaccagggcaagcacctcttacattgagggtggtgtgctcttacagtgagagcactactacagttatcagtgatgaaacaggaattcctgatgcagtaaattgccttttggaaataaatggtagcatactttcaggcttaagttgacaatttaggtcattcccccaaatctaaaacttcctatcacaaaaacctgcaaagaaatcacacaattgttgaagttagctgctatactgaggtcatttagtccaatttttaatgcaaaatacctcctaattggatgtcactcttcctgaaatataaacagtaacaattgattaagtttcagatattcttgctagaagttttcttgacttaacccacttaaccctcagtagaggtattactagctccctccctccctttacaggtgataaaacagagatccagagaaactgagtcacttgcccaagattacaaattaaaggtgtgagctggttttgaactccagtgatccatttctaattcctaaggaggactatgccttaagacaattcatctgcattttctagacaccatggccacagttttaggcaaataagagttaggcctgggactctttaggaaatgactgagaaagagaagcccttccttcctttaccactggggtttctaaaaggctagatagtaactgtggaattttgcaaccatgatggcactgtaagtggtgagccagagatggcgtggtcctgagctctgatgatctggaatttactgctttctctgaaatgtgagccaatagattccttttctttaagccaggttgagttgtgctgtcacttgaaaacagttaagtccttaaggagtgaacaactaagtaattgacataaagctccaagtttgtaatgcttaagccaatatcttgcacatattagatattcaataaatattagtttttattcttccacaatgttcaggagcaatgattacgcttctctattttgcacagagcctaaaaagggctgaaacataaaaaataaatacattgaatacatgtctgcagatcaacagacatgttgagaactatacccaggagagattagacagtcagactgtacccactcatcatttccacttctggctctaagtaggagccagggaaggaaagtgctctcagcatggctcacaggggagactttcccaacaggattctacagattggacttgactcatagtcataatgtgccagactcaccccagtgccacctggttaatcaaagggccagaaggtatctgtggaagaaagacttaaggaagccggggaagtagatagcagttcactgaagttcctggcatttgcctgagggcacagctggggacattaataatcatttttctcatcagactgctgaaaatgagagcaaagtgagaaagggaaaaaaacaagtgttttgctgcctcctgtttgaattaatctcttctgacaactgctgatttgggtttgtgattcgatcttccatatgtctagctccattggtcaattaagtgtcgagggtgattgggggaagcagtgacactcagcctgattagaggaagaagcatcacaaggcatttagaacatgcaaagcagcccactgagcctggcttaaacagagccaagcagagcaagggtggtgtctggtactgccaggagggtcagggaagagtcgaacctcagcactcagagcactaatcaagtaaggaggacatcaaagtcagtttcctgtgagcagcgagtaagctctggagagttttggagggatctaaggctcatgcaaagttaagcccccgtcaacccattcaaatcttattcttctagactgtccaactaatgaactactttcaacaaagtatcataaacttgagaacagaaaataaagtcatgtctaacttggagagttcaatttatacatttgaaggaatcctctgaaatcaagaaatgggatagcagaacacttaagttagacaaaaacaatgcagaagcagtagtgctcacacattactatgcagtaataaaaacattgaggaactatgagttctagtcctacctcagttaatggcttgttggttactttgcagcaagatgcttcttttcttcattgtcacttccccattttttttttttctttgagaaagaatctcactctgttgctaggctggagtgcagtggtgcaatctcggctcactgcaacctctgccttctgagtgcaagtgattctcctgcctcagcctcctgagtagctggcactacaggctcacaccaccatgcccagctaattttctcatttttagtaaagacaaggtttcaccatgttggccaggatggtcttgatctcttgacctcatgatccactaaggctcagcctcccaaagtgctgggatgacaggcctgagccaccatgcccagcctacttccccatttttaaggaggctgatggaggaagtgggggcacttgtacgctcctaaataaaactgaaacttgatctaacagctgaagagaatgttttgactggagcaatggcagcctaaagtcttttatgagttaaatgctaaagtacttcatgtgactgtttaaaagaatagctaataaaaacgattgtacgctatttttttataaagatccatatcaatgctcaacaatcatcatagaaggcaacaggctcctttaaaagtaacattatgtcaaaaaagcacctatgatttcttggatgtagtcacagttttgttgttcaaatttaatgaaaatagaacaaatgtggcagttgttaaaaataaatggaaaaactttggctggattgcaaactagttaagtatgatcttaatagaataaccatctaagcatgtaaacatgtggatttatatcactctgaaggaaaaactaatagcctagcaaagcctccattcaatgctttatctcattcaacatatttattgatgactgacatgggtaaaatatacttaaatagagagattatcaacttacttccccaaatttaaggagaaaagctaaggcataataaaagcagggtacaaaatgaactagatctgctctattccacagttgtcattgtaaagatcaaatacagatcaatgccacaacattaaagatataacaaattttaggtcaagtgaagaggacgtgtgatggtgaagaagacttgggcactgtcagtcaaagaaaaattgaaggaaatggatcaagagagagcatgtttgagggaaacaatggcaaaataatcagtctattttaaaggctttttaatggggaaaagatttagatttattctgagtggatccacaagcaaaatactttagagagatagattttgacacaaatgaagagatttttttaaataagtaaaatgactttcctaataaatagtgagttctctgatgggagatggggctcaaaagaaaccagggaaagactctcccggtaaaagagattcacatgtcaagtaagcatctagactgcatgacttctgagatacttgtagttctaaaactccttgattctattaccatagaagaattctacagctatttattttacatatagaaaaagcatgttaagtcttgagaaatatgtatttcttagttaactgtcatgatgggaaaatagaacattaatagacttaaatatctgaatatacgtgtccctccaaaattcctatgttggaacttagtgaagtgatggtattgagaggtgggacctttgggaggtgattaggcctcagggtggaactagtgcccttagaaagagctctagagagcaaatatgttccttgttgacccctgctacctgtgaggactcacagaaggtgctgtccatgagaaacacgcccttaccacacacacatctgccagaaccttgaccttggccttcctagcctccacaactatgataaaataaaattctttttttttaaatcaatctaaggtattttgttacagcaccccaaacagactaagacaaatgtaaattctgtaaattcttaagcatacagtagaaggaataaaatctaacactaacaaatggtagagtttttagagaatgaataatctatgaaagaaggcatacatattgactactatgaaaagaccgcacgtgacagaattgtagggagtgatgtttaagagcacaagctctaggttagctgttttcattcaaatcctggctctgccacttgctagatgtataaccttggacatgccacagtttctgcatctgagacatgaacataacaatatatctatcatataaagtttttacaatttaaatgagtttaatatatataaagattttgtaatagttcttaaaacacagtaaacactatacgagtactcgttattttaccagctctttaaaaattttcagaaaaacaggactagagatattcaagtgaaggtggatgtgctttcaacatccctcttaataaaaataggtaaattagttaatagacaatagaggtcagctttttaaatttcattattttatttatttacttggtattagccttctggaatagctatatgtgaaaaattgattttcatcctgttgtcttgccattactgatgacggaatatatagcacagaaaattttaaaccactgatttttatctattacataacttttgcaaaagctgaaatataacaacctggggtaagcatctcccatgcctttttcctttcttgtaccctaaggaagtggtatcaatgaatggccaaaagatgaaaagtaataaggcagcccatctaattattgaattgtgtaaatagctcctgaataaatgaaagttgattgtatgtataaattacaggttatctaaaaatggataagtgtattttaaaaataacaacattcaacctaggtgatctgatgagatgaaaataaactatgaaagtcaaaatatttaaacaaacaatgtcaataacaacaaatattttgaacatttagcatcaatttattaacttcctagttaatgtggcaaaaatggcagagtattttacacatcgttcataacgtgggaattctaacagaaatgttttcttgattcagaaccaagatgtctacccttttttgtctccttggtctgtccagactgaagcacaatcaacggcaaatgggagatatgagaaaagatgacatatttgaataaattccatgggaaaaaattctcacatctttagataatacatctaaactcttttttttttctttgaccttcagaaaaatcctaaatgtcagcagcctgatttagaaaaaaaaaatgtctttggcagatttctcttccttttgttttctttactgcttttaatgaaatgctaatgataccattttattcagcaattctacttctaggaatttggaagtagaagtgcctatagctgagaatgtggccttagattcaagttctagttccaatgttgtctagctgcatgaccttgagaaaatggattaacctctctaaacctcactatcgttatctgtaaaacaaggacataaagtctttagcatacatacaggtattctaagttccttctttatatcaaaataagtcagtcattggaacattattagttttagacaaacataacttaatccttctcaaatctaccagtctatattttaatgatcttctctgagagtttactgagggcaaatataagaagctcttaaataaagcatttttttatttgctataacgctgttaaaggcatcatctttaaaagtacccgctctttaaaattccataaagtaaattcatttcagcatgtactatcacgaacactatctttcttaaataattagtatgtgttcttctactcattaatgaaaatataaataaacttctattttagatgccaggaaactcagagtaaatttctcattcatatttatttcatccttttttgtaaaatcattttttccattataaatattatattgtataaacatgttaataagcagactcaaatatttcataatggaacccagagaactgattacttttataaagtataatgtgactacaatttagcctgcatcaaaaaataattaaaacatgttttatatttttatattaaatctgcattaaaattacattagataatacattcaaaaaccataaccaaaggatatttctcactgctgatgcaggtgtggagagaaagcatcttggaatagttcctaatgatagtgaaaatgtccatgaaaggcttggtaaatctttacaaatagccataaaaatgtcaacataattcaaaaaaatttgcttctagaaatctatgatttctaagaaaataatcatgaataaggataaaaatgtatgtatgaatgtattcattacagtactacacttgtaaaaatattttatgaaaaaatcccaagctaaggaaatcatgaactaatgaaatacatgtaatttcaacttgttgtatatttaagtgaattattttactcaaaagaatgatattaggtaggaaaaaaggccaacaaagagtagattcttctcaaaattatgttgaaaaattattactgttcagatattatttccaagactagaagaaaatacaacaaagtgttatattgcttaaatattggtaataggatcaccaatggtctttgtattttcttttgattttcatgtgttttcttgttttctacaatgaatatcacattaatcagaaaaagtaaaaacaaaaataatttgtgaaagaatctaatatgaaaagggaaaatataagactttttatattattctaataaggtagttttattagaaaacatgtctattctaaaggaatgtactatttcactttattataccatgaagtatgattctgagctctgatataatgtatattgtccaaaatgtcctcaattccacaaagcactaaaaattatggaagtaataattgggagcgaacttgacaatcatggttaaccatattaattataaaactttcaaagtgttggcacaccgtgtcttctgttgaattgattattgcagcactctgcaaggtaagcagatcatatattaatgctttccttattcaaaggggttgaatgactcactcaaggtcactcagagcttccatatacacaatctggactctaattcaagtctttagatctaaattccttggaattttataggtctagagacgggttttttgtttgtttgtttgttttaatactctctttctctgtctctctctcccctactattacttacttctatgcaaagcagttagactagtgcttgggacacattgcacaggcatataagtattcattgaataaataaaagtgggacttttcatactggcttgaaggaaatatgcctttggatcttcttttggaagaagctgtgttcattttccttgatgaaaaaaaaatgtaatctaataattagtctcacttacaggtgaaaaacaggattattctactcataatagtagaggctcacatgcccctcacttcattgctgttagtcatgctgctgaaagccaaacagaagccaggtactgactggctgtgtacagggcacattctgcaatcccatgtactttgtgctagcaccaccgcagcaggccttcaaaaattggccctgtcactttaaatataatagacaataaatcatccctctgagacagcccctaaggaaaacaggggaaaaaaaatagaaatagcatttaaaagcccttttctattacaatgcctctagggagcttttaaaattggaactcttttgaagtgaattttatgctttttggggcttttaaaaatgcttctagaattaatcttgcaattctaggaccaaatcctccatgagatcctttaatttgggggtctttattatgctagtattatcatatttgctcatcttctctgtgctgctttccctggtattccataaccaatcaaccccttttctcatgctctttgtaatttctttattcctcgttcctccctatccatgtttctgccagtatatttcttgcttggtctttcttttcttttttttctttttttccttcatcaaatctagttttagttacttctcctctaagataccctttgttcttttgcaccttggatgcagataatcctaattaggctaccatgcagataatccagaattttctactttcctcctcctatagcagaattttcttagacacagttgaaccacaactgcctctgtttcataagcctccccttctcttgttcttgtgactgttcctagttgataagagaaaaacatcaaaatagcaaagaaagttaatttagtttagtctgaaaaaaatcttagtcaaatcctgaaaaaaataaatggtaaggtgtgaacatataaagcacagattatacaaagggttagggtttacattaagaaagagagattcaatatcagcctgactctcatgtaaccagtactcagctatgatcatttaagtcatatagcattatgtggcccaataaaacagttatggctcaatggcctttattattcttacaaattaaaaatctatactgaacaaaacacagttcatcttaatattgaaaaacatacacactcagtgtaaataacaggacaacagcaactgtttcttgacactacattacatgtcttcttagaccccctgatctgtgaaggaaggcaggagaaattcaacttgatattgagctggtgtcttttgataaattgggaggccaaagtatgaagcaaaaagcagtgagaagagattattctgacaccttttagatttatagacttcccagcctacttaatggccattcatctcatctggcctgccatagtcactccagccaccctctgggtgagtgcttattaccaacaaggcagcaatcaaattattgcagggaatttactgagtgagataaataaaagctgcctaagtcagtgattctcagtgctttctctggaacataagtctcataagaagctctaaaaatgtcccacagacacataagtgttgtcaacactacataccctaacccctctgcagagtaatgggaagtatattagcatagtaaaagcactgacaaaagaaagctgtctggctttgtttaacccagcatgtacccaaagcatgggacatgctgttttactttttttttttttaagaaatggggatctggctatgttgcccaggctgcaatgcagtggctattcacagatgcaatcatagtgtgtgcactacagccttgcattcttacttaagtaaaacttatgaaaattctttggaaactttggaaaagcctagattaagtacttgcctaaaagaagatctgggacaactatcttgaaggtaatgatgactgttaaatgaaatgattagatgaagaaaaataggaagaaatactgaaggtttgtattaatgattactatcaccaaaggagagaaatgtaccagcagatcacagtcattaaaaatgacccatcagtggacagcaaattacatacttgggaaccaatgctggagaaaaatcaaagagggagaggtcatgttttattccacttgtagagcttttcaaattcagtcctaaccaaacctgattaaagtaaatcccttttttacaggctgtggagtctataagattatggtgttaatggaagtgctattcgatccgtcagtaatggtgcatgtcgggaccctggcgcctctgacaagtccattttttaagacgtatttattgttttgttttttttttctcccttctgttctctgcattgcggggtttaattgaacagtttaaagtgattcttcttcaaggcccattaattgattttatttgtgtattctccagggtcaaggaaaagggggaaaaaaaaaaccaataaaattgcagctctggttttcactgtcatattctccctggaaattcatagctctgaattttgtttcttttctctgcctcaagaggccattttatgatttttgcaaggtgcatttttttttgttttatattactgatttattcaattccgatagggattcgccattaagaaaatagtaaaatgtgcccaatctgaccaaccatgtagtatctaggggttcctcatgataaacccaattaaagaggaaatacttcggtgaaacagtcatgaaactgtacattctcatgacaaagcatccatagcggtttctttctatcataatgggacaaagtctcttgaggtttgatgttgtgacatgcctacacatatataatcacagtgtgttcatatttattcatttaacccagcactgcccctgaatggtcttatgtctgtgaagtaagaatgaagatgctacctggattgcaaaacagtatattcagggggaggaaactgtagagtgaaactgagattctgccaagggcagaagctatacatatgtgtgtacatacatattggcatcacaccacaagaggctctgtcctgtcatgtcatagtgccctatgatgtcacattattatgtcacctaatataatttgtaccatttcttaatgcttgtttctatcaggaagtagctaatcctcacactgaacttatgaagcaggtattactatcaccattgaatcgtcaaagtctgaaactcagatgtgaagtaatcttccaaagatataaataaggtttaaatatgcatctgatttactccaatgcctctacttttctgttccttggatatactgttgccttggagacttagtttgcaatggcttttatttcactaaagatgaaaatataataaagtcatttaaaggtggataactttttttctacctctgcttccccagagtaggccccaaacaaatactagttgaataatggaataagattcctgcccctttgctatcacatcattcctgctttgagcttcactctaagaccagtcctttatgggcattgtaataacaaggccagggtaaaagataagaaagggacagggccataaacaccaatctggattctatcatgtggacaagctaattctagcctcttggtttttttgacatatccatctcttcattcatttctttgtcccttccttattcaaattcccttgatgaagtccccaataacacataaagcttaggtctttcattgaaatgcaggtcaaatttgtcttttgcatacactagtaaaactatgccactggcttctggttcctgattatcttcccctgaatgttttaagagagattgagagtttaaagctaatactaagattgaaagaaaaagcagcaggggaaggggagggatcatatagaaggaagtatttttttgcttgcttgatttactgtaatcaatagctgagaggagaaagcgacaagttcgaaatttacttccagcggatgaacagatcatcgtcaaggacaagacacatatatttaagaatgtgtcagtcaactgaaaatctcacaaaggcaaccttctcgcggaaggggtgcactctctgcacgttacggtcacacagttcagaggaaattctatgctatcttgcatctgcacctctatgtccatcttctctttctcgacttaagaaaatcagcttcctggaccccctttacctccattcacctttcacaactttcactcgttttgtgagacagttcaattatcactttcaggattgtgtctgtttcctgatagatttaatagtaaaatccttccaagggccagaaagaatgaatggcgaggagaggtgtcccagtctgaagccaggtgtagtgaataggaatagttagtaggagtgagtacaaaatcctcaactagtagtcgcaggtggtgaccactacaaaggaaatgaaaacacgttaactttttggatattactccaagaaaagagaatatgcctgcagacctttctctaagcaataagacacactggtgtacaaaaagacccacactcctccccatgctgagatacgtgtcctcctgtggattcccagaacatgaaaatcactatatcaaaatatgtgtcacacactaccctaagctttggtttgcatggatctcccctcgaaactgaatcaagtcacgttcatctctatctctagtttctccttcagtacctggcgtataagagatgctcaatacatatttcctagcataaatgaaagaatgaataagaaggaattttcttgtaagtactaatataaaattgtgatgcaattacaaattttggagatagtggggccaaaacaaagtggggctaaataactggtccagaaaaaaaagacagggataaactttgaattttgcattattaaggttaaaaacagctcttatctggccagaaagagaacagtttttgtgtaaaataattttttcaaatttcagaaaaaaatatgcttatgaaagaagctttagaatgcaacctgcactgttcatgaccaaacatgtatcagtatagagggcatgagagcagaaataaacagaaataaatattcacctccacagggtagccctaaggatcctatgcccagataactagcttgtgagttattcactcctggaattgcctgttaccattgttccctgcttaagacaaccatgttgtgagtatatgtgtgtatagtgaggtacagggaaagataaaacagtgtcctcaaaagcccatggacaagatggtcatattttacttgggaggatgtgaatatgaactaatacactcctcttgttaagatattagtacagggtagcatgttaatgttcatcagaatgcttgtcaggtggttgcagtgtcaaggattccttccaatatgagggtatgtagaaaatgcagccctccacttttgacactgcttacaaactttgaatcagagaagacagttgtaaagggaggtggtgttcttcttttcacaaacttttcacaaactgtctttatttttattcttctaattttctcctgagatatcaacatcgaagtagcatataaccttcctggaagcaatctaactccagaaaaagcacatacaggcacagaaaaaaaataaccaaattcatttttacataagaatagcagttgcaggtggcattactttggtctgattttatgattagtggaaactgatgccttctgtattgctaccagagtacataacctcttaggcctaagtctccattgacaaataattgggataacaagcacttttcactgcatttgtgagtaatctcagtgaacagtcttctttctgtcttgtacttaatatccttcaatgatcaaatttgtaagcaggttgagcagctacacttattcctccaaattaaggacttcccatcagctgctcattaacatctgtatggatattgcctaaatttgttttaaaactctgtgtgagggtacactttgatctgctcaactgacttcattctagctattaaataatttcaacacaaccttgatctgtctaatccaacaaaaccaaaggcaacttcttagtactttctgccatgtaaaaatacatcatagtctttcaagccaatatattgttatgaatcatacatgcacaaactcagcaaagttaaacttccttaataatagagtgggtgctatagtacctgtacaccaccttcaatccactgctgtgagcgaaaatcaggcagcagcactagtagttaactcaatatcagctgcattaataagggtaaaatgaataagtgtgcctggatttttctcccttgatgactttaggtccagatttatcttattttagctttagtcttgaatgattgtcaaagatgtgcaccggcctctgagatagccactgtcaagctaacatgtatggaaccagatcggaagaaattgcccaacagatttgcagggcttgtcaaggcctggaaatggtggaagtcagatgattatatttgcattgcataattggcggagcttgtcacaacactgctggagccagcagctgctctctgctgagagctaattccacctgatctatttaatattataatgaatttaatcctctccacattcatccaggagccaaagagcacagtttatggctaaacctgcatttgcagacagatgacaagggacccctctggtggtaggaattaatttggggaagtatgctgacagaattgcccaatcatttgtttcggttgagatttttttccttttccagagagcagtcttcagtatggtctgaattttcccttctctccttaagaagaactcttggaagtcagaaatgaacttagatattgtttagagctgaaatgtgctccccctcactcacccactcaaattcatatgttgaagcctaaacccctagttcctcagaatgtgactgtctttagatatagggctgtcaaagaggtgattaaattaaaatgaggctgttagggtgggtcctaattcaatctgactggtgtccttataataagagaatacagagagagatatgaggatatgagtaatgcatgcacagtgggagaaccatgtgaggaaccaatggccatctgcaagctggagaggcttcagaggaaaccaaacctgccaacacctttattttggactttcagtatccagaactgtgagaaaaaaaaaattcaatggcttaagccacctagtctgagtggtattttgttatggcagtcctaccaaattaatacagctattatctagtgtaactcaatgtaagtttcttctctacagaatatcataatttttttttttccagaggaacgggaagaggaacacctctcttatacaacgcaactgttagcattaaaagaagatcattttatcagaaacttctgtgtactgaggcgggatgttcctccttatgactgccaccttactgtcccacttctgtactctggttcggaaccaaataagatgtcttacagggcagccctttaattagatgcaggcagccgttgtatgtccatgctccttttttaaaccttctctttttagttaaacctttcttgatgccttcagatactccctatatgccactgttctgagtgcattctctcatgtttgttctgctttgaaccctttctactgggcaattgtttctattaaaatgagatatagctaaagtcactaactcagatgttatccagcactgcagtgtgctttaggactcttagccctcttgctttcactaccatattttagggtcctccccattaagaaagaataaaacaaaatgatctttaagccctggtatggaatgagtatgtggtaagctcttgagggtaccatgatacctttcatatgtgacacaggggaactgagacttactgatggattttctatcagctgagtattttggaaaacattatttttaaaagttgttaagaaatgttcttagtattacatttgattttactgatatatatatatatatatataatatatatgtatagatgtataatacacatccagattcaagcagctttacttgtatctattcacataattataaaaatataaatatattaggcatttttttccctcaaatacttagaaatcctaaaatgcaaaaaccaaacacctgggtataataattgtatctccaggagggaacaagtttccatagcacactaaggatagagattactgtaaatatccattaaacttaaatatgccactcaattgagtctgcaatttgcaacttaggagaaaatggccagaaatgatgaagcccctgggcatcagtacatgaacagttataaaaatagaagaaaatagtgtatatttttggcttctatttgctgatgtatgtattgtaaggcaatagctaacttcaaaggttttcatgcttgcccaatagctattgaaaacaggacataattaaaagccttttcccctaaacaccatgactccttaaaatgtagaatgcaagacctagccgacatggaaacaggatacaggtatactgcagtctgtcatattgactctctacagttttcctattatatgaacatatcaaaaatacctggaggctgaggcaggactacaaaaatgttttgcacatgcgagggaatttgagagctagcctaggggcagagtaaatatcagaaacattagttatgtccgttaccggaaaaggagtgaccaatgccttatcactccatggcacttattttttccctctctactttaagaataatctctctagagaattagctctggtatagctgaacactttcttagaaattaagtaacaatatgataatatctttcaaattccatcctaaagagagagatctatttttttaatgactacagaatgtcctccccttaaccctaaattactttgcatttagcattttagctgccagaaggtactgtcaaaacagacagaccgcttaatggaaaagaaaagttaatgaactaacaagggaacaataaatattccacaaatcaaggaaaagatggaacgatttccaagggggaagtggatgtatcgaaatatttttgctagaaactcaaagcaatgtgttttaaagattgaaatttggggtgagggaatgatgtaatggttgattagtgcattactaccaataatctcaaaacaattatataacattgtttatccgagtagaggagaagcaacaggaaaagaaagacaagaaggaccagttccttttattaagtgaatggcatttctgccatatggtattagataatgcaaagataatgccagtgactgggagaccatcatgtgggctttttggaaggaagcatgtatgcctgacacctgtcacatagctcaaatgtgatgctggcatatttgcaactaaattagaataatttaaccttcattaaccccttcctgtgtttatgaaagtagagcgtaattgacaaaattctgggggaagggtggctccttgacttagattcggtggaatttttgtgagtagacgcaaatactgttgtgtcatacttctatgctatcaggctttctgcccaggattccatttatttggagactgtgaacctgaagtcaaggatatctcatgttccagtgttttcagtagaaaaataaggcgaactgtcaattgacagatttttcatatatataaaaaggaacagtctaggatttacggggcaaataaatattgtgccagaacagctggcaagcgtgagtaagagcacaaaccgctggtatgttatctgcaacctcccacacacataccgtgagctgcaactcaataagtggatgattacagaggttatgagaaaagtagaagtaaacacagtgaagtttaaagaacacctggtatgaaagataacttggtttccaacagatacctcagtttcatgggaagcattttagagtgatggttaagagggcaggctctaaattggtgtaatttcatatataccaattatgagctgtgggattgtaccaagtcgctacacttctttaagcctcagtttatttatataaaaggtttataatgttgcctgccttatagagttacagagagagataaataaatcactccacctaaatcacttatcacagttcttaacacatgatatgtgtttaataaatgctagctattaccattaacaatgcccatgatctagcacattctaatttatgatgccactatttccacatccaaaatatcacctatttcaactgaaggaagaatagcatcaggtacttaagttggtgcccatgaggaaccattatagaatatagtatggttcgagatgttttaacactctaaatgaaaatatttatttgcaaaaagataatcatgttcatgaaatggtttaaatattgccttatttccaggaaaaaacaaataagtagaaattatatataaaacatatacatgatatgactattatgcatacaaaacacgacacgagctaatgtgtttttagtttcactaggctttctttatacgtggtttcactagactcatgctttgtcccaggtctgtgtgaaaattgcatttctgacttaaacttttggaaaaggagaaaaggttatgttaggaaattgcaaattaaatcattaacttaacaagtgccctaaaaaacaattacatagattcatatacacattgatcaacttaataaagcatattaagaaaaccacatctagtgatctagttgcatcagcagttgaaagtcccatgagttcagtgtccatgcttaccactaacgcctagcaaacagcctggcacatagtgagatggaaaagttcccttgaccccctcccaggacttgtgacagggatggcttgtttacatggcagctgtgctcaaagcccatgtgggagggggagcacgcaggtgagcaggtgcagcaggtggggcaagtgcctttgggcaccaacaggaagaaactggcccgtggcagcaactagcggttgcatgtgaccactggagccccagagggcatgtgttacaataagtgctctttcagcatttgccatccttggaaggctaagtgttaaacagctcagtggacagtcagtgtgacagcctcttgcacctacacccagatccttgtctggtgctcaagaggaatgaggccatacagactggaaggatggtgaatgcaaaggttgcactgagtggtggaagtagctctcagtgggatgggaagctggaaagggaatagagtggaaacatagtcttctgcgtgagtttgtctgtccctggctgaacacctctctgaccataatctcctatgtccagctgcctcttctcttgatgttcagttgcttcttctcctctctcctctgctgcatcgctctgctcctttgccagtgaagcctggggtttttatgggcacaggataggaggcatggcagaccaaaaggtgacattcaggtgtgaaaacagggatgtgaacttctcatttagggcttcaggtccaggcttgagggtggaacccttgtcagggaccccgcccatttctacctagtatttccctgcctcctgtccatatcaatagtaaatgataaataattactgataaatcacttatctctttatttcctctctgtatgtaggaaaaatttagttctcatttcatcatacttaggatatgttctacacattttagctctactttaatgaaacaccttatgctagaaactttaaaagaaccatccttaatctatttttacagatgaagaaattaaagctcaaacatgtaagagttagttgaatacaaggctgcacagctaggaagagctagaaccaggtgtgaatcttcatatgacaatctctattcactaccccatgacacttttcattcatacttgagctcctttgtgcctagatgtgtgatatgaggtaacgtgagcatcatgatctcttctacattttctttatctctctgagaattagttatgcatcagggagcactatttcctttatcctccctatcaaataaagattcatgcaagatgtagcaaggataattcttaaccaaataagtctattatattcaacaagttgtaatgagtaagtgtataatttcatacacatttggttttaacactcttcactcagctgtgttagcttcactaaaagagttaaacattactattcactaactctgttccaacatctgccctgaaaaccaagggttttcagctataaagtctttgttttcataatcttttatcacactaaggaataatattaataaatcactatttctctctgttggaaaaaggccagcattttttggatgtacataggtaaacatccttgggtttaagatgtaagtgaggagggctttacctacccttttaattatgaggaaatgtggaattcagtggtgcagaaagcccatctgcagtattgcccaaaggggattcttttaagtgacttttttagacctggatcagacagtagtatctccattcatttttagtcacagagaggctaaattgaagtccatttttctgaaactagtcacatagtcaaaattctcacattaagagtaataaaatcctgtgaagccataacttttctgaaagagtttttctcaccataaatatttaaaaagtagcaaccagtttcaatataaaaattagcgtattaatgatttcccataagataaactagatatccgaatgattggcttagtttaatgaatcagcacatatatttaagaaaggaacttaccattagtgaaaagttgaaacaaaaagcataatataaattcaaaaatagtaactgtacttattatatctttcatttattggtagctcactgtatgctaaatcctatgctgagctatttatgtttattaactcatttacctatactttgaatctccaaggcaaatgctattcatatatagtatgaaattatgctattgcagattaagacagattagggttagcaaagtgaagcaacttcactaaggttgcagagttagttggtgacacccatagtagtctgactccagggttaaaatacttaaccttcatgtatattaaacggcataggccagtggttcagtttccaaactcctgtcctagaacaagtgctaattcctaaacttttcagcagtcttttgataaatattctagttgcattttgtttttaaatatgtttatttgggaaaattaaaatagtgtcaaacaaatataattgttccatattaaaaataaacattttggaagtaaaagaagaaaaagattttcaagttatttctgtgtactagataaatctgagctgctatttacatgaggaatcctttttttgggtgcttaagggtgacagtgttgaagaccagaagaaggtaaccatttaaataaataaccaaggatgtaggaaatattgaggtgaaaagaacaagtaaaagctgttataatcccaaatggcttggacattttatagacaaagaaaactctgggggaggtaatgctattttatttgggaagatgatgggttgcctgttaacttacttctgaacatgttgagtttgtggtgagggatttaagtaggaaaatatctagcaagcaatataaggaaaactgcaggtttcctgatcagacaaaaactaaattcttcaaggtaagcaatgtgccagtgtgtcagtgagtctggtcagtctccaaggcatgttgaaaggagggggaagtggtcaatctctcagccttgacactgcccctgttggtcatcttttccttgaacacttgtcataaatgaatattgtcactattgcactggcttgagggtagaacccttgccaggggcatccccactttaacactttaccatgaacctgaatgcacatgccttcctttaattttccattcggagttgacgccaggctgtttccgaaaggctaaagactcagagcaacaaaagggaaattagcacaaagtatataatgtgtaattagatcaatgactttaacctcttttgggtagcactgagaatctgatgaatctcccc

SEQ ID NO: 548 - DNA, 20001 bp, Homo sapiens
ctgaggcaggagaatctcttgagcctgggaggcagaggttgcttggactccagcctgggcaacaggagcaaaactctgtctcaaaaaaaaaagaagaagaagaagaagtggaagaagaggaagaagaagaagaaagaagaaagaagaaagaagaaagaagaagcagaagcagaagcagaagtagaagcaaaagaagaagaaaaagaagaagaaggcggctccatgcttgtcattgtctctgaagaccttcctgtggcacaagatatggagttggaagacattgatattgattaccttgaccttgtgtagacctaggaaaaacatgtgtgtttgtgtcttagcttttaaatttaagtttttcttttttgtagagatggggcctcactaaggtacccaggctggtcttgaactcctagtctcaagtaatcctcctgcctcagcctcccaaattagcttttaacataaattttaaaaagtaaaaaaaaaagaaaagaaaggaaaagaaaaagcttaccgaatgatataaagaaaaaatatttttgcatagctgtacaatgtgtattttaagcgaagtctattatttaaaaagtcaaaaagtttaaaaattttaaagtttatacagtttataaggtaaaatgttacagtaagctaaggttaatttattattgaagaaaaaataattgttataaatttagtgtagcctaaatgtacagtgttgataaagtcttacagtagtttaaagaatgtcctaggccttcacattcaatcatcactcactcactgactcgcctatagcaactttcaatcctggaagttccattcgtggtaaatgccatatacacgtgtgccacttaaaaatcttttatgctatatttttactgtacctttcctatgcttaagtatggttagatatacaaataccactatgttaaaattgtcatcagtattcagtacattaacacactgtacagggttgtagcccaggagcaatgggctataccatatatcctaggtgtgtagtaggctgtgccatctaggtttgtgtaagtacactctataatgttcacacaagatgaaatcacctagtgattcatttcttataatttttctctgttattaagtgacacatgactgtatttaataaatggagagggtaaagtgtttaaatgagagtaaacttttgatgcttcactagaagtggtaaaattttgataccagtacatcatgataagctatgtatgtatactgtaatatgttcatgaaccactgagaaaactctacaagtgatattctgaaaaacataaataaaacaagaaagaattctaaaacttttaaaaataatccatggtaagacaagaagagagaaacaaaggaacacaaaccagaggaaacagaaaacaaataataaaatgccagatttaagccctataatatcaataattaagtgtaaattgactaaattgatagaaactaattggaagagattggaagactgaatttaaaaaaataacccaactatacaatatctacaaaaactcatttcaaacataacaaggtaagctggttgaaactaaaagaatgaaaaagatattatgccaccattaataaaaaatagagactatattaacaccaaacaaagtagatctcagagtgaaaaaaattacacagagtgaaagaaggagatcaactgtaggatcaatccgccaggaaacatagcactaaacagagcttgcccgtggagcattaatcaacatagaccatattctgggtcataaaccaaacctcaaccaatttaaataaataaaatcataaggagcacattatctgacaataatagaatcaaactagacatgaataacagaaagacaatggaaaaatcttcaaacacttggaaattaaacaatgtgcttctacacaatccatagatcaaagagaaagtcccaaagtaaatttaaaaatacatagacctggccgggcgcggtggctcatgtctgtaataccagcactttgggaggctgaagcgggcggatcatgaggtcaggagttcgagaccagcctggccaaaatggtgaaaccccatctctactaaagatacaaaaaattagccaggcgtggtggctcacgcctgtaatcccagctactcaggaggctgaggcaggagaattgcttgagcctgggaggcagaggttgtagtgagccgagattgtgccactgcactccagcctgggtgacagaatgagactccgtctcaaaaaaaaaaaaaaaaaaaaaaaaatagacctgaatgaaaatgagtgtagaaaatatcaaaatttgctggatgcagctaaatcagtgctgagagggaaatatatagcattaaatccttactttaaaaaagaagaaagctatccagacaactcaagtatctatcctctagagtaaaatacgtttatgatttaaaatgacttctaggcttatgttcacagagtgagcaacaaagttctaggctggcaaattttgtattcagttgaaacagattcaaagaacagtgagagattaaaacaaaaatttgtcaagattgaaatccagatgtcatgtttatccagctgggtaactacatggtaactttattttaaaatccatcataggtactttacagataatttccaaaaatgtggattagtatataaaaatcacttagctccaatccctaaatataattgctttggaaatttattcttctgaattttttgtgtgtatgtatttttgtttatctgttaattgaaatgtttatgtctgtggaagtttctatgctatttatgctattttatgagctactttttctcctttaaaatatgatatgaatagttttctatgttattaggcctaggcattcctccataacagatttatgatgatgtaatatttatttaatgaagactaatatttagctagcttcttattatgaacattttagttctttccagtttttgtttttgttgtttttataaccatcacactatcctgaacatcattatgactatatcttgaatcagagacaagatgatttctttggttaaattcctagatataaaagttcttctctttctttttttttttaattttttaatgttttttattatactttaagttttagggtacatgtgcacattgtgcaggttagttacatatgtatacatgtgccatgctggtgcgctgcacccactaactcgtcatctagcattaggtatatctttcttatttcaacaaatgctctgaaacgccatagccaaaaccttattttttatatctattgtccttgagattaataattaacttttataagaaaagtaataagttttcattctgccttagagtataggtaccaaataactgaatatgtgttttggatataacctaaggttcagataaaaataaataatatgaccattttcaaaggtatgaaaccagctagttttcacaacacatgatcaacctgttgtctacagtggcttctggggatttttaagagatttaataaatattctaaataaatcaacaatagtattttcagacttgtaccctttaaggatagttgaagaaaccagaaggtagtgagaatatgtaatttgattgttcaaatatgtgcaaaagattgttctaatatgtgaaaaatctttctaaaaccaaggaattttttaaattgctataattaaagtgagttttcaaagggattaggtgaaggaatattttaacttggagtcttcaagtaatttaataaaaagttgattttttccctaaataatacaggaaattgccttgtttcttagttataaacattttctcaataaatagtgctgggataactggctagtcatatgcaaaagaatgaaactagacccctacctctaaccatatacccaaattaactcaaggtggagtaaagatttagatgtaagaactcaaacataaaaatcctataagaaaacttaggaaatgcccttcttgccgtaggttttggcaaagaatttatagctaaatctctaaaagcaattgcaacaaaaacaaaaatggacaaatgggacctaattaaactaaagagcttctgcacagcagaggaaatccccaacatagtaaatagagagcctacagaatgggagaaaatatctgcaaactatgcatctgacagagggctaataatatccagaatctataaggaacttaatgaattaataagcaaaaaaccaaaacaccaaattaaaaatgggcaaagaaaacgacagacacttctcaaaagaagaaaacaaagcagccaacaaacatttgaaaaaatgctcatcactaatcatcagagaaatgcaaatcacaatgaaataccatctcacacaagttagaatggcaattattaacaaatcagaaaacaatagatactagtgaggctgcagagaaaatggaatacttacatgctattggtaggcatgaaaactagttcagccactgtggaaagcagtttggatatttctcaaagaacttaaaatagaactacggattgacctagcaatcccattactgggtatagacccaaaggaaaataattcattctgtcaaagagatacatgcactcatatgttcgtgcagcactattcacaatcgtaaaaacatggaatcaatctaggtgcccattaacagtggattacataagaaaatgtggcacatatacacaatggaatactacacagccatgaaaagaatgaaatcatgtcctttgcagcaacatggatgcagctggaggccattatcctaagtaaactaacacaagaagagaaaaccaaaaactacatgttttcacttgtaagtggaagctaagcattgaatacgcttgaacataaagatgagagcaatagacactggggactcctagacaggggagggaaggaggcgaatgtgggttaaagaaccacctgttctgtactatacttactgcctgggtggtgtgatcagtgggacttcaagcctcagtgacatgcaatttacccatgtaacaaacctgtacatttaccttttaatctataataacagttgaaattatttttaaaattcttataacacttttttttatctttctctgttaaaagttcattttccatatataagttaatggggggattaatagaagaaaggactccattgttacagatagtatcttctggaatttttttaagtaatcatatttgcaaactaagaattgcaaggtctagagaaaggttgactatatattagtgaaactgaaaaggttcgaagatggtaacagataattttaaaagattggtcagtaacaaataccaactaaaataaaacccaatattgtaggcctaaataggtgtgattgaaagtccatgataacaaataaaatgtttttttaacttttatataatcaacagactttaaaacccagctgaaaagtgttttaagaagcatttaactacactgtatttcaatacaaataaactgtacaaaccatatagcctctgttttccagttcaaattcacacacttactaaatatagggcaccatgattaaaactttatatattttatatcactttattctcacaacagtgctatagtgtaggtacttttcttattttattttttttttttttgagatggagtcttgctctgtctcccaggctggagtgcagtggcgcgatctcagcttactgcaacctctgcctcccgagttcaagcaattctcccgcctcaggttcccaagtagctgggattacaggcgcacaccaccatgcccagctaatttttgtatattttttttagtagagacggggtttcaccatgttggccaggctggtctcaaactcctgaccttgtgatccgcctgcctcggcctcctaaagtgctgggattacaggcgtgagccaccacgcccagccttcttattcttttattacaacagaagaaactgatgctcagagaatttgcatgacatgctcggaatcacattgttactaaagtaatcaatcaaaagcagacaggccatttccagagcataaacttattcatctcttggaagagctaacactcttgatttgtaaaataatctacaattttattgagtgttcatcaaccctttactatgtaataacatctagttctaatgagtaataattaaggaattataaaagtaagttttcaagtatagatgaaagtgatttgtttttaatttagggaagggaaaaatggtgctaagtaatagcactggaaatcaataaaacattattcaaagaatattacttctgttctcaataagaactaaagaaagtagagttaatcctgcagtctgtgagtttatctttaaatgtgagagaaagagaaaccttaattatcaaaatattcctcacattaatcttggaaagtgatttagagtacacctcagtgagccactgagccagcacccagctcttctgaccgtgcccaggattatctacattttgtcatgctataatttgaagttgaaatacatgatttctcaaggtccccccatcatgcccaaattgtacaatctattacttgtataaacatacagagtatctgccagctttaataagacgtagggaaataatacacacacacaaacacacacacacacacacacacacacagagctgtttagagtatggcatcaggctgctcttctgttcttgttatctagaaatagcagagggaccttgggtgcccctgactattctcaaacaggcatgcccagtagagttgaacttggctgccacacacagtgattcagcaatttaacaacagagaatgtgagagagagagaaggaggatttttcatattgggtttggataaggcacatattttgttgtgcacaaataaggagagatctagagttgttaattttgttagttattataaaactcaaataatttgtataactggctggtttatgaccaaaaatgctatttgcctaatgagcatttagaacgtggaaactgattttgaagcttgtaacagaaataggataaaataaaaataaaataaaatgatgtttacagaaatgtatctgtattacatggctaaagatatgggaagtttttttctagttatgagacgtgttctacttaaattgaatagacatctaggagagagagattgaacattttattaatcttattttacaaaagaggaaggggaggcaacagaacattaaaggattgtttctcaagctacatagcaggatgcaacatctgaatggcattgcccccaaaatcagcctatgcccacctcagtccatttgcactgcaataatgaaataccacagactgcgtaatttataaacaatagatatttattcctcacagttctagacaccaggaaatccaagatcgaggagctaacaagtttggtgtctggtaagggctgctttctgcttccaagatggctccttgttgctgtgtcctctggagcggatgaatactgtcctcatgtggcaggaagcagaaggtagaagggcaaaacggggctgaactcactccctcaatcccttttataatggtactaatcccatccagaaggcagagctgtcatggcctaatcacctccataaaggcccaacctcttaattcagttaagtttcaacatgaatttggggacacaaacattgaaaccatagcaatgcctcactcaacaataatgttttatgaaaatgtagtatcaactcttcctcagattggcaggtttaaaaaagctaaccttaatgtgaactctatcaatcttcctatcaaataattagatgtgggagtgaatggccccgtgaagaaatgacagcaaataaccttttccaaaccaacatttttttttccaagaaaactttggcttactgtttgtggctgcttgggtatgtgacttttttagataaataattagaaaaaaagaaaaggtgcaaccctccaaaaggaaacttgaaatcattagtaaagagagaaagagactttcaaagcctaattctaaattcctttcggaggttcatatgagcactttagctctagaacaatgtttccagaaacacaatctatcaataatgacatttataggtcaattactattacctggggaatttggtctactcttattttacagtatatctgccaaaagaaaatcatatatggcatgttttgacttggctctaggctttctcaaagctttcatttctttttcagctgcaactgtgaaacttacctgttactctttggcccagagccagttcgtcactaaatctacagagcactgtgtttctttctgtattccagcctgcctcctatttcaatctttggcacaaacaacagagtgctaatagtgaagccacaaaatattaagatgagattatttgggatggggcagggagagggaaaatatggaactttttagagcctggaacagaccaatcatgcggaaaacacttggctgtggaaggtacttccattccaccactatgatgacaagccactgtcttcacagtcgctgagaaaacttgaccaatagatttggaaggcccacttggggcctctatttcattattcattctcttattcctttattcatctattcccccagtaactcatttggtaagccatttaagaaaaattttattttgaaaattatgcaagagtccttctaaaaatttaacaaacattcaaattaccaggaaatcttgttgaaatgcagtttcttgttcacattctgcatttccactaagttctcaggtgatgcagatgctgctcctccaagggaatgagaaatatacttcattttcctttttcttagatcagtggttttcaaacttgttagaaaaatgcaaactcttgggcccaacccagacctactgaatcttggagtgggatccaataatccacatattaccaagtcctacaggtgattgtgatgcttgctcaagtttcagaaccactgagtctagacctatagctcccaaaacctggctacacattagaatcacttggagagctcatgggttaagtcgtgttctgcaaaaagatgtgttgaagtccaaatccctgatacctatgaatgtgaccttatttgaaaatagagattttgtagatctaatcagtttaagatgaggtcatactgggtaaggatgagccccatagccaatgactggtgtccttttaagaagagtgagattggaggcacgtagacacagggaagaatgccacatgacaaaaaggcaaaaattggaacagtgcagctataggccagataattccaaggattgctggcaaccaccagaagctaaaaaagaagcatgaaacagattattttctacagcattcagagggaacatgttcctaccaaaaccttgatttcagaattctcacctccagaactgtaaaagaataaatgtctgcagtttaaaccaccacgtttgtggtactttgtcatggtagtccaggaaactaatacagagctttgaaaaaaaaaaaaaaaaaaaaaaaccacacacacacacacacacacacacacacccacacacccacacaatgcctcctcaccaaacaattaaatcagaatctctgggggagggatctctacatgggaattttaaagtctccctcaaggtcaggatttagatccacagctctggatatttttaaacataaatagactatactttattttccaataagtcaaaaacactacaaagagtggaatatcagtgtaaaattatccataagtttcatgagcatcaaaatcagtaatacagataagaagtatactgtcagtatttctcagagtttagttagaaaaacactggtattagaatcacctgcagtccactaataaagtgggttgctggggtccatctcaaacctaatgaccagaatctcatgggctgaggcctgagtaagcacaagttatcaagctcccttaaggtgacccttatgcatactaaagtttgaaagccaactgtatagggatgatctagcaggtttgagccactggggagggtctttctgaagatgagaaaactgaatgaatgtagggagagaacacacctgagcaatggcagcagtagaaactgttgagaaacggcggctggggcaaagggggctcctttctggaagctggtggatgtcaggcagggcttgtgagagagtatagagaactctgaaagccagagtgacaaaatacaactgaagaaacagcatcagcattgtctgggagtttagtagaaatccagaatcctgggtcttccatagctctactgaatcagacactgggttttatcaagatccccaggtgatttgagtgtacattaaaatttgagaagcactgctccagtagcagtaagaaacctgcaggaagttcctgagcgacaaagtgatatgataaaattatggaatggcaaacttagctcagtggggatattttagagcaaaatggaatgctcacagtgctttccagcaaaaatttctgtaatgatggaactgtcctacatctgtgctgttcagtacagtagctgccaaccacatgtggctattgagcacttgtgatgtcgctagtgtgatggagaaatgaaacgttttattttatcttaattaagttaaaatgacatttaactagtcacatgtggttagtggttactgtattggacagcacagactcagaggctacagacataaagactgtggtggtcagagggtgctccaatcgcacctgtggggatgacattgttgcatgctatcaaatgttacttctcacaccattatttttacgtgtgcccagaaaagcataggcaatccaattttctgctgaatgaataaatgaacacatgaattaatgattgtttacttttgcctccaatcaactttcaattataaaggatcgaattatcctgtctagtgcttatgtagtggcttgtgcttattgctgatttttctttcatttccatttttgttatttgcattgcctgtcttgtcaataatatcactttccgaaaggtcaatagagacaaacacaaactgaaagggatctaattggtaaagaaaagagacaccattatttacctgaaatttttgtttgggtttgttcagtcaatttcaaatgtctggtgctccccaaagtcattgtctttttccttcacgaataatttatttagggacagagtgacagaaaagatgtgagtgacatgcccttgattattattagtggtgtttgtgtcgcatccaatacaggattgagaatggaagaacacatggctgtgagccccagcaggctatacatcttgctctgtctttaaccaactctgtttacctccctcttaatccatgaccttaatccatgcctctcacctactccatgctctggaaatcaaaacacatctctgagcctctttgaagctttatatgtacttcgtattcaaattctacctcttacaactctgggacacctgagcttattctctgagtgcttctttctctttttactttccacgtcttatgtcttccttcttcattattagtcatcagtttactgactcctttcttcttgaaccctctccccagtttttattagcgtggagagacattctcactttctaggcaggctctggccaggtgcgaagactttaagagtaagatcagatggaatttttttttggtttttttttgttttttttttttttttttgagacggagtcttgctctgtcgcccaggttcactgcgatctcagctcgctgcaagttccacctccccggttcacgccattttcctgcctcagcctcgcgagtagctgggactacaggcgcccgccaccaagcccagctaattttttgtgtttttaatagagacagggtttcaccatgttagctaggatggtctcgatctcctgacctcatgatccgcccacctcggcctcccaaagtgctgggattacaggcttgagccaccgtgcctggcccagacagaattttttctgaagcatcagcataattagatagatccctgacgttgctattttaattttattttcctgatacctcagttctttttgtagagatggggtctcattatgtttccaggctagtctcaaattcctggcctcaagtgaccctcctgcctcggcctcccaaaggctgggattacaggcataaacctccatgcccaaccatgaagttgctatttttaaagatatttaattgaaaacacagttttaataaatgtatttattcaaaaagagttattcatcatcaaaacacagcctctgcttgcaaggaacccaaaatctgctaggaagagaaagaataaaaataaataactttagtacagtattattctttcaaaatagaatgatttgggcacaaaatcattcagaaagagcagggaaaacttcatcaaaaagataacttttgaccagggtcttaaaaggtaagtaaacattctccaggtagatgggagtgagtcatgataaaagtgtgttgttatctgagaaattcaattccacatggctagaacaaagggtatgagaaactatccttaactgcgaaatctgtaggcagcagatagctaatagaataccttaaacatggtgctaaggaattgtgactttatccaattggtgatgaggaaccagagaagagtttcaatgaagattaataattagatctttatgtgtaaatatagatatggagaggataatactggagtcaagaagataagttaatatgttgttacaacagtctggataagaggtgatgaggtctaaaattgagaatagagcaatgggaatgtagaaagaaatctgagataatttaggggtgataaaattgagtaaatttcaaatgagctttccttttcttaaaaagtaattttctaacaaattgctgcgctggcaacacagagctggagatcagatagggcgggatgactttggactttgaaatcagagaagcctggacttgagacccaaatccatcacctccaaggtgagtgactcacagccagatactttacttaactcaccccttagtgaactggaggtaattcctgccttgcaagattattggattacttaaataaagtataaaaaatgcctagcacacgtgggcagccaattaacattagctacctttctgccctcttttccaactttaaaatacatgacagtaaatcctttaatataaaaaaaaaaagactttttttaaattggcagactgggagtctacaatatacattttaaaataagcaatcactttattttctgacaggattaggcctagtgtaccactctaataaatttttcaagtaacagatatgttaaatgcaacagaactgtagtgtgtctggagttgacgtattctgatcaatgtacttattgtttaagacatcagattcaataaagcattccaatgccactcccattgctgactgagtttctgatagtaactgaaaatctccaaagcggatataattatttctaggcaaatgctgtgcagaaagttgttctcccacttctgagaatctttcagaaacaattttaattgggatgttcagagagtctagggaaataataataattttgaatcaaatctgcccctttatgtaagataagcaattatcaaatacattaatagacagagacaaccaaaaagaaagatgtaggctgggtgtggtggctcaagcctgtaatcccaacattttgggaggctgaggcgggcggatcacctgaggtctggagtttgagaccagcctgaccaacatggagaaaccccgtctctactaaaaatacaaaattagctgggcttggtggtgcatgcctgtaatcccagctactcgttaggctgaggcaggagaatcgcttgaacccaggaggtggaggttgtggttagctgagatcgtgccattgcactccagctgaggcaacaagagtgaaactcaggaaggaaggaaggaaggaaggaaggaacgaacgaatggagggaggggagaaagggagagagagagagagaaagagagagggagagaggaagaaagagagaaaaagaaagaaagaagagaaagaaaggaaagggaagaaagaaaaagaaagagaaagaaagaagaaagaaagaagaaaggaaagaaagaaagagagagagagaaagaaagagggagggagggaaggaaggaaggaaggaaagaaagaggtagagctcagcatggtggtccaagtctgtaataccagcactctggaaggctgaggcaggaggattgcttgagcccagaagtttgagaccagcctgggcaacatagcaaggcaccctgtctgcaaaaaataaagaaaattagccaagcgtggtgatgcatgcctgtagtcccagctactcaggaggctgaggtgggagaattacctgggcctgggagtttgaggctgcagtaagccatgatctgcacaccagcctgggtgacagagtgagaccctatcccctccactgtccaccagaaaggaagatgtagtaacaatgattgctgtaatcctcataaaaatcattttgattaaaaatttctacaccaggccaagtgtggtggctcacgcctgtaatcccagccctttggggggccgaggtgggcagatcacttgaggtcacaagtttgagaccagcctggccaacatagcgaaaccccgtctctactaaaaatacaaaaattagctggtcatggtggcacacacctgtggtcccagctacttgggaggctgaggcatgagaatttcttgaacccgggaggcagaggttgcagtgagccaagatcacaccactgcacaccagcctgggcaacagagcaagactctgcctcaagaaaaaaaaaatatatatatatatatctatatatacatacacacacaccagaccaacctgccaagaaactatttaaattcgaagactaatagaaagattttgttttcataatgtttgtttaagttttgtactgtgaaaaatagagatatctcttgaaagttaaaacgtaattccgtaactaaattttcagaaaaaaaacaaagactaaaacaacaacaaacaaaaatctatcagaattttatattttaatgcacttacttatcagaatcttatcttttaatacaaaaattcacttgcaaaacaataaaaataagaaagtttggccttcaaagagaccactgacacgtaatcagaaattgccaaactacatccaaagttttgccaaagactataacctataggaattttttaatcatgactctaacatttttttattaaccactcagtgcctggtactctgatgattactataaatgcattatcatttataattcataaatcccataaggttggggctttgttttaggagggaacactgagccttagtgtttaaataacttacttaaacttacttgaaccttagacagtttaaataacttacttaaacttacacagctaaaaatgagtttacatgactcctacagctagaaaggcatttaagtaattggctcaaacatacacagcatttgaacccatggctatccagcttgaaattcctgctgttttgtattacactgggtagtctttgaaagcctcagtattatcacccacagaaggggaatgaggcctatttctaggtgtattcttcaggattccaacaggaaataagtacactcaaactaggcaattggagattctaataaaggaactatttatcagagtgtgagcaggcatatgggaaaaggaacagaaccctgtgctaccaataaggaagagcccttctacccttgaccttaaagggaaaggaaaggaaaaagattactggaaatagaaagataattgtaaagagtatttctggccaggagctgaaacattccataggaaaaaaacagctggaaggattgatattaccatcactcccctctcaacctgtgatcctctgtgattgcctcatgcccattaaaaagtagatgaacggccaggcgcagtggctcacgcttgtaatcccagcatttgggaggcctaggagggcggatcacaaagtcaggagtttgagaccaacctgaccaacatggtgaaaccccgtctttactaaaaatacaaaaattagccgggtgtggtggcgcgtgcctgtaatcccagctactcagtagcctgaggcaggagaatcacttgaaccagggcggcagagcttgcagtgagcagagatcatgccactgcactccagcctggatgacagagcaagactctgtctcaaaaaaaaaaaaaaaaaaaaaaaaagtggatgagtagatggacatttttcaagtaagacatgcaagctgccaacaactacatgaaaaaatactcaactgaggtgattgatcagttgagtatgaggtgatttctcagttgagtatgaggtgatttttcagttgagtatgaggtgatttctggttgagaatgaggtgatctctcagttgagtatgaggtgatctctcagttgagaatgaggtgatctctcagttgagaatgaggtgatctctcagttgagtatgaggtgatctctgagttgagtatgaggtgatttctcagttgagaatgaggtgatttctcagttgagaatgaggtgatttctcagttgagtatgaggtgatttctcagttgagtatgaggtgatttctcagttgagtatgaggtgatttctcagttgagtatgagatgatttctcagttgagtataggtgatttctcagttgaggtgatttctgaagtgatttctcatgttgaattgcaaattcaaaggagcagcttcaatcaaaaggcggggcttctcccgcctttctccccgcatcagtgggagaagtagattgaagccagttgattaggatgtttagctgttaactaaattttcatggatttgaattccaccaatctagcaaaaataaagatgccaattaaaaccacaatgagatactatcttagtgtggtcagaatggctattactaagaagaaaaaaacaacaaatattggtgggaataaagaggaaagggaacacttatacactgttagtgggggtgtaaattagtataatctctatggaaaacagtatggagatttctcaaagaactaaaaataaaattctccttcagtataacaatcccactactggatatctacccaaaggaaaagaagtcactatataggccaggtgcagtggctcacacttgtaatcccagccctttgggaggccaaggtgggcagatcacaaggttaggagttcaagaccagcctggccaacatggtgaaaccccgtctctactaaaaatacaaaaattagctgggtgtggtggtgcatgcctgtagtcccagctactttagaggctgaggcaggagaatcgcttgaacttgggaggtggaggttgcagtgagccgagatcacgccactgcactctgcactccagcctgggtgacagagcaagattctatctcaaaaaaaaaaaaaaaaaaaaaagaagtcactatataaaaaaagacacctgcactcatatatttatcgcagcagtattcacaatagtaaagtcatggaattaacctgtgtccatcaaaagataattggattttaaaatgtagtgtgtgtatacacacacacacacacacacacacacaccacaaaatactactcagccataaaaaagaatgaaattatgtcttttgcagcaacataagtggaactggaggccattatccgtagtgaaatgattcaggaacagaaaattaaaaacttcatgttctcaattataagtagaagctaaacaatgggtacacagggtcatacagagtggaaaaaaagacactggtgacttcaaatggtgggagaatgggaggcaggctgagggatgaaccaacaactattgggtgcaatgtatactattcaggtgataggtacactaaaagcccacatttcaccactacacaatatatccatgtaacacaaatgcacttgtacctctaaatctataaaaataaaaattttttaatataaataaaagacttaactgagaaaaaagaatttcattccttttatagcccaataatctataattctctgaatatatcacattttgtttgtttactcattagttgatagacagttggatcattttcatcttttggttattctgaacagtactgctataaatatttttgtacaagtttttattcgggtactcattttcaattcttttgggtttatacctagagtagaattcttggttatacaaaattgcgtgtggtagtcctaaattatcatatttttctttctacattcccattgctctattctcaattttagacctcatcatctcttacccagagtgttgtaacaaagtaatttatcttcttgactccagtattatcctctccatatctatacttaaacataaagatctaattattaatccccattgcaactcctctctggctcctcatcaccaattggataaagtcacaattccttagcaccatgtttaaggtattctattagctacctgctgcctacagatttagcagttaagggtaatttctcataccctttgttccaggcatgtggaattacttgaattacttgaattgttgagaaactacccagtattttttccacagtgagtgtagcattttacatttccaccagcaatgtatgagggctccaatttctctacatctctatcatgcttgttattttcatgtttttattactattattatccagttcacttttaaataatgttgttgttaatattattagactaacaccctggtaaagatttataaaacattggtcctctatttacctcagtattttccatattggtctctctgttagcctagacacagtcatttgtcatgcctcatatatacatttgttgaacaaatcactaaatatttttgagcatttactacgtgccagattctgactaggcactagggatagaggaatgaagagggcaggattaccctcaagttacttatcaaagaatagaagagacagacatttattagtttcctgtcactgccatagcaaattaccatacagtggcttaaaacaacataaatttattatcttaaagttctctaggttagaagtccaacataggtctcactaggctaaaaatcaacatggtgtcagggccacttttgtttctggagaccttgggaaagaatctgtttccttgtgttttccagttttgaagggacctgcttcccctggccagtgggcccttccttcatctacaaagcaagcatcatagcctctctccaactcggcttctattgtcacatctttctcttaaccacagccaagaaaaactctccccttgcaaggattcatgtgatgaatttgagactatctagatagtccccacatctaatggcccttaatttaatcacgtctacaaagtcctttttgccatgtaatgggatacattccagtatattctgtaacagttccagagattaaagcacagacatctttgggggtattactctgccttgcatatacatgtaaataaataataaaaacagccaacattaaaaaagaaaaaaacaagagaaataccaacacctccccctctgtaagaggtggaccttaactacacctaccacccccacttgtatgtgggctgtgcttagtgaattaattcaggaatggaaaagaaactttagaactgcatagaactctcttggccgagggatcaaggtacacatcactagtgataagtcatgttgatagcacatacccttgatatgatgtgatgagaagagtactttaacactgaatcattcttctcctcaaacccataactctagtctgaacatgaggaaaaacatcagacaaactcaatggaaagacaatctacaaagcactttactagtactcctcaaaattgtcatggtcatgaaaaacaaggaaagttgaagaaactgtcacagaccaaag

SEQ ID NO: 549 - DNA, 20001 bp, Homo sapiens
cagatttctcatgaatgtcttggtgctctctagagttttctctctggcaagagtggattagatccttcaggaatggattccttcctatgaaagtgaattgttagaaagcaaggatgcccctcaggttttgccccactgcatgtgtctgcttccccattgaccttctgtcatgttgtcacacagcataaatgcccttgccagaagccaagcagatgccggtaccatgccccttgaacttcctagccatagaaccatgagctaaataagcctcttttctttataaattacctagtctcaggtattctgctatagcaacacaaaatagactaagacacatccctactcaataacatagctgcctcttcaacatattcaccctaaggaaataaaaacatatgcacataaaaactcttacattagaatgctcatagcagttttattgacaacagccaaaagctggaaataaccaaaatgtccatcaataaaaggatggaaaagcaaattgctgtatattcataaaattgaatgttatttagtaataaaaatgtacaaactactgacatatataaaatgtggataaacctcaaaaacatgaaagtgatcaaaagaagccagacacaaaaggatacatactaaatgattctttttatataaagttctagaggagacaaaagttgtctctaatgacaaaattcaaaatagtattgcatgatgaatggggcctggactggccggaaaaaggcataaagagacctttaggggtgatgaacatgctctatatcataatggggtaggtgtacgcacttgacctcattcactgtacccttcagatttatgcatcccggccgggcacggtggctcacacctgtaatcccagcactttgggaggccgaggcgagcggatcataaggtcaggaggttgagaccatcctggctaacatgtgaaaacccatctccacaaaaaatacaaaaaattagcctggcgtggtggcatgcgcctgtagtcccagctacttcggagactggggcaggagaatcgcttgaacccaggaggcaagaggttgcagtgagctgagattgtgccactgcactacagcctgggcaacagagcgagacaccatctcaaaagaaaaaaaaaaagatttatgcatccctatgtatgtaaattttacttcaataatctaatcccactgaaatgtttgagcacctctatgtacaaagatcacatggaaaatagtggacaaataatatgaatgacatacttatttttaacttcagatatggttatatgaggattaaacatttaaacaactcacaattctgcagttcaaatgaatgctgtacagattaaagacagagtaattttagaaattattctaagaaatttattcattcaacttggaagatatgagtcatctttcatttcaaaaaatgtttattgagcacctataacagtcaatgtactaggatgatagataatgttcattgagcatctaaaatgtgcagacgctgtgctaatttcactgtaacatcatcttactgcagcacagtagttaagagccaagcagatctgggtttcggttcagactttgtaacctgctatttatatataaactcagggaaatgattaaacttccataaattcaaaattctcacttgtcaagtgagaatcatagtaactgtacctattttgttgtatgttagtaaagattaaataaaataggcaaaataaagacatggtccaaatcctacagaatcaagtaggatgctgacaacaaataacttcattatagtgtgtttagaagtacgccactggtgctatacagagaagaggaagaggaggtaagataaattccttagaaagatgcctaaatggaatattgaagaataacagaagaattgaaaaatacatgaactacaggcaaaggaaacatcataaacataatctcaaaggcaaaaagttaaaagtcctaattgctggaatgcaaaacacaaggcagataaggcaggacagattcagagggcccaagttttatagaaggttttatattacatgttaaaaagtttgacctatattctgtaggctcttaggagccattgaagggttttaagtgacagcaatttggcattttaaaaacacaggtggctctatggaagttgtatttgaaaatggcaaggttggtatatgagagggaacttaggaggctgttacaaaatttcaggcaagacataataaggcataaactagggcaactgtagaggcatgaagatggtgaagttctgagaaattcagaggaagtaaaatgggcaaagcaaactaagtcattggctgtgaggggtgagggagataacatgcagatttgtttcctgagttacaatagtctcataaggattgtaggagaaagaataggtttgattttgagcatgttacatttgagatacctctatgaatcccaagggattatgcatagccctggtgaatctgcatgtaaagctcagaagaaagtttaagagtcatatgaattggggagctgtggagtataaagaaatagatctattaagatgactgagatcatctaaaaagaaaacaagagtacaaactgagatgagccaaagacataaccctggggtcactaattaaagcaactggtaaatgaagaacttagaaggaaggcagaaagaaatagaaaaaaaaaaaaaagtaggaagcaaacaaagagagagtaacatcccagaaaaaaagagaccagaaaattggtctttgagcagtgaaaggtgagacgggtatattaggtagagcaaaagcctgaaagtttcatgctgtgttcaggaaaatatccacacattaaaaatgtagtttaaagtgaattaagagactgggaccagctaatggggtcttgaagtcagtgctagtaagttcaagttttactctcaagcattgggaaagtattataagttatttgggagaaaagttacatattcaattgtttatttcagaagtcaaactctaattttggtgtgaaagaaagaatggagacagaagagatgctagaagagcatttgggtggcagttgcaaaatatgggagttgaaggtgagtgcctgaattaagaggatgggaagtcagactagcaagttctttcccctgggagggtaggaagagtcatatgaattgaggagccattggtgggtgttaccagtgaataccttgggacctggtttagggaagtgagaactgagaccatctatgtccacatgacttacagtctgtagaccacctatgtcaatgtggcttagttctttgttttagaaaaaacttttccaaggcaaaataagactgtacggcaaaaaataattcctgattgtttcagataactgtatcaaaaagtttgttcacctgagcaaacagcccacttaccaaagaaaagtttacttatcaagactttctgtaggagattttgtacagtctcaattagctccgatcttgaagacttttaattacttgatcttagttgccaatattccgtagatattctgcttctgacttccaattctgagacactaataagactcttaaactggtgttcttccttactgcgacaagttctagttaaattttgcttaacagattccttggtgataattgagaaagtttattagagagaatataatgaatgcattgtgcgacatatttgacttgaaagatctggaagacattggcaagcaggtaaaaattttgatatagggctaaaaagaagatggatgtaaaaatttacatttaataaagttttcaaaaaatcactattgttggggctcagaggatgataccccagaatatggtgctttgacatgctgagagcttttgaattaaaggaaacttgaaggccttagagctgcctcagaaccaaaacctttctaacctcttgtttttcaccacccctcccaagccccactcaatccccaccccactccactcccatcacaaacccacatccacttccaccaccacccacccaagtgcaaagaggaactctctctgaaagttccctaatctggcaaggaaacttcttccaaaataaaattcaattgtcttaaaactctctccctagggatctcatcaaataaccagagaaaagactaaaagtcattgccacacacaggcagacttttcatgtagtgtgagggcagcaacaaaaaattacctggaagactttatctggcataataagacagcatttgttcacactgaagttccactcctcactttttggcaattcatcacctcacccagagctcagaggaaacttatcccagatcactgtctgttctgtcccgtttagtttccaaagagaatcatttacaaactattgtctgctattttgggcccattcaattctcaaaaaaatcatttactacccttcaaaaatgcctacatttccccatttcccctttccctatgaagaagaatatttaacttgcaaccctcattggcttgataatcattcttctgtaatttttcccccatgcaccttaagaaatgtgtatgccttttctcccattatagtcagttcatttcagtgaaccttcaaagggcagagggaagttttcctttagctcctacaagatcatatcactcagatgggcaaaatatggattcaggtcaaaatgttataaactaataaaaattatatttttctttaatcttctcatcaaactacacaaccactgtttcccactgtacgtcctccactttatgaaggtttgtcatgccaagctcatccctgactccatgatttagttgatgttgcttttcccacctttaataattttttcctgttttccacagtttaaattcctcagggctagcagcccccttctagctcttgaagctttttcagaggcttcattaattctcagtgttttccccttctcttttctctgttgcttaactgctctccaatccatcacgcatttgttttgtatccctgagaatattaaaattgccttaaagagagtgatcaatacttaccttttttattgctcccagtccctagtttatttcagaacttgtaagccttcaatgtatatatttaaatgtattaatttgaactcaggaaggttaagaggaaattcacatgtgtttctttgcaaaaaaagatatgtttagcaattacctggttaatatctattagcttaatttgagagattaggagagaatgaaaaggatatctgaaaacatatttaagctaaagatctaaaagatgcaaaatttttaattagtttctgaaattattatatagtaggtagctagtcagacataatagggcaggagagtgccctcccaacctccaaccaggaatgtcaggtgacaatcaagtgatggtcaggtggttaagagtctctctaaaataataattgattgcagccagtaccagagaaaggcagtcttctacagataggaaaaagctgaaactggtaatcagtagcttccagtaagatctcaggagttgagagagtaggcttaagcatgcgcactaagagacaaaaatggcagagtttaactggtatatgacctcctagggacatttggctggtaagggaagacggcctcaagtaagcatgcatacaattcaagtaaacgcactgcacatgcccccctccaaagtgctagcagccactacacatgtgaatggccaaccacaaggaaagaatcaggagtgaagggacacaagaacccagaagttcaccaacatataaaaccccaaatcaaaaggtcaaaaggtgcacttgtccttcaagttgcctgcttggccttcttccaagtgtactttcctccttttcattcctgctctaaagcattttaataaacattcaattctgctctaaaacttgcctcagtcccttcttctgccttatgccactccattgacttctttcttctgaggaggcaagaattgaggttgctgtagacccatacggacttgccactgataacaaaatgtggattgtaagtattttgcatcaaacatttatctatgtatatagaagcatatacatagttatgtgtaaggctgggaggatatgtacccaaatgttaacagtggttatcttatgtgtaatgaaggtaggagaaaggattgcaggcaactttttcttccttattttcatcttatttatttaatttattctagagcacactggtatttgttgggtaataaaacgtagttgaacaaaattaaaagtatcagtgttcattgtagaagtctttacaaggtgtgttagaaatatgtgagcacaattattcatcctcaaaatagaatagtgaaagagaatgaaagtgacaatgtaaggactaaaggaaaacttcccttctgtcctctgaaggtttgctgaaatgaactgacaataaacaaattagcagaagaaaaggcataaattttcattaatgtacatagaaaaaatgacagaagagtgattacccaacaaacaaaagaggctcagaatcttttatacccttctctcttagtcagggttctctagagggacagaactaatagatgtatatatgaagatgagtttattaaggagtattgactcacatgatcacaaggtgaagtcccacaataggccttctgcaagctgaggagaaaggaagccagttcgagtcccaaaacctcaaaagtggggaagccaacagtgcagtcttcagcctatggccaaaggcccaagagcccttggcaaatcactggtgtaagtcagagagtccaaaagccaaagaacttggagtctgatgtttgagggcaggaagcatccagcacaggtgaaagatgaaggcaggaagactcaagtcaaggcaagtcaagtccttctacgttcttctgcctgctttattctggctgtgctggcagctgattagattgtgcccatccagattgagggtgggtctgcctctcccagtccactaatgcaaatgttaatctcctttggcaacaccctcacagacacacctaggaacaatactttgcatccttcaatccaatcaagttgacagaagagagggaaatcagaaaacttagagaattgtgaggggtataaataatttttaggggagcagttccaagatggccaaataggaacagctccagtctacagctcccagtgtgagcaacgcagaagacgggtgatttctgtatttccaattgaggtactgggttcatttcattggggctcatcggacagtgggggcaggacagtgggtgcagcccaccgagtgtgagtcgaagcagagcgaggcattgactcacctgggaagtgcaagggggtcagggaattccctttcctagcaaagggaaggggtgacagacagcacctggaaaattgggtcactcccaccctaatactgcgcttttccaatggtcttagcaaatggcaaaccaggagaatataggctgcatctggctcagagggtcccacgcccacggagcctcactcattgctagcacagcagtctgagatcgaactgcaaggtggcagcaaggctgggggaggggcgcccgccattgctgaggcttgagtaggtaaacaaagcggccaggaagctcgaactgggtggagcccaccactgctcaaggaggcctgcctgcctctgtagactccacctctgggggcagggcatagctgaacaaaatgcagcagaaacctctgcagacttaaatgtccctgtctgacagctttcaagagagtagtggttctcccagcacggagtttgagatctaagagcggacagactgccacctcaagtgggtccctgactcccgagtagtctaactgggaggcaccccccagtaggggcagactgacacctcacacggctgggtacccctctgagacgaagcttccagaggaacgatcaggcagcaacatttgctgttcagcaatatttgctgttctgcagcctccgatgctgatacccaggcaaacagggtctggagtggacctccagcaaactccaacagacctgcagctgagggtcctaactgttagaaggaaaactaacaaacagaaaggacacccacaacaaaaccccatctgtacatcaccatcatcaaagaccaaaggtagataaaaccacaacaatgggggaaaaacagagcagaaaaactgaaaattctgaaaatcagagcacctctcccctccaaaggaacgcagctcctcaccagcaatggaacaaagctgtacggagaatgactttgacgagttgagagaagaagacttcagacgatcaaacttctccgagctaaaggaggaagtttgaacccaaagcaaagaagctaaaaaccttgaaaaaagattagatgaatggctaactagaataaccagtgtagagaagtccttaaatgacctgacgtagctgaaaaccatggcacgagaactacgtgatgaatgcacaagcttcagtagccgattcaatcaactggaagaaagggtatcagtgactgaagatcaaataaatgaaatgaagtgagaagagaagtttagagaaaaaagaataaaaagaaatgaacaaagcctccaagaaatatgggactatgtgaaaaagaccaaatctacatctgattggtgtacctgaaagtgatggggagaatggaaccaagttggaaaacactctacaggatattatccaggagaacttccccaatctagcaaagcaggccaacatccaaattcaggaaatacagagaacaccacgaagatactcctcgagaagagcaactccaagacacataattggcagattcatcacagttgaaatgaaggaaaaaatgttcagagcagccagagagaaaggtcaggttaagccagaagagagtgggggccaatattcaacattcttcaaggaaagaattttcaacccagaattacatatccagccaaactaagcttcataagtgaaggagaaacaaaatcctttacagacaagcaaatgctgagagattttgtcaccaccaggcctgccctacaagagttcctgaaggaagcactaaacatggaaaggaacaatggtaccagccactgcaaaaacatgccaaattgtaaagaccatggaggctaggaagaaactgcatcaactaacgagcaaaataaccagctaacatcataatgacaggatcaaattcacacataacaatattaaccttaaatgtaaatgggctaaatgctctaattaaaacacacagactggcaaattggataaagagtcaagacccatcagtgtgctgtattcaggagacccatctcacgtgcagagatacacatagaagaatcatgtcgagataggtaatggatgaggaagaaatttgggtttgactgaagtaacgggggctgtccgtgaagcctggcagcagtacagcctaggtaatttgctgagcctgatggatgtcagggtcagtccaagtgaaagcaaagagaggctgggatgaagggtgcaagaaatagtaaagaaagcatgtttgaggtccagaacagaataatgggttatgcaggggttgtggagggaggtattgaggataggagagtatatggcttcggccccagggggtggataggcaagacaatttggttgataaggcgcagatcctgaactaacctgtgaggcttgtccggttttgggacaggtaaaatgggggaattgtaaggagagtttataggctttaaaaggtcatgctgtaacaggcaagtgataacaggctttaatccttttaaagcatgctgtgggatgggatattggcattgagtggggtaagggtgattaggttttaatgggatggtaaggggtgcataatttgtcactaaggagggagtagaggtatcctatacttgtggattaaggtggggagatacaaggaaaggatgtgaaggaggctttgaactggggcaaaaggtggcaatgaggtgtggctgtatcccaggaatactcagggaagcagataatgtagttaaaatgtcccgacctaataagagaggtgggcaggtggggataactaaaaaagagtgcataaaagaacgttgtccaagttggcaccagagtgggggagtttttaaggggtttagaagcctggccgtcaatacctacaacagttttgggggcaagggaaacaggcccttgaaaagaaggtaatgtggagtgggtagcccccgtattgattaaacaggggatggacttaccctccactgtaagagttacctgaagcatctgtgatggtccaggaggcttctgaagcaatcagacagtgtcagtcttcagctgctaagctgaggggatctgggaaggagtcagccaaggaacattgggtttgggctccagggtccttaggagcggcggcaatgtgagttggacagtccgacctccagtgggggcccacacaaacagggcacggcttaggaggaatcccaggctgtgggcattctgaggcccagtggccaggcttttgggatttgaagcaaggtccacgaggatgttttgaaggagcccctgggagctgtggcttggatgttctgaattttttgtacgttggagacgtggttgtcggttgtctcagcagaggcaagtagctgtaactcagaaatgcattgctgtctggcaaactcctctctattattgtacaccttgaaggcgaggttgattaattcctgttgtggggtttgagggctggattccaatttttgaagcttttttctaatgtcaggagctgactgggtgataaaacacatattaagaataaggcggccttctggcccctctgggtctagggcagtaaagcatctaagggttgctgctaagtgggccatgaaccgggctgggttttcgtctttaccttgggtagtttctttaagtttgtcataattaccagctttgtaagctgcctttttaagcccttcaactaggcaggaaaccatgtaatctcgcctggctatacctggggaatctgcctgatagttccattggggatcttctcgggggaactgctctaataccttcctggaagtttgtctcctggagccagcggttatcagcatgagattgggctagagaaaaaactctttcccgttcatctggggagagggtagaagtcaggatgacatttaagtcactccaggttaaactgtaggacagagttagatattggaattcctatatgtatttagtggggtctgatgagaaagagcctaaatgctggctgatctgggaaaggtctgatagaggaaaaaggcacatgtaccctgactatgccttcgctccagccacctctctaagaggaaattgctgggcaggtaggggagagctagtcgcagaacgaaactgtaaaccagaccgggtgtgaggaggggaggtgatagaaagattatagggtgggggagcagaggctgacgaagaattgggacctggcttggcctggcgaggagcagcctggagagaaggggagaggtcagatgagtccatagaaaagaaggattcaaaggactcagagcttggggtggagactgaaggaacagacaggagagaaagaagaaagatctgggatgagtcacattgggagcagagactagggagggaccaatgtgtaaaagaatgcctggacgtcaggcacctcagaccatttgcccattttttgacaaaaattatctaggtattgtaaaatggagaaatcaaaagtgccgttttctggctacttagaaccactgttgagtttgtattggggccaagcagtgctgctgaagaaaataagacgcttagattttaggtcaggcaagagttgaagaggttttaagtttttgagaacacaggctaagagagaagaaggaggaatggagggttgaaggttgcccatagtgaaggaggcaagtttaaagagaagggtagagacacggagagaaggggtggggggtgcttgccccccaggaaagtggagaaagggtgggaggtgcttgccccccagaaaagtggaaacgggatgggaggtgcctgctgcaaggaaagtggaaatggggtgggaggtgcttgccccccaggaaagtggaaatgggatgggaggtgcttgccccccaggaaagtggaaatggggtgggaggtgcttgccccccaggaaagtggaaaaggggtgggaggtgcttgcccccaggaaagtggaaaaggggtagagacacggagagaatgggtggagtgagcagccctgggctgcaatatgggtgagcagccaaagcaggtgtccctgcaattgacttgccaccaaaggaatgtgggtgaatgaccaaggcaggtgtcctgtggagatcacacaccatggaatgtgggtgaataatcaggcaggcatccccacaatgattaaacaccaagggaaggctgccttcccgagtccatgaccggtgctggagttttgggtccacagataaaatgtgtctcctttgtctctaccagaaaatgaaaggaattgaaattaagagaagggagaaattgaagggtggcaccaagattgaaaggaaaatgggttgagggatagtgagacaggtgggagaagagagtaaaaagaggccgcttactcaatttaaaatcggtgagatgttccttgggctggttggtctgaggacgcgaggtcataggtggatctcttcatggagtgagggtgaggacaggggactggtctcccgaaggagtcccgctgacctgggtctttggcaccaaatgtctcacacgtccgtgtgaagagaccaccaaacaggctttgtgtgagcaacatggctgtttatttcacctgggtgcaggtgggctgagtccaaaaagagggtcagcaaggggtggtggattatcattagttcttataggttttgggataggcagtggagttaggagcaatgttttgcgggcaggagctggatctcacaaagtacattctcaagggtggggagaattacaaagaaccttcttaagggtaggggaaattataaagaatgttcttaagggtgggggagattgcaaagtacattgatcagttagggtggggcagaagcaaatcacaatggtggaatgtcatcagttaaggctattttcacttcttttgtggatcttcagttgcttcaggccatctggatgtacacatgcaggtcacaggggatatgatggcttagcttggactcagaggcctgacagcggtatcattctctgagctccaacacaactttctttctatgccatctttctttgtcccgtcaactagatttttccgtaggtggaatgataatggcttaggcaaaataatcaagacagctaagagcagacaaaatatgagtttggcagagatgtctatgaagtatcaccaagaaatctaaagattttgaatcctaaagagctttttttttaataagctattcccagcctataaattgatgtcttcctgtcagtaactagagtcatagaaaactcttctcacttcctatcctgaaactctgatcatataaaagcagcgattatgtagagcttagacagcacctatcacaggaaatgagcaattgcttcagttattttacggagaacattgaaggaaatgattaagttctccacacacaaagaaaagaacaaagagagtttgcactatggaaacattttgcaaaaattctacacagtttgaactgagagcaattgcacatagaaacactgaaaatatttctcaattggtgttaaatctatataaatgccaagtcactgttccaatgaagaaaccatagcacagggacattgtgcaacaaactaaaaagttcaaaatggaagccaggaaagtgagctggtaacattttttagcaatccttaaagatactggaagttaaaaatagaacctcctgtatagacatcctaatttgagctacttattatctatgtttaatttaactgatgaattacctgatgtaattaatttccatagtatgagtttaggcccattattccttttgttgtcctgtaaaacaacaacttcttatacagttgcatacatatttttggacttcatagaccctaactagcaatcacaataaaaattctatggcattaccctctacaggtgctatatgacatagacatacacttactgttttgatcaatactgggtagttagttcttttctctgtctctataaaccagaatttttatagagtgaagttataaacccaggtgaaaattatagtaatgaactgaacctgttgactctccttacatgctttattgcactgatgcaaaccaggaaatcatttttatcgagggtcttagagatcaaataaaaccaagatttgagttaaacttaatgacttcagatttacaatttaatatatttacttattattttacattctgcattatctagtacccaaagtaggtcagtaagacaaaattggttttggacctgagactaatgtgcataggcttctcattccaggcttctcttatcttcctttctatttggctcatcgatccaaatctgcatgtgtcagaagccaacataaatagcaattaccaaatataaacacactaagtattggacacacaattgaaatttggacttttgcccctgaatataaatatttccctcaataatttcttttcccacccagtcatttttttttatactgagctctttttcaaggtaaaaatttattctctaacaaatagaaaatatcttggactagcctaattctaacctagtgtttataatccttaggcactttaagaagcaaatcaatgcagacatttgctttaaaaaaaaatctggtgacagaataaattaggctagcatcctgaagctgaaaaagttttgccatttgcacaccccaatgatgtgggagagcaaaataattattccaaagcagccacatcagatggcacattggtttatctatttttgactaatttgaccattaacatcacagagagtaaaatttaatgtgtacatataggagttgtcatattggatactctttctatattccttataatctatttctttgtctttatggatttttctgtatttcttattctgataacacaattctatgtacttgtatctaaaactgtaaataaaataaaaaagcaattagcagaaaattagaaatatttatactgctttgtaaatgtttactctctgtttcatgtcagtctagtatgtctcatggcaaaataatccataattaaactttactgcaatataaatgtttgcaaaatggactgtcttagtcagtgtttagaaaaattaatcaaatccaattcctttctctaatgaacttcttcatgcactactagctcaggcatgtagctcgaagtgaggctgagcaggtaatttggaaaagctcatgggtagctagagcagtcttcccactctgttctggaaagacttagagttcaaaaaagcatgtgaaatattagctaaggaggaaattcacacatttggtaacttcaggaaaagtgcatatatcaagtgcctggttttaaaagtgcattatagggtaagataccacatgccagtgaaaaattaggaaacttaaaaatgcatttcagaggccaggcgcggtggctcacgcctgtaatcccagcactttgggaggccgaggcgggtggatcatgaggtcaggagatcgagaccatcctggctaacaaggtgaaaccccgtctctactaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaatgcatttcaggaaattttggaagatccatgtaaacacttgggtaaaacccagacttgatcaacctaggccctcgacatttccatatcggaaaagtgttaagcaataaacttcacattacatctggctctgctgcttactaaatgtgtgaccttaggcaagaatttaatatttctatgcctcagtttccatatctctaaaattggagaggcagtatacactgtattggtccattctcgcattgctataaagaaacacttgagactgggtaatttataaagaaaagaggtttaattggctcatggctctgcaggctttacagaaagcataattctggcatctgctctgcttctggggaggcacaaggggagcaggcttttttcatggcaggagcaggagcaaaacagagcaaagagggaggcgcaacacacttttaaacaaccagattttgtgagaactcactcaccatcaggagaacagcaccaaggggatggcgctaaaccattcatgagaaacccgcccccatgagccaatctcctcccatcgggccccaccaccaacactggggagtacagctgaaaatgagatttggtggagacacagatccaaagcatattccacacagtaaaagttgttatgggagatcaaacaacttttgacacacagagagacacaatcacacaggtgcacattcacaaacatatactaagtgtttataatagataaatttatatatttgataattgctggcgtttaaggatcatgattgaattctaagttgcggtcaggtcttctaggcttttcctctgttcatcttctaggatcaatttttcaaagttttcttcttcccttgttgcagattatttctgaaagcctttcctctttacagttgccactatcctatccatttatttgactccctccgtcatcaaagttgtgggtaaaatggcaaaagtcagctctctaagttctcccaaggatcctagactttttcttctttcctgattaagagtttggaggaaatagactgagaatagcaaagagagatgaagtgggagaaattgcaaagtataactttctgaaagttcatttagatggccatctgttaaaagagagtaatttgcatttctgaagccaattaaactagaaccagtctttgtctaatataatccaccccaaagacagacagacagacagacacacacacacacacgcaaacacacacacacacagagtgagagagagacagagtgcatgtgtgagagagagcgagagtgtgtgtgtgtgtgtgtaagaaagaaagagaaacatacgcttaattttagttatctcctaaacctggcatttttagcccaaaatattcagggagtcatttgacttggattacatccttatttttacaaacctctaggtgaaactcaacatttcttttatttattagcatagtagtcagagcagtatttatgcctttgtcactttataattgttgcaaatattatttaatgctcattgctacttaagaattaaagtagctactaaacctactatagatcttattatttaatgtttcaatagaaactgtatatgttgacatggtttgaatgttttattccttccaaaactcatgttgaaacatgacttccaatgttggaggtgggcctagcgagatgtgtttggatcatgggggcagatcccttatgaatgtcgtggtgctgtccttgacatagtgagtgagttttccatctgagtttatgcaagatctggttgtttaatagagtgtggcacttcttccctctctcacttgctcctgtctctctctctttttctcaccatgtgagatgccaggttcccctttgctttctgccaagattgagagctttctgaggccttaccagaagccaagcagatgctgacatcatgcttcctatatagcctgcagaactgtgagccaattaaactccttttctttataaatttgcacagcctcaggtatttctttatagatatgcaaaaatggactaacacatatattataaattggggggttttgatgtctgcattcccatataattggctgactttgtaatttatgcattttactttgtgcatataaagtattactagctatttagtttttcttttgtttaaatactccattattttgcatacttgggtttcgttccatttagttatgctatgttgatgataggcagtaatcgtttcacctacatttcataatggtgctgaaccacctctttaacaagggagtttgaagctaaggatgacaaaaaaatgaataagaagataatttctttaaagctttattgtttaattgtggggaactgtttttctaaggaaaaaagtgttatatacaaatctgtacaataatgaaacaagctgcaattggcttctaaagcgtaacaggccaagtatataatatataccctgaacacaaaggcacagctcccagagtttgctaacggaacttctcactcatggaggcatgctgctatattattgacaagaatcgccataaacagagtcatgcagccatcttggcaagacttgcccaactgtgtgcttaggtgttgcttccaaaatcccttccaaatcacacaagtggaataatttctccttgtgttgagcacattataacagctgcatgctgtcaccatgatttttagaaacaaatatctaagctttttcaaaaagcagagcatccccaaaatgatgatttcctattatgttgcaaaattgcttcgaagcattattaatattctttatgtctgaactgggaagcttgctaggtaagcttagaaggaattcatttgcacagttactgaagcaagatgaagatttactgcttttctcttagagagcttgctgatgtaagatcaacattatatgccatttacagaatccaggaatctttacttatagagaaacttttacctgtggaactcatactcatctaaatattattccagccaactccagatttggtcccaaactggggtgttataagaagaaaaaggcaacgatcatagtttcttactgagaattgcttagaatacccacagctccagactccatgccaggtgaaaagctaaaaaaaaaaaatctcagtttctgggatagtaattatcttccatcttccatagtgaatagtatatttccaactcatgaaaatttagaatcagcttagaaatgtttaggataatctaagacaaagaaattatactttcagattgtgtaatgaagaattaacttcacccaacaagaggtctgcccttagccttcggctactgggaagtaatctctaggcccctagaatatactgcctaataagagtttgtttgtcaaacagtgtaactgtgattttttaataggggctttgagtcatgctacatcagttttgacttccagagtaaccagattaaaggcattagtctgacttcaggaggtactggacacaaaatatcagcagcagaaacagtatgtggctgatccccagtaaaagctctggacatcaacagcttggatgagcttcttgtggtcggccattgctatacattacgaccaggaggaggtgctgctccgcatgacttcatggggagaggacaggagaggagaacctccatgtttagactcctcctagactctgacctatgcatcacttcctttgattaattttaatatgtatcctttccctgtatactctttgagagtataacagctttcagtaatttctgtgagtccttttagcaaattatcaaacctattacttagtataacagctttcagcaatttctgtgagtccttgtagcaaattatcaaacctaagggtaattatgggaatcctcatgtttgtagccagcccatctgaagtaagggtggtcctgggatgctgcagtgttcagctggtgtctgaaatgaaggcagccttgtgggaagtgttccttcttcctatatagtttgtctagctctgggcaggtattaggaaggactctgcagaaatttagaattttatatacttgtaacatttggcttattagagcaacatccttgtaactcctacttaaaatgagcaattga

SEQ ID NO: 550 - DNA, 50097 bp, Homo sapiens
aaatagtggagcaaacacgtttcccacaccaatcacaagaggtgtttgtctctgagctaactcactgcttgtggctgcttcggggtgtgaatagggctacaaagccagctgagaaaatccctccaggaaatttgatttcaagctcatagttttccctcacagcctcttgcacaggagtcacacaaatttttttccaaaagtcctgagtattgctaccatcagctctggcggttctgctatgagggtataagagcccttggctgaaaagttaataatttccatgctattttgcaaaagcttacagctggtgtccccagagtcaaacttgtcagataaataaaattaaggctgtaaggctgttatctaaaacctaccacaattctattcccaacagagatttaggggaagatgaagataaagagaagaataatttctaaatcagttcatcacacacacaaaggccaggacttaggaggctcttttgtgtgagggagggcaggagggatgactttcccagctgtggtgaattcccgctgctccaggccacaaggtgcaatttctggagcagctggccactgtggctctgtccttggccctctcctagaactattgtaccataaattggcctggccattggacaaatgtgaggtttgtctctggatcactcaatcatgtccattgacttgaaatgctagaacttagcagcagcagcaatggatggggtgagcattgcagaacagcaacatgaggcctgtggagtcctggaagatggacggacggatggatggatggatggatagatgggggcatactatgctgaccatgaatagaatttgttcttccttcttatgtatagccagagataatattttgaaacatcaattgatatactttttgtccctgatgatatgtttttattttttggcttttccaccgttaaaaagtaagacataataatagtatcttcttcacaggattgccatgagaattaaatgagataatctgggaaaagctgtttagcttcggtattaatttacagtaagggatcagtatatggcagctattgtcattatcctccccatttgacgctaataagttggtagaacctggataagtcctgccccactagaaagcagctgctggcttgaatttctgcagaccctccctcttcccttttagagggagaacagcaccattgaggcttcccagcaccagtgtagaccagctcttccctcccttagtatgacctgaagtggtcacactgtctgagctggaaggaaaatagagctgtgtatatgctggggttaggggttatagaagaggtctgctctttggttttgaaaattataacctatgggagaattccgctgtggtttctcaaaaaatctaggaacggaagctctcactgttcgttttaggagtccaagccctgtggctctgatggtccttcagacaggaaagaaatgcagaaccaggtgggtacagaagaagagatgcagtttatcctccctcagcaactttcctggaattcttcaaataaacagacctgcagtgattctctgcaaatggagggcatcccttgctcccaccacccctgtactcactccaaagatcactgtttgccctgaatgtcaaatatagttcaaaaggaagcagatcataactggaatctggctctgtctggcactagctgtgtctcttgggcaaattaattctcccctccaagcccctgagctaagggagaagaaagagaaagggccatctttgagaagtggtgttatttgagttaagtggaaagacgctggggaaataatcctttttggctagaggtacagtctgtgactcctccaggggtcttctaagtccaaagcccccaaagagggcagggctgagagcagacagagccctctgtggctgcgcagatggagacagcttgatgagagccaagccccctcctccccatgtgccacctgctgctgatagagacagcaaaggctggagcttggcagaaaggtgattgtcaaataggcggcctccatgcatgcttaagacctagatttttttttcaaaaagtacatatactaactccaagaggaccgttcttgaaagcagaacagctgctgcgttttctctgtgaagatgtcacctgtaactctcacaacttctatttttctgatgccaggcgacaatcataacaaaccattttcaccagtaaaagcttgcatctgcaatcacagttaatctgcatgtttttaaaaactgtatttcagaaagggtctccagtcctccaacataacatccaaaacaccggttctcttgtgagagatgtaaacatgtaagtgagatagataaggcatgcagctgggatgagatccatttataatgaacacgcagagcagtggtgggagcagtgagatggcagagaagccacgtgccccttaaagaacaccccaaacatggaaactcagctttggggagcaattaaattagtaaaagtaagattttatattttgtaagatttttctcaggattccctttgataaagggttgttccggatcacttacaatatagcatgatttacaaaaagcccatctgttcgcaacgtgcaatgtttgcaaaagcacagtggttggtttggctacaagaaaggaggatctactgtttatgtgaaaatggcaaaggcaacgtccagatgacttgcagaagctcttttcctggaattctcaaaagagtctattttctaagggattgtcccagtgaatcattacgatgactagtacaaccgagataattgtcagtttgtgagtaaagtgatgaggaaggaacaggggatattttgtcataccaccatcaaagatgatggaggatgttagagatggacaaggactagtgaagcaagcttgtgttagaatgagacggggcttcggcctggacaggggtcatgggccaggaaccagacaggcagttaagaaccaagaaattcatggaagccaaaggataaggcaaagttgtggttctgaattcagtaaagaaccaggggctcaaatgtcctgagacttcatgcaggcaggaagcagagctataggtagtatgaaggctggagggttccttagctccagccaaggaacctcaggccctgtaggcacgaaacagatgaaccacattttagaagtataggatcacttgcctggaagggagagtcagaggttgggctggaaacaaggactcacatgtaatggtttatctttggaagcagtgatgccataatgtccaaagaacaggaaattaaattttattctctgctgcctccgggtctatttatactcccaagatctaatctttctgtaactcttgttacctgagtaaggtacatagccaacttgtcaggtatccaataagagagataagatgctctttccaaagccacgtctactgcatattattggactgaagggagttcctccaggaaggaaattaaatcttgagggcctcagcatttgacttgcctttttccttcctgctgctgccaagctgccagtgtggttaactggtaccctagctcggagaagacccaggtgggtctccaccaaggaggcacaggagatgtcaacagtctcttctgcctgccctatgaccttgggatgttgaaaacaagtaaggaagcaggaagagagagagtggcccaaagcgatctctgcctgcatcaagcattttacccagagttattcctgaatacaggtatcctgagcagaatgcctaatagggagaagacgattgaagatcaagcttctaagaggaattgtgcatatctgggttgatgaaagtgggaaagggggagagagaaaggagaagaagcaaaaggccccagccgtggcaaactactgcagatactttgttcttctgcatcaggtagcactgatattatgtttttttacttataaaacataataggagtaataaatagcaatatgtgaatagcaacataaatgtacagattacaaaataacttttagtgtcataattgtattatttatttatttgtttatatttacattttttgagacagagtctggctttgtctcccaggctggagtgcagtggcatgatcttggttcattgcaacctccacctcctgggttcaagtgattctcctgcttcagcctccggagtagctgggattacagacgtgcgccaccatgcccagctaatttttgtatttttagtagaggcagggtttcaccatgttgcccaggctggtcttgaactcctaatctcaggtgatccacccacctcagcctctcaaagtgctgggattacgggcgtgcaccaccgcgcctggcctagtatcataattttatataaaacaataaataataatattttattaatatatgactgatgactgtaagatttttctggctcatttttctgcaaactcatttatacttttagcaatttattttccattaatattattgaaggcaatgtgagttgctcttggcaaatgcaagactggaagttgataattgattctttttaattttgagaagagtctgatgatgcaactgttactgagctattaagagtttctacagactatggcaacagatacgtttatcagataaatttctggtaaattattttgaaatatataaattttagcatctctagagctggtgattctcatgaaacaatttttctagaaagatttcactcttcatataaatcagtttcatatagtctgaatttaattttaaagtaattttatacaatggcatttaaaattttcatctaatattttctgtaacttgtgaaagtcatataagaaaccaaaagtggcttcatggttttatataatgcagagcttctgcttatgcattctattaccgcatcttcaattacaaaggaaatgagttataaaattgtcctcgttatgttaaaaattggttcacctaacactttgtatgaaaattgtgttcttttccattgaatgcaataatatttaaatttaatttctattccaaggctgtgggtattttctttgcactgttgcagcagttttcaaaaccagagtctaatctcattgaagaataacttctggccgggcgcagtggctcacgcctgtaatcccaacactttgggaggacgaggtcaagagattgagactagcctggccaacacggtgaaaccccatctctactaaaagtacaaaaattatctgggtgtggtggcacgtgcctgtaatcccagctactcaggaggctgaggcagaagaattgcttgaacccaggaggcggaggttgcagtgagccgagattgcgccactgcactccagcctggcaacagagtgagactccatctcaaggaaaaaaaaaaaaaaaaaggaataactctttgggatgctttattgcaatatatatgcttttattttgtaataatttacagacaaagtttactgtctgagctctggcatcaactgggatggcattcaggccacattaatatttgtgctgatggtgcagggatggtgctagggtttgaatatttgtgtccccttcaaaatgtatgttaaaacttaacccccaatgcaatagtatttagatgtggggcctttaggaggtgattaaggcgtgagggcagatctcttgtgaatggaattaccaacattataaaagaggttccagggagctgttcggcccttttgctcttcctctctttctccccatgaggacacagtgttcctcccttttgtccttttaacccatctgccatgtgtgagaacaaagcaagaaggtcctcactagacaccaaatgctagcgttttgatcttgaacatcccagcctctggaactgtaagaaataaatttctgtccttcatgatttacccagtctcacctattttgctggaacagcactaatgaactaagatagaaggtttctggggacaggtaggcaatctggctgccaccagtggtcctgccaccactctcacgcagagtcccccctctctctcagtggccgtgtgggccaccactgttgctctgctactactggactgtcattgttttcgatcttggcctgggtcctgctgcaggctgccaggccaaccacttggcatgcatgtgcccctgctcactgtggcagtggactcagcctatctcactgccatctggcatctcctctgcccccacacaccgtcctatctgacttcatttacaaaacacaagagtcagataaaaacgataagataagcaaattcacagcagtgacagcagagtgttaaaacaagcacagggcctcttgtgagggtgggcctaagtgatggcacaggctacattcccatgaagccacccctgcttgtgggactaggtcaggcatgtgatggggccccatgctggacttaacatgtctgggcatgcataactgagtaatagggtaaatcccctacatcaattttctggttttcctatacaaaaaagcacaaagtatgtgcttcacaagggactgggttgggagaataagaagtgccaattcctggaccctggcccagccctgaggatgggcatctgactgagccctttgcagagtgaggctgcaagcagaagctgaaggagccgtttttctcaagggccctgtggatgtggagaagcctgcagggatgcttgggggttcagatgactgcatggcacagagcctcccacagctctgaagagcagtaagccaggtactggacaactaagcactgcagaaagacccagttggtctggtccctcagggcagcagctctggggggcaccgccacagcttttcactgtggagatcagcagcagcagctatggcagcatcctgacctcacaggccttcctgccttgcatggaggagccaggcaggagaggagcaagacctgtagaagcctgggtgatagaagactacttgtgagctggtgtgagtcacgctcagcaaagggggaagaagcagtaaaatggggttagaatcattcctgggactctgtttgtaaccaagggttctagggaagactggttacagaagtgatcttggtgttgagcacttaaaggcccaagatggaccggttctatgaaggtcggcagcatgagtaagtagtggggagataccttttaaccttgtgggaagaggagaagagacactctaaccgtaaaagctgcccacggaaggcatgggctgccttgaaccagttccaacacagattgtgggactctgggttatgaatcgtggagagaagatgtaggaagagggtgggagtaaggagagggagtgtttttcaaagtgctgctggagggactacttgcattggcaacattttgacgggagggtgttgaaacgcagactcctggtctccacagaaattctaattcggtgggtctgaatatggcctgggaatttgcatctttgacacacacccctgacatttctaatgtgcactgaagtttgagaaccactgtactaaggtctttgcagctgttaagacttgatgcctctatatctcagcacttttctttgacacatgcccctagcatttctatgtacattaaagtttgagaaccactatactaagatctttgcagctataagacttgatacctctacatctcagcactgttctccctgcccttgcaataacgatggcagagagaatccctgagtctataacccactcaggtcccccatgcctacacatgagatactataaaagtgagcaggagacagagtgagtctcctactaatttttttttggcataaattaaattttcttttcacgaaaacacttcagcagttgttcagaatctggctttgcaatccaaaccacccaagcactaaaaggcacaggcaccgacaaagactatctccttgacaaaggtttagttgggctcctctgagccttcttctcgactgggctcaactttctgtgtgcttctttcctgagtccctcctactgctacacacctattggaatagtcttgaatacagtcttctttgcaggactgtattcaagtctgaacaagcatcagaataattttttccttaacaggtatggtgtcacgactcagacaggatgagagtcatcattggatccctgggcctctcacccaggaccccaggtgcctacctttgaagctttcatcttcactcctgactgactgattggggctccattggtgagcccgactcctgatccaatccaggcctccagatgacagtctgttgaagaatgggcagcacagattgtgattcttgagattctgagtatactcttgaagctgggttagtgtcctaggcttctctgcttgtaagaactgggctataatcccaggcaaacaaaaggctgggttggaatctcaggtttctctgtaagaaagaggctgagttagattcccaggctttcctgttttaagacatagagttgggattagagtgccaggctccattgtttgtgaggtatcatgagttatgaacatggcagcttctcagttgactgaacctcaccccaacctccttctgaaacccctgctgactatgtgctccaccacctaggcactaactctgtctgcttcccttcttgttgatatgatcttacaaaggataatttgggacttccctaaagtggcatctctaagatctctctcttccttttgcctccattcctccttccatttttgatatgccctcctttaaacccccacctcctccacatttttgttcagccctgccagacttttcccttcccactccaggctctcaactacctacactcactggagccccgttggagactctatgggactcaagagcctccaaaagcaactacaatatcttaaaaatgtcctccataatattggtaaaaaatatttttgctctcacattggtcaggtagcaacttgttccattcaccaaaaacacaatttggataaaaaaattaaagtgcagtaaagacgagagccaaccatttcatataaaccagagttctgtattactgtgtttacctgactcatggctacaattttaaaatggaagctataaggtctccatttgcatctatctgtatgtttatgtatgtacatatgtatgttatgtatatgtgatactttcctatcttctgatggtattacccaattaatttataaaaccctataaagaagctctattctgacaggcttagggacaaattgcttatatcaattaaatatttataaagctctcagaaatataggaattaaccccaattttttttaagttcatgtgactttgggaaatatttgttagataaaaccagtttaaaattgttgattgaataaaacagctgtcttctgagttatcacatgtattaaattcatgtgagtggaatcaaaattttataaatgaactttttgacaataattatgttttataatatctgcctaaaaatgctttccacaatctttttggtaacttgcaatcttaaaattatgctaagtaatacatattcattaactatctagattatttctaagtcagataaaccactgaaaatttatttttaagcataagtttaattttatatacttttggcttcttatttttatatcatatagagaggctacatatatttaggtctgttactaaacattctttttgccacattaaaacaattgtattacgaggaagcacatacctataaaaattgtgagatggtatattcataaaatttgctgatctgctacagaatgttggtacttgacagacaactcacaattgtctataacctagttttttctgttaccaaaaaaagaggttacttatggttaaaaattttaatcaacatatgtaaataaagctactagaactaataaagataaagggaaatgacttgcaagcacaatttgcaaagcaggaagaatgtgtttttgtatgggaaaaataaaaataactgtcttaaagtgaaatgactggctgttccagaataagaaagaggaaaacatagaacaaaatgaaatagatataaaaaattgtaaaaggaatattgggccagagcaattaggcaagacaaacaaacaaagggcatccaaattggaaagaaagaagtcaaattagccttgtttgcagatgacgtaaccttggacctagaaaaattgaaagactccactaaaacactgataaaactaataaacaaattcagtaaagtttcaggatacaaaatcaacatacaaactgagcgtagtggctcacgtttgtaattccagcactttgagagtacaaggtgagtggattgcttgagcccaggagtttgatgccagcctgggcaatatggcaaaacccagtctcaaccaaaaaatttaaaaattaaccatgtgtggtggcgtgcacctatagtcccacctaacttgtgaggctgaggttgggagggttgcttgagcccaggagctcaagactgcggtgagccatgattgtgccactacactctagcctgggtgacagaacgagacagtgtctaaaaaaaaaaaaaaaaaaagaagaccaaacaaaaaaatacaaatacatacaaaaatcagtagcatttatatacccaatagcaaacaatttgaaaaagaactcaagaaagccatcccatttacaatagctacaaaaaatataaaatatctaggaatccttttaaccaaagaagcgaaagatctgtataaggaaaactataaaactctgatgaaagaaatggcagaagacaccaaaaaatgaaagatattttatactcatggatcagaaaaattaatattgttagaatgacaatactcaaagcaatttacagatttaatgcaatccctatcaaaatactaatgttatatgcctactatgtacccataaaaatgttttcaattttttttaaagataaaataaaataggtcgggcgtggtggctcatgcctgtaatcctagcactttgggaggccgaggcgggtggatcatgaggtcaggagatcgagaccatcctggctaacacggtgaaaccccgtctctactgaaaatacaataaaaattagccaggtgtggtggcaggcgcctgtagtctcagctactggggaggctgaggcaggagaatggcgtgaacctgggaggtggagcttgcagtgagccgagatagcgccactgcactccagcctgggcggcagagcaagactctgtctcaataaataaataaataaataaataaataaataaataaataaataaataaaataaaacaaaataaaacaatgacatattcacagaaatagaaaaaaaaatcctaaaatttatatgaaactacaaaagacctcaaatagccaaagcaattctgagcaaaaagaacgaagctggaggtgccacactatctgacttcaaattttactacaaagccatagtaaccaaaatagactggcataaaaatagacacacagaccaatggaacagaatagagaaacctgatataaatccacacatttaaaaccaagtcatctttgacaaagtcaccaagaacatacagtagggaaaggacagtcttttcaataaatggtactgggaaaactggataattatatgcagaaacatgactataaactcctgtccctcacgtgagcaaatcaaaatgaattaaagacttaaatctaagacctgaaactatgaaactactagaagaaaacataggggaaatgctccaggacctcggtcagggcaaagatttcctgtgtaagacctcaaaagcgaagggaactaaaacaaaaatagacaactgcgattatatcaagctaataagcttctgcacaacaaaggaaacaatcaacaaagaaaaaggaacacacaaaatgggagaaaatatttgcaaactatccatctgcaagggattagtaaccagaatatataaggagctcaaacaactcaatagcaaaacacaaagtatctgattaaagaatgggcaaaagatctgaacaaacattttctttttgcaggggaggtggtgagacagagttgtgctctgttccccaaagtggagtgtagtggtgtgatttcaggtcatgcaacctttgctttgcagtgaacagacatttttcaaaagaagacatacaagtagccaacagctatatgaaaagaaatgctcaattcaacatcactaatcatcagagaaatgcaaataaaaataacaacaagatatcatctcattccacttgaaatggcttgtatcaaaaagacaggaaattaacagatgccagtgaggatactatgaggagatgctcataattccatggaaaagggaaaccctcatacattgttagtaggaatacaaattcctagtacaaccacaatggagaacagtataaaggctcctaaaaaaactaaaaatagaattactatatgacccagccatcccactatcgggtatataaccaaaagcaagggaatcgtccaagagatatatgtgtactctcatgtttattgcagcactattcacaatagccagaatatataatcagtcaaagtgcccatcagtggatgaatgaacaaagaaaatgtggtatatatacacagtggaatattattcagccataaaaaaataagatcctgtcatttgcagcaacacagatggaactataaaccattatgttaggtgaaataagctaagcacagaaagataaatatttcatgttctcattcatatgtaggagctgaaaacatgtatttcatgaagatagagagtagactggtagttatcaaaggctgggaaggggagggggaggaggaggtgaaaggcaaaaaaattatatatatattaaaaaatatataaatgtacttattaccactgaactgtacatttaagatggtaaatatagtaagtaatatatgtatattttccctcaataaaagtaaattttagaaagggatattggaaaagaaatcttatcttgtgcaatcaaaactgggtaagagtaaacagatttataaagtgtttaaaaaatgggcttcagtaaaagtgctaagcctttttttttttagcaattttgtttctacatatatttacttttgaattcttttactatcactttggttaagctggtaactaagtattgtttcacagtggcctagagttctatttagttaactgttcaaacctcttgatatttttgacaatttggcctttccaaaataaaatcctaaatgaaatcttgatcttgaactgaccttgagatttctcagggagcccctgcaaaatctcaaaaaatttgttctttcactttctaaaaacagcaaagttaaaaaacaattaggtttatttggtatgttgaattgcatgaaaagcattgttacataaagagatgcttaaccttccctgtgttatatttgtatgggtcaatgttattaatataaatatttcagaaattgtatgaagtttgtagaaatctgtcattgtccttgctgctcataacatgtactggtaaagtgttatcaatcataattccatcattttaatatttaaaatgttgcatgccacagagacaaccgaatttccttgtcatttgcgtattttttattatgaactcttagcagatctttagccatggtcattttaaggcttttgtcattcactgataatttttgttttactctgattcttctctgaaagcattcgcaacctgctacaggcaagcatgcttcattttcagcaaaaaggaattgtctcagagactcatagaaaggactgtcaagtactctgggctacaggattctgatagcattgttcacataactttgagaccatagcactggactgagtaagaatttccataactctagtggagaagcttacgggttcataaaactgctaatctaagtgctatggactgatgtttgtatcatatccaaagctcgtatgttgaagtcctaatccccaaggtggctgtatttggagatggggcctctaagaaagtaattcaagttaaatgggtcataggatggggccctgatctaataggattcgtgttcttataaaaaagaaacactagagaattcatgctcgctctccctctctctctctctctctctccacatttacacaaagaagaggtcatgtgagcacacagtgagaaagtggccatctgcaacccaaggggagagccctcaccagacaccaatcatgttggcacctcgatcttggcttttcagtctccaaactgtgagaagtttcgttgcttatactgcccagcctatggcattttgttatggtagcctgagcagactaatacaactaagatcaagcagaacaagaattaattagatgaaacggaatgaactgatgaagaatagttatggcttttgtttgaaatattgttgctggatttaaggaacccctttctctttcctctgaagctatctgtaactcattaatagagtatgcttttgtaaacagaatgaaacatttaccctttatccttgcctagactttccagaatttggaaagtcatattgagtattcttattttcacggtaatataattatttgcagagatgcagtcagagtctgttctccttgaacagttcagaggttcctcagaaaactcaaaatagagctaccatatgatccagcaatcctactactgggtataagcccaaaagaaaggaaatcggtctatcaaagagatatctgcacccccatgtttgttgcagcactattcacaatagccaaaatttagaagtaacctaagtatccatcaacagatgaatggataaagaaactgtggtacatatacacaatggagtattatttatccattaaaaagaatgagaccctgtcatttgcaacaacatggatggaactagagatcattattataagtgaaatatgccaggcacagaaagacaaacgtcacatgttcttacttatttgtgggatctaaaaatcaaaacaggctgggcacagtggctcacaccagcactttgggaggctgatgcgggcagattagtcgaggtcaggagttcaagaccagcctgaccaacatggtgaaaccccatctctactaaaatacaaaaattagccaggcgtggtggcaggcacctgtaatctcagctacttaggagtctgaggcaggagaatcacttgaacgcaggaggcagaggttgcggttagccaagatcatgccactgcattccagcctgggcaacagagggagactccctctcaaaaaataaataaataaatacataaaaataaaaacaattgaacacatggagatagtagaaggatggttatcagaggctgggaagggtagcaggagaatgatggggggaggtggggatggttaatgggtgcaaaaaaaaagaatgaatgaatgagtaagacctggtattgaagagcacaacagggtgactataggcaataataatttgattgtacatttgaaaataactaaaagagcatacccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagagcataattggattgtctgtaacacaaaggataaatgcttgaggggatggacactctattttatatgatgtgattattatgcatttcatgcctgtatcaaaacatctcatgtacccccatatatatatatatgtatgtatatatatatacacactatggacccatgaaataaaaataaaaagaatatgttctttttattaaagatgtaattggaaacattggttacatagccaaggctttgactataatgttatatttgaaaatgatacatagattcagatatgactagacagttttaagaaatcaaggctgactatatggagcctacaaaaactctcttaggaaaacctggcttgggccaggtgcagtggcttgtgcctgtaatcccagcactttgggaggccaaagcaggcagataacctgaggtccagagtttgagaccagcctgaccaacatggtgaaaccctgtctctactaaaaatacaaaattagctgggcgtggtggtgcatgcctgtaattcccagctacttgggaggctgaagcaggagaatcgcttgaacccaggaggtggaagttgcagtgaacagagatcacacccattgcactccagcctgggcaacaaaagcgaaactctgtctcaaaaaaaaaaagaaagaaagagagagagagagagaaagagggagagaagaaagaaagaaagaaagaaagaaagaaagaaagaaagaaagaaagaaagaaagaaagaaagaaagaaagaaaggaaagaaggaaaaggaaggaaagaaggaaaaggaaggaagggaaggaaggaaggaaggaaggaaggacagactacttgtctcagtacctggcttacagtgtttccagccatacaattgagcaaggaaggccacttcccagcagacccaggaaattttggggacctcaagaagaggaattaacccaaatctataggtattgccagtaaaatctggtggtgagttcctggcttggctgtctggtcttgagaagcattttaaaagtcttatctgagattcgtcatggagatgtccagcaaagaaaacttcaaaaggtctgtgtgatcagttaccattctcattgcacttatctaaataatcaggccaaatctaataagatttgacttatttcacaagcaagaataatcttagtttggttatctttaatcagaaatggggctgatcatagagaacgttttgtgttgcagtgaaaaactatagcacacccttgtgggttatcagattctggtcttgtttattgccttggaggttttgttattcacctgtaactggattctgctgtcatgcatatttgacattctttcatccacatcttctaccatctacactgagaaataaccatgactgtggccctcatgtctatgccatcaccaaagacattcacactgcaaaccaggaaacctgtcagcttgccactgccgtcctcactccaccgtctaaagatgtctcgagtctaacgtgtagcaatcttggctgccctctggactcagaaactgggtttattgtctgctccaaccactcatctttgtactgctttttattttcatagaaatttccctcattaaatattctctcctatctaatctctacacatgcttcagatagtccttaatgaataaaggcaactgaacaagcaacagacttatattgttcagaggaaagaaagatgttctttccttgcacaagaggaaggatggacaaaaactctcaaaactctctccttattcagacctcagtgaagtgcctctgagctctcttctcaactaggcctcaaccttgggcctcagtttctgcaagaatcctggtaaagtggtttagctataatcccccactcttttctctggacccaacacgtcaggctggaggggcactctttgccactggcctctggagatgccaaggcagcaggtcattggaatgagaggtagcccagctcattgaagcctgagtttcccttgagattccatcccctgcaggaggagccagaatagggtggataaaatcagattaacgcagatcacagggctgtgcctgctttgtggaattaaatactttctccagatctgtcactcccatttgcggggttaggaggaagagccgtggggagccctgggactcctcttttcccagactttgtactaactggttgtatgacttacaggcaggccctttaggcacagagtgttgggaaatatgatctcttagattcctccaaatcattctccctggggctttgtcgcccccctgctgccttcctcaccagcctcatcaaaggtttgtaccatttgttgttcctcagactcattccctgtggctctctcacctactgctccagctgggcccttgcatgatgtgaaaccacattttataaggtgcaaagtttctatagtcaaccagttggcaggagggaggcagttattacatttgtttcctccttctcctgcactttgctcaaaatgcctcttttaattttttttcttcccagtttttcagattttacttaaaatttgtttgattgtggctaagcatgatggctcacgcctgtaatcccagcactttgggaggccgaggcaggtggatcacttgaggtcaggaatttgagactagcctggctaacactgtgaaaccccgtctctactaaaaatacaaaaaaattagccgggcatggtggcgggcacctgtagtcccaactactcgggaggctgaggcaggagaatggcgtgaacctgggaggtggagcttgcagtgagctgagatcgtgccactgcactccagcctgggtgacagagtgagactccgtctcaaaacaaaaaacaaaaagaaaagaaaaaagaaataagtctgcaagtttctgtaggtggcaaggagatttctagaagaaaggaatcgagactctacttcctttcttttgggaggctcaatgttttagaactcatataataggtttcagttttaaaaagctgattgactacagttgttctttctctgccctaccaaaaccttgccaaaatgatagtaaagaataaaaatgggcacaaggacaagaagaacaggagagcaacagcagacaagacatttagatgagtttttggaggacaaatagcaaacgaagaagtggttgctgactcagtggacaggagcaaagtataacttaagggtctgtcataaaaaatttggcatgaagaggaacccagagaaatcatgagaggtttgggatttggaggctctgctgagaaaagggatgaggcgttggtctgaaaacaagagtcactggttgaaagtctgcatagagtgtgttgggatcccaggtcccctcctcatcccacatagccaggaagctgatacttgagtttgtccctgtgaaaatgatggctcagggtttgaaaaccctaaagaaaagccaatcagctaacagctctatgcacacactgcagagcttcctacaagacttttagtgcctcactcttaacatgaatagatagccaaggatatgacatatgaggaaagcttccaacataggagagacaaaatatccagaaaagaaaaaggaatgtggggggaaacagacaatatagggaacattagaaatgatattgcggccgggcacagtggctcatgcctgtaatcccagcactttgggaggacgaggtgggcagatcacagggtcaggagttcaagaccagcctggccaatatggtgaaaccctgtctctactaaaaatacaaaaaaattagccgggtgtggtggcatgctactcgggaggctgaggcaggagaatcacttgaacccagaaggcagaggttgcagtgaggcgagatcatgccactgcactccagcctgggcaacagaacaagactctctcaagaaaaaaaaaataaaaaggaaaaaagaaatgatattgcatcataaaacaagaacatgatactatgagaaagaactttaaaccagaaacagtctctggggaaaaaatacatgaaagtgatgtggtaaagcttagagaaaattcagtagattggaataagttagggatgatggaacatttggggggaaataacactgcagaaaagcacgcaaatgtgaaacataaattacaagccctggaaaaactaagggccatataagaattaaagcataatatagcccacttcttgattcaaccatgaaaaatatttgtatagccagaatgaaatatggactgtcaatttaaccaaacattgtgaaataactatatttggaagatgcaagagacaaaatgagaaggagcattagtatatgaaaactaagtccttatctaccatggtgggaggttagtagaaaatggctaaaaatgataggttaaacattagaaagaaaaatagaagcaaatactagaagagctagctaaaagttttgtggatagttgccccaggcaacagaactggagaatgggatggtggaaggcgtgggtaaaggctttggggttttcaatatgggccctgtagcgccatttgactttcaagttatgaacatctgctacttggatgaaaaattaattattgacaaaaagaacactgctaaggattaagacaggttgcttgaaatcaatgagtagcaataaaagattccataggcttcctacggcatacagtaagaactcaaaaagtgtgaacagctattattgtcatttaacaattagtggagaagccagcagactttgcaagatcattgcccgtccatgactggcctttgtctataaatggcaggatttctcatgtgtcagctgcagtatttagatttggttggagagctgggcagtgtggctcagctgaagtcaagagaaaccccgaacttggggaaaataactttgcggtgaagaacattagccaagtgatcaaagttagtgacccccgtgatatcatgtggctatcttctgaaagtttaagattattctaaattaaaaagtaaaaaaagtgatagagaaaaaaaggcaaaagctttgaacagacaatttacagaaatacaaagtggccaataaatatataaaaatatgcccagcacccccaataattagaggaatgcagcccttaaaaattatgaagtattggccaggtgcggtggctcatgcctgtaatcccagcactttgggaggccaaggcaggcggatcacctgaggtcaggagttcaagaccagcctgaccaacagagtgaagccctgtctctactaaaaatacaaaaattagctgggcatggtggcacctgcctgtaatcccagctacttgggaggctgaggcaggagaattgcttgaacccgggaggcggaggttgcagtgagccgagatcacgccattgcactccagcctgggcaacaagagtgaaactccatcttaaaaaaagaaaaagaaaaagaaaaaaattatgaggtatcactttagccccacctgaatagcaaaaagttgaagagaatgaaaacagctactagttaatgggaatattggggtgaagtttccccccagatactgtctttcttcataagtagaaatgtgatagtgcctcttttggagatcaactttgctctaccttttaaaatgaaaaaatctacgtactcttcccttcatgagtccctctccttggaatctatctgatagaagcaagagtccatgggcgtttaatgaccatagattcaatattattcatggcacccgtgttccaagtagccacccaaacccccaactaaaatccaaacaaaaggaaaacaagtacacaaacaaaaaccagaaaacgaccgggaactaagctaataaaagggttagatctgtttcagaagacttgaagagatttctagaatatgcttcttatttcttccctgcctccctggtttctagacaaggtggcttacaccaggtggttttcaggggttacctggaatgggaaggagagttggtgcagataaagagacatgcagaagggaagcaggaaggtaagacagcaaaagactgatttgggagatataaaaatatctcccaaaataaaaatatctcatttatgttaaatatgtgtatgtctaaaacttatgtatatgcaaaatattgtcaacaagtggctgatgggatcatctcagggtggtgggattttaaatggttttttattttaattaattaattatttcataaaattcagctcctgtgggaagatgaacttttaagttatttcctacacttttatacactgttcaaattgttccaaagagcaagtgttaattatataaactgaaacagcaataaagctgtttacacagtgaggaggaaaaaaaaaaacaacttatcaaggatcccttatccatgcacccacctggtgatttctttaaaacaaaattgtaaccagccatgtcctggagcagacacggtcctttattttactatgtgataaaggaggtagtgcttcttttgtaaattcgagctcttgctctgaggagggatccttgacattctgagaactgttaaatacgtatacatgcctcgtttctaaacctgaaatcatttaacagatttggttattgtctgctccattaattgtgctattctcccattgcagaccagtaagccagggctgaggggatctaaagctcctcccagcatcacacaactgagagctctcccagacacatcccctgggagctagtagatagactggaataaaaattttgagccttcacagtctcccaagccaatcttttcatcctactatagtgtaagcttccatgcaaagccaccctcccctccactgttctctggagcagagcaggtctacagggtcaggctgcctggctaggcccctctgtgaatgccccttgattagagaaccactattattctcctcctcatagtccatggaaaataaatacaggaaagtcagcaaactttcaagaatgatgatgctggctgttttcaggtcccagtcatccctgcagcctggccgtgccttctgtaagcctgtttcttcataagctctctgccagcaaaactcctgcaatagaaaaccatctggagaagagccaggcaaaggccttgatatcggtgttctgggcgctgggattgatcatgcagagaccagtgcagcacctaaacagggaccatttcctccagcctgcccacagctgctgccctcggggcttgctctgacacccaatttttaaaagcaggctcttagaataataaaaccagagaatctttgaatacagaaccattgactgttagaatcataaactattgagagaagaaccatgaaattctagaatcttggcgttggaagttacctcccaggtaaatgggttctgtctccccacctaagcaacaggtatttcttctgaggaaactgggtgcagcaatgatgtggccacaacaccttgtagatgtgggaagatgtccacggtggccacagtaagaagcctttttgtggtctctaccttctgaaatagtacatgacgcaagaaaatgtccatgcttgtcacgacaaaaactactattccctggaagtctgtggtacttttgaactctcttaaaactttaccctccttgaagaaggtttcaggagaaagaggaggccctggaaactcttgataatgccctcagcactgcttccaaggagcgccagtcatatagaccatccctgagagaaacaagagaaaacgggaaattctgacttctctctacttcagaactatgagctattttagttggcatttttgcccccatccaactttttttggcttcgctatctaaaacaaataaataaaacagctgatgctgtgaactgtaaagaatctgagctaatttggtcctcccctttctcccatccattgcagacttcggccatagcgcgtgagcattagaaaacaacttgtcgcccactcaactctctttctcattcctaaaggaaaatatttatattacgccacagaacgggtttccatgacagtgacgactgtaacactgttgccttagcaaccacttgagtccatcttgaatgatctgaatccccttcacagacaaataaggaaaatctgtcaaaagtgccattccgctggtgggaagtcctggaagacggttttctcgcgccctcgttctccctccaggtccgtccccccggtcccccagtacatctcccctaacgctcactcgggaactttccatatttgctactctttcaagagcttgccctcgcccttctcctagtgattagaccctaatccaccatggagacgctgcccagagctctgcaaagggttaaggactggcaggcagagccgtgccaaagacaacaagagacagaataaatacacagatcatcctttttatagggccttgctcttgcccctggagactgggtgcacgtttttctctatcagtccagagcaactctgaggggagagttttataggaaagaccagtcctccttgaggttcagctctcagtcacaacaagtgggcaggttgcctctcgggcctcagtttcctcatctgtacgataaaggggttgagtggagggtccttctggctcttacactctaggaatttgggggaatcaagaatgtatcatctggccgggcgcggtggctcacgcctgtaattccagccctttgggaggccgaggtggatggatcacttgagatcaggaattccagactagcctggccaacatggtgaaaccccgactctactaaaaatacaaaaattagcaaggcatggtggtggatgcctgtaatcccagctatgtgggcagctgaggcaggaggatcgcttgaacccgggaggcagaagttgagaggttgcagtgagctgagattgagccactgcactccagcctgggcaacaaagcaagattctgtctcaaaaaaaaaaaaaaaaaagaatgtatcatcttctttctcccaaagtcatcagatttcttgtagcatgcctacagagaactcagataggacatcaggacaagtgacatcctggagtgacatggagcacgccagcattcacagggaggtgcatcttcccccatcacacgtgtgggcacaggtgaaaagcaccgtcggcatcagcggcagtggtgctatcagcaccgtaagcacacactgcagaccaggccactccaactcaacatcttttactggagaaggtgctcctgcaggctgattaaatcaataaatgagccctctcagggaagcagcgacttttctcctggaggaaatgttttcaatgcaattcatatccatctctggagttttctttgcctctttccttattgaaaaacagcttgaaaagctagaaatgctgacctgttttctttcattcatcttcctgcttcttactgacagggagaaagctgttttaagagagaaaaagagcagtttaaatcgtttttataattttactagccggcaagaaaatcactttgctggatttgtatggagactaggagaaatggaacaaaacatgggtggagggccggggagaaaagaaaaagaagaagctggtgccactttaggaggaagctgaaatacctcttcaccaaagcccttcttggaaagtgtaatatctacaaaagtcacttcagaccttttcagacttctgacctaactgagaggcaggatggagtgcaggagtttagagtgggctttggagtcatacgaaagtgggaatgcactttgctcccacatcccgtcttgcctgctggccacagctgattagagtaggcaggagtagatccctgaccttaagacaaactaaacacggcctgacctgatctgacccaaaaggattggctgggtcagctggttttctttccttaggagcctgaataggaagtaaagaaagaattcagcctggcgcggtggctcatgcctgtaatcccagcactttgggaggctgagttgggtggatcacttgagctcagaggttcaagaccagcctgggcaacatggtgaaaccctgtctctacaaaaaatacaaaaaattaggtgagcatggtggtgtgtgcctgtagtcccagctacttgggaggctgaggtgggagtattccttgagcctgtgaggtcgaagctgcagtgagccaagaacgtgccactgcactccagcctgggtgacaatgtgagaccctgtctaaacaaaacaaaacgaaaataaagcaaaggaattccccagtcattggaggacaggtcaggtcaatagtgaaagaactgaaaaagcacaacactggtagtcatggaataagattcatctcatccagaccatatcgtgttctgcatttttgtgaatctgttaccaatctttaaactttgggatattttgcataaaaacccagctctttggcttctcttaaaaagccagaagctctgtaacacagagtcagcatgtcctggctgcaatcagctggagctagggcctgcagctgcccgcttttcctgggccatatgttctcccatccaccagcctccaccctgccttgttacgctcacactcagcttacctgcctgccccatgtaggcactggtgcatgcctgtgtaggtattggtgtgtgcaacccctaaattagagggaaggcccctagcaactgcttcctggaaactacaattgccttgaatacacagctggaattactgaggcaaactttaatatagtttctggtcccagatttcccagaggctccccttaatcttatatgtggagccttacaataaatcctctctaccaagctagcttgaatgggtctttatcccttgcaatagaacaagccccatgtatacaggggtaattattaaattacctccccttcttttcccagctctctcagaggctgcagtttttacaaggggctgctgtctgagaagtctaggggagactggctgatgattgggagatgcattcctaaggattagctgggcaccaggaaccaaggtcaggctcactttgccaggggagatacaggaatgagagctgactcagaggccaacagcttgtgaaaaataccaaagtaactccataggtacctacctgggattctttggagccaggtgtatgcaaggcacagactggtcctctggacatagtaagccaagggtggtgtccagtaggactttggggaagcttacccacatgagcaatcagaaccaacctcagccctagcctttggaggcctccagctggactgtaggaggagcccaaggcagctggagttctccaaaggacttgaggggctctggacagaggttattcatcaactagtatgaaagtatataaatgtgagccactggtatggtcccacctgtgactgcggggctttaactcaaagaataatcattctttaagtagtcatgatggataccgggcctcgtggtcaccaggttgctgtgagtgcagcattggtaccttaatgggttaatgccagcacagccctggaaatcttcctttgttatgtgcacagggatctccagaagcctggctttgcaaggatttgggttcagagatgtgtgtgagctccaggatattgcagtttcttatcactgactctcaggtactctggacatgagccatacatctcagtagacagtgaggtctttatcttgtctactagattcagactggggttattgtgtggatcaacacataagcaagatggaggaatagggttttccagtgcccatctacccacagaaacatcaatttgaacaactctccatgcgtaaaaatgccctcaaagggttaaggaaaccaagtgagagattatagcaagtgggttgtagcacagaagtaagaggtgtttaagagggtagggaggagagttttacatcatccaaattgcccctccccccagtccaggcagcagagggcagagagataccctctatgtcggggagggagagggaagtgaacacctgactttgccttggggcctaacactgggccctctcagtaaaactcagtaccaggcaggactccacagcccagcctccaggccaatacccatggactaagcctccaaaccagccctggtgccaggagggatcctgaagccccaggctccgggcctgcatagtggaatgtctctaggcccgtcccactgccaggctgaccccagtggccccagactttgggactacctagcaccaggccaaccaccacagactcaatatccagacgcagtggccctggactctggaccaccctcagcactaggctgcctcccacagccccaggcttcaggcctgccccagcaccaggttgaccccagagccctagtcatcaggtcttcacctatagacccagtctcaaggctggcctttgtgttcataagttcttatcatttagctctcacaagtgagaaaatttagtatttagttttctgttcctgtgttactttgctaaggataatagcctccagctccatccatgttcctgcaaaagataggatctcattcttttttatggctgcatagtattccatggtgtatgtataccacattttctttatccaatctgatattgatgggcatttagattgattccatgtctttgccgttgtgaatagtgctgcagtgaacatttgcatgcatgtgtctttatggtcgaatgatatatattcctctgggtatatacccagtaatgggattgctgggaggaatggtagttttacttttagctctttgaggaatcaccatactagtttccacaatagttgaactaaattacactgtcaccaataatatataaatgttcccttttctctacaacctcaccagcatctgttattttttgactttttaatgatacccattctgactggtataagatggtatctcattgtgggcttgatttgtgttgttctagtgattagttatattgagcttttttcatatgatttttggctacatgtatgtattcttttgagaagtgtctgtttatgtcctttgcccactttttagtggggttggttgttttcctctggtaaatttgtttaaattccttatagatgctggatattagacctttgtcagatgcatagtttgcaaatttttctcccattctgtaggttgtctgtttactctgttgatattttcatttgctgtgcagaagcttttaagtttaattagatcccacttgtcaatttttgcttttgttgtgattgcttttggtgtctttgttatgaaatctttgcctattcctatgttgaggatggtattgcctaggttgtcttccagggtttttatagttttgggttttacacttaagtctttaatccatcttgagttgatttttctgtatggtatgaggaaggggtccaggttcagtcttctgcatatagctagccagttatctcagcaccacttattgaatagggagtcttttccccattgtttgtttttgtcagctttgtcaaagatcagatagtcgtagatgtggggccttatttctgagctttctattctgttccatgggtctgtgtgcctgtttttgtgccagtaccatgctgttttggttactgtagccttgtagtatagtttgaagttgggtaacatgatgccaccagctttgttctttttgcttaggattgccttgggtatttgggctcttttttggttccatatgaatttttaaatagatttttctagttatgtgaatcatgtcattggtagtctgataggaataatatggaatctataaattgctttgggcagtataatcattttaatgatattgattcttcctatccatgagcagggggtgtttttccatttgtttgtgtcttttctgatttctttgagcagtgttttgtaattctctttttttttttttttttttttttttgggacagagtcttgctctgtcacccaggttggagtacagtggcacgatctcggctcactgcaacctctgcctcctgggttcaagcagttctgcctcagcctcctgagtagctgggactacaggagtgtggcaccatgcccggctaacttttgtatttttagtagagatgagatttcaccatgttagccaggctgatgtcaaactcctgacctcaggtaatccgcctgccttggcctcccaaagtgctgggattacaggcatgagccaccacacctggtctgtaattctcattgtaaagatctttcacctccctggttatctgtattcccagatattttattctttttgtgacaattgtgaatgggattgcctttctgatttggctctcggtttggctgttgttggtgtataggaatgctagtgatttttgtacattgattttgtatcctacaattttgctgaagttgtttatcagctgaaggagcttttgggccgagactatggggttttttagttacagaatcacgtcatctgcaaacaaagataatttggcttcctcttttctatttggatgtgatttatttctttctcttgcctaattgctctggctaggacttccaatactatgttgaatagaagtggtgagacagggcatccttgtcttgtgctggttttcaaggggaatgcttccagcttttgtccattaagtataatgttggctgtgggtttgtcatagatggctcttattattttgaggtatgttcctttaatacctagtttattgagagtttttttaacttgaagcagtgttgaattttatcaaaagacttttctgtgtcactgaaataatcatgtggtttttgtctttagttctgtttatatgatgaatcacatttatgttgaaccaaccttgcatcctggggatgaagcctacttgatcacggtggattagctttttgatgtgctgctgaattcagtttgcaagtattttgttgaggatttttgcatctatgttcatcaaggatattggcctgaagatttctttttttgttgtgtctctgccaggttttggtatcaagatgatgctggcctcatagaatgaattgaggagtccctcctcatctattttttggaatagtttctgtaggaatggtactagctcttctttgtacatctggtagaattttcttgtgaatctatcaagtccctggctttcttgggttggtagcctatttattactgattcaattttagagctcatcattgatctgtttagggaatgagtttcctcctggcttagtcttgggagggtatacgtgtccaggaatttatccatctctgctaggttttctagtttgtgtgcatagtagtttctgatggttgtttgtatttctgtggggtcagtagtaacgttccctttgtcatttctaatagtgtttatttcaatcttttctcttcttaattagcctagctagtggcctatttattttattatttttttcaaaaaaacaactcctgggttcattgatcttttgaatggcttttcgtatctcaatttccttcagtccagctctgatttttgttatttctcatcttctgctagctttggggttgatttgttcttgcttctctaattctttcagttgtgaagttaggttgctaatttgagatctttctaactttttgatgtgggcaacttttaatgggcatagggattaccttggggccattttaaaatgtggattcctgaacactcccctggagattctaagctgaaaccgacatgacccctaggccagtgaaaagcacgaggaagaggacagagtaccgggagagtccctgaaagacttggaatctggagcttgctgggtgaacaaattgtgtgatttggacaaattccttcacttccctcttgttatataaggaagttggatgggataaccccagcgaaccctccagttctgacatcccagggttgtgccatttgacaagttccaaatactcagaacccttggtttggctgagaatacagatgcaaagtgtctgagggcattggccacatttacaccccctagcacagggttcactagacaatattctctcctgcagaagggcatggagatgagtccctggcccagtcagaacacctcatgccaactggtgcttttccaacatgtatgcccttcccagaggctctgagaacagagtgcagtctaggggcctgtctaaatgggttgggctcttcagactgaagtgccatatttcttctttctcccattggcatgccttatttctgaggatgctcatttatacacctgggagaggatcagcccatagatataaaatacaggatttttcaagggatgagaaaagacagggtcctgaggaaatcagctctgggctggagaggtggagcatttctctctttcccctctgagcctcaaggcaccatggagaggagaaaggctttggggtcagattgaattccaatcctgactctgccacttactactgggggtaatccaagtaacttaactgctctgagtctctgtgttttcacatctgaaaaaaatgaagtggcaataatcaagtttatctgcagggttgcagtgagaattaaatctgattacatacataaaggtggctggcacttagaagggactcagtaatcctcacccctcacttcaccgcctcgagctctttcttgctgccatcctttgcctgggggagggtgtctgtacctagtccctgcaggcttaggagtcatcaagatagaacaggggttgggggaggactccttccttctttagtattattgaaggatattcaaaagaaacatttacaccaaaagtgactctgaggaaacaaagggaaatgaacaaagcaaatataaatccataaaatgaaatgcagattacagcttctacaagagcctctgataaactccccacagtggccagaaacaatggggccaactggagctgggagcctgttcccagctgaaaattgaagccctgtctctgcagtggagcctcctctgcctctggattgttttctcagcctaaggaaggtgggaggtgccgagagttggaggcacagagagcactccaacttgtccgtcagctttgcagctcctctgtggctcctgcccaatgcacattccccccttcagtcatctctaccccactgaggtcctctacaaagaataaaaccacagccctgcctttgcagagctgcacgaggctgcacagagcctgtcaccactctgggctcagaggagacttgctcctacttgggtgggtgttggacaaatagcaggagttaagaggctaccactgctgtcttttctgcatctgagccaggtcctacagcatgggcttctggggatgtcaaagtgttatcagaaagggatcctgatccagaccccaagaaatagttcttggatctttcttgtacaagaaagaattcgggggaagtctacagagtaaagtgaaagcaaggttattagacaagtaaagaaacaaaagaatggctactccatagtcagagcagccttgaggactgctgagtggctctttctatggttatttcttgatcgtatgctaagtaaggggtggatcattcatgagtttcccggcgaaaggggaaaggagttcccagaactgaggattcctcttccttttagatcatataaagtaattgctggacattgccgtggcatttataaactgtcatggcacaggtgggagtgaatcttagtatgctgatgcattataattagtgtataatgagcagtgaggatgatcagaggtcacttttgtcactatcttggttttggtagcttttggctggcttctttactgtatcctgctttatcagcagggtgtttgtgacctgcagcttgtgccaacctcttgtctcatctgtgactaaggatgcttaccctcctggggctgcagcccagcaggtcccagccttattttacccagcacttattcaagatgagttgctctggttcgaatgtctttgacaaagggacagagaacaaaattagtgggatccaatcctggaatctcacagctcacagcctaccacccatactcagccctgggagaagtggggggcttggaaggaaagcactgaacagctggtatgtcaagggagggccaaatcaaacaatagccattgcctgagcttgggacaaccaaactgagccctgacccttagctccctaggactggaggaagagtgagaccctcaatatctaaaaacttccagagcagacaagcaggagtaacaccacaatgcaggctgcctttactgacacagtaaaggttaataaaccctcctgggctgaggcctgaggagggtggccaggatctgctcaaggatctggaaaaattgccagttaatgatttaagaagctgagggtgcttagtagggaaagaaaagctttaaggacacctggatttatagatgtgagggttcatctgcggaaaaggaatttgccataattaggggatgcgtttaggcagaactagagtcagagggtagaagtcacaggaagaatttccatcactgggagtggccagccatggagcaagcacgggattgaggtctttagaaggatgacctgtttggatttgaaacaacaatgccccaagtgagatatgttggtggatgttttaccggttatggagccaacaagggacccagtgagccctcttcaatattttgagcaggctaatgatgcatagggatggtttaaacacatatgtgtaggctttccaaacagaacacaaaaaccatcggctcagcgagtcaccatgcagatccctcccccatgaacagcgccaactctgggttttcagagcttgccaaaatggctgtagctctcagcttataggtatctctggtcaatgcctgataatctgatgcactgcctggacactccctgggcctgggaacatgctaccggatcacaagaagtgcaatcatgccccagtcaatggggacacagcctgactcgaccagaaggaacggatggtgggtcctaacaccatggcagatcttccttcttttttttttttttttttgagatggagtcttgctctgtcaccaggctggagtgcagtggcacaatctcagctcactgcaacctccacctcccaggttcaagtgattcttctgcctcagcctcccgagtagctgggactacaggtgcctgccaccatgcctggctaatttttgtatttttagtagctatggggtttcaccatattggccaggcttgtctcgaactccagacctcgtgatccacccgcctcggcctcccaaagtgctgggattacaggtgtgagccactgcgcccagcctccttccttttttgagtcaggctctagttcagtgggcccagctgcttgtgcaacccaccctcatcctgtctggattcatactgtttattgtcccctgttggaaagcctaataatgtacaaatagaagggagtcccacaaagcaaccagtctaaatggctgctactgcccgcttcctcatcattgctttctcttggctcttggctggggcttgctctcttatccttcagaaaattagccctgaactcaacccccagaactgttgtatctttccataatcccaaacgaaaacgtctcctatcaggttggattttagaccagatatagggagaaagacgctgtttctacatcagaaacaacaactaataggaagaactaaccatttatcatactcagaggtctacatccttatctcattcatccctcgcaacaatgcttttatgggaaatattcctctggccctttgtagcaggatatgaaacttccatttgttttgtaagacacctcaatttgtgtgcaccttttctttgctccattgaacgttatcatctggctttccccaggatgagatcaaacattttctgaaccctccagagaggagagataagatagctatcctctgtgaatactaactctttgtgccttcaaagatgaaagattctgatgtttttcttttattaaataattacgaattatttgagctccagtttttatggacggggttttgtgtgtgtgtgtgtgtgtgtgtgtgtgtgtgtgtgtgtattttcactttggctatccagcattcttttcttaattgaaaatatcctagggccggacatggtggctcacaactgtaatcccagcactctgggaggccgaggtgggcggatcacctgaggtcaggagttcgagaccagcctggccaacatggtgaaaccccatctctactaaaaatacaaaaaaaattagctgggcatggtggcacatgcctgtaattccagctatggggggaggctgaggcaggagaatcacttgaacctgggaggcagaggttgcagtgagctgaaattgcaccactgcactccagcctgggcgacagagcaagactccatctcaaaaaaataaaaataaaaataagtaaataacatcctagtttccttttaggaaatcctctcccccattgttttcagactggtgtatgacagattggtgtgtcttgcccccaaataacagaagcagaagggttactgtgggctcctttcatcggattccttctctctcatcccagtacagccatgtgggcatgtgacctaagcccaactaataatattctcccctgggactttgaatgttgagcagagtaacacaaagatgccaagaggggagaagcaacaccctgtcaagtacatcctgtcctgatttcttcctgtttccaagcagtcttccagacttcccagcacttccatgaactctctgataactttctaataaatttcctcttctgcatagatcatgttttaggacttggccaaaaccaaggacgacttccttccctggcattctttgaattatttagaaataagcaacaagatagaagagtcaagtcaccaagagatcaaaaagtcaaaggacttttctgctatctcccttattctccctcaagacatggctgcttaatgacgggctaagagaagaacttcctctatgtattcaagtaagtgctgaggaatcagatcagacagcttgcaatccatcctcattattcccatgagtggtaccttcatattgcttgcaatagccctaagtatgtttcctatgcagccttgaggtgagacagagtttcactccacatgcccatgatccacaacccggggtcatgctgtgaatcagtgctctgctctgctctcactcagcctcatctatgaggatacccttatggggctctcagaacaacaggaagaccagaaaaggcatgtaccccaaggggtggtgtagaagctcttgtgctgaggctcagttgctgaactgaaccctctggagaggcaagagcagagccagtgggaccgtggagccccctgactcatagctaagtgcataagcacaggttgagggtcgcatgactcaccatgttcaacagaaaatgaggttttagacaactcaagacccatggggtgatatgactcccaataagctcagtcaatctggagagtcattttgatgatgtttggaatactggggccagctctgtgcccccaccaaggcacttcaacaccaggagatagagggaaatcagaaacaaagaaagagaagattcagatggagaggaagagtcaagtgggcagctagctgaagcactaacacatctaagagggactagaatctttctgcatcatagggcaaaactgaaaccgatgggtagaagttctagggcagcagatttggatcagactaaggaaaatctttttttttttttttttgagatggagtctcgctcttttgcccaggctggactacagtggcgctatctcggctcactgcaagctctgcctcccgggttcatgccattctcctgcctcagcctcccaagtagctgggactacaggtgcccgccaccacgcccggctaatttttttttgtatttttagtagagacagggtttcaccgtgttaaccaggatggtctcgatcttctgacctcgtgatccacccgcctcagcctcccaaagtgctgggattacaggcgtgagccaccgcgcctggccaggaaaatcttttaaaccaagcagtatagcagcgacgtaggctacttctcggaggctgacagaatagtggacaagagtcttgcgttaggaggcagcaaccatggacaagtcccagccctactgtataacagtcacatgacctttgtaagttaccgagtctttctgttctcatttgtaaagggaaggaaataatagtacccacctctgagggtatttgtgagggttaatattgctgtactatggcactgaccaattgccatagaagtgtggagaaaaaacattttccaactggaagcggtcctagaaaggctcaatatagcttcattgaatagtgcctgatatatacatatactgatcatcaaagtgctagatattaaggaggattatgcttgtgaagtgatcagcacctcattgctggaaaaggttaaaccatggctgcaagacaaatgtcagggatgttagaggccattcccacactgagtgggagatgggaccacaccatggctcagagaacaaagcaagagctttggtggtagacagctctggtcacatcgtgcagctaccactggcacactgggcaaaccacaagatctctaggtctcagttttcatatccataaataaggctgatatgtctcactccacagcacagccacaaggatgaaataattatgtatacagatgtgttatattatttgcacttgttttgtatttttaaaacccccaaatacaataataaaaggcaattatagaatgatcacctatgtttggtccctggcacctaaaggggtagcatgtgtatgatgatcattctctgcccttcgccctgaatgccctgcagttccccggacaccggagctggtcctaggctgccttctggtgggactttttgtcctttcacagtggctgccctctccttccaggccgctttgtgtgactcaccgttctttgcaattaactgtgatgttctgctggaggcttccattagaaacgacgagaacagctactttggcctaaacagagtgtggtgggcttgattgtttcacctcacgatttattgctaaagagacagaagatgggcccctgggcaggtcatggctggcctgagtccttcccgctgcacaagtttgtcctgtgatctgggtccccatggcatattcagtcctgagggccaggcctgcacactcacacaggctcagtggcacctggctagacagcaggagccaggaagcgaggctggttcgaggaggttggcaaggagagaaatatggtttcttctctgggagtttgaatcccatttaattcaggaagctttaattgaacacctactctgtgccaggcacactgggggatcagatgtgaattaaagcaatcctcactccctagaaacttagaatttaacagagatgaaggcaaatctatgaccagtcctgagcctctagtatgccactgagcaattatcatagaaatatagagaaggatgagattttgcaaccagagggggccctagaaaggcttcacacagctgccatttgttgagtacctactatgtgtaggatactccccttgtttaatctatacaactctgtgaggaatgggattattgtcacccctatgttgcaaatgaagaaactgaggttctgaaaggttaaataacttgctcagaagtcacatagccagtaagaggtacaaccaggacaagattctgagtctgaaacatgtgctttttcaagaaggccaggctacctacttcttagaggaggctgaatttgtcctgggcctgaaataaggctgatattttgtcacacagctctgagtggggagggccttccttctgcttctgcttctaggcaggtacaaaccgcctgttctgagacacagctaatgtcctttcatcttcttcccacaggggaccaataaagcctgagagtaggcttgggaggggccacattcctcccaggaggggctagttcctctctccagcctctgtctgtgattcagccctaaatacataacctaaatacgtaactgtcaattcaaataatacctgcccactggaaccaacaacctggattcatttcacacctgctgggagccattagtggcacaaacacattctttacatcacccaaggcaagtttgttcgcagtcatagcagtttagactacagcgctggaaggcaatggagtgcttagagacaaccaggttcgagtacctcttctcacagatccacactgaggtacagagaagggaaggggctggcctgaaggcttcgaggagagacataagaaaggacaccatcttctccgtgctccacacctgttgggaggagcaggatgaagattcactgagcactatttctgagtctgcaggtatttgcccttagtgttgtgctatctcattcatcctcatcatagctctgattcgaggtccctgcacaccctttccagatgggaagcctgataagctgaggggtcctgggaggtgtcccaggtcacatgagaagaagcacagccaaggtgggagcacacacctgctggctccaaaatcccaccatggaatgaaaggaggcagttgttcccctctctctttgaacttgcaaaatggggttgggttgagtttggacccagggggtctatgacacagtttctccagctcggaggggcccagccctggcctttcccatggtgtgtcttctgagctgcgtgaaataatgtccagccctgggcaggcatgaagtgacatgcagaggctgtggaaagtgtatctacatttcgtgctttgttcctaaatgactcatgcagcccacagaacaaaattaatgtcttgtccagcaccagcaaattgcatttctttctttgaaaaatcagtcaggctgcaaagggccctggtttattctggggacatggagccatcctgtggctgcttccactggacaggctggaaacagcaatcaggcccctcggaagggccccttccagaggtggtctaagccttgtgctctgctccggccagaccctctgctcctgccagtgacaggttgttacacccttgtctcctctgaaccgatgttccacatatgatcaagtgctttccaagcccccgtaccactcccctcacacggcccctctcccctgcaggtggcagacttactcattctcatgcttcagctccaggggttcccctgtatgagtcttctctgcccgctcccacaccccaggtagcattgcccctgcttgctttgtgccctcactgtctccacatatatacacatctcttacaataatattaaataccagccaacatttatatagtacttcttatgtaccaagtactgttgtctatctatctatcatctatctatctatctatgtacacacacactcatattatcttcacaatgctatgaaataggtattattgctgtccattttacagatggggaaaccaatctataattggtttagtgagatttactgagcatatctacaggtatttgtccttggttataggaaaccaatctgtcactggtttccccttctgtaaaataagttaaataatttgcttaagctcactcagatagtgtgtggttgagtcataatctgagctactctctggcccaaactgcttattgtaaccaccacatcatatggccacttcagcaccagtcacacctcattttacttgttgatgtctcagttttcccctctattctgcgggctacttgagaagacttctgtcttcttcctctaggtatctctgtgcttgactcagtatcgagaccataggtgtgtgggtggggttaatccacacttgctgaacacatgtgtccgtgcccaatgtccctgtgcatagtggctacttcccatggttcacacgcatcttcatggctcttgtttcttccattcacccatcccatgtccctggccctgttctcagtgctgaggatggaacctcattgctgctgcttccagccctggccctgcccctgtttggggctcagtgcttcatcccgtggagctcaaggggtgctgtgggtactgacaaacttgtaccccattcctagttcaaatttttctttgcctttcaaaggcacttggtgtgtgttcatacattcaactaataatgtttggatatccaccacacatcaggcactgttctaggtgctgaaaacacagtgcggggacaagaacaaggtcccaccatcgtggtgtcacattctgcttggggagacagacagtaagccatcagcagctgagtagtaatacagtgccacgtggtggtcagcaccgtgaagaagaaagccagataatggcagagagtaagggggtggtcagggagggttgtctctgaggatgtgatatttcagcagagaccagatgaagagagggagagagggaggctgatatctgggggaagagtgttccctggcagagggaacagcaagagccaaggctctacagtggctcatatggggagagattgagaaagcgtgaagcccactaatgcaggcgcagagtgagacaggacaatacagtagcagagcctggaagtcctcagggggcatggagagcctttgcaattttattcccaatgtgttagaaacatctcagaggggcttgtgcaaggggccggcacaatctgtgccatgttttaaaaacttgaaagcatgagtttatgtatgtgctgtccccctcagttacgagatcaatagtggcgtttttagtgatgttttcttaggagttctttctgttgccactgctatttctcaacacccccctctctccaaagcccacattgtttctctcatggactcaactggcttcaactagaacttacagtctaataagagacacaaccaagtaaacattggactgctggtgatatgaactgtgatagggcggctttggggactgtggaagcacagaaaaggagctgctcagacacagaaagccagggatggcttctggaggccagggcatctgacatgagtcctgaagggtgaggtcagccgcatgagaatgctctaggcaggggaaaccacgcatgtgaactgagaaaccgtgacgctgctgtcacagtggccttgcctgggtccttagttccctcacccccatatccttcagtccccacctaggcaactccagtgctagccaggctgggtaaatcctcttccactgctgaacactgctgtagaaatttgccatccctggttccaacacaaactcacactctaatcccagctggatctttggccattcggtactccttctttccatgataattaactgcctgccacattcccagcagcacgtattccaggcttctattttcttcccacctaccccactcactgagggtgacctgacctcctattatgatgtgcctcccactcctcctcccactgtgatctccacctcaaagaatgtttgtcttcaaccccatctccttcaaacgatctcagaaagagatacgattattctttttgagattaaccccttggaaaaaaaattgagcatttattttgccttgcctggattgtattgcagggtaagcaaaaagcccaggttgataagggaaagttctttttcataaaagcttaaaaatttgaatagagtgcagaagtagaaagtcatctttttgcaatcccatttggtttaggcaaaaatcataagcagatgaaacaatcagacggtttattaatgggggactttccatggagagataaagctgccacaagctgatcctgctgctcagttttatcacgatcgctaacaatggcatcaacaatgctatgggtttgccgatgagatgaaatatacaatgggtggcactttgcctgcacattggaattgtctggggagctttaactactgatgtctgggatccatttccactgattatgattttaaatgcctgggatgtagcctgggcatagagatggttaaaaactgcctccagctgattccaatgagatgccaaggttgagaccactgccaaatgaagtacaaggcttcagtgtgaactgtgctagctcccgcaagagttgagtctcatcaagcctttcaagttcatctgtagctgaaaatattttggggcatagggaaacaagttaagggacaatgtgaggaagacaaatccagagtgtagctcgttctgtccagcaatggactcactgtattttttcaataatccaatacctttaaaaaggggaggagggacagttacaaattaagagattcaaagatataagaaccaaatgcaggattttggatctcgaatggaaccaatcatttttatacaactggggaaccttgattatgaactggatattagatgctaccaaagagttaatgctaatttattaggtatgtaatgacatagtgtttatgtaagaagtgttttttaaatccatggttttttaggtgtaaaggggcagaataataggggggctaggatttactttaaaacatttcaacaacaacaaaatgaagcaagtgtgacaaaattttaggaattactaaatctgaatgatgagcatatgcgtgttcattatttgagtttttcatttttataataaaataaaacaagtgaagccctctgcatttctagtgtgagatatcattagtactagtattattacatctgttccctcacttcatgattgccgccgtaatcagcagcagcaatagcaccagtcaggtgtgattgggactgtgctggtgctgtaattcccctgcaatccagtagggtggatgttgttatccttgctgtacagatgagaaaactgaagttcagagggattaggtcacttgttcaacattgcctggctagtaaggggcaatcaggattagaaggcagatgtaagagcctctgatcttcatcactatgctctgctattgtcttccctctttctccttggctcatctcctgtctctccctctccaccatctccttcctctaggctccttcctcctgcaagaacattcccttccacccaccccttctgtggcacagtcatttctttcttctcttccctcccccacactgctgggaacagtcatctacacttacctgccttctcatcctcacacccattcatttcttagtttcccatactctgacttctactaccccaagttcataaagacctcatgaacacaacctggagaacgccctcagcctcatctcacctccctgcaacacatggctcacttgtctgcttcttccttcttagagtcctctctctggttgacctgtcaaagatgggattctcctgttaacgaccctgactcctttgtctccttctacaaagataatgcactgactttccaaatgtactaactagtatgatcatcactgtctactgttgcatcgaaccactactaacctcaatagggaaggcaccaggttcaagaggccaaagaagagacccagagccagcaaatgagacatggggttttatgaggggctcacatagaggggagagagtccagtggcagtgggctgggcaggagaaccaccttacacgtggtccagtggtgggaggctggaaaagagatctgtcttgcctacagttcagtggtggcgggttgggcaggaaaaccacaactgcctgcaaacatcatgcagtttacataacattgtcacttagcagcctcccctaacgacctccacctggcaatcttcatttaacccaaaactcaaggcctcaatcccctgtatggaccatgtttcatgggacaggccaggggctcagaagtttatcatagataaggaatgaatctccgggttggccactcctggattccctagcttggaacacacattcaagtgtatctgccattctgagtgtattcttcaattattgctgtcaggtgtgttgaccctctatctacataagtatttctcaaaccagggccctacgatcagcatcagcatcacctggggtatatgtgaaaaatgcagctcctggacccactcctaaccttttgaatcagactctcaaagttaggtatgcatttttaataaattctccaggagattcttctgttcctagagtaacagtgctttcccggtagcccagcctttccaaggcctccacctgccactggcaggctgatgactctgaatgctgcagattcattacagtcttcaggcttctctcttgaaacccagtctcctgttctactccgtcctcctcattccccacatatgatccattgctccaccctgttaactttgtttctgggccattccttgtatccaccatctctcattgtcccattgggccccactgccctgcccttggtgaaattctcaccctccctcacctggtctgttgtcttagttttctgagaggtccctttgtccccagactcccccatctaccaactgtcctccatatccctgcaagcatgtgctacagcgcttgtctaattatatggatttcccaaccctgcaacatgcagtggtcccctacggcctgttgaggaaaatccacattcctccatggccccacccccacctacctgcacaatcttatcttccctttagatttaaaatgatcaagactaatactgctttttattctccacacacatcagtgctttgctcatgaggtctctcttttttttctttttcttttttagatagagtcttgctctattgcccaagctggagtgcagtggcatgatctcggcttactgcaacctctgcctcctgggttcaagtgattctcctgcctcagcctcccaagtagctgagattacaggcacctgccaccatgcctggctaattttttttttatttttagtagagagagggttttgtgattttggccaggctggtatcaaactcctgacctcaaatgatccacactccttgcccttccaaagtgctgggattacaggcgtgagccactgtgtccagccaaggtctcttctgccaagtatgtttttctcctcctaccttagatgtgaaaatattttccattggtggcagctaggctccagcaagcctccccagagaaccctgttttgtggtcatggtgccatcatggaatcccctcccatttgaatctagctccaccaatagcatgcagtggaagtgatattgcgtaactgcccaggatggatcataaaaagactcacagcttctcccttggcctctcagagtgcatgctctgagggaagttaactactatgcaagaagcttgactaccctgaatttgtcatgctgtgaggaagcccagttagccaagtggaggggggctatgtagcgagagatactctgccagccaacactgctccagccatcccagaggaagtgccagacatggcagtggcaaagccattttggatgcccagcccagctgagcgtttggatgactccagccccagctgtaacctgactgcaactcggtgggaaacctggaatgagaatcaccagttatcccacagaactatgagagggtataatgaatcactgttttaagccaccatgtttgggagtggtttgtgacacaaggatagatttctggaacagcttccttctaaggacaggtcaaatactccctccacagtgaagggatccccgagcccttgggtggaatgaattgctgtcttccctgtagccttcacagctcttgatgcctggcagagactcactgggctgactcacaacagttgggaagggcgaggatttttgtcttgctcatctatgtagctctggtgccaatcacggtttgtggcacggagtagatgctcagacaatgtgtactaaatttaattgattttctttcctttctctagtctctcaaggcagataggcagccacaagacccaacagagataatcaaggaaacctcagagtgcctagaattgactagtgaggctgaatgtgccaaatcagtgctggaaaagctttccataagagaggaaagaaaaacctttgagccaatgttaaaaaagctgaaccaaagagggatggaggaggttggaagtgaccatcactctttgctcatcaatagcagttcagtgtttgtggacctggtgcctcctggcgaggagcatacttcccaactccctggacagctcccataggtcctgggctggaggattctagtccatcagggtggcccagagatatccgccacaggctgccttagatggatgctacaaacacttagtttaccagatagtgccagcccaagtcttttaattattgctgagtctcagcatcagaaagccaccacaagtgcctcttgtggaccagaaataaatcttccatgtcattatcccctcttttaaagcactctccaggtctcgctctaatcacctccattcccttctcattaaacaaccctcccatcattctcatattctgccaaataattttaagtgtgttttatgcaactgcagctgtcacactatacagatgacaaaagtctctactttgttataggagaagagtctaatcaatgtgcctttatcctaagtgtgactgtggtgaggctctttctaaggagttggcctgtgagacaagtcgttctccatcctggatgcataataggatcctgcaaagctttgaaaataaaacctatgtctgttcttagcccacatgattaaatcagaatccctgggcacagggtctagacatcaatagcttttcaaaagctccccaggtgattcccatgtgcaccagagctgagaaccattgttccgcagaacatgaacgttagtgatgtctgtggttccaggcaaacccaaacagtttcctgccctgtcccgtttcttatccatttttcttacaaaaagctacaaattagctttttgtaaaacatgcctggccttccaggacgggagggacacgagacagacatgaagctgttgccagccaagtcttaactaaattcaggttcagtcatattacacgggttcagttctgtttctttaaacattgcaacaatgggatatagtgttttgtgacaactctgaaaaccatagcatgaaaaaatatcaaactattaaatgaaatagcagaatttcctctcctctgtgattgcagctgcataaaaatatacatttaaaaagcctaaaaatgaaagcacaaaatgatcctaatttgggtattggatgattttttttcttctttcaaaacgtcttttgtgttgatcgttatacttttaaaacaaacaaacaaacaaaaaaacaaaaaaagcaaattaatgtctgaatacttgaatttatacagagaatgactttcacacagaccaagaggaaaacaggttactgtgcaacctatacaaacgctttcccctctctgggcctcagtttcctggcctgcagtttgcaccagaagagctgcaaggcctcttgcagccccacactctgattcctggctcacatgacaccacttttatgagactagttatgcaaatgttatccagtacgtttctcttggtgaggagtcagggccaagcaagctctgagacaagctgtctcacctcctcatctcctgagcacaactcacccacagctctgccctcgcctccacctacatcatgccttcctgcatgccaacttccctctgaggttcccttcacccacttacaaccacagcctccttccggacctcccctacacgatgaacagtctgccagttaatatacatcaagctgccaccatgaaacagctcggaaagccccatttgttctcaatagcattccagctagaaagaccatccaccacccatggccactgaagaaggtcctcccctgagtgccaggcagtggggctcctaactctgggccccaattagcttagcttgggggagcaaaggacaggagcactgttcacccagttggactaacagctccacactgtgcctaataggaacctccttctcacaggtggcacctttgtgaatcagggtctgtcctgagccaccctcccttggagagatctgagcactgagaaccacagagcctgggacaccagcacagggtttgaaaaactccactcccagtcagctgcggtggctcatgcctgtaatcccagcactttgggaggctgaggtgggtggatcacaaggtcaggagttcgagacagcttgaccagcatggtaaaaccccatctctactaaaagtacaaaaattagccaggcatggtgttgggcacctataatcccagctactcgggaggctgaggcaggggaattgtttgaacctgggagctggaggttgcagtgagccgagatcgcaccactgcactccagcctgggcggctgagcgagattctgtctcaaaaaaatgggaaaaacatcattcccatgtgtgtcctggttgcttgtctctttcaaagtactgcatactaaatgcta

SEQ ID NO: 551 - DNA, 20001 bp, Homo sapiens
atgcctggatctcagactcctggcctccagaactgtgagagaatacctttctgatgttgaagccaccaaggctgtgggactttgttacagtggcctcaggatacataaaaagtcttgcattcaaatctcgggccgggtactttgatttaaatcggggtggacaatggaaccgaggtcccaaacctgaattccctgggtcattctctcgaccacctcttttggtctgcgaagctccgaaaagaagttttgctcccgagggaaaggccacgatgcagtagaagcgacactcactggtgagtcctggttcaggcttaccccatgccctggagttctgatctggggaatttgaggctgctgtcttagcggcccccagtgacatgaggggtggcgcagactgtgtctcacagggcattaagcaaagttcttaataagggccttttatggagcagtgggaatgagacctgccaggcttggctgggagtctatcaggccctcaacatgggctgtggtggcagcagccacctcatagtgtcgtgtacagccatctattaccatgtagggttcaggcattgctggctcagcccggacatccccgcactcctcggctggggcagcagcacggttggtgaccaggcctggctgcaggtcctgaagggagaagggcctggcttcgtcccagctcacccttgctgactgtgctgctcctgtcaagttccttcaggtcagtttcctgcagctgccacacaaagcaccacagacccggggtcttgaacaacaggaatttattttcctgcagttttggaagccagaagccccaagtcgaggtgacggcaaggttggtccctgtggagggctgcgaggaaggcctcattcctggcttgcgcttctccttcttggcctgcagctcctgtccggcggcccctcctatagcaacagattgccctgttttccaggaacaggcccctccctttgccccttcaggcctagaagtggtgtcgtctcctcctgctgacctggagagcttcatctgcccctgaggcttcctggaagccagcccacgtgggtgcaaaagtccatcccgtgaaccgtctccattgcccctctgagtgaggcacacaggcagccttgcaggtttttcctgaatgcacaatgattctggaattacccagtgcccagcttggtgcttggcttagaaagtgtgcagccagtgttccctgaatcaaattcaagattttcaaagggcctgaggtcctttggatgaaagcatttaaaaagtgcaaaggtgtgtgattatgcacacatcattcatctggggagtcttggaattgcagctggcaggagctccctggctttctggagtcttgtttgttttctgtaatgagagcaaatgccctctcgtggcctggcctgagtttcctttaccggcgcttttctatatgatcaacattacatgagtagggttggggcaaatctacctgaggataaaaatgcctggaagcccaagggaaaagagcaagtctgggtttggcttcccagaatgttgcagggtcggggtggattgcaggcagccactcctggcactggcctagaaggtgacacttcttggagagaagaggaatgaggtagtgatggaggctgcgaaggcacagaatcactcaccaatgtgccaggtgaacagccccagagaccctttctgaaggctactgggggcgagcctctccctgcctcaagaacccgctgtggctccccactgcctgtagagtaaggcctgaagccttcagaaccctcccagcccatctcgccagcctcacgcccactgtgccactccctgcccactgcacagcaaacccctccctgaattatttacggtttcctaaatttatggtgccgttccacccctgagcctttgtgctgtgggctcagcttgtgatgctgtcgcttgcaattaaactaatctcaacatatagaaaaatgtcaagggtaaaagaaagaacagctcactcctttgtaagtgagtgactgagagcttccacagggaaggcactgaccctgggacctgagttccggaatcagggataaggccttgctctctgtggctgcccagtgcccctactgatccggctgccttcttggtgggccagaccctggtgagaacccctagatttggagtcaggcaggcgtgggatccaaccccagctctgccacttgagagcaatggggccctgagtcagtcccttttggaacctcagtctcttcatctgtgaaatggtggtgctgatgcctgccacacaagacccaaggaggtgactggtgtcaagaggtggcatgaaggccagcacacaggacttgctcagtcaatggttcttgtgattttagggctggtgtttggcagtagagcgtgactcctgtgtctgtcttggggcagattttaggggacttgctttgcaaagtcatggtagtaagatccttgaatcggaggttggcctatgaactaatgataatccgcttagctagatttcagtctcctccagtccgcctggacttaagagatggtctgttcctatctgttcccagaacctatgatggggctgaacttgcaggtggcagccagagacccccatgctgaactcagttccataaaaatctatgaaggctattctgtgtgatcatgaaggggcataactcccaggctgtgtcctggggcagctcgtggtccagtgggagagacagacatgcaaacagacagtgacaacatagagagatgggacctgcaggaggctgcaggaagtggtggtggtggggagaagcgtgaacctggtcaggatgtgagtggtcacggcagacttcccggaggaagtgatgttgaatgagcatcaattttaaaagcagagtagggaggaattaaacagggcaaaagagcagggcaatgcaagcaaaataattacccaagaactaccgcaggacgtggaggcggtgggagagggatggtgggaacctcagcactttagtgttggacaagtcacttctttttacctgtacgacttccaggtgagcagatcagagaaaggataatgttctccagttgagaaagaaagcgtcctggctgggcgcggtggctcacgcctgtaatcccagcactttgggaggccaaggtgggcagatcacgaggtcaggagatggagaccatcctggctaacacagtgaaaccccgtctctactaaaaatacaaaattaaaattagctgggcatggtgttgggtgcctgtagtcccagctactcgggaggctgaggcaggagaatggcgtgaatctgggaggcggagcttgtagtgagccgagatggcgccactgcactccagcctgggcgacagagcgagactctgtcttaaaaaaaaaaaaaagcatcctgaggccacccatggttagggcaggattgagactggaagccacttctccagttgtctctaaggcaggctgagcaaacagaccccgattcaaacttcagattgtcttagtctcctagagctgccataacaaaaccccactgatggagtggcctaaacaacagacatgtatttattacagttctgggggctggaagtatgagatcagggcaccagcatggtcagctccagcgagggctcgcttcctggcttgcagacagctgccttcttactgcatcttcacatggtagagagagagagagagtggcagaaagcaagagagcatgagcaagctctctggagtctcttcttacaaggcagcaatcccatcagatcaggaccccaccctcatgaccccttctaactctaatcacctcccaaaggccccatttccaaacaccatccccttgagtatttgggttagaatttcagcatatgaactttgggggccacaaatgttcagtctataacagaagggaagactcagcttctggcccgtttgcctctaggcctctcagagcacagtgaaatcagctttctcatgtatttgaaatttgctgattttaccaaatgtgatcagccacaggaacgctcacgtcctcgactctgtcctctccctccttccctgtcatgctggtctccagcaccgatgaggggaattgcacactgcaaaagatctgtgctttggagaggataaaacaccctctaaatgcacattattgttattttttttacgggcacccgagcaaaactgtctgttcataagagctaatttagttagatcaggaataagtgctacttgagatgaaaactcattctcctttgtgatattttcttttgggtataaatcaagagaagggcttttaaaatatttttagtataaatgtatttcaatcatatggtcagtcacctcttggcacagttatctaatagatctccatgtgattactgaaattgaacttgccttgacagctcagccatccttttctccattcaagccgtatttgatttcatcgatttggaaagggagcagggaaaatcacctatgactctgcatggaaaatctgatgtcctgcaggctgatagaggattccattgcagacctgatctctatgtggaattggaaatcagcattgtagtttcaggtagggactccataaaagttctgtctcccgtctccttctgtccctccccaaaatagctctttctgttatatacagtgctaggaatttacccatgcagcatgtaacccctaagccttccactaaagtcaaatgtctctaagagggtgaacaccttaaaccaggactataaatatgccacacagatgctgacatttccaagcccagggcagacactgctaatcaatcaggcacagtttcccacaaaggcttgattttgacaggcagctccaggcagacattcccagtggatcagagtcatgggtcgaaactattagtcatcccggcctgaaaccatggtggagatggagatgatgaagaggaaagcattcagcttccaaaagccctgctttctctcttttgatgtttctccttcttctttcttctttcttctttctccttcttcttgctctgccacccaggctggagtgcagtggtgagatcacggctcactgcaacctctgcctcttgggattgagctattcttccacctcagccttctgagcagctgggactacacgtgcacaccaccatacccagctaatttttgcatattttgcagaagcaggttttgccaagctgcccagtttggtctagaactcctgggctcaagtgatttgcctacctcagcctcccaaagtgctgagattataggcatgagccatagtgcccagtttgtggtttctttgtttgtttgttgtttgtttgtttgttttagatggagtctcgctctgttggccaggctggagtgaagtggtgtgatctcagctcactgcaacctccaccacccgtgttcaagtgactctcctgcctcagcctcccaagtagctgggattacaggtgcctgccaccaagccctgctaatatttttgtatttttagtagagatggggtttcaccatgttggtcaggctggtctcgaactcctgacctcagataatccaccctcctcggcctcccaaagtgctgggattacaggcgtgagccaccgtacccggcctctgttgtttcatttctaacataaagtccaccacacctttccccccaatatttaccatgacattttgatttctgttctaagcagattcactctaagtagtctttctcctgttactggttttactcatgtaacaggagcctcttgttataaaaaaggcaaggagcttgcagtacagaaagggcagtcagggaccagtgggtcactggtacaatgtctgattttctagaaaagataaaaccatccaccaaatgactctggctgactcagaaaggggtctccagttgatgaattgggggagacaatgaggttttggctcaaacacagatctggctcatctgaacagaaccagttggtactgagcccttatggggccagtcctgggttggggagcaggcatgaactgggcatagaccctgcatccctttcctgaggctgccgtaacacgagaccacaaactgggcagcttaaaacaacagaaattcactctctcatagttcaggaggctggaggtccaaagtcaaggtgttggcagggtcacctccttctaaggctgggagggaatctgctccaggcctctctcctggcagtttctggcaatcttgatgttccttggcctgtagacgcgtcactccagtctaggcatctgtcttcacacggccctcctctctgcatctcattttctgtctcttgtaaggaaacgtgtcattggatttagggcaccccattaaccaagccaaggcagagaaggtgtgtgcctctgagcagtgggcaggaagctcagggcaggagcacgtatcagaactgagtcctgaagacgggctgggaagtgggaaggtggagtgagaggagctgcgttgcagggcacaggggatgtgagagggcaccatggctcaaggacagctcttctccctctgctcatggcagagtgagggcgaactcctgcggcaggggcatctgggccgactctgtggtcatgagctgggttaggatagggggtcaggagtgtggacggggctgcgggatgtggagttcaaagctcaactcttaacatgtagcagctcatgtgactttggacaacatcctcgacaccacgaagcgttactcttctcacctgtgaaatggaatgacagcgaccatccccacctcacagggagaggagtgctgacgagggtaaaggaagggaaacaggagagacacagtgacctttcagccgtcattagccacttgcactattatttcaggcttgtacccccagctgctagcacggagctggcacggcctagacgctcaagaaatggcaattgaacgaacaaacaataaaagcccaaagcacattgctttcttaaaaaaaaggcagctttggccaggcgcggtggctcacgcctgtaatcccagcactttgggaggccgaggcgggcggatcacgaggtcaggagatagagaccatcctggctaacacgatgaaacccggtctctactaaaaatacaaaaaattagccgggcgtggtggcaggtgcctgtagtcccagctactcgggaggctgaggcaggagaatggcgtgaacccagaaggcagagtttgcagtgagccgagatcgcgccgctgcactccagcctgggtgacagagcgagactccgtctcaaaaaaaaaaaaaaaaaaaaaaaaaaaaggcagcttcattgaggtgtaagttatgcaccatgaaatcactcattattcaatggtttctagtcagtttacggatttgcgcacccctcctgacgtccagttttggaatacgtccatcaccccagttcgtgtccttgctgtcactcacagttcccacgcccagccccagggaaccattgacccgcttcctgtttctataaatttgcctttttggggcatttcaaataaatggagtcacacaatatgtagtattctttggctggttttcttgtatgtggcaaaatgtttttgaggttgacgtgtgctgtagcatggatcagttactcatttcttttgattgataaatagaatttcattgtatccgtctgccactttttatttatccattcctcagttgatggcatttggatggttgccagtttttggctactgtgaaaaatattgctatgagcattcacatgcaaatctgtgtgggtttgcatgttttatttctcttgggtagattcttaagagtgaaattgctctcacatccctgtgatatggtactattatcatcatgccatttcacagatgaggagagtaaggcttgacatgttgagtagggtagctcacacctgtaatcccagcacttcgggaggctgaggctggaggactgcttgagtgcaagagtttgagaccatcctgggcaacatagtgagaccctgtctctacagaaaataagaaaaattatctgggcgtggtggcacgtgcctgtagtcccagccacttgggaggctgaggtgggaggattgcttgagtctgggaggtcaaggctgcagtgagccaggattgtgcgactgccctcctgcctgggcaacaaagcaagaccctgtctcaaaaaaataattaaaaataagagatgttgaatatattgtgcaaagttcaagttaaccttttaaaaaactaagtttattttttatttttaatttttttttgtaagacaaggtatcattttgttgcccagattggagtgcagtggcatgacctttgctcaccaaaactgctgcctcctaggctcaagcgattcttctgcttcagcctcccaagtagctgggattacaggtgcacacaactatcgcccagctaatttttgtatttttagtagagatgggatttcaccatgttggccaggctagtcttgaacttctgacctcaagtgatccacccaccttggcctcccaagtgctgggattacaggcatgagccagcatgcctggcctagaaactaagttttttcccagtgtggctgtgcccttgtacattcccaccagccacgtatgaacttctagtttctttaatctttttcacatctgttttttcattatactcacctttgtggatgtgtgatagcaacttgttttcattttaatttgcatttccctaatgactaacaacattgagcatcttttcctgtgcttagtagccatttacataggtctactttagtgagatgtctatttaattatattgcccatgtttaattttttttgtcttcttaagttctaagagttctttatatattctggatacaagtgtatccttttcccattgaattgttttggcacttttatcaaaagctaattacccataatgtttgtaattctgttacaattctgttctgctgatctatacatctattcttccatgaatgctccgctgtcttgattattaaggcataatattaagattgaaatcagggagtataaatcttccatgtcctttgcctttccgtataaaatttaggaccagcttatcagcttctacaaaaaggttcgatagtattttgacagggatcacattgaatttataggtcactttgtggagaatttgctatctagacgatattgaatcttccaatccatgaacacggaatgttcttccatttgtttatgtcatctttaatttctctcaacaatgtttggtagatttcagtgaagatcttgcacttttgttaaatttattcctaagcattttattctttctgatgctattgtgaatggaattgtttgcttaactttatttttggattgtttgttgctattatatagaaatacaattggtttttgcatattgatcttctattgtacaatcttgctaaacttgtttatcctatgaggttttttttttttttttttttttttttgagatggagtctcgctctgtcatccaggctggagtgcagtggcgcgatctcggctcactgcaagctctgcctactgggttcacgccattcttctgcctcagcctcccgagtagctgggactacaggcacccaccaccacgcctggctaatttttttgtatttttagtaaagatggggtttcaccgtgttagctaggatggtctcgatctcctgacctcgtgatccacccacctcagcctcccaaagtgctgggattacaggtgtgagccaccgtgcctggcctatcctatgagtttttaaatggatctgttgggattttctatattaagaatcacatcatctatgagtaaaagtattttatttcttcactttgaatcttgatactttttattattttgccatattgccctagttaaacctctagtagtttgtcgattaaaagtggtgagagtagacatcctcgctgtgttcctggtcaagaggggaaagctttctgtgttttttcatcactgagtgtgatctttgccatgggttttttgtagatccccttttccaggctgagaaagttcccttctatttctagtttgttgagagttaaaaaaaaagtcaataggtactgaattttaaaaaatgcatttcctttgagacagtcgtgtgtttttctcctttgttctattaatatgatgtattagattaattgatatttggatgttaaactaggcttgcattttcaggataaatcccacttggtcttagtgtctagtcctttttatatgttgctggattcagctggctaatattttgttaagaattttagcatttgtttaatgatgaatattggtctgtggttttcttctaatgttttcgtctggctttggttaggataatactagcttcatacaacgagtgagaagtgttccctcctcctctattttctaaaagagtctgtgaaggattggtattatttcttctttaaatatttgttaggattcaccaatgaagctatgtggatctggcttttcattgtggagagattttaaattattaactcaatttcctttatattgttgcaagtctgttcagattttatattttatcttgagtcagtttttgtaatctgtgcatttccaggaatgtgttcatttatctaagttgtctaatttgttggtattgcattgtttacagtattctcttataagccatttaatttcatatgattggcaacgatgttccttttctcatgcctgattttggcaattcttatcttttctcctccttttttttttttttggctcatctagctaaaagtttatcagttttgttatctctttaaagacccacctttgggtttcatttattttctcttttgcttttctgttttctattttgctgatttttgttataatctttcccattttctttcttctgcttgctttttgtttagtttgctcttctttttctagctcatttagatagatgcttaagctatttaagacctttcttttcttctgacataggtgttaaaaggtataagttcccctctatgcactgcttagccgtgtgccattcattttcatatattgttagaatttttcatccgcttcaaaatattttgtaatttctcaggtaatttcttctttgaccgttgagttatttagaaatgtgctgctcatttttgaaatatttgggctttcatagacttttgttaatgtgtgatttaatttcactatggctaaggaccatgctttgtgtgatttcagtctgtttacattaacgaggctcattttaaggcctagtaatgttctgtcctggagaatggtctatgtgtgcttgaaaaaaattgtgtatcctgcagtcattaggctagttaggttgagttggtcaataatgtgtttaagtcttctatatctttgctgattcttaacctagtggttccattggtgattgagagtgggatttgaaatctccaactattgtccttttaattccattagtttttgtgtcatgtattttgaagcactgttattaggggtgtatacatttataatttttatatcttcctgatgtattaactcttttatcattatgaaatgttcttctttgtctctagtaatatttcttatctacaagtttattttgtttaatattaaaattatcactcccagctctcttatgatttattttttcatggtatattattgtccagtccttttactttcatcctatttgcatttttgaatctaagatatgtctcttgtagatagtatatagtcacatcacttgtttatgcagtctggcaatctctgcttttggcctttttagactattcacatttaatgtactttatattacattatgcttacatataccattttgggttttctatacatctcttttgttgttatctttttcctttgttccttcttcattacttttgtttcttttaaataaatatttttagtatcccattttaattcctgttttttttttaaaccttgtattttgagttattttcttaatgattgctttaaggactacaaaatacttttaacttgtcataatccacttcagattaatactaacttaattaatctgaccaaatacaggaggtttgcttcaatatagcttcattcttttccccttgtactattattgtcacatatatattacatatatattatctaaatatctgtatctatatatttttcttataaacccaacagtgtagtgttataatgattactcaagtcttttaaagaatttaagagaaaaatatatttacagagtgttttgtattaacagtaatatttaccatttcttttttttttttttttttttttgagacggagtctcgctctgttgcccaggctggagtgcagtggtgtgatctcggctcactgcaaccttcacttcccaggttcaagcaattctcatgcctcagcctcccaagtagctaggactacaggcacgtgccaccacacccagctaatttttgtatttttagtagaggtggggtttcaccacgttgggcaggtggtctcaaactcctggcctcaagtgatctgtccactttggcctctcaaagtgctgggattacgagtgtgagccactgtgcctggcctaacatttagcatttctaaggcttttaatttcttcttgtgaatttaagtttccatccatctgctatcatttcctttcagcctcatgggcttcctttggtatttcttgaaaggcaagcctgctagcaatgaattccaacaatatttgtttatctgagaatgtctttatttcacttttgtttttggaggatagttttgctggatatagaaatattggatgagttttttctttttttgcattttgaatatgtcattctactgccttctgccctctgtttttttctgtgatgagaagtcagctgcttatcacattgttgtcccctaatacacaatgaattgtttttatcttgcttccttcatgattttcgctgtctttcaatcatttgattatgatgtgtctaggtgtatatctctatgtatttaacctacttggggttgttaagttttttcaaatgtttggattaaagtttttcatcagttttggaaatgttttggccattattccttcaagtattttttgcatcctctttctctctctcctctcctctggaactcttctgaaatgcatattgacatgcttgatgttctacaggctgttgaggctctattaatttttcttcacccttctgttctctttgttcttcatattggttaatttttattgctctgttttcatgcttgctgattcttctactatctcaaatctgccaccgagcccttctggtgaatttttcccattagtgtactcttcaactctggaattttcatttggtttgaaaatattatttctacccctttattcagattctctatttattgatttattattattgttgtactttctgttaattatttgattatgtttataatagttgctttgaagtttttcactaccaaatctaacttctggagatcctcagagactagttttccctccctctgacccccagagtataggtcatatatgcctatttttttgcatttctctttttttttgttgttgaaaactggaaattttaggtaacatattatatcagctttggattttgattttccccaagaaggttgttactgtttgttgcttgttcatttgtttagtaacttgcctgtgctaactctaggaaattcattttccttgctgtgtatagctgctgatgctcagattaaaaatatatatatatttctggctgggtgtggtggcttacacctgtaatcccagcactttgggaggccaaggcaggcagatcatttgaggtcaggagttctagaccagcctggccaacatggtgaaaccccctctctactaaaaacacaaaaattagccgggcgtggtggcacgcgcctgtagtcccagctactcagtaggctgagtcagcagaatcgcttgaaccaggaggtggaggttgcagtgagccaagatcacgccattgcactccagcctgggcgacagagtgagattctgtctctctccctctctctctctctctctttttatatatatatatatatatatatatatatatatatatacacacacacacacacacacacatatatacatacacatatatacacatatatatacacacatatatgtatatacacactatatatacacacatatatacacacacacatatatacacagacacacacacatatatatatacgtatttatatatttatatatatattttttaaagcctggcttctgtgcccctgtgtgtccatagtatagaggtcagccagtgtttgatcagaggttattctcaaacacctcaagctcataagacttctatattctgttaaagacctgtacacaggtaggggagcacattcataattctggccgtttccaagtctgcctggcttttactttttactaggctgttcatgtttcctgtgtgtgtgcacgtggccttagggtcagctagctagaaatcatggctggcttggatcctttccagtctccatcatgcatagacacagccccagccattccacacagcctgtcagattgccacttttgctgagaaagccattagacgtgagcattacccattgctccaaattgtgtgattcctgtcaactgtggcccaccagctgctggtcctcagggcctgtcctgccctaaagaatctctaagtctatccagctgggagggcagtatcggaacagccctgggccagaattttacaaactcccactgtttctaactgaaattcagcagttttcaagaataagcacttctcagattggtgcatgcttttggatgattttcagagtgtggaaatggctggtctttttggtcaattttgtgcagctgtataattgacttttggggagaggatttgtcaacctcctcgcttggccatagctgggagtccagaagtactttcctgactggaaaatgcggtgggcaagatgaatgtcttggcaggatagggtaggggaaaagtggttggatatgaggctgaaaaggttgcctggggctaaatgaaacctcatttagtagaggagaaaagaggtagcacccttggggaaagggattttcccaagttctcaaacctcagtcaatgaagagatgacactggaacctggatctcttgactcccaatcaattgctccccccgccatctaccaaattgcgttagtagttgtagtttagaagtccacatccagttttcagtatgaaaggctcatccatccatccatccatccatccatccatccatccatccatccatccatccatccatccatccatccatccatccatccatccatccatccatccatccatgcatccatccatccattcatccatccatccatccatccatccatccatccatccatctacccatccatccatccatccatccatgcatccatccaacaaatactgactgagttcccactgtgtgcccagcattgcacacagctctggcaatacagaggtaaatgaaaactgacagagtcccagggcttatgacccttatagtcttagattggggacacttcagttgccagaaagggccttgcaagagctagtttgaagaaatgtctcatgctgatttgttagtgttgactaaggctatagccctttccaggaaaaacagtgagttttaattgactcccaagctgaaatgtctcaagccatgattttcaaccaaaattttctttgtgaaaaattgcaaatgtgcagcacatttaaataaaaaatcaatttcatagtcaagagtttggtagcaaaaatgttgacttccaaaatgaatctcaagggcaagaataccgtgagttctctttcaaaatgtctgttaaacttgagggctttgaaaatctctccttcagagaaatctatcatcatgaggccattggcccttcacggtgagactgccatggagcggcctgatacttaaacacttgccaattactgctagcttcctatgcgatgccaagcaaccatatggaaactgaaaaattcagcaaaaatctggatgccttttctatatgacaacaaataatcagatatttggaaacaagagattattttttaactaaatcttgagtcatcctctggaaatttctaaacacaacctcagaggaagttatggtgttacccatttcatcccgtccttctctgttttcttcctgggtgatctcattcaataatcatgcccaaatctgtatcccaagcccttaaaatctcctggtcaccacttccaaaggcctcccaagcttccctgatagcaagccaacactttaggcaaattcattcagacgaataaattcttccctctctcttccttctgccttactcagcacgtatttccataatggtctgtggtctctagggctcaccaaatgtccaagtgctcccacatctcccagccttgcttgtaggtagaggccatgaacctgggtctggccactgggatgtgagggatggagcgatttctaggacccatccttataaaacatcctgtgtgattctctagctctctcttctcctgttatgtgactttagaggcctcttgttccagattgcaaagctacagaatggagaaagccacctgactttgcatttgcatcagactttgtgaatgagtgaaatgaaccttgcttgggttacaccactgagatttggggttaatctgctgctgcagcccagcctggcctatcctgactcatacctccaggatgtcccacagacacctcagaggctacacgttcacagttgcaccaggcactttctcctttacgtgttcctgacctggggaagtggcatcatcgttcctcctaccacttcctggttgtgtttgactcctccgtttctcactttgcacaagaggtggttctggggacccacctctatctcctcctctccacacctccccatggcctccaagctttcagaagctgccagcattaacttttaaaaacacaaacctgaccatgccattccttttcttaaaatccctagaaggtcgtctttgaagtcagaataaagcacaaaccctttagcacccaagacctgtggcctttgggcctgcctccctccagtctcttggcctttgtccctgtgtgtgctgcactctctgtttcacctcacctgggttcctactcaccatccaagacctgctccaatgtatttttctctgatgccaacatgtcaggcgaataaattcttccctctgtcttccttctaccatactcagcacatatttccataatagcctatgttctctggggtgtaactagctgttaagcagaaataaaaaccacagggtcaaagagttgagggacaatggaattaatcaaagtcaaacaggtttttaagttgcagaactttgcaggccttaatatgcaaagtcacatgactctgtaaaaggtatgatggagcccatggtccttcctaacatagcgcatttctagagagcacctcctaaggctaacattccatgaaagtcctagtgtaacccaccctctcacttgacagaatgggaaactgatacccggaggacacagctgggagtggccaagtggagacagctgggagagtgggtgaggaggtgaagtgtgctggccggggggctgctcttctggcaggtgagggactcagtgctcagcccccagccttggggagcatttgccttgtgaatgaatacacactgtaccccagctaggcatttcggggggctagacagagacttcagaatagaccgtcatggactgtcatcacataggtgaggttgtgtgatgcaacggggatttactgtgggttatctcatcataggtccatgtgaagaccccctctgcagcacacaacacaggcaatgccttccaggtgttcttctgagcattacatagacactcatttatctacatggcaacctacaacccgggtaccatcatcattctcattgaacagatgaggaaactgaggcacagagacagtcagtgattcgtttcctgcagggccagaacctgagttcagcctctctcccaaccatcactgtgagctcatttaaaaaaaaaaaaatacttatgacacactgactgtgatgggtgctttcacctacagaacaaccactttgtaggcaggcatcattactgccctcactaccccctctgctatggttgaatgatagtgtcctctccaaaattcatgctgaaatgcaatccccaacacaatgcaaagtggcctttgggaggtgatgataatggaattagcactcttattaagggctcaaagtggaaaggcgtactctcttgcccttccaacatttccctctcttctgccaagtgaggacactgtgtttgtccctcaagagggcaccatcctggaagcaggaagcagccctcaccagacaccagtcctgctggtgcctcgatcttggacttcccagcctccagaaccatgagaagtaaatttgtgggtgttttttttgagacagggtctcactctctagcccaggttggagtgcagtggcacaattatggctcattgcagcctcaacctcccaggctcaagaagatcctcccacttcagccccatgagtagttggaactacaggcgtgcaccaccatgcctagctaatttttaaaaaatattttatatttaaaaatataaaatggggtcttgtcatgttgcctaggctggtcttgaactcctaggctaaagtgatcctcccacctcagcttcccaaactactaggattacaagtgttagccactgcacctggcctgttctttataaattacccagtctgtggtattttgttgcagctcttacagccgcctctaggcaggtgttgttatctcccctcaagaccacctggaagggtgtagtcagcactctcatcctaaagatttgcgcctttcagccatgggccactttcccagacctcccccagtgcccatcaggagaggaccatgtgtggtccaggctccaacgtgctgagggtttcctctaagcaagagcattctcctgcccggtgagaataggaatgtccgattggtgggaggagaataaatcactccccacctccaacctacattggccagagctggcccccgctctctgttcccatggcactttatatgtgtgcatagagagccagggagcagtggggttcagggtgggcccatgctatgtgctgcagagctggtgggtcacagtctccccaggtgatggtggtgttaataatcatcctaggcccgtggggtggggtgaggattgatgcatgagaaagttgaggcgggggccctggcatggagcagggctcaggccgcttgtcacccaggctcatgtcagccctccggagcctgtgggtgtataggggaagcgcaggggttcttcagccagagggacaggttcagggcctgctgatgccccttgctggttttgggaccttgagcaagtccccttgccttttggtgctgtgcctcggtttcttcttctataagaaggaggtgatgatgtaacccacccacccagcccctctaccccgcgcatcagggtagcaggcgagctagcactgtggcaccaggagtggagctggcccctggcgggcccacgctggagaggcatcgccatctctgctgcccccctgtggcgtcatcatatcaacctgccagtccccctcacctggtgttaatctcccagaggatggggactggttctgatcacctcctggcttccaagtgcctgccacagggcctgggacccctgatgcctcagaggacgctgggcagacctggggaggcttgtgttcactacctgctgccatgtgctgcactctgccgccctgtggctctctctccacttcttcaaaggcccctgtgccgtctgtctccaggtgtttgcaccggctggtttgcaaccccctccaccatctcttccc

SEQ ID NO: 552 - DNA, 78630 bp, Homo sapiens
tgagcaagaaagaaatatctgaggtttgggggtcattggttacttcagcacttagcactttattgaaattgtttgtttgtttgtcttattcaaggtgcattcaggaaatgcatcttcttcgttggatgtctgcatagtctggagcttggcagttggtgggagctaataaatgtttgtggaataagtgaatgattcaatgaagatctccaatgagaagcatctattatctgccatggcaattgtgctgactggagaatgtttcttaccctgagcagaaattgaatcctcctgtacttccactatgggttttagttatatcccttaggctcctataaaaccgtctaattcctcatccatatgacagccctctaatgcctgaaagcagtgctactattcatcttaggattttatctttgcagaataggtattcccagtccttatccattttggtatctcccatggttttaatgtccttggtttcctgggggtcctctttgcaggtgctcttgatgcatgtctctcttagcacatgggatctgcaattagcatcattatccatgtgtggtcagagtagcacagggtgaggaaagagtgtctcctccctctgtctagacaaattatactgagtctaacacagcctccagttgccttcactggtcttggcagccccatcatgctgctgacccatgtggagtcaaccaaatcccttaagtcttttccaggagcctttattgtcaagctctgcctcaacttgtgcaggtggtttggggaatccaaatgtagatctttatacttttccctgtttgcctactcccctcatttcatctagttactgatttctgtctacagtattttgggaaatgaaggctttggtttctgggaaaggaaatgcagcaggtagtccacacaaaggagaaacaactgtgtcttgttaatcctggtatggctagagagctccattttcaggttctgcaatgtatacttcactatgtgaggtagctcatttctagtactgtactgtctttgcttggtttctcagggggaatagaagagtagcatcaatagcacacaccaacaagaagctctatgtgtgacatatagactgactgtaaggtgttccccataacccctgcttcccggtaatcatgctctttgattatccccttggcttgagtatagacatgtcctgtaacttgcttctatccaatggaatatggcaaagccaatgggatatatgtgattgcatgtacataattatatttggtgtgattgtaacattgcttccttgctggctgtgaggagcaaggttctaggctgtgatctgttccctgggaagaggccacatagtcagaaactgagggcaacttctagctgacagctagcaagaagctaaggccctcaacctgacagcttgccagaaacaggatgctatcaacaaccaaatgggcctggaaaatgatgctttcccagtccacccttgaagtgaggttgcagcactggctgatgccttgattgcagcttccagatgagactctgaggcagatgattcaacaaagccaggcccgactcctgatccatggaaactgtgatataataaatgtgtggtgttttatgctgctaactttgttgtaaattatttatcagcaatatgcaattaagtggtagaaaccaaattcaattggaagcctatgacatcatgtagccaaaatataaatatatattatatatataatatatatataatatatatattattatatattatatattatatataaatattattatatattatatattatatataaatatattatatataatatataatatataatatataaatatataatatatattatatatataatatataatatattatatattatatatataatatatatatatatgcccactggcctgctgtctctttttgaagggttgcattgacttatagaacccctaataatttccatggcctataccatgagaatgtgaaaaggccacttatcagtagtagtagcagtagtagtaatagagctgttttttcttttttatttttccttttttttttttgttttgagatggagtttcactcgtgttgcccaggctggagtccaatggagtaatctcggctcactgcaacctccgcctcccgggttcaagtgattctcctgcctcagcctcctgagtagctgggattacaggcacgcgccaccacagccagctaattttttatttttagtagagacggggtttctgcgtgttgatcaggctggtctcaaactcccgacctcaggtgatgcacccgcctcggcctcccaaagtgttggattacaggcgtgagccactgtgcctggccagtagagctgtgttctagtatttccccagactaactttctgctcacccatcttctccaatgtcccagttctcctctttgccttccttttggacttcttggttccatacccagctgtgaatatttgcttcctgcccaccaggccttctaactttgattcgtcattggagcagggtttcccagttttgatcacttccatactctcaacgggaagtgttttaatctagcttcttttttgtctatattttctaggtctagctcttatagatctcctgttaaagaagattctaatgctctacgctcctttaatgataaaaaaaaaaaaaaacctgtattgggtaatgtgaacttcagcaaaagaatagatatgggggacgccaaggaaggcacctcaagccattttgttatttccattcaggttcttttcatctttgagcattatcatcatcatcatcatactaaagccctgtacacatattatgtatgaaaaggaagttgtaagtactatggtttgtagatcctggggaactgcttgatgccatgaggctagtttgaatcctgcttttcatttctaatggttcagacactggacatgggggcctgagggagaagctgatgactcactttttctgtttgtaccagtatgctatttttgcatgcagctaagtttgccagagagagaaaggtcttctggagtccctcagtcctaatgtactttaaatgctatacatagagaagtagagaatccaagagctcagttcccacacactgggcttgctctctaaaagcagagggatgtttgaatttaggtatgtgagccctcttagacttgagcttttaggttcaggctatttcatttaaggtgttactgctgaggcaaaacatatactatgaacaatttgagtcatgcccatggatgtccctagaagtacagacagatcagaaatgggactgagctgagctctaatacaaacctttaattttacctacagaaaaatagaaactcagaaaggttaaatgcctagacagaatttatgcagttaattaatgacagcatccagacttgatttcagacaaagtagccatggtgttctttgaaaagccgtaaagaaaccgaagctcagaaagaaagtcagtcgctctcagttgcttggaggagaggtgagttctaactcaggaggctggacctgggaggggaaacactccattcaaggagaatgattctccttctccttgtctagacttttaggagtccaaatgatagacaaagatgaaaatagtacctgtcaagtcaagtgcgatcaggacataggaagagaaggagtcaggaataattccctttccttaggggttccatgtggatggagtgggcctcttagatgttttgattttataggactgtttatttccttgtttctgctcttcagcatttagtaaagggcctattgattttcattatttttaatttcagccttgcctcagcctcagctggacaatggggagttcattgaaagggctttcttttttctgtctgggccagagtgtttgaagattactaccctctgaggccagcaggatggtgacaatggaaacagagaaggaggcgaagcaagagaggatctggaaacaagttcagagctccagaatctggtgctccttcctccagggtattttctttccagtgccagcctcaaagggattgatttttatttttgcgcaaaatccatttaggccctaggtcaaaggcctcctttctcaccaagtctccacaatttgccatctaccccttcaatgctgtcttctgtcttctatagtcccttaactggacaatcactcctatgcttatagtttggcttgtattcaaattagttatgaatagttctgtccatcccttaagactgtaatccttcccacagcagggaaagcatcatttttactctataacaatcctctcctctagcccctgctccaatagacacccgatagacactgctaggtgtctattacatacctgcaccaagtaactaattatacggtagtgttttccacacttttatgatgacaagaattatgtggtagaactggttaaaaaaaatttctcagatcccaccctgaccctctgtataggaatgtccaggggcaaaacctaggaagctgtttttttttttttttttttttttttttgagacggagtctcgctctgtcgcccaggctggagtgcagtagtgcgatctcggctcactgcaagctccgcctcctgggttcatgcaattctcctgcctcagcctcctgagtagctgggattacaggcgcccaccaccacgcctggctaatttttgtatttttagtagagatgggttttcaccatcttggccaggctggtcttgaactcctgacctcatgatctaccctcctcggcctcccaaagtgctggattacaggcatgagccaccgtgcccagccgggaagctaaatttttaaccggagttgcaagtgactcttatcagtaaagtttaggaaactctcttccagaaggtgagaaggagagatagctctatgctggggtggcctttttgtgtcgaatatattggagatgagtattgtggggtcagaggctgtcagaagggcaaattattaccaaacttcattctttctgttcccctgaagtgagctacatgaagccctgcaaaatcgctcaggagctgcgtaaaatgtctctcctggcatcctcatttgcccttgccgttgctttcagacatgcagtttttacagtgtctcagtccttgtcttcacttcctggtcccccgagtctgagtgtgatgctaaagcgagaatgtccttgaatgttcttgatctcgatgtgtcggccactctcggaagccttctgtctgctccccacccttccgggcaattccacgtgtgtgaccctctctctctctctttcttttttctttccttttttttcccccttaactcccctcatactccatgtctctgttttccccctgggcaatgagtgcagaaagagtttttacgcacgcagtggtttcccactgctctaaagtccaaacctctaaatgaggccctgttctgcctacttgattcagacagagccttctttacaagcaacaaagatggactcagtgaaaagggagattattggaagggttctcggggatctatagaagaaactagaagcaggaggaccagacttaggaacgggtaatcaacaggggagctgatcatcgaagattgcagcaggggtcacaacagaagcatgagctggctgctgaggcctccgcattatttggccactctttcaggatacaaaccccagaattaattgacaactggataagcccaattcatgtgccagcttcctgttgaccaaggacagggcgggaagagctgcgcttggtttttctttttaagtgatagactggagcgtttcaccaagacttcactaagaagagtttctcaaaagggagaaagtggtgagataatagaaaaagaagcttggttgtcaaagaacttaaaattgatgtgtcttctatgacaatgctccagccttaaaaaaatggaagtgtttggagaaaaatataaattacacaaaactcaaaggctttttaaaaattaatgtattagtctgttctcatgctgctaagaaagacatatctgagactgggtaatttataaaggaaagaggctcagtggactcacagttctacatggctggggaagcctcacaatcacgtcagaaggcaaaggagaagcagagtcatgtcttacgtggcagcaggtaagagaagtgctgaacaaaatgggacaaagccccttataaaaccatcagatatcctgagacttgttcactaccacgaaaacactatgggagaaaccactccatgattcaattatctccacttagccatgccctgcgtggggattattacaattcaaggtgagatttgggtagggacacagccaaaccatatcaatgaatgcaccaagtggccttgtcttcctctctttccctctttttgctccccctcctcccatttcctctttttctcttctctctctttgcctctttttctcctttctccctgtcattttactggcagttatgttcttctgttcagtattaggaaagttccagatgaacttggaggaggaagtggaaaagtaagactctaagttgtgagaaaggaaattgggatgaggtgtgtccatgggagttaacgaattaaaaccactaagagtttatcatcttgctttagcgttgatttggggttcttctttccaatccacagcacacagagatgttcatttaaaataggtccttagagtttgagggtccttctaacatttaactcagagatttccctgcagatattcctctgtaagaaaataatctagaaaaattggggaaaaagtttatacagaaaaatgctcatttcagctttatttataacagccttcaaattggaaacaacctaaatgggatgagtatctccatggtatgctcactttatggtatattatgcttacaaagcatttaaaacttggaaaatgtttattaaaaagtgaagtgaaaaagccagtgcataaaatgctgcataaaatataatcacaattacatagaataagctaaaagaataaaaacttatcaagtgagaaaacacagaagttagacacagcactgttacagggattgcttttagataataggagtcttggtgattgacttaaaaatatttttgtttgtcgccttttgcatgtctttgatcttcaaaaatgcattgagcacacattgagcacactaaaacaagatgcatgcatttctttacaccagaataaaatcaacttttgttaacaaccaaaggagaaaatgtccttgcttaaacaatggacccacggcttccagttttcacggaatcttctgagatagctgctctcttgctgagttcaccatagtgctcgtgtaatcaaatccagtaggcatactgtgccctcattttcctcaaccctccagcagtatttaatgtggttaatccgtctttcttgacacgctatcattttttcctggaaacccgcctgcttctcttgccacccttgacccttgcctccttctcagttctccttgttcatttcttccttttgtacccaaactctaaatgttacactcccctcctagttacacttgcttttgtcaccaaaggcatcccatccactccttctatattcagacaccttcttggtttatgaatctgcccttctctcccttgtgatcacttatctagctgcttccttgacatccttgtttggatgtccccaaaatatttcaaacttacatccaaaatgaaactcttcaaggtaagtctatgacatagagactgaatgaaggtccatgtgtcaagtgatatagtaaacattggtgtaatataattttcttattttttcaatttaaaaatgtgtgaaagtagaagctctaatattttcttcctgaatctcaatggatcgtattgcttactccttaaaatacaaattaccttcttaaagaccagtgtttgcattgccaaaatcatagatgattctcttctctggaatcttcagattctctgtcttttaaaattagaagtgcaacaaaaattccaggttctgatgagacttgcaaaataaaaggatttttctactgtcactttattttatatgttatgcaatgttaagcgacatttatatagtactcaaattatttccaatcccctgtatatgatgtttttaagtaaggtcctacgccatttgaacaccactcatccactcccacaccaatgtttacaggagaaggacacagaaagttttgaccataaccagcgaatttttttttttaaccaattaaacatgacaacataatttttggagaggtttttgttacagggactttgtgacatacctattcaagttctagctgtttgcactgtgtcttaaaggagctgcaactatcttgatgtatttattaattacatgtttctatttcttccaaaaataaaggtaaacataattacatgctgagtgttgttcagctttggggttctaaaaaggtaatttgaaccagattcctttagtctcttgttacttaaaatgtgatgcatcaactagcaacattggcatcacctggggctgtattagaactcacattctcaggctccacccagatctgatgaatcacaacccacattttgaacaagatccctatgtgacttgtttgcacactaaactctgagaagctgtgatctagaactgtaagcctttcgacttcttaaaatctagcttcatattgctatcattcactcaaattctatgtattatgattctgactctgtagcttttacttgataaaacatcagattgagcgcagtggctcaatcctgtaatcccggcactttgggagtccaaggtgggcggatcacgaggtcaagagatcaaggccatcctggccaagatggtgaaatcccgtctctactaaaaatacaaaaattagctgggcatggtggcacatgcgtgtattctcagctactcgggaggctgaggcaggagaatcacatgaacccgggaggcggaggttgcagtgaaccgagatcacaccactgcacttcagcctggcgacagagcgaggctccatcccccaccccccaaaaaatcataagtttagaaattatttaacaaattcagcagaaagaaaaattatttaaaattagaaaaatggtttaaacagatatttcactgaagaaaacatgatggcaaaagcatgtggaaagaggtacatcattagtcattaggtgaatgcaaattaaaacaacaataagatgacactacacaagtattagaattgcaataataataataataaccacaacaataatacttaacaatattaagagttgatgaggttgtagactctctactggtctagtactctcatacattgcaaatggaattgcaaaattgtatagtcactttgaaaaacagtttggcagtttcttttgcttaaacttttattttaggttcaggattacatgggtaggtttattgtatagatagactcacctcatgggagtttcttgtgcagattatttcatcacccaggtactaagcctagtacacagtagtcattttatctgatcctctccctcctcctaccctccaccctcaagtagaacccagtgtctgttgttcccctctttgtgtccatgtgttctcatcatttaactcccacttagaagtgagaacatatcgcatttggctctctattcctgcatttgtttgctaaagataatagcctctagctccatccgtgttcctgcaaaggacatgatctcattctttctttatgactttctttatgactgcatagtattccatggtgcgtgtatatatatatatatcacatatatatcacattttttaatccagtctaccattgatgagtatgtaggttgattccatgttgctattgtgaatagtgctgcaatgaacatatgtgtgttctttttaataaaatgatttatattcctttgggtatatacccagtaatgggattgctgggtggaatgttacttctgtttttagctctttgaggaattatcacactgctttccacaatggttgagaaaatttatactcccaccaactgtgtatatgtgtttgcttttctgcataaccttgccagcatctgttattttttgacctttttttttgagacagagtcttactctgtcacccaggctagagtacagtggcatgatcttggctcactgtaagctctgcctcctgtgttcaagtgattctcctgcctcagcctcccaagtagctaatttttgtatttttagtagagatgggtttcaccaccttggccgggctggtctcgaactcctgacctcagatgatccatccagctcggcctcccaaagtgctgggattataggcataagccaccgtgctcaacacttgactttttaataatgtagtttggcaatttcttataaatgtaaactcatactcatcatatgattcaacaatcctactcacaggtatttattcaagtgaagtgaatttatgtcatagaaaagctcgtaaatgtttagagcagtttcatcggtagtcaccaaaacctgaaaataccccaaatgttctttaactaatgcatggacaaatactggtatatccatataatacaatgctataggactataaaaaagaacaaattacagagatatataaaaacatggatgaatccacaatacattatccattatactaaatgaatacagctacacatttgtatgacattctggaaaagataacgctatggggatgaagagctgacagtggttgccagaggttcaggataggtggaggtggagtatttgaatataaagaaatagtctttgttgtgtatcactggagttacactgtagtctgattgggaaagtagctacatgactctagccatttgccaaatctcataaaactgtatatcagtctgggtgcagtggctcatgcctgtaatcccagcactttgggagactgacgtgggaggatcccttaaacccagttggaaatcatcttatgcaacataacaagacctcatagctactaaaatacaaacaaacaaacaaacaaaaaattagccaggcatggctaattatgattggcatatgcctgtagtccaagctacatgagaggctaagtcaagagaatcacttgaacccaggagtgtgagactacattgagccatgattgtgccactgcactccagcttgagcaacagagcaagcttctatttcaaacaaatgaacaaaaactgtgtatcagaagaaggaggctgggcacggtggctcacgcctgtaatcccagcacttagagaggctgaggatggaggattgctagagcataggagttcaagaccagcctgggcaacatggggaaatgctgtctctacaaaaaaatgcaaaattagccaggcataaaggcatgcacctgttagtcccagctactggggtgggagaattggttgagcccaggaagtggaggttgcagtgagttgagaacacgccattgtattccagccccagtgacaaagtaagaccctgcctcaagaagaagaaggaagaagaaagacaaaaagaaagagaaggaggaggaggaggagaaggagaaagaaggagaagaaggagaaggagaagaagaagaagaagaagaagaagaagaagaagaagaagaagaagaagaagaagaagaagaagggaagaagaagaagaagaaggagaagaagaggaagaagaagaagaagagaagaagaagaaaaggaggaggacactttattgcatgtaaattaaaagtaaatttacaggaattatttattatttgcagtgcatgctctttattcttgagccaaagagacatagcttaactaaagctaactatgatcagtgatgtcacataatggcaattgtgacagtgagtttgtggccctttatcccttatcacccttccaatcacatcgctgtgattgagtgcagactgcttcctttgtttgttttcatgctccccctttgattactctctcttttctgagctgtattctccttccctgtaagtaaagtacgacctgtaaaacacaagaggaaatgggagcataaaaatttgcataatgtaatgaaactgctgtatcatgagctttctttctttggttatgttcgaatgaaaacaaaggtatacctctgaatcggagtttggagtgttagccctggaaactggaatgaataaaataggccagtaaggcttgcgtgccttacaactttaatgcagccatgtgctgtactgtttatgggtaaagcacctggcatcacagtccttcctggactggcctttatctcaggtaagtgaggcctttcctgttgaatctcttccaggcaggtgtgcagggaaagatgatagcctggcccatggctgaatgattacttctcatccatggaattcattttcatatctggaatgctgcataatctggtgaataaagcactaaactggaaatccaggatatacagtttgtgaggacttgctgactgcacttatgtgatcatcttaacagcttaatgcttgaattaactcaatcagtatcatggttggtaatttgtagtaaaaattctgacaacttatacatggtttaaatttataaagtgcttttatgcagtttaactcttttaatcttcaggttcagatgggaaaaaaaaattggggctgcgcgctgtggctcatgcctgtaataacagcactttgggaggccgaggcgggcagatcatgaggtcaggagatcaagaccatcctggctaacacggtgaaaccccgtctctactaaaaaatacataaaaattagccgggcgtggtggcgggcgcctgtaatcccagctactgaggaggaggctgaggcaggagaatggagtgaacccaggaggcggagcttgcagtgagccgagatcgcgccactgcactccagcctgggcgacagagcaagactccgtctcaagaaaaagaaaaaaaaaaaaaaaaacaacaaaaaaaacctggctgaatgaggttcggtgtcatgtttcttataggatagttacgtcgtctttcccttcatattcatcctgtgaagacactttaagtaacacagcagatttgatcttggacctttcatgaccctgaatcataacattcaagacctgactttctctttttcttacttagtattttttttttaagattatagatgaaggtaaaggtcactcagcctgttaattgcatctttagaaaattgggccataagcttgtgaaatatgactccatggaattggaatgtgttgatgctcacgacatgtatataaggggatgaattgtttcatagatatagtgacaggtgagggagaataaatagaggctgtttatgaggtgctttgaattctttagggtcaataaagtgattacaaagtcacattggtcaatgagacataaaaagaaagtaaaaataaaatggggcacaattacagtttgggtgatgggttaaagtctaagttaggcatattttagtggaaaaaattaaaatgcttgattaatcttaaagctaaattagaaatgtagttgtgaacttcatgaccttgaatataagtcatttttttttcagttatttctgtctttctgtcccccagtacttatggacagtgagtggccacatcttatgccctaatacgaattagttcttgaactacagagaacaaaggctccttggagatcaattgattccatgccttgggtgcctcgggatgaagcaaaatttggatagattatgagctggagtggctgccagaaaacaaggaaattgtagcaatgtgtagagttgtaccaaaaggacaaaggagatagcttaacaagacccccactagccaagatgcaacaatttgagcatccaaagggagaaactataactagttgggatgaattgagtctataagaaagccatgacattcaaagaggaaataatttaattacagtgtatgagatgataattatactacaaaaaagggtgaaagcaatttttcaattaactaaaattagtaggggactattgatgtatttgttttgtttttccaagtacatgtttataggtattaatatgttggttttttgttctgttttactttgttttttacttacctctgtgtgtagtatggaaggagatgcaaaaagtgtctgaaaggagggaggaattgcactaagaacagctagggaccatcacctcaaggaaccgtagacaagaaccaggtggatagagtgtaaatgggtttgctacatgatggactggtcaaaatttagaatgaagactgacagatcgactcagccttgtatctcctagcaaataaaacctatggaagactcaaacaactttacagagatacaaaagttacacaatgacttaagttatacattgaggttaaacatcgtgtattagttagctagggttgctgtaacaaaatactgcacactgggcagtttcaaaaactgaaattcactttctccacttctggaggctgaaaatctgagatcaaagtgtcagcatggttggttccttctgggggctacgaggaaggatgtgtttcaggcttctttccttggcttgtaggttgccttggcctccctctgtcttcacacagttttccctctgtacatgtctgtgttcagattttctcttcttataaagacactagtcattacattagagcccaccttaatgatattataccatttaattacgtctttaaagattctatctcaaattatggttacattctaaagtactggggattataacttcaaatacagattttgggaggacaccagtcagcccataacatacctcatgacacccatgtagtgaagaaagagaaagagagagagagaggttggacaaaaaagcatggctatgaacattcccattggcacagcctgtcaatcttcatcataagagaaacctaggtaataaatacctggtagcgttcaactcactgtggaagtctcagctgggttctttggtctgattaatagttgattgataatgcaaccatttcaattgatttgcagtagtttttggatgtttgagaggtcattgtaatctggaaaatgcattaaatgtattaactgacataaataatgaagaaattgattaagcctataagatccacagttttctgataggttgtgtacagatataaagatacattttataattattgagataatttgcaactatcttatctcttttcaatcgcctaagaaaatgtagctctcttagtctgttcaggctgctaggacaaaaagaccatgaacagagaggcttataaacgacaaacatttatttctcatcatgttttcccatgtccttccctttactcttcttgatatttcttcatgcaacactatgcccacattttctcagagatgagcaaagcataggtctaaccacaaagaagaactttataataaagccatggcatgtccctggctccagagctcactgttgatgggaaaattgattcaataaatataattcattaaaagaggctcatgacttgaggtattactagagtaattcagtggaatttgcctttgataataggactgtatgggaggccaattcttagcctgaaggaattacctgagaacaagacatgatgtcaaatctactttactaaacaactctattcatgtgacctagagtgtcctatatatcaagtctgtgacttaagtcaaggcattactttatgggaaacttacccatagaaattaatgccagtaatcattatcttttgaatatcttctgtagtgctttttgataatttgcatacagcgacacatggaatattccatccaactcatagtatacatattattttcccaaagataaaatcagaaatttagtaatactaatcaaagctctaaaagagggacagagcaggatagccaaatagaagcctgcactgattgtctccactgcagaaacaccaaatttgacaaatatctacacaagaaaataaccttcataagaaccaaaaatcagatactagctcagccacagtggggtagagcaccaagcagcctcttgagatccccacttcaaggcctggatgatggaagtcatttctggacctgccctgttccagaagggagcccactgtcctgaatggtgagtcccaggactagcagcctttaccacaagctgaagagtccttgggcctgaagtgaacaccagaggtagcccgacggtaatccttgtgcacctgtgatggtggtggccatggggaaagctcctctgcctgtggaaaggagagagaagaatgggaaactctttgtctcgtggtttcagttccagcttagtcatagtagcatagggcaccaggtagatttctaaggttttttactccagtccttggctcccggatggcatctcttgacccacttgggacctggggtaactcactgccctaaagggaaggacacaggcatggctggcctcaccacctgctgattgtagagccctagggcctggagtgaacataggctgtagtcagggagtggttacagcaggtcttgggcaagatccagtgctgtgctggcttcaggtctgactcggcacaattcaagtggtggtggccacagggggacttgtgtcaccccacccccaactccagcacggggagagagactctgtttaggagaaagtaagggaagagaagaagagtatctgtcttgtcatccagagaattcttccagatgttttccaagaccaccaagacagtacctctacaattctgtaagaaacactgcattactgggcttggggtaccctctaatacagttatggtttagatcacaacacccaagtccctttgaatacctgaaaagccttcccaagaaagatgggtacaaacaagcccagacttcaaagactacaataaatattgaactcttccttgcagacatggacaaacatctgaaagtatcaaggctatccaggaaaacgtgagcttaccaaacacataaaagaatacaccaggaaccaatcctggagaaacagagatatgcaacctttcagagagagaattcaaaatagctgttttgagggaactcaaaaggaattcagtataacagggagaaagaattccagaatctctcagataaatttaactaagatattgagataataaataagaatcaagtggaaattctggagttgaaaaatgcaattgacatactgaagaatgtatcagagtctcttagtagcagaattgatcaagcagaagaaagaattagtgaacttgaaaacaggccatttgaaaatacagagtcaaaggagacaaaagaaaaaaagaataaaaaccggtggcctacaagatctacacaatagccccaaaagggcaaatctaagagattttttgcccttaaagagcaggtagaggaagagatagaggagaaagtttattcatttgcataataacagagaacttccgtttaggaatatcaatattcaagtacaagaaggttatataaaaccaaagaagactacctcaaaacatttaataatcaaactcccaaaggtcaagattttttttttaaaaaaaggatcttaaaagcagcaagggaaaagacacaaataaaatataatggagcttccatacatctggcagtactttcaccactgttgctcaacatagtactgaaaatcctagctagagcaatcaaagaagagaaagaagtaaagggcattcaaattgaatagaaagaagtcaaattattctggttttcagatgacatgatctcatatttgaaaaaacctaaagactccaccaaaaaactattaaaactgataaatttagtacagttgcaggataccaaatcaacagacaaaaatcagtggcatttcaatattccaacagcaaacaatctgaaaaataaatcaagaaaataatttcatttacaataggtacaaataaaattaaatacttaggaattagcttaaccaaagaagtggaaaatctttacaatgaaaactataaaatattgatgcaagaaattaaagaggacacaaaaatttccaagatatcctaatttcatggattggtaaaatgttcatactaccaaagcaatctactgatttaatgcaatccctataaaaataccaatgacattcttcacagaaatagagacaaaatcctaaaatttatttggaaccatcaaagacccagaatagccaaagctatcctgagccaaaaggacaaaattggaggaatcatattacctgacttcaaattatgctacagagctatagtaaccacaacagcatgatattgacataaaaacagatacatagaccagtgaaaaagaatcgacaatccacaaacaaatccatacatctacagtgaactcatttttgacaaaggtgctaagaacatacactgggaaaaggacagtctcttcaatatgtggtgctgggaaaactggatacccatatgcagaagaatgaatctaaactcttgtatcttgctatatacaaaattctaaccaaaatggattaaatacctaaagctaagacctcaactatgaaactactcaaagaaatcattgggaaatctctccaggatattggattgggcaaagattgcttgagtaataacccaaaagcacaggcaaccaaagcaaaaatggacatatggagtcacatcaagttaaaaagcttctgcacagcaaaggaaacaaagtcaagagacaacccacagaatgggagaaaatatttggaaactatccatctgacaatggattaataaccagaatacataaggggctcaaacaactctataggaaaaaaaactaacaacccgatttaaaaataggcaaaatatttggatagacatttctcaaaagaagacatacaaatggcaaacagacaaatgaaaaggtgctcaacaccattgatcatgagagaaatggaaatcaaaattagaatgagataccatctcaccccagttagaatgggttttatccaagtgacaggcaaaaacaaatggtagaagggatgtgaagaacaaagaaccttcatacactgtgaatgtaaattagtacaaccactatggagaacagtttggagattcctcaaaaaactaaaaataaagctactatatgatacagcatccccatgctaggtatatacccaaaagaaaggaaatcagtctctcaaagagataccttcactcttatgtttattgcagcaccatttacgatagccaagattgtccatcaatagataaatgggtaaagaaaatatgatacttatacacaacagagtactattcagccataaaaaaagaatgagaatctgtcatttgcagtgacatggatagaactggaggtcattatgttaagtgaaataagccaggcacagaaagacaattttcacgtgttctcacttatttgtgggagcttaaaattaaaataattgaactcatgaagatagagggtagaaggatggttgctagaggctgggaagggcagtgaagggatatgggggaagttgggatggctaatgggtaaaataatagaaaaaatgaataagacttattatttgagagcacaacagggagactatgaccaataataatttaaatgtacattttaaaataactaaaagagtataattagattgttcataacacaaaggataaattcttgaggtgatggataccccatttaccctgatgtaattattctgcattgcctgtctgtaccaaaatatctcatgtaccccataaatatatacttctactatgtacccacaacaattaaaaatataaaattaatataaataaaaactataaataaataaaatactaatcattcttgggtttatctgaaattcaaatacttatcttaaatgctataaagctagtgacttttaactgaaatacactgtttttttaccccctgaatcttagttacccatttgtgaaataaatatgacatctactcatgagacccttgtcgagtccaattatatttatataaagggaaggcactcctctttccatggtgagacccgggatgtctgggtgctttcaatctcccaagccactcctcccaaaacctcagttttcaatatatttttgtgtataattatatttacatttatatgtatccatctacgaatgctggaggtgaagtcaatcctgtctctcagtctcagatgaggcacatccatctgtggatggatggtggtgtggctgccctcctccgtttcaactgggcatgtgatcagggtctaggtttgctattgctcagggcagggttgccagattaagcaaacaaaaacttaacaagtccagttaaatttaaatttcaagtaaacaaaaattttctgttgcgtgttttataaaatattttgggcatattcataaaaaattgttgtttatctcaaattcatatataactggacttcctgtttttccttctttttttttttttttctggcaaccctaatcataagcctggggactagaatcagcagctcttactagagccagaaccttcctaggcaagaaattgacaagtcagcaattaacaggacagttgacagaatttgggacaggcattgagggccagtctcaaaggtaaagaaaagaagaagacaggcacaaagaatgtaactatacatcccaagccccatagaggacttgggaggattctctcctcccatttgattttcctctttcatttagggaaacaagcaaactattctgtttttctgtttacctcaaatttgggaactttctagattgacattaatgcaatatttttttctgttgtagggccacatgcattcataatacactaaaatgtgaaaaaagggtatctttgttttctctatttcttatctagtatttctcagaagcctccacttcattgggtgatggagaaaaatctaaatttagtccagtctggcaaacagttctatctaataatgcaagtgatcttttggggataatgcagctttatagacttaaatgtttttcagatgctttctctaatattcctatttctcaggtaacctggtaccatcttgaagagaactccaaaaccgtagagtttatcacctcagagtcctgcctggaacaaaaatcactgatgaactttgagttctattacagaccctgtgtagtgaggtgagtattaaagccaggccttgataaaaggataaataacttcttgagtttctgtagattcagcagggatcagaagcccagcagagctgactttccgtatgactgaggtggagagaattcaagctatgacacagtgaaggctgaaatgtgcttcttctggcctcaacaacatttagaaaagagctcagtgacagaaaaagatatgggaattgagataatggggtcctcgtttctcctcagcttgggatttggactgggaaacaaggaagttttaaaaagattcaggaaggtttggggaactcagaacgtggggaaatggatgacatccttctccaggccaccagtccccaggagaagcactccacaaggacaccttcagcatgggcagaggtgaggtagaactatctgtggagggagggggctggacagtgggcttgaggcagtatgagcagctccacagacctgggagagtgttacagggatccagaagtcccccattgaaatgagggaaggatggaacatttctgtcgggctggtggtccagcagagtctgacagtcatgacgtaaaagagcctgcagtgtggggaaccgtggtgtctctgcagaaaagctacaaccttgtactccagacatgggcattctcatgttgaccctggaaaggtcttaagcccagtgagcacatcagactgatcatcggttgaaaccgtgcagactcagattgacaatgcatgggtctatatgcaccccttgcttgctttcttcaaacacctcttgcctgagtgtctgtgcatttgttcttccttctctcaaggataccctttcttttcctcttcactcctgtgctttcttagccttgagatcattattccagttgcctcttcccagaagacctccaggaccaccacctgcattatattaagggatttcccttcttaatttttctgcttgtctatttcccatcatccaccacgtaagttccatgatgtcagggccctttctgtttggttaatttctgcatcttattatcgactgcatgtttgtgtacccctcaaattaaatgctgaatccctgaacatcaatggaaaagtatttgtaagtggggccttcggaaggtaattagatcacaagggtggagctctcatgatgagattagtgacgttataagaatagacaggaaagagcctctctctctctctctctctctctctctctctctcggatgcaatgaggagactgccatctgtaaaccagagggctctcaccaaactctaccatgcagccttctgatattgatcttctagactacagaagggtgagaaataaatttctgttgtttaagctacccagttaatggtattgttattatagcagccaaactgactaagatatatcttcagtgcctagtacctaatgggaattcaatcaatatttgctaaaaactgaaagttattcaattattctcctcccatatctactatcattattatattgtcccatcatggactgggcccctactacatgttggcaccatactcaaccatttatttaaattatttcttatcgtagaaatgccctgttacattgtgcaagtagacaaactcgggctctggtgagataatgttgcctgaagttttcagattaaatgttagtaagtaggagagctaagaatagactcagatacttcaaattttaaggttttctattatgttaccatgtctttcaaataacaaaaataatgttttcattttacaaagtgctttggtttattttggaaaatgtgaggtgaattggaaagagcactattaacattttactctggataattccttgctatagggtgttcttctgtgcactgaaagatggttagcagtattcctggcctctatccactaggtgccaatagtataaatggtccccttccccagttgtgacaaccccaaatctccaaacattgccaaacatctcgtggatgcacaattaatcccaatggagaaccagtggtttaaactgacaccatttgtgtgatcttggtcagtttatttgtatccgtgagctcagtcccctccaccacagagaggaatcacaatatttgccacccgtactacaaagctcatcaagccagtatatctggtgagatgaaagggaatcaccatatattgagagcctgttgtatgtaaggcatcactccagcctgcatgttttcttgtttagtccaccccacatccttgtgaagtcctattatctcttttttacatatgaagaaagtcaggttcagagaagtaaagtaacatgcttaaagtcacagattcagcaggcatgagagagcagtcacacttcatagcaagtgcaatggaaaaatgtgactggtcaactctaacctacgatacatgtggaaaatatgataggttgctacacgtggttaattggtcaatattatcaccctgcaacaagacaaacaacaacaaaaattttatatatatatatatatacatatatttatatacacattttgttatttgaaagatatgataacataatagaaaaccttaacatttgaagtatccgagtatatatacatatatatatacacacatatacacacacatatatttacacatatatgtgtatatatatgtatacacatatatatgcatatatacacacatatatacacatatatacacatatatacatatatatacacacacacacacatatatatatatatatcctgagtcaaaaaggaagtggaaatgttagtaaatgccttgagtttgtaaacttgtatagacattctttaatttcctttatgactatgaaaataaatattttaccttcacagaaaggaaacgatccatagacatcattaaaaaacactgatgaaccccttatacaatagcattttattctcatgaaagaacaaggttatgtccagcactagagtctatcacattagtgtaatttcatggagcatcgatacttcaaacttttgtttttaactgcttttatggttttcaggaattttactgttgtcattattttttacataaatgtactttgtgttctctgtaaggattaagcaggaaaaaagtattgttttggagagagagagactgaggggtgaaagggaagaaggaaggaagggacagacagtatgaagaccattccagctgggcgcgccggctcacaccattaatcccaacattctgggaggccgaggtgggcagatcacttgaggtcaagagttcgaggccagcctggccaacatggtgaaaccccgtctctactaaaaaaatacaaaaattagctgggtgtggtagtgtatgcctgcaatcccaggtacttgggaggctgaggcaggataattgcttaaacccaggaggcagaggtttcagtgagccgggatccagcctgggcaacagagcaagactccatctccaaaaaaaaaaaaaaaaattccaagaagtcacaggtgaggaagccataagacaacatcctttttctctgtgagagaaaaaaaaaagtgacttttaaagtgcactgagtctgctgagtacttgtgaataatttcagaactgagaccctatagcactcttggagctgctgagccagctgccatccccgcaccccacctcaccaactccctggcttcccccacttgtgccagcactgccaggtggcactcagagagcctccaggggtgtgtctccggacctgccattacctacaggaaggggcttacatagaccagggaaagccaaccctgccttttcaaaggaacttcatgcagcctggggacttttttgacttctgtgaattgtatcatcagctttcctggttctcaggggataactatctatcttctacagaaaaatctttcttttctatagagagaacaatgctttctctctctctctctctctctctctctctctctctctatatatatatatatatatacgtatatatatatatgtatatatatatatacgtatatatatatatatatatatatacgtatatatatatgtatatatatatatatacgtatatatatatatatgtatatatgtatatatatctttatatagagagaggtagatacttattatatatataatccctctttacatgttcctcagttgggccctgagcactacagcttgtctcctttatctggaagctgattgcatgcctcccctctctccctggcacagcagctgggagcaacttgcacatgaccaggctttatcattttacattggaaataatatgtttccatccaggatttcagtgaagcttcatgttcaatcttttgggaagtcaggacagggggaaatgttgttagttttttcttaaccagaagaacatagaagccagaagagacagtactaagctattgtcccctaaaccagtttctggtggagaaaagtgaggctcagggaggtaaaagtgtctgcctcagttggttcatcagcgccagtggcagtgctctaaggagacgccaggcctccggtaaccactcagtgtcagaagttcaggcagcaacaggtgcatgaggaaggagtggggacattccagaaatgcagctgtcaggaattttttaaattgttttcctttcctcttgggccaatcattgggtatttacattcactgtggtcacctgagccaggtaccgcaattgcatgtcctggagtagaaactgatgtgatacccaagactaacacttagttccttctttgcctttaagtactaagtggatctgtgattttaggcaagtgattgtccctttctgggcctgtggtttttttgtttgttttacttttttgttttttaattatcatgaccaaaagtcttttattattaacaacaattgcacactttttgttgggaaaaaaggtatacaaattataaaacagttaacaatgtttccttaaggagagaagtgttaatgctcttctctaattatgcttttaatggtattttgttctatttttttattttcaatagcttctttatttcccttgggatattgaagctttacttaatcttattctttctaagtagggtagagaattcctgtttcaagtctccacaaaacaaaatcccttttcttgacatagtagaaaggacaggtgcttggatgtttggttggcaggggaaaggaaagagtccaggtgctactgatagaaatattcaaccaaatcctccagttttcgactccaccactcactgtggtgccttcctcaagaccttggagctccaagtctctgaagaatatttcaggcaatgagaggagtccctgactaaggtaaaaccctcctctctgtctctttctgtgtgcgtgtatatgtatgtatatgtatatgtatatgtatatgtatatacatatacatattctattgctgcttcctccttaaactccactagaataacaatgaaaggtatttaacatattaatccaccaatgtgaatagttgagagatgccaacaatttgaaagatggaaaagaggtctgcaaatgctcattgtcgtagcacagctgagaaagctcactgaggcgctgagagtgagatgcgaagggacggccagtgcaacacgggcctgtgtgtttttatggacagtatgaaggtattgaaactgatcagtagtcttcaaacattttctttctttctttttttttttttcttttagcagggagatctatttctcaagtgaaaggtaactgaaactgtcatgcatgaaacaagcccaagcaagcagctgcagttgcatggtcagctgagccaagggcagagagatgagccagatgggcttcccgcccctggagggagcccccatccccagagggcagactctgacactccttcccaggttcttggggcatcaccaaaaagagtggaaatccctacatgttttatctccaagggtctctaaccttctgtaacactgctctgtgaatgcaatgagaccatgtaagaaaagcactgagtaaaaccaagagcctcatgttttgttgctatgctgattttaatctttgaaggtaaagggcccttgtatctgacctgcaaagcacttgggctgctggctttgcaaggcattggcaagaataatacctaaggtacagcttcaagaaggtggctttgttttctcctctgagaataagggactgaaaaagtgatgagtaactcggaaaaaaataaaagagaacaagagagaacaaagtagcttttcttgataaagcatttcctctaacctgaaagctagacacggaagccagggagtgcaggaattgccctggctgtggctagtcaccatgccgccacccccaaattcttctcaccaccagatcagccagggaacggcttgctgaaacctgctggctctttcttgtgacctggaaggatgacagagaggctgacatcctggaagacctcattgccctgggttccttaggaatcacagaagggaactcattcactcattcattcattcaagaatagtatagactctgcacagtagagaaaacatgtatatcatttttccagattcaacagctagtgaatttcctgtatgccaagtctttagaactcagggatgaatgaaatttcacaggctattctgtctctgaaaatcaagtaaggcaacactcacatcccctctgggaagccaaccttagcctcgtagtctggataaaatttcactattatgtgctacctcagcagttatgtactgtagcatcagtcacatccacttcagtgtaagttctgggaggacaggacatgtgtctctagtagcagaagagattggcatgacaacaacctccagtaggtgttctactaattaagtttagaagaatttaactgtggagcccgaggcacggggatcacttgaggtcaggagttcaagaccagcctggccaacatggtgaaaccccatctctaccaaaaatacaaaaattagccaggcgggtggcacacacctatagtcccagctatgtgggaggctgaggcaggagaattgcttgaatccagaaggtggaagttgcagtgagccgagatcgcgccactgcactccagcctgggtgacagagtgagactctatctcaaaaaaaaaaaaaaaaaaagaattaactatatttaactttgcttaccacaccacactatgtacccaattacttgtctgtcttccctctctactctccctatgggctgtgagcccctacgagcccctaaaggctggaaccttacctcttcctgtctggcatcacatgcactgtctcattctattgtgcggagacgtgagccaggtctgaattcaaatctatgaccctgccacttcctgtggggtgcatatcctgtttcagtttcctcatatctcaaaatgaaaatgaaaacacaatttccacacctacagctacgaaaaagcttagaaagaatgccagtgatctgcctaggacaatccatagcaaagcatgggcacacagtaattgctagctattaatagaaacttcaatttgtttaaactcctaaagctcattgaattgctggaaaaaaacagcctctagagaacttctgtatatgctttttttcagattcgccatgttttaacattttgccacatttgcttttttatcctctattttttcctattctctctttcaaatattgttaaatatagtaatgcacacatacatacatacacaaacatgtatgtgtgtgaattatgcattctaaaattattgttttctataccatttgaaagtagattagctacatcctgttcttttattttttaatatttcaatgtgtattctctaagaatattcttttaaataatttaaccacaatggtatttcatttaggaaatttaatgttataatattttcatctaatctacattttaatatgccatatttgtcattgtcccaataataataatgtgcaagtgctcttcccttcaaaacaggatctggtccatttagcaattgtgtctgttgaattccctttaattcagaactttcttcagtctttcccactttcacgacactgacatttttaatgaacacaggccccttgtagcatattctttaatgtgggtttgtctgatgcttttttatgatcagattcaggttatgcatcccagcggggatactcataagtgatggcattccctctccatgcacacatccagaggcatgtgacatccatctgttccttattgctaatgttaattttgatcacactgtcaaagtgacatctctttatactaatactgtgtagttactacttttcccctttttgactaatatgcaatcggtggagagaccttttgagactataggagtattccatttctcaaaattcctctgacacttggtacccatggatgattcttgcccaaccaacccttactaggatggttagagcacagtgagttcacaaatctaccacctccacttttgtcataggttttctaccgtaagaaggaactatctctaaagaggcaagacagtgtgtctgaggacatttttcctgttactgcaaagaaataggaactttgtatcctggtaagaggttgcgctggagacaggggtgtgtatgttaagcctacaagagccccgagaaaggctgggaacaaatcagaccctaaaacaagggaagtgagagaccttgagcatgaaggagcagaagaagatgaattataggagactcgttggtgtcaggagagtctgggcaccagccacaggcaaaggcaggtcatatggcactgggaccacaatctagttagtccactaggagagtctcttcctttgagtatgtttgctcttccataaaactgtgacaatcatattgatgtcatagcattttcctgtgtttaggctgatgttggatgcaaagtgccaagcacactgtttaacatcatgtaagtgctcactaaatgccccccttcccttcttccgttctcttgcactgttcagatatcgccatggaaactctcctctctgctttcactgaggccctttaaaatttttacaattactttaacagctcatttttttcatctgaaatgagaaattctaaaggtaataatataccatatttgctgctaacagtaaattaaatgcagggtcaaaaactgcttctgaactcagctaggaagtctcgtggatgcttttatttgaaaatttattgcattattcttgatacattaaatataacaaaattaattaattattttccatgataatgatatctccattttattgttgtcattaagatacaataattataattgccagttttaaaactcgatacctaatatttagtaggcccttaattaggtgctttgcagtcattacttatagtgctctcaactgacttatgtcagcattctctccactttacagatgaagatattgaggctcagagtgtctgtgggacctgccaatggtcttattcctgaaatatggcaatgcaggctgtaaaagtactctgtctccaaagaatgcatactttgctttttggcagtgatttcgatgtgataaaaattccatgttttccatgaacttctgtatttgacttagtatagagctaaatttaattaactatgtaattgagacagggatggctgttgcacacctcacattccatgtgctccccttcacttctcactcttccttgcagtgaggttgaggccaagtgactctttctggccaatgagttgtaagcacaatgacacatgtttcttccaggctgaagcaattgcaatctggtttgcttctttcttctctctgtccccatgctgaagcaaccttagaagtgacatgttaaggagctatattataaggtgatgcaagcctggatccttgagtcactcgagggagggtcatcccaggatcctaggccaactgcattagactctgtgtgtgaaagaaatcaacttctgttgggctaagccaccatgattataaagtttatttgttactgcaggacaacctagcctaccctaatagaatggtgaatccttttaggtgacaagttatcatgggtggtgtaagaagctcctgattttggaggtcaaggaggctagatgcctctccttaccatcatcaaagtgaaaactgaattccatgacctctatgtctatttttaggcaaattaaacatagtcttgttattattatttaaggggataagtgttaaaaatgaacctcttccttttctttattgaaatttagtttaagctgaatgaatgaaacttccactgcaagcaaagaggatagaagagtaatcctcatgaagcggctgttgtacactcaggaggatatgttttaaataatgttcccacaaaaagcacctgcaaacatcagaatctaaaggaaaaaaatcacaacaaatgagattcagcctgattagggaaaatgattttctctatcacttttacactgcaaggccaggctttgtctgaatcttattaatacgagagcgatgccaagataactaaggctgataaagaataaatacaatttgaccggattcagctacaaatatcagatgttttgaaagattatcataagtggctcaaattcacttaattcttttataaaacaagtttttgttggactataaaatattttccaatttccctggatgacaaatggcaaaagaggttaattaaaagtcaactgaagactacttaggcacttaaacatgtaatttcttgagcttcaaacttaaatagctcaaactagttaaaaaatagcttattattgtaattcatgtatttcctctttaaatatacttttcttagtttgatttaaaatcttactaaaagtttgaaaaaaaactagtcgtttaataatcattccgtatttgaaggaatgaatgagaatatacatgcaagcacagagaagggtacaagggtctcttgcgatcctcagaacactaattgcaggcttctctgtccctctttacttatattttctttctcacctctgtgtcctcaccctggcaccttttctctctctatgttggattatccagctgttacacatctgtcagaatcctattacttcctcatgacccaggttaaattgttcttcctctgaggtgctctttcagactctcatattctctctcttgatttcctgttacattctttgggcaattccctcttcatttcaggaagtttataatttttactattttgttaattttattttcatatttatattctgctatgcaccgaatgcttgtgttttcccaagatttatatattgaagcctaaatgtcaatgtgatgatatttagaggtggagtctttgaagagtaattagatcatgagactagagcccagatgtatgggattaatgcccttttaagtggctaaaaatgaccagaagtctttctctttgacgtgtcctcatgacaatgagaacatgaccatctgtaaaccaagaggaaagcattcactttgatctcagaaccccagcctcctgaattgtgctaaataaatgtctattgtttaaggcactttatctatggcattctgttagagcagcatgaactgactcaaacataggccttatctcttcctttttactgtgtatttcccgggattaaggaggatacctaatgccttgtacagcatcccttgcttgggcttggtagtggaaggaagtatcaagtttcccatattgtgtctatttcagaatctatgttcagttctgtctccactggcaagtaacttttcccataaagagaaggaagaataagcacatactccagcctagaaacaaggtcaattttcaaactcaaggccaactatggaattgaatgaggcagagttgtatggccatgaagacagataaataattttagctggggtttaaaagtgattagcagacattttcagagtatactgtcaaaaaataaacacttctttattaatatttgaagttaactttgaacacttattaaagacaaattgaggatgttctgcaattagtaataggactctgagaaactctactcattatggataagctgttcatgcaacacaacaaatgagccttgttttgccttcaagaatgcctatcagaacttttaagacttggaggcctcatgttctctcaaggctccaagcccttttacacatttctcatctgcctggagccaccctctctttaccaaggtaactcctttgccaggagttttcttaaaaacaaaaatatcactggtacacaaacaggcacatagaacagtagaacggaataaagagcccagacacaaggctgcacacctacgaccacctggtctttgacaaagctgacaaaacaaacaatgagggaacagactccctattcgataaatgttgctgagataactggctagccatacgcagaagattgaaactggaccccttccttataccatatacaaaaatcaactcatgttgtattaaaaagttaaacataaaacccaaaactataaaaatcctggaagacaacccaagcaataccatcctggacataggagtgggcaaagacttcatgacaaagacaccaaaagcaattgcaacaaaagcaaaaattgataaatagaatgtaattaaacttaagtatttcttcaaagcaaaagaaactatccacagagcaaacagacaacctacagaatgggagaaaatttttgcaaactatgcgtctgataaaggtctaatatccagcatccataagaaacttaaacaaatttacaagagaaaaactaacaaccccaaattaaaagtggacaagtgacatgaacagacacttttcaaaagaagacatacatgtggccaacaagcatatgaaaaaagctcaatatcactgatcataagataaatgcaaatcaaaaccacagtgagataccatctcacaccagtcagaatggctattattaaaatgtcaaaaaataacagatgctgacagcattgtggaaaagaacatttatacactgttggtggaatgtaaattagttcaaccattgtggaaagcagtatggtgattactcagagatctaaaagcagaactactgtttgatccagtaatcttattactgggtctatatccagaggaatacaaatcattctaccataaagacacatgcacacaaatatttttgcagcactattcacaagagcaaagacatggaatcaacctattgtttatccatcagtaacaaattggataaataaaatatggtacacatacaccatggaatactatgcagccataaaaaagaatgagattatatcatcttttgtggaaacatgaatggagctggagactattatcctctgcaaatgaacacaggaacagaaaaccaaatactacatgttctcacttataagtcaaagctaaatggtgggaactcatgaatacaaagaatggaacaagagacactagggtctacttgagagtggatggtgggaaaaaggaaaggagcagaaaaaataactattgggtactaggcttaataccttggtgattaaataatctgtataacaaacccctatgacatgagtttacctgtataacaaaccttcatctatataaaataaaacaagtgaaggttttattttatttattttattttttattttatttattcctaaaataaaagtaaacaattttatatggataaattataaaggcttacaaatacactcaaacatacatatgtttgtgtgtgtatacatatatatatgcatatgtatatttatgtatatatgtttttaatagctctaattaattacaattcaaagtggtaatcaataattgcaatgcaagtttgctccaaagtacacctgtgaagatgaaaggaaaaactccatgaataactcaagctccttattgaaccagtgtgaagcatgtattactaatattaaaataacttctagtaaaaaattttaccagggtaacttcacacatcttctcaaatgtcacttctgctgggaagcaaagacagatcttctcccgtctttcttcccagcttccagctaagttagttgtttctctcatgtgtatcctgaactttcactattatagtgcttcttgactctaattccctttttaattgcccctcttctctgataaactataaactttatgaaggtaggaaccaagcctatctctgataaactataaactttatgaaggtaggaaccaagcctatcatcttgttagctgttaaatttcccttgcctaggacattgcattgacatggtagacactgaaaatatctgttaaaaaaaatagagttgtcagtcttaggcaatgaaagaggagaaatccaggcaaaccaagccagagtcttgtctttcaattatctctggctaaagtttctcacattattgaggaagagattggcatttacactagaaatctactgtacagtagtatagtacaatgcatttgttaaaaatatgataaactacttagagttctaattttgtagattaagtttagttactttcatctgcatgggttgcttcatcctaaagttttctgtaaaagaatttgaacaaattatttcatagagagatgcctggactctggggcccctaccaaataattgctgtcaagttttgtccagagaatcgacattaccatttaaatgtctaccttacatatattcatgactaggaataactactaaggttaacacaagctcgtagttgttgagtacttattatgtgctgggcactgtgttaagtaatttgcatcaattatctgagagtcatgacccctacaccaggttggcactcttatcctaatttattaatttatatacctgacatttactgggttcataacgtgtaagatattgaactcagcatcagagatacaatagggaataaaataagtatcagttatcctggaacttacattctagtagaggagaggagagaaatgagaaaaactgaaaatgccaattttattagatactaagaatgttataaacaagtgtcagtagagaagagagaaagagttctagggagtacaattttgcatagagagttcagggaaagtgtctcagtctgtttgggctattataacccataaaccatgtggcttacaaacaacagacatttatttttaactgttctggaggctggagattccaagatgaaggtgccagcatattcgaagtctggtgagggactcgcattctggtcatagatagtgccttctcactgccacatgatggcatcgtcactgtcctcacatggtggaaggaacaaagcagctctctggggcctcttttataaaggcactaatctcattcatgagggctccaccctcatgacctaatcacctcctaaaattcccaccttctgataccatcaccttggggattagatttcagcataggcattttggggggacacagacattcagacatagcagaaggcttcacttatagggtgcatgtgagcagaaccctgaaggagataggagagggaaccactcagatatcttagggaagaatattttaggcaaagacagcagcatgtgcaaaattctgacatgggagcatattggagtagttagggaatagcaacgaaaccagtgtggttaaaatcagtgagtgaacaataagcaattgtgaagaaggggccagatcatgtaagaccttgttcgctattttgaggattaaggctttattttgagtgacagatgttgttggaggattttgtgcagaaaatgatctggtttacattttaaaaggatattctggcttctgtaaagaggatagcttgagtgggtaaagagaagaactaagaagtttaaataggaggctattacaataatccaggtaagagggcatggtgacttgaaacagtgttttattggtggagatgatgagaactgctcaggttcagtatgtatttttatgtggaactcacaggatttgctgatggattggatgtgggttatgagagaacaagagaaatcaaggatgacaccagagtttttgccctgagcaaccaggaatatggagttgctatctactaaaatgcttaagattgaaggagggacatatttgggataaaagaacaagagatcggacttggactcattaagtctgaggttcctattaaatatccagtgcagatgataagtacgggttggatatatatgtctggagttcagctgactgctcaggctggagacacaaacttgacaatgcttaatataagaatggtattaaaaaccctagaaactgagttgactcatccaggaaatgagagttgaaagagtagcagttcaaggactgaggcctagggctgcccaacatttaggtattgtgttcattcagggaagcagatgctcagacactgttaggagggcacgaggcttcttgggacattttgcctgtgaaagacaaaggggaaggaagtggagttgcacaaggaaaggcttcagaccacaaagcagatctgatagcttgaaacagaagagtctgtgggaggcaggattggtagagttagcctccaattttgatacagctctgataagatattggccaacccaagggaaaaggtggcatttttgcagagccccactttggataaacatggccaatccctaatgctcttgctgtgctctgtccctgattaggggcttctgacaaatcatagtgtcagcttgaaatctgcagtagaccccaaacactctgcagctgaagcctggttgcaaatgacactgcttgcaactaaaaggcaagtcttttcttaaatgaaaatctgagcagcacacttccttggctgccacagataccacttgtggccatacggatgccccggcacagagagactaggcagctaggctgaattcacagagaaagtaggtggatttaagttctggcagcctgattatggatgcagtcctctactgtgcatgtaggacaatgtcaaatagtgaattaaactttatttgacattgtacctagaactcagttaaagaagcactacaattggtttgggtagctgtgtaccaatttgatagctcccccttttatctggctctcaaactttcttggaatgtctgcctcttctccttacctgattcaccacagccagccacacaaacactacatagttgattcctgagccaaactcaaagtatttgcagataactcaaaaatgttgcctcatcaatgaagctctctctggttctctaaggaacggtattcttgtactactctaaagctgcatagcattttatcctaattatcattattactttctaccttccatgataaatacgtgccccatttccctattcttcaacatcagcccctcctcctgcattggcggaccgagggactcaagccctattcctgacccattgcaggctccttctgctactctgcagccacaggtctttatcaatcttccctcctttctcactccttagggcctttttcacaagttgttctttctcttggaatgactgcttcttctccaagtttcagcatgagatctcttcattgaaaacctttcctcttctacctcctactaatttcatctagatgtctctcctctgtgctcctactcacactatactgatggcatttaaagatttttgatgatgacctgaagtcagaaatgccttttacagcatgacctggtacacaaacctgcatatacagagcctcctatgcaatcagaacacagttgttttatcaaactcttatatctttactgcagtataacgcaccctgatatattctggcctattttattcctttagaaagtgctgtctgcagcccagtaaattgatttaatgacctgccagtgggtctcaacatacagcatgaaaaacaccacccttcatgagcctttgttaatatactgggctcgcaatgctgacatcattagtatagttgtctatttctccacgcaggcagtaaatgctgagggtagaaatcgtatcttattcttgttttttcttctagttcagcacaggaaatgtctaagaaatgaataaatgaatgcatgcaagctctgaggtcttgacaataacctacttcgagtttgaaaatgcagcaccggaatgtttgcgttcgacttaccagaagcttctcccttgcctcttggctgtgaacctccacagcgccctcccacagtatgtcaatggtgttgttggatcagcattccccctattctggaatgtttttctctttctgttcatttgtgttgtttgcattggaggtaccccgatcttaacagagctatttctctgactttaggtgatgacccagggatgggcacccaacataaggtgagccaatttctaaacctgtgaccagaatgcatgcgagtcagtttctctccaggcatgggaagacaagttttctgccacatggaggaagccagaccatagagtatgatgtagagaccacagaacgaaggaaaggtagagatagagtaggtatcctggcaccatttctaaacccctggttccagttttttaatagccagcagacccctacatatttcctgttgggtgattcagctgtcaagtgacacaagatgcttccagtaagttctttattcagtggagttatgggtcttaacaataccactggcttttgtcagtttgatgtagatttctgtcactggagaaaactaagtccaaaatcacacaatccaaatgtgccagagaagcgtgtggctgggtagacagtgacttgtggttatgactaagtctctattctagacaccatcatttcctcaactctatcaggaaagaggcctagaatgtttgcttgggaatgcaaatattcgttaaaccaagagacaggtcatggttgtaccagaaaaggcagaaggggctttttgcttttcatttataaactagaataggtcgtaaaaatcattttactgaatgaactctggctttcttgccctcatttttttaatccataaaatctacatagttctaagttttgttgtgaagattaaataatataataatgtgaaatacgtagcatttcacattcttgacatggagtaataaatatagctcttctaattattccttttcttgtaaaaatcatgacatagtcttctaatttttaagttatttcttgtttcaaaagttaatgtcttagataaagcagagatttcctgtgccgccatcactcttgttatttagcgttctattatcatttgctgaatcactaaatctccagtgatttgcatgtttggtttggttaataaatagtaaaaataatgccacaacaaattaagatggttttatttttaaagcagcctagaaaatggctggtcaacagcccaacatgggactggatgataggcatttctctagataaagcatctaccaccactgaccattactaactcaacaaaattgtcccactttgccacatagatatttaaacagcttgtcttgtcaggacctgatgctgagctgtcagacaaaattgagtctctgaattttgccatattttgtagtgaccagaatctcactatgagagacagcaggtttaagtggcagaattagacttctctcttcaatgtatttttctggagaagttgaaattctacttctgaggcttgggacaacctctgtagcctaagccgctcagtctgaggttgcttcagggatgggaaagtgatctcaattctagataatcatagagccctgcctgtgctctggcctccaaaaaggccatgggtgaaaagtggggtgacaggggtagttcttctcctttctccattgtccaccgggtccccacatatgaaaaattggttcagagaatggtattcagaatcaagatggagaaccacaaaggaagttaaatgtaagctagacgctgtttttcaatgggcagagatggggctctctgggctacatgacctcgggaaatggggataatcaaaattgcctgtgaagtttttgtcaaattatcaaaacccctttataggagactatcagagtaaatttggatcagaaaagctctgagactattctgtttgcaatttaaaaaacctgatgattttaacataccactatcactgctactccagaaaaatagcagttttctccagaccattttctcactgaaaacctcctctgccatgctgaccaagaattcaattccactgttgctacatcacacagaagagaagagtaggtggtagtgccactggccctgcggtttagtccttctgatctcttgatcagctctcttcctaatattgccctactatgcctgagtccagaacccttcaacacacctccccaaaatctccctgcaccccagagtagaccatgtgcttcccttgtaatctagttccatataataaaggagctagaagacagctttgagctcactcagtctgttcaactccagctgcttcatagccaaaggaggaaaagtgaggttctcaagatgaacaagtgaaagaagaaaatttagcatttaatgtgtcataattcactctgttttgcatttgtatgaccaagttctttactactggcatataccttctttgtgaagtgatcaataggaaaatcacacaccaatctcttattatgctgatctctccccactttattattatccccacatcatgcatgtccagggtgaacaaagaaagacacctcctttcaaggatccaatgtataagtgcagaagagtaagtaaatatactatgccaaagctactcaagaattcattcagctaccataatggtgtttatgtagaatttacaaaaaaattaaaaaaaaaaaaacagcaaaaagtagccgcaacaaaaccaacattgataggttgaacattgtggactttggccccagtattcattctcttctgataacagaatttctgttttccttctgggcattcatgtctccttcattctcaatcatgtattctgagcacaacgtgggtgaaaactgtgacacagactggtgtactagctttcttgatgcagctgtcgcaaattaacacaaatttagcgatttacagttctggaggtcagaagtccaaaatggttttcatgataccaaaattgagacatcagcaggcaagcctagttccttttggagactccggaaggagaatatgttccttgccacttccagcctgcacaggcttctggcagcccttggtttgtggccacatcactccaatctcggattccactgtcacagtgctttttgtaccatgacctctaactcttttgcttttctgctataagaacccttataatcacattggataatatttccatctcaaaatccttaatataatcatgtctgcaaaatcccttcggtcataaggtaacatatgttctggggatcaggacattcatacctttggggtgttcttacttagtctaacacaaccagccaatcaaagcagcaaacatcttcagcaacagtcattgttttggataagtaaatggcccaggttgatccactcagagagaatcctgggacttgtgaactggcactgagggaagcaagttctcactctaggccgccttggagctgtgaagcaatgggctagcactggcacccctgcagctgttctgtcactccacgtgtgtaacttgtatctgagcaagagttaccacagtgattgagcctctggtcaggtctatgtctaggctactattttgaaagcaaatgtgcttccatttgctgaagtcaattgaaattttgtgtgtgtgtcattttcagttgaaaaaaagtcttaccagttataaataataataatctattgatttcttactctctacccagcactctaagagttttacatggatggtctcactttatccttacacagccctataattaggtggttactgttattatcctcacttcctatgagaaggctcgaggcttaaagaagctgagtgatcagctcatggacacagagctggttactagagaagcctggatatcatagtctgtcttcaaagacttaaccactctgctaaaaattaccttgtgatgtcgaaggaaaaggctgagtaaaatggcagggtccatataataaaattataataatataaacaaactctgcatagcaaccattatagagaggcaatatctttggggaatcattttgtactttttcctacatattgtaaattttctataattacagtttctcacctttttaatagaaactaatttttatttaaccagagatgacctttttctctgcacaactgtgtctgagtattggtcttgtgatcataagaatggcaggtaagactttgaagcctagtgcaacatgctactaattgctgcatttgcactcatcttccttgaagttgggctgcaaatgtacatgcatgcttcacccgttgtgctggtgacattaataagaaattacatttatttttcctagcagaggactggataagtaggtctctgatagatgtaattatcgcaaggtttcaaaatgaattattttttaacaaatacaaaaacttaaatatgtatgacatgtacatacctatatgttggtttataaatacagtcatcgtgaaaactctacttaaacttgccattcaaatgctaacttggttaatgaatctctctgttatttgtctatgtcacagtgtctctaacttgaagtaacatgaacttggcattttggggacagatactgtgtaccagacatattgtcaggtaatttaaccacatcctctcatttaatcctcacaaaaactctatgaggtgaggaaactacatcttttagataaggaacctgcagctatgagcttatgagatttgctctgggtaacacagtatgcaagagtgagagctgtgacagactgtggtctatctgataccaaaacatttttatctcccccttcacattcctgtgttttcatctgtgaaaccctatagtattatgcaaagcatcaccttacctattgtgttttatagactgcctacttctgagaaggaatgagaattagaggaccatatgaacttcagagttagatttggatttcagtcctggccctagtaaatgctagctatgggaccttgggcaagttacatgaccttggtaaacgccttcatctgaatataaggaaaataactgcacccctgtagagttgctatgagcagaaataaagggatacatccaaagttgtcgcaatagaggctggtttgtgttccctctttcccagcctttaggaaggttggaatagttctgtaaatgtggcctgatggattagctaaattaaattagattaaaaccccttctttcctattccctgaccacattcctctttcaaaaagatgtgtaggcagaagaaggaatgaatagctggcattctgatgaaaataccccatatttctggcaaagaggattcatgcaatagatcagagctcgtgtggcaggtttcatttttatagcctgatgagtggcacattttgcttctcttgtttgcttttatcttgaggtcaaagaaatgatgcaatcacaagtgcacacccttcatttcttgaacatctgtgctcatagcatatgtctgcctagacaagtggattcatcttgctgctatctggtctcttctgtgttggctcctttgaatcatggtgcatttattttgaccattcctgccaaataatgacaagtttaaggggaaatcaggaaaagggaaatgtttgttttccatctggaaagaactctgagatgtttattagcctctttctctcttaaatcatcaaggtttaagtatgttcaagagccacaaggcccgaagttaagttattactattggcttatcttgagcaaattttggcttgtagacagacacccatgtggtttgaatttcttccataataagcttaaaatatgagggtgtaatcagtgagtcttgaagttgaatgaatttacgagcatgcaaactcttgagataagccaagtgcctgtggcaataccccatcctaatgagaggctttccagggatttcctgaaaaaaattattttcactactgcaacatgattgttgttagaagctctccttagaacatcatccaaataagaatttggaaaagtgggagacatctttgatacctccttcttcctctctccaagcatcaagtcctgtgggtttttcacctttccattctctctcaattaagcatcgaattgccttctaatatctgccatttgaccctctactgtgttcatcttgcagccaactatgagttttcatcaacaaaatctgatcacataatgacctgttcactgtatctccattatgtagcactgtgactaacacatgttagatgcttgataaggcattgctgcatgactaatgcaccactgtataagtgaactggggaactttaagcacatttcacctccatttttcttacctgagatgaatatttggatacatactattcaagtggattgagggacataatgtatttgatccagatgtatgtgaaaggtaccatagaccagcaagactacttaactcaatcagaattttactttccaatagaatagtgttgtaatgatattttggtgtttggtcttgagggctctctcttgagagtgatcctaagtcaagataacaactctctcggagagtcatgataggggaaatgttaggtttgagtgtgtgtttcaggtgagatacaatgagaaaatgaaaccaaaatgcgtgaaatagaaaaaatatatattttgtacatgtcccagagaggttacgggtgctgatgggctgctgatggaaagtccagagaaggtgagaagctcaaccagcaggggccagcacaggacccaacctgtgggactatgcccccattaaggtctattggcgttatcccttaggcttttccaacggggttgtggactggctaattgaagagaatatatgtgaaaggaggaacttatttacatgattctgaggttcatcattagattgctcatagtcagcagctgtggatatgctgagttttgcatcactgggatgaggaacaagcagaatctatcagagtcacataggagaggggaaattataactaggtcagaggtgacatggcgtgcctgggtttcaaataaattacatcaggcctaaaaatgaatgctgaggcagcaactatattaaacaaatttatgaacactaaatatttaataaggaatttaataaagaacaagaaccttcgtctgatcttaaaataatatttattctggtaggacaacataataccttgaagcccagctagcgattttttaagaagaacatatgtattcacagaatcagagccagctggcagtgagtaatatcagtaaatgaagatcctgttaagacactcatctcaaactctgtaacaccaggaggtacagtgttgtataaagaggtagggagggttggggagcctgatagctcagtcccagggataaacttggcatatcttcctgctaacaatttcacttgaatgatgaagatagtggggaaacaggtaaatgtttatgcttagagtttatatcatatccaacaaatctgttttaattccacacaattacttgttaattttatgtgccaggtttacattttgataataaaaggaaaacattaactcttacacatccgatcaattctttacaccaaattctcaaatttgattttttttcacaaatatataattctgctgtttcattttcaacttcagtgagttttctcagcgaatctgtgtgatttgcatgtagtgacatcagcatcgttctgtgtttagatcctgccctgtcccccgacattatgcacagatatagatgtgaaggtgtgcttgaaacccactggaatgtccttcccgaagcctgctgagtttctcttccaatgtttcatgatggcttcaaatatgaatcacagttttcttatacagttttgtttccctggaaggttttcttttctcttcttaaatttttttgcaaattgtgctttcatcttattcctcctcatcttcttcttcttcttttttctttttttttttgagagagtcttgctctgtcacccaggctggagggcagtggcgcaatctcggctcactgcaacctctgtctcccagggttgagacaattcttgtacctcagcctcctgggttgttgggattacagctgctcaccatcacgcctggctatttttgtgtgtgtgtgtgtgtgtgtgtgtgtgtgtgtgtgtgtgtctatttttattagagatggtgttttgccgtcttggccaggctggtctcaaactcctgacctcaagtgatcctcctgcctcagcctcccaaagtgctgggtttacaggccagagccactgcgcccagcctacttatgcctcttgtttctacatttccaaccttactatctgttctgatttatccctttttagggggtgatcattcttttcattcttttaacccaatacagattatttgccctgtaaaatggcttcattaacaacattctctagacttcctgtttctactgccctgtattgatctcaccactttctggtggtcatgtcatctttttttttttattttcgtgtatgctggagtacattctcaaggaacttcctaagagtgtatgtgagaaataaacttcattcttatcttccctgacaatttggctgtgtataaaattctgggttggaaactgtttgtcccttacatcttggaaatcctttctctgttgttttctggcatccagtgttcctgatgtatttgaagataccctaacctctccataagactgtaggttctttgttttatcattagtgttctatttttttttttttttttttttgacttggggtctttccttgtcacccaggctgaagtgcagtggtgccatctcagctcacggcaacctccacctcccaggttcaagcaattcttctgtgtcagcctcccaagtagctgggattacaggcatccaccaccatgcccagctaatttttgtgtttttagtggagacagggtttcaacatgttggccaggctggtctggaactcctgacctcaggtaaaccgcctacgtcagtctctcaaagtgctggtattataggtgtgagccaccacacccagcctgaattttttaaacgacatccctaatgagagctttcaaaaaaccatctcgtttggcacttagtgggccttttcctttttactggcatcatatttgctgaagggttaacaaataattgaatctactctttcgaagtacagtttaagctttcataaaggtatactatcatgtattcatcaccaactgatgatatagaatatttctagcaacaccaagagttccctcttgctccttcttaattgatctcaactcctcatctccaatttctgacaaccactaaccttatttccatctctttattttgtctttgccagaatgtgacataaatagactcaaacagtatacagacctttgtgtctcacttctttcacataatacttttgagatttattcatgttgttgaatatatcagtagcttgtttcttattattactgtagtattccattattgtttattgttactgtagcattccattgttggtatgtaccaaaatttatttatccaatcaccaactgatgatttgatggtcctttgagttgcttcttgatatcatataaagatgctataaacttttatttacaggtgtttgtgtggccagatattttgacttctcttgggcaaataactaggagtgagactcttgggtcatctggtaattacttatttatgtttataaggtatcgacaattattttttctaaagaggctgtactgttttatatttctacttgcagtgcatgaaagtataagtttgtctgaatattcatcaacagttagtattttccatttttccctatttattttttaatattaactattctagtggaagtgtggttgtatcttattgtggatgggacattttccatttgaagatttccatttccttcagttctacacacttttcttgtattatatctttggcaatatccttccctgtcttgtcgctattactcttgtccaggattccttttattcaatgccgggaccactggatttgtttcttctcttacgttcttctctatctttttatatctaagttctgtgcaatttctttgactttacctttagcccatgtattttttccctttaattttacatgtagtattttttaacccccaagaagtcttgttatcttacaatttctttttttccaacgccctattctggttttttgaaggcaagttgtcctcaaatttttgtcaagatgtgaattggaatctgtttcctgattagagcaatctatttctccttgagtctttatttctcaattatttatcttcgtcttcctccatcaagctttcttcatatttcctgtattatcttttcacattaaggaattaggcaaaaggaggcttcctggaagttccatgtaaaaatgaacaaggcgggccgggcgcagtggctcacatttgtaatcccagagcactttgggaggctgaggttggtggatcacctgagatcagaagttcaagaccagcctggccaacgtggtgaaatgccatctctactaaaaatacaaaaaaaaaaaaaaaaaaattatctgggcctggtggcagatgcctgtaatcccagctacttgggaggctgaggcaggagaattgcttgaacctgggaggcagaggttgcagtcagctgagattgcaccactgcacaaggcaaacagaacaacagaccttgctttaatttgtctcctttcctgttcatttgtacatatatataaaaaaaggcaagagctctggtttaaatcattgaacatccagctgcaaagggggaaatgctgcagtggatatctattaagaatcagctatgttcctaaaccctttcaaataatagcaatacatgaacagttatctagtgcttataattttcaagaccaccttccaaacacttcatttatttaatcctcacaagaacgctgtcagaaatgcctattactattattcctctttagagatgtggaaattggcacacagagaggttaagtaatgtgtctaaggttgcacagctgatcagtggcaaagctgggtttgaaagacagtggttttgatccattgtctttgctgctaggcagtgttctagactggctcttagacatcgactttctccctgaatccctctaacaaattggtgaggtggccattatcattgccactttataaaagagatttctgaggcccagagagatcgaatgacaaacttgattccccaaagtcagatgagtagaatctgtctgactccaaagcctgaattctattgcctcagatttgtccaaagaatgataattttaaatacttacaaatgaagatttcttgacaattaaatcaatgtttatttgaagtagggtaacatatgaactcaatattttgttttaaatgataaaaacaacaaaaaaatcttgttactaatgatctgtgagaactgtctcttttactttggaatgaacaattaagatttaacatatcaattatgttgtttctcaataacataacggatcaataaccttcattttgtgttcttcttaattactgcattggggtttctgcagagatattctgaaccagatcttgtgtattaatctttgcacatagtccttgttcctcacaatggagcaatcagcccttgattaatgttagcattaaactaactgctatctaatcagttgacaaaatgccggttttgactctggttttctgtggtctgtttgtttctgatgtttctgattggtgtttgctatggggaagaataaagaaatacgacatacattattcattgaagtgaatagaagggttttttttgatattccctcaggctttgacagaatgacagagcagtaactcaaggcctaaatgtaaaccatcaccctccctgccctgctattttttgaagaatagcgaatttaaaccaatcatccaataagtaaaatgtccctctagaatcccacatcataaaaaatgataccaacagctgccaaattgcccatgaaaaaaaaagaagactgttagtgaatgtttgttctttgccttgtattccttccagattctttcagatccttacattgtcctttctccccctatttaaaaataatacttaaccatctttttcttcatctatttcctgcttttgtagtcatccatccctacttctgtcctatctccatccatcagtctgccacattggagcagaatgagcttccaaatacacagcttcagatcacctgccacatggtcaaaattctccagtggctctctagagtccccactagcttttcagagccctagggttgaatgagggtgtctcagaggtccagaagttcctgagtggaaagacttctgccctgtttaaaatgagcatttctatttgtatctgcctgttgtgtagaaattctgaataatacattattagataagtaaaacaaaaggttatacaactaaaaaggcttgaaaactattggtctataggagaaaatctgcactccatcctatgacatacatatcccatacagtgacctaggaggttattagtgaagagtcccccatcttcctgtcaatccatgttgtgctgcctatgccagctcaccctttaaaaatttaaaattgatctgatttacttgcatctttctgaacaatctgtaccgtctcatgctatctccttgccttggcacattttctttcctcagcctggaatctcctggctctctctgatttgcctggaaactctaatttagtcttcaagtctcagctcaagagctactttctgtaaaggctttgtaacccctcatctggactagcactgtacaaaagaactttgtgcagtgatggaaatgttctgtgttgtccaatccagtagccacaaaccatatgtgattatgaaacccttgaaatgtggttactgcaactgaggagatgaattctaacatttatttataaaatactttcaattttttcaaattgaaatgtaaataaccacacaagagtagtggctactgcattggaagagtagctctagatagacctactttgaaactatttttattacaatactttgaaaaagttgcatcataattatttatttacatagacattgattatggtagtctatgagcatctgtgggacaggactgtgtctttgcctgtgtgaatactttgctgccagcactgtgtcagggtcatagtagggattctttgaatgctgaataagtggatgaaagtaaatagcataatcaagtgggaagttgagatatataacaggaaaattctgagggcattgccatcagacacttatcattttgagtctaggatctttcacttagtggattagcaacctaggcaagttgcttctctttttttagtctaacttttccacctacttaaagagcacaacgcatgatgttccctattaggtttcttccctatttaaaggagctatggtatatgaagcatatacgagtcaattagctaaaactagttctcccttcaaggttacccactgtacattttctacttgtatcttttgttctgaagtatgtttatgttacctgaaattcaaaaatgtaataatagaaatgtttgaaaaatttgcaccaagaataaaacagattgcaataagcataaacagtcaaaaatacttttaaaaagattacagctggtcggtatcagacccaagtaagcacagctatgtccccaacttcagtgaaaccaaatccacctctacatgggtaagagcattagcagaggcatgccaaatggcgggtggtgagctctaccagcatgactaatggtagagaaaaagagaaaggcagagggaaagaatctgttggtagaaacacactgatttgttattcactgggaaaaaatgcagtgtcaagaagtacaggttcttgcttgacatcagcgctctgaatcaattggaagagttttattcgcgtgagctgtagccagaaacaattgtccacctttgtcatcactttgtgtgtctaagcacaaagggaagcaaaggctgcaatcagcagcagagagggagggaggctgcaattaccaaaaagtattagagtcattggcatatacgtggagagacagcaatcttgaaagcactgcaatgatttacataagtacaatcacgtgaatgactccatccccaaatcaaaagtgccggctcatcacagtacagtctaggggcaaactagtgagcattgcatttctgctgctccaaatcagactgctatttaaaattaatcttatcaaggcattttaatagtaaaacaactttggtcactttttgatcttggagactgatagactcaactatgaaatatgcaaaactgaaaaactgcagttagatttttcaacagggttttctttcttttcatgacaattctcttttattttttatcttttctcctgtgagtcaatgctcatcacaagagcccttcagtctagtttctacttccttactgtttttttatttccttatatgcaatttgaggtgctttttgttatggcttatttgctttgttttgttttgctttttggctgtgcatgcaactaagaccagagagttaatagtgtcatactcatggaaactgaagtcagttaaacctaggagttgacagaagcatcaatattttttatataagaatctctgctgagcactgaggaacatattctatgaataagatgctctttacatctgcagtaggtggtcataggaacttccaccaggaatccatgctctacttcctagaagtgatgactgtgaatgtgaaataccacacccatgatggtgttgtatgacacagttgacattataaaatagataatatcttagtgggcctgatctggacctgatccaatcacatgagacctaaaaagcaaagaattttctctgactggtgaagaaaaagaagacaaaaatgggagccagagagtttcaaagcacaagaagcagcagatgcactattgtttgctttgaagctggaggaagccatgtgagaagtagagtggacagcttctaggagccaaggctgacctctactgacagccgtggggaaacagggaaatcagtcctacaaccaaaaggaactagattatgccaacaacttacatgagttggaagtggattctccccaaagcctctagtgaagagctaggctggctgacatcttgatttcagtctttggagaccctaagcaaaaaggctagttaagctcacctaaatatctgacatacagagctgtgaaagaatattaaatagtgttatttgtattaagccaataagattgtggcaattctttacacagcaatggataactaataccgcattcttcaagagtataaaattactagagaagaaaatgaaaatatctgagtaataattataatgtagtgtaatatgtgttggaatcagggaaaagtgaaatgtgccgtagtgggagagaatagaatgtgactcactttgtcagcagtacctacgtgacatatgacttgggatgtgatgaatgcaaagaatttgggcagggaaagacagaacagaagtgctattcaagcagagggcacatctgcaaatatccagtgtcacatatttgttcccgaggaagctgactttgagatggagattaagagagcagaagttttatccaggagttcccttgggatccacacctgtggagggaggtagagaagtaggaatatgcagagggagaaagtgagcagcaatgcagcccaataaaagtctttagccaacattaaagggagctctggagctgaaaaggcccattagaattgttgaccagcagagaatgcaggctgtcagtggaaggaggtgtcaccttgggtaaggcagttttctgcagctgagactattctcaagaagagtgacagctaatggcttcctccgcaaatccacatttctaaagtggggcctgagatgtatatacaggaacacggagaagtctgtcgttttcaaaggcagatgagaaattaggcctagacaaacaacaggatatgcagaaaaataggaaaggttagtaagaaatcagtgtaaagagatatgtgttttggctcacgtagggttctgtgagttaggctaaacagacagatgtgtatcctcttggggtggggtcccaggagaaggttttaggcagaagagtgatttggattatagatagatagatagatagatagatagatatagatatatatagatagatatatctatatctatctatatatatatctttttttattatactttaagttctagggtacatatgcacaacctgcaggtttgttacatatgtatacatgtgccatgttggtgtgctgcacccattaactcatcatttacattaggtatatctcctaatgctacccctccccccttcccccaccccacaacaggccccggtgtgtgatgtttcccttcttgtgtccaagtgttctcattgttcaattcccacctataagtgagaacatgcagtgtttggttttttgtccttgtgataatttgctgaaaatgatggtttccagcttcatccatgtccctacaaaggacatgaactcatcatttttatggctgcatagtattccatggtgtatatgtgccacattttcttaatctagtctatcattgttggacatttgggttggttccaagtctttgctattgtgaatagtgccgcaataaacatacacgtgcatgtgtctttatagcagcatgatttataatcctttgggtatatacccagtaatgggatggctgggtcaaatggtatttctagttctagatccctgaggaatccccacgctttcttccacaagggttgaactagtttacagtcccaccaacagtgtaaaagtgttcctatttctccacaccctctccagcacctgttgtttcctgactttttaatgattgccattcttactggtgtgagatgctatctcactgtggttttgatctgcatttctctgatggccagtgatgatgagcattttttcatgtgtctgttggctgcataaatgtcttcttttgagaagtgtctcttcatatcctttgcccactttttgatggggttgatggtttttttcttgtaaatttgtttgagttcttttagattctgggtattagccatttgtcagataagtagattgcaaaaattttctcccattctgtaggttgcctgttcactctgatggtagtttcttttcctgtgcagaagctctttagtttaattagatcccatttgtcaattttggcttttgttgcctttgcttttggtgttttagacatgaagtccttgcccatgcctatgtctgaatggtactgcctaggttttcttctagggtttttatggttttaggtctaatatttaagtctttaatccattttgaattaatttttgtataaggtataaggaagggatccagtttcagctttctacatatggctagccaattttcccagcaccatttattaaatagggaatcctttccccatttcttgtttttgtcaggtttgtcaaagatcagatagttgtagatatgtggtattatttctgagggctctgttctgttccattggtctatatctctgttttggtaccagtaccatgctgttttggttactgtagccttgtagtatagtttgaagtcaggtagcatgatgcctccggctttgttcttttggcttaggattgacttggcgatgcaggctcttttttggttccacatgaactttaaagtagatttttccaattctatgaagaaagccattggtagcttgatggggatagcattgaacctataaattgccttgggcagtatggccattttcatgatactgattcttcctatccattagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttcggctgagtcgatggggttttctagatatacaatcatgtcatctgcaaacagggacaatttgacttcctcttttcctaatttaataccctttatttctttctcctgcctgattgccctggccagaactttcaacactatgttgaataggagtggtgagagaggggatccctgtcctgtgccagttttcaaagggactttttccagtttttgcccattcagtatgatattggctgtgggtttgtcataaatagctcttattattttgagatatgtcccatcaatacctaatttattgagagtttttagcatgaaggttgttgaattttgtcaaaggccttttctgcgtctattgagataatcatgtggtttttgtctttggttctgtttatatgctggattacatttattgatttgcatatgttgaaccagccttgcatcccagggatgaagctcacttgatcatggtggataagctttttgatgtgctgctggattcagtttgccaatattttactgaggatgtttgcatcgatgttcatcagggatattggtctaaaattctctttttttgttgtgtctctgctaggcttagttaaatattcttgtgtctatggagaaatagtaagcatctgatttaagaaatgaaccaaggagtacacaggagtcaacatggttgggtttgagatgtgagagagaagctggattggatactctttatatttttatctgttacattggtaatgggttcctatactatatattattattggagccactgcgtgtacactgatgccattcactaagccaacaaatagaggtagagtagatttaaaggtaaatgtaattgctttgttgaacatgtttttgaggaatgggtaaagttaaaataatctgtaggtagtagggaatacaggaatgaatcaatgaaggcagaaccacactacatacagaaatttggaagtcattgagagaacatgatatttactaaagccttgagagtgttgacaatttcccagatagagctcattgagcaagaagagaaagtgatcaagacagaatctcaaagaaacaatatccaagaggtaggtcaaaagcaggaggaaagtgaagaatcttgaacaatcttgaggcatagaaagagaaaaaaggacccatggtatcctagaaattaaaaggaagatgataataaagagtgaatggtaagaagtgctaatgttgggcattggacctattaatggcaagaaaaaccagacacatccactgccctcatggagtttataatctagtagagagctacacataaatagaatatttgcaaacacacatatgaaattactactatggtaaatgccatgaatttacagtgcaggctgctataagaggctgtaatgaggaagtctgacttcatttgaaatatcagtgcaaacctctccaaggaagtactgtttgaactgaaatctaacgggatgaatttgtcacccacccagatttgtatcttgagtcctagcctgtagtactacagaatgtgactgtatttggagatcgtgcctctaaagaggtaattaagttaaaatgaggtcattagcatgctccctaatctaatatggctgatttccttgtgagaagatcagattaggacatggatatacacagatggaagacattataaagacacagagataatacatctatctagaagccaaggagaagggcctcagaagaaagcaaacctgcctacaccttgacctcagacttctagcctccagaaaacaagttatgttgttaaaggcaccatctttgttagggccaagttatgttgttaaagccacttatctttgttatggcagctgtaccaaacaaatacaggtaggaatccacctaccagtgtggaaggatgaagccaatgggtatttgatagctccatgaataggacttgatgatgaactggatattgggaaaccaagcttgttgtgtacgataatatagatcatgaatacactttacagtgagtgaagggggaattggaaagttgaagtgtgaatgagaggactaaaggctaagacaaaaagtgtggcaagcagattcaagtggtcgcttccacatgttccgcaccttctagctccaggcattggagatgcattctatttatacaatggacaaagatctgctctcatgtaacttaaagatagttcaggaagcagggcattatacaagtaattaaactcatcattatttactattgtgttaaatcttttaaagaataaatatgaactttatgaaagtatatattcaggtagaaagtagattgggctatttgggaagttattgctaaggaagatatttaaagtgggataaatttgatagttgggataaaaatgccataggaaggggaggaaaaaaaattcaggatagtaggaacactcataagcaaagttagggtgtagagaggcagaggcgtttgtaaacacaaatgtactatgtccaatgtccctgtggtaaggaaggtcaccaaagcaggcagcaatgtcactgacatttgtctccatggagctcagcagaaacaaggcctgctctgcttttctgaacagcatgtaggcaccttgccatgcagcttgtcaggggacagtcacacagtcctgctgagctgtgccttccaggggcctggcttcctgtggagcttcagtgatggtacagacagtgggatgctcaggcggttgggaaagctgaggctctcagggttagaggggccatctggcaggaatgtaggatcacagacgggaagtcttaaagtgacagtgttcatgttttccacatgcatttaatgaaaacttgttaggttacaagcactgtactaggtatgagaaatcagagggtccccaagagacacaagttgtttgctctctttagtaggttgtattgtgtcccttcccccaaaagatctgtctaagtcctaacccctggtacctgtaaatgtgaacttacttagaaatagtgttttggcatgttctcactcataggtgggaattgaacaatgagaacacttggacacagcaaggggaacatcacacaccggggcctgttgtggggtgggggaggggggagggattgcagtagaagatatacctaatgtaaatgacgagttaatgggtgtagcacaccaacatggcacatgtatacatatgtaacaaacctgcacgttgtgcacatgtaccctagaacttaaagtataataaataaaataaaataaataaaataataaaaaaataaaattaaaaaaaaaagaaatagtgttttggggccggatgtggtggctcacgcctgtaatcctagtaccttgggaggcagaggtgggcagatgacaaggtcaggagttcgagaccagcctggccaatatggtgaaaccctgtctctactaaaaatacagaaatgagccaggcatggtggtgcccacttgtagtcccagctacttgggaggctgaggcagaagaattgcttgaacctgggaggtggaggttggagtgagccaagattgtgccactgcagtctagcctgggcatcagagtgtgagactccatctgaaaaagaaaaataagaagaagagggagaaaaaaagaaaggaaatagtgtttttgtagatgggattaatttagaaagctcaggatttagatttcctggatttaggatacgctgtaaatccagtagctggtatccttacaaaagaaaggagaggggatttgagacatagacatacagacacagaggagaagttcacgtgagggaggtggaggttgtagtgatgcattgacaagccagagaatgccaagattgcccacagccaccagaagctaggagtgaggcatcgaacagattctcccttggagcttccagaagaaaccaaccctaatgacaccttgatttcaaacttctggcgtccagaactgtgagacaaaacatttccactgttttaagcccccaagtttgtgatagtttgctacagcagtctaggaaatgaaaaatgaggttaatgtcaattttttttctttttttttttttgtgaggggtgtggagttagagaactaagaaaggcttgatacagctttcatgacttccatggggaaagacagtaactaggcagaggaagaaaggaatgaacattctttggtgaacctactgtatgccaggtattttgctgggtattttaggtgcaataagctgcttaactcttacaacactaggaagtttgtattgtcattcatggtcttcatataaaacatttcagtctcaaagaggttaggtgatttgtcccaagtcgcccagacgaagccagcaagctcaggccatcaggacctcagagtttgcatccttctctagaaacatgctgcgttttcctccctgccaaggagaaggccttgactcaatggactccaaataagatcctgtgtgtatgcctcagtttcttcatcaggtaactgaagagactagatagccaaagattcctttcccatctaaaacaaacggtctgcttgagtccatggagccccagagctttcttacttaaacatttcctgctctgatccatgttcttcatccagtatgcaaaatgaaacatgttcattccgtctcttggtcttggggttgtaattcttatctttattgctacctctgcaaggaggagtaaatcattatttgtgtattttgttgcccccccccttttttttttttgctctctctttcaaagttaatcaggttacttccatgtaattttttacaaagtaaatttccaactacctttaaccacaaattagtcatcacattgtgcttttcagggttatattaagtcattcgtcatagatgctgccgataatagttggcttaggctaaatgtttccttgttcagagtatttatcacatcctgtacctgccatgcctgtgaaaataaaaggcagggagggtgtgaactggctcacagagggcataagaaaatgagtatgaaggagctaggtaaactgcagaggcccctgcagtggggaggtggttattattggcattaagtcatcctttggcaggttttattgctgcaagatgaaagggacaaagaggaagtgtctacaggctcacaaatacgcaggggctgtgtagggagaaggtgggcttccatgtctgggaagcaatgctttctagctgtgaacttggcaaatcacttaccatctcccatctcagactcctcacaggcaaagtgtgaaatggaaattccaccccatggggctattgtgagatttgaatgaaattgtgtctatgaaaccctagcctggcccagagcattcaattgagtttgagatcctgtcattcaaggcaattggctggaaagaaatctccacaggattcattggcactgatcacataattcctcatgtcccatcatggatcttggataggtctgcaagctagggcctcctatctgccacattgtgaggtactccctcacaatggtacacaagggagtaccatttcgaaggtactcccttggatgtggagtcttccactgtgctgtcatggtctctcaacctggtcatggctagtctggtttgcttcagcaagtaacttttggcacaaggtgtatattcatgctgtcttagcatgcggtattcactgaaacactagctctgacttaatgatcgatctttattaaccgaccttcaatggaacatgtcaacagtttccatcacactggaaataggatcccagtaaatcaccagcctcttgccatggtccacatcactgatgactctgcctctgacttctcttgctcccttccttctgcttcaccagctctagcaacaccggtcctcctgctgtttcttggtccccactcccaccgcagcccatgcacacacactcctctccccatgtgaaactctgtctgtgcacctgcatagtccgtgctttcaccagcttcacctatttgctccaatgtcaaccccagaagaaagacttccctgatcatcctgcttaaagtcacacaatcccctccatagctattcatcctctcacctttgtaaatttgttttcactgcctttttttgttgtattacattaactatgtattttgcctgtattctgtacttgacatatattatgcatattataaatatttgttgagtgaaagaatgcataaacatactgacttttatgaataactatgccatggtacttgaattaaaggagtcagaggcaaacatttacttagctaggggatggttccttcaataatttttttttctttgaatagtagccccatcactctcaatgaggtggaggttattattcccattttacaggtaagagggaagaaagtggttcagagattaggatattcacagaaaagaatggtacacaaagctgctcagtttctctggtgaacagtaactgtgcattaaggatttgctgatgaatgaacacttaattgtttacataattgaggctaaaaaactatactaattccaatgattgttgtgtttactgctgttgtttttattataatcattatcatattattaatattattaacatcatcatcgttattacccctttagctctttcattctcagtttggcaaataaatttggatgtgttcatttcaaggccacctgactctccataagaaaccatatcacccagatccatttaataaagtgcagtgatcatgccccccttcagcttccttgtggtcacctgattctgtactctttctagaataaagtaaagatggaaggggaacagaacctatttgatggccgcctctagtggagagggccgcctctagtggagagttcacaagtcgcaaagtgaaaagatcactaggaaaactgtattaggccattctcacaatgctataaaggaatacttgaggcttggtcattcataaagcaaagaggtttgatgggcttatggttctgcaggctgtacaagcatggcaccagcatctcctcggcttctggggagtcctcagggagcttttcctactcatggctgaaggttgaagagggaggaggcacatcacatgttgaaagcaggagaaagagagagagtggggagggaggggaggtgccacacgcttaaacaaccaggtctcacaagaactcactcactatcaaaaggacaccaccaagccatgggggatctgtccccatgatccaaacgcctcccaccaggccccacttccaaaactggggattacaattcaacatgagatttggcagggacatatattcaaactatatcaaatggtgaccagccagggctggcactgtcccaagcaaacctgggcagatggccaacctaagtagagaagcatgagatggagatccaaaagcattggcttggtagtcaggaagacctgagttcaagttcagagtccttggacttgtgacggtggacaaatgccatagcctgctcaaggtgatattaataataaaaatataactcgtactttgctttgaggattaaattaaactgcccatgtggaaaaccctgtagagtgtcagactcatagctcatgccaggaagaaatgtagctgctatagttatgcagcactgggttctctgtttatttgaagagtggaggctttgagaggttatgagacttgctcgaggttacgctgagacagatctcatataagggtcaagacctacagacactccttgcagttttctgtccaccataaagtgctgctcttctgatgcattctttattacaagccactagtgcagtacttagtatattggagatgcttctaaaataaaagattccataatagcaacatcaaaatgccatttataacataattcccctttactttttcaacaaagttttaataagtgattactacatcctaagccctgagttatagctagggaataaaatgataatgaataatagatgatgcccttgccttcatgcagcttacactcccaggtttgtacactgtagattgtatcagatgctagtttctatacatggcccctgagacatgcaaatgaagagtgtttgatttactacttttcagttcactatttttatcccaagagaaattttcatttcaactctccagccttaccagtgtcactgaacacagaaaattctcgaacgcttaacaaggtgaaacacagtttctttcttttcatgaacacaaaacaatgtttttttggaataatttttggatacaacatcttttttgtgtgtacaaacaaattttatgttctaaagaaatgaacaactaaggcatgcgcatgagaagctttgtcttcatatttcatttttttcataaaaatatttagctgttgtccaagaaaccacactgcttcctaattagcattgagcattagctcttaagctaaccacataggtcagctgatttcagatataagacagcataaatatagtaggctgaacctgcacattcaaaacaagatcaattggtcaacacgtatatggtaagtgcctatcacatgcaagacaatgctctaggtactgatgcagacaagagagacataatctttgccctcaaagagcttaccttctagagaaagaaacaagtagatattcaaccaaaaatacattacaaagctaatgttaatttttaaaaagtgttatgaaaaagattaaattgatccataagttaaacagtgcctgagggagttgctggggatgaaaagctccacagaaatgtcatctcatttaagctcaacacaaatgtcatctcaacataaatgagatgacatttgtgttgactaagtaacaagaagaaggcagtcatgcgaaggtttacagaaggcacttcaaatagaaggaacagcagatacaaaggtcctgaaatgagtgcacttagtataccattccaagggctgcaagagggtcagggtggttggagcttgggatgagaaagagagtggcctgagatgaaattcatgacagaagcaggggccacttcatgaagggccttgtagggcatagtaaaagcctagggcatggttttacgcagggaagcttacaccgtctgattataaggctcactcaggcatccgtgtgcagagctgcctgtaagacacgtgggtggagatgaggaccatcatcaagataatggcacttgatctgggggatggactatgctgacccggattaggatttcagtggcaaagataatagcaaaagaccagatttgggatgctttttggaagaagagctcatacaacttgctgatgcacagaactagggtgaaggaaaagaaaaaacaaatcaaggattcctcctagtttggggccttgataactgggttgatggtggattttggtggggacaggggtggcatgggtaaacaagtggtccgttttagaccaaactaagttttggatcccatttgatttctaagtgaaaatgctgaatgggaagttgagcctgggactcaggggagtcatcagagctagaaatgcaaatttgagagtcttactgtattgctggtatttaaacagaggaaactgcataaaatcacctaagaaaagaattaagggagagtggataaggggtttggagatagaatccaaggaacacaaaactttagagatctgttgggggagaagagacaccatgaaaaagttaaaaagaaaaggtgatttaaaaggaaaacaatgtaggcgacatattctttcacagattttttttccccaactgatccttgtgaaatctgatgtttgtcttatttgtccttggtagctggtttgacataaaccatctcattcctattcctctcagctacttcaattcagcatgtctagatattctgtttctggcctgtttccattttgactgatattcctacaaattgtgggtccttctctgacctgagatctacttcttagatcctcgatttggagatttctgagcttcagatacttgtgggtgcattgtgggtgccagaagtaaggctttcaaatagaaaattgggaaaacaaaaacaaaagcaaaatactgtttatgaaaatagaaaaatctctctacatgtattcattatgcagccaacagataatgtttctgtgcgtcctttgagcaaataggaaccatggttttaatgtttgggtgatgtctcataggtaaaaagctatggacctctggcacaaatacctggaacaaaaggtcttatggtatttgtagtaaatctatatacttattagcccacgtttcccttttctagactataggtatagtctctcataaagcaggggtcatatgctaataataacaataatgatacattagctaatattaattgacagttacccctatgttaggtactgtgcaatgtatttaattttcaaaacagacttatgaggcaggtgttattattatcttcatttttagacagtaaactgaggtttataaaggcaaattcattcccaagatcatttggcaagtaaaaagccaagttattagtttaacttagtttgacttcaagcctttactttaagccagtgcttaaaccagtgttaacatgcatattctgatcccacaggtctgagatagagcctgatactctgcatttctatcgagctcccaggtgatgagtatgctactggtcccaggacccctctctgagtaaccaggctctcagcctctgtgttacagtgtcccctcacgacctggagaaatgcttgctgtgatatgagtatggagcaattgcatactgagagaataaacatggggagatggggcaacagataagtcttcccatctgctcacagaaactcagcataaacaatgttagaggacgagagctttgccacattgtggggcagccatagagtaatgaagtgggtcagcctggggtatgggttagcctcagttgaaagcacagcatctcaggaagttccagatcagctttcttcattaggttgtaaatttttgagagaggggaatatgttatatttcttctacatctgtcgcaaaaggtagcaaagtttttggaacacagagactgttcaatgcatgctcactgcctgctttttcttacctctgtcatgtatgtgctgcttcacttataaaaactatttttctattttccaagtcaagacccccagtggagagatgagctctaacagtgaagtttacatgatctcgattttggccagtagttaacatgtgatctctagagtctatctttccaggtttgaatccagccctgccacttgctagctgtgtgacttggggaagttatttaacctctttctgcttcaattttcttgtcattaaaatgagaaagatagtccctgacttgatggggctgtcctgaggtaaaatgggtgtaaagtagtcagagaagtgcctagcacttaataggtagctccatacatgttagctgtatttattattaattacaacctaatagtgactgtatcagtcggagtttaccaaagaagcagcacctctaggatagatggatggatagagataataaaggaacgtgttacagggaactggccttatataattgtgaagctggttaagcagtgtctaaaggctgtctccacatctgctggtgaagcctgaagtccagagcgggggaattctggagaggaagatcatgaatttgccggtccccacaagtatgaaatggagccccacaaaaatctactgaagcctgcgtccattcttgttgcctctgactttggtagtggaaagggtgtcctgcaaaagctgggaccatttatcacagagctaaacgtacacctgatctgggaattagacaagctgaaggagtgatctaagagaaggcagagaaattgcagacctatagctgctgcttcatgccaataagtgagtcagcagatcagtaacaaaaactatgagctacaaaatggttactgcttctgttccaaaatcttcccagaatcttccttgtagcccatcctaactgggaaaacacaagatagacaatctggaaaatgtagttgaacccagctaagttgatagatggcaaaactattacagtgatagaccgaattatggtagctaatttattaatatacatgccaattcaaatcttatcacttgcagtttaaaagatgaatttgactaatttatttgaatgtgaagttttcttgaagattagtgctgaggtcatgagaccatgaatggtcttttgtttattctctccttcttctagctcaacaccctcaaggcaaattaaatgagtttcataagcagtccaagacctgtgcagctgttccatgaagtcatgaaggactcgagatcttctagctctctgctccaccatctttagcatgtggttctagttattggggttgcaaaacagtaactgtggccccaggcattgattccacattccagaaaaaagaaggaagcaataaggtagaaaaattccaatggttgggaaacaaaactttcctaaaaaaacagcaagagactccagctgatgtctcattggtcagaacagtatcaaatatctaccctcagcaacaaggaaggcttggaattagagttcaggggagtttttttttttcttatgcacacattattgcttcaaacaaaattagggttctgtttttgaggaagaagctaagagaaatagatattggaaaggtagatggcactaaaaaccagagaagaaaaggccagatgcagggggattagcaagaagttattattgtatataaaaaagagaaagagtgatgtcttagagcatggtggtgtggtagaggtggttggaggtggtggtgtctggatgcattggaatgtagagcagatggatttgatttggcagaggactggaaaaaaaagaaaaaaataatttgtaagccatcattgacttaggataatatttggatgtaatgctgcctgaattagtgacaatgtcacaggacccataactccttgcttgacatttacattctcagcgatgcagctggagacaaagaatgtctgggggaaaaaaggaatggatatctagtagtttggatcattgaattctataggctggaataatgcgaccaaataccggtgggtgttttggctatgcaatggataaagtgtgatataaaacttttttaaaaagtgaagaaaacaggttttaggctatggtaaaatccttgcatcagcttttaccacttgtacctgcaaaggatctaaattccctgaacctcagctttctcctactcaagataaggagattgatatctttgttatagagttgttctgagaattacttaaaatcttaggtaaaaatggcttatctttatctctcacttcctggcctgggaaataaccctctttttcgaagctcctggaaactcctctatcagattcccaaaatgatttataggcaaactgatgtcacagaaaaggccagacttcagcctcagacagaaatgctttcgaaatatgcttctcatcagtgatatgagtggcttaacttgtttcagccatggttctcagaaatacaaagcagggataatgatacttatgtcatgaccttactgagaggccacagcttgttgggacaattaagtaaacttaaataaaatacagcacgcaagtttggtagcctgagaccagacacatggcaggcgcagttcaatgttcattttcctccattgagataaataatgagacatagcatagatacattatttagtctaaagctttcaggttttctatgatgctgggtttctaaccaagcctgattgccaaattttggttaatccttctttgcaggggatttttttcccgcgaaactctgcaccacatcgcataaatcctcttgccatggccgtggcccttcatgtcaagggatctggagaccttacgtggagaaaaaaaacatgatatgatgtagtcattgtgctcaacagtgcactgcaaatgtgataagtcccaaaataatataagcaagacgatcttcagaagaagaaaagagatgcagggattagctaggaaagaagagatggatttcccttgagccgaatttcagtggtgaaataacgagtcatgaaaatagagatattgaactttaaatgacacacaagggacacctccctgttcaacctgcttcccacttagggctgtcggcgtaaatcagggctcagacgggtctgctaggcaacaggctgggttcggcgcctgacaggaagactgtcagcgactttaggcgtgccttacatttagaaagcctcctgtcgtctgactaatcacagagcctttttcttgtgactaatgggtagttttctttaatctccagaaacctctgatcaattaactactatttaagccaatcaaggaaattgagatatggggtgtaattagctttctggaggttacacatagcatcagtcagtagagaatcctgaagtggaactcagagcagggctggtggatgtggaaagagtaaaaacaagtggcatcagagtagaaggaagatgtgagcagccaccaggagatgaggcatctccccgaccctgagggaaaaataagatactcttttcctatggttccttagagaaccaactacacctttgaacaataaacttttgtctgtgtcagtgttcttcctaagacacttacttgtctcatttgtctctagcatagaacatggcctcatcagccctccactccacctcattgtgtgattgtgaaaatctagttgtgtatcacatgtgacaacttgatggcaaatatttcggtatcacacacatgaagatcgtagccacgcacacatgagggtcagtgataagccattattatcattgttatttgttcccaaattctaccactgcaaactccttgatattactgaaatgatgtctctttctctgtttctcttcccctgattaactgctaataaatgaccagctgcctcttctttcagcttttggtgaaattctttcagcttctttcagccctgccctgccctcctctcccatgtgccccccattcatctttggcctctctttcccagagtttttgggatgccgacaagctcctaactttgttggtttgcctgcatgcagtttgcttttctgtgagaaggaatgacagtcactcatagggaaccctggctattttttttcacttgtccaaacatgaagcacacttgcttctccaggtgtggcattgcagaaagcctgggggatgctgtaggtcttgatggttttggttggtgtgtgagtttcctatggctgctgtaaccaattacagcaaatgtagtggcttacagtaacacatctattgttttcttacagttctggaggttagaagctgaaatgggctgatatcaagatctcagcacaaccatgctacctttgaaaccactagcaggagtgtccaatcttttggcttccctggaccacattagaagaagaattgttttgggccacatataagatacactaacaccaatgatagctgatgaactaaaaaaaaaaaaaaaattcgaaacattcttataatgttttaagaaaatgtatgggtcaggtgcggtggctgatgcctgtaatctcagcactttgggaggctgaggtgggcagatcacctgatgtcaggagtttgagaccagcctggtcaacatggtgaaatgtcatctctactaaaaatacaaaaattagctgggtgtggtggtgggtgccttcaatcccagttactcaggaggctgagacaggaaaattgcttgaattggggatgtagattgcagtgaggcgagagattgagtcactgcactctagcctgggtgacaagagtgaaactctgtctcaaaaaaaaaaaagaaaaagaaaaagaaagaaagaacaaaaagtaaaaaaaaaaaaaaaggaaagcttatgaatttgtgttggccctcattcaaagctgttctgggctccatgtggcccacgggctggggttagacaattttgctctaggaggagaacccatttccttgcctgttccagcttcttatggctgtctctgcctctttgttcatggccccttcctccatattcaaaatcagcagtttagcatcttcaaatctctaattatgagctcctggttttgattttgttttgtttttgtttgtttgtttttgagacagagttttgctcttgatgcccaggatggagtgtaatggcatgatcttggctcactgcaacctctgcctccttggttcaagtgattctcctccctcagcctcccaagtagctgagattacaggcatgcaccagcacacccagataattttttttttaatagagatggggtttctccatgttggccaggctggtcttgaactcctgacatcagtggatccacccacctcagcctcccaaagtgctgggattacaggcttgagccactgtgccccgcctcccctttttttcttataaggaccctttgattacattcagcccactcagataatccaggagaattttcccatctcagtatatttacctcaaccacatgtgcaaagtacctcttgttaagtaaagtaacattcacaggttctagggattagggcatgaacatcttttgggaccaccggagtcaaatgttaaagtaattaagagttgttataggctaaagtgcttaactccctgatgtggtttggatttgtgtccccacccaaatctcatgttgaattgtaaaccccagtgttggaggtggggccagctgggaggtgattggatgaagcaggtggattctctccttgctattttgtgatagtgagggagttctcagaatacctagttgtttaaaagcgtgtagcagctccaccttcattctcttcctccagctccggcggtgtaagatgtgccttgcttcctcttcaccttcttccatgattgtaagttttctgaggcctccccagccactcttcctatacagcctgcagaactgtgagccaattaaacctcttttctttataaaatacccagtctcaggtattttattaaagcagtgtgagaatatctccacatttatatgttgaagtactaactccagtatctcagaatgtgactatatgaggaggtagaatctttacagaggtaatcatgataaactgcagtcatttgggtggatcttattcaatatgaatggtgtcttttttaaaaaaggaaatttgaacacagccatgtatagacagagaatgatgtgtaggcatagggagggggcagccatctgcaagctgaggagagagacctagaacagatctttccctcacagcccccagaaggaaccaaccctgttgacaccttgaggtcaaacttctattctccagaatggtgagaaattaaatttctgttgtttaagccacctagtctgtggtactttgttatggcagccctaggaaacaaatgcaacaatcaacagttggaagtttaggcaagaataatgtataatgtattcatttatacattataatgtgtatatttataatgtgtataatttataacgtattcatttatacattataatatttataatgtgttcattatattttgctgaaatatttacttaatatctgcatggccttaagaatgatataatggaatttggggattcagaggggaagactgggaggcaggtgaggaataaaagcctacatgttggggtacagtgtatactgctcaggtcactggtaaacagaaatctcaaaaatcactactaaagagcctatccatgcaaccaaaaaccacctgtaaccccagaactattgaaataaaaataaaaaataaatataactatcttcatggcctgaaaaccagagacatttcctgcattataagaacttgacattcttggccctttgaatgacagaggccaattttagtatgtgtgtaatacactatctctattaagagttctggttctgaaattaaacttcttggcatggtcacttactgactgtgtgaccctaggcaaattgcttcatctctctgtgcttcagtttattttctgtaaaatgggaagaagaaagaagggagatcagtttactagctcatatgactactttgcagactactaacatatgcaaagtatttataccagagcctgacaacaattatcactgaataaatgctataaattattatgggtggactgcatgctgggtacaaagattgtaaagtgctgacagtgctattgtttggacacacattgttaatcgttattaaaacaacctccagtctatcctctgatctccatatggcctcctccaatgcattctttcacagcctccagagagcttctataaatctgatcatgtcacatctccatttaaaaatcttcaaaagcacccatgttttataggatataatccaacaaaagcagagcctataaactccccagaatgtggtccctctctctctttttccctattgtctctgctctcacccaagaaggacattgaggtatttttaaagtgctcccacacgagaggcatttttggcctttttaaatttgtcctcttttgttacttattttttttatactttaagttctggggtacatgtgtagaacatgcaggtttgttacataggtatacacgtgccatgatggtttgctgcacccatcaacccatcatctacattaggtatttctcctaatgctatcccttccctagcccccaaccctctgacaagcctgggtgtgtgatgttccccttcctgtgttcctgtgttctcattgttcaactcctacttgtgagcgagaacatgtggtgtttggtttcctgttcttgtgttagtttgctgagaatgatggcttccagcgtcatccatgtccctgcaaaggacatgaactcaaccttttttatggctgcatagtatacttgttactaatttttatagggagctcttactcatcacctgctcccattttccccaacatcgtataatcttatggggtgaactgggctctgacaactgctttcagaaccttacctggactcccttctgttagcatccattgttttgcattgcaatcatttatttacttatcttcctgccccactagtcaggggcatccttgagaacagaaatgtatcctttatctccatgctgtgggtccctagtgcctactgaatgctctataaatattttctgaatatgagggtgagtaaaggagatacatgactaagtgaaatgcaacagacctttgatgaaccagtgaatcccaaccactacttattacactttctgctacgatcaaagggtccattttctgctcataccaaaagataaggccatggtgaggatgcagtaaggtaagggatggatcagaagacttacttgactacaggggattctaggcatctatgaatcctgatccataagatatcttgatttctctttattctcgtgttggcctcttgtttgaaaagagaattaataaagtgatcttcattgagaagaatagttcttttacaaatttaatcttaacaaaaccccatgcagtaagtagaattattcccattgttcaggagaggaaacagattctcagatagtaagtgcatcatctaacaacaaactactggtattagtggagcctgatttcgaagccatgttggtcacaaatatccatgttcttttactttttcttgccagtacactgttataggatattttttatgtttacttgcttatttcaacctgcttccctctctagcaaggttgctttttgtctttccttactcttggtaccaggtatcatttccaatcctgttcctgacctttattcataaataaaccccttgactcttggccacaagcatttccaccatattcctaaggaaatgggtacccactgaccagtgttggcttcatggctgtgcaatctgtatggtcccagagggctccaggctgaatgtgctgctgctgtcatcttaatatttataaaatctttaaaatatggggctgtatatttttattttgcaccaagtccttcaagttatattgccagttctgctggtgacacaggtagtcaagatcaccagcggagtaaatcaccacctacttgtggatttgaggagactttagatttcacagctgatctgctcttctgctttaaatgtcacaatcagaacttaaccaccctcaaattatcaccaatcagctccaaatacccacaggacaaccaaaagtcatcatttgcacatgaggtctcagatgtttagagtgagaaacaaacttaatagatcttctgcctggcttgcctttcccatggtttggcaggactcagtcacacagttaaatcagtctctgctcatgtcattcccttaaaaagcccatctctgatcactcattccaaaatagcaatctttgttattctcccccaaccctttgcttcattttgtttccacatcattagcattaagtacattgtacattggcatggtcacttctcatggctcactgtatccatgaactcctgggctcaagccatcctctggcctcagcctcccaagtagctgggactatagaaataaaacaatgtctatttatttttaaaaatgtattctctatctccccttcaccccaccaccactgcagatgctatgcattgctgcatccttcattcctggtacagagcctgacctacagtattcagaaacagatgctagataaacggccgctagttgaaaagtttctcatcactaatggagccatgctattcaaccagaaacagaggtctagggataggtggaacttgagggtggaggagagaaacaaacccttttggggggttcatcttggattctgagtatcttatatatgtccatcttcctccacaagaatttgtgtttttgatctaaaagttcatttctttgcctggactctaacgatgaggcatagggttgggcgtcagtcaagttatgctagtttacactatgataccaacccccaagatttcagtggtttaaaataacaaaggttttcttatttacaccaggtccaatttgtgaccaagtgctcccaggcatctgttcttcatgcggtggctgagctttgctgcttcagagcaacatgagctcccacaattgtggagcctgctgagggtggttggagatgggaatgctggtcattaattccctctgcccacagccacatacatcacttctgcttcatttgattggccagatgggtaggagagtgccatcctactct

SEQ ID NO: 553 - DNA, 20001 bp, Homo sapiens
catagcttaaggaagagatatttgtaaggaatgccaaaaaataacatttcctttagggtatgggaactcaacatgccatggaagatggggaactggtcaataaaaggaactgaggcatctattataagagaaaaatgttgtgatcaaagaaaatgtttgacaagaaataaaatttgatattcagatatgttagcagattaaacacaaagaggagacacagcaagaagacttggagttggagagaaaggccaacactttcatatagttctgttaggaactgatattgtataataaaataataactttaggaataggcatcaaggcttgaggtgaggatggagaaagtttgggaaaggcttttttgggaggatcatgagagacagatagtaggaagttgaaaggcaacacaaaggaaacaaccaaggttagatagcaagcaactacttgcaattaatgaaagtagaatttctgcaaacttctagcaatactatgtagcttgggagagaccaacgaagacagaaaatgcagttttctcagaactgtcgaatagcaaaaagtttgagattctaagttgtagtgaatgcatttttaaaagactactcaatttagtccaaaattgtggtatggaagcatgctgacttcaccactttcctcaaaaacaaacaaacaaacaaacaaaaacaggcccagtactgtggctcacgcctgtaatctcagcactttgggaggccaaggttagtggatcacctgaggtcaggagtttgagaccagcctgggcaacgtggtgaagccctgtctctactaaaaatacaaaaatttgctgggtgtggtggtacgtgcctgtattcccagctacttgggaggctgaggcaaaatcacttgaatcctggaagtggaggttgcagtgagccaagattgggccattgcactccagcctgggtgacaagagtgaaactctgtctcaaaacaagcaaacaaaaaactaaaaaacaaaaacaaacatacagtgctaagatcatcaacagaaatatcctagagctccaggaggctgaggcaggaaagttgcttgagcccacgaggtggaggttcagtgagccgggatcgtgccactgcactccacagtccagcctgggcgacagcgtgagacttcatctcaaaaaagaaaaagaaaataaataccctagaagttaaatatgaagatgagacattttccggaacttcagagaagtgaaaaaagccctgagccaatggtaaattaattggacttccgcatccataaaccccctcctctcattctgcccagcatcaaacacagagaaggttttttccaactcattttgtctacaatggaaaaagtgaaattgtggtggacaacaagcttcttcattatcctgggttccttggcaggaggtttgtccctaccttaacttacaggaagattgtgagtgcctgaaggaacaaatgtagacaaagggggaggtgggattaccatcctcactcctggcaactctgctctgtaacactgccagaggatccgccaaatcaaagttgttattcagcagcaccacactgtaggaggcataatccactgcatgaacctaggcatgaaccactgtcctgtcttcccacattgccagggtcttacctttgggatcttcctgattcaggaagggtgatactccaattgtttatgagagctgaggtgaacctgggcttaaggagccatcaagacccaaaaagtaggcagcaaccttgtggtaaagaacctctaagtaaacatactgagagaaaatcaaaacaaatcagagaagactgaaataaataactaatccctcaatgcaaagacatagacatagatccataagaaacaacagcaaacagggaaccgtgatctctctaaacagacaaagcaaggaatcagtaactgaccctcatgagagagtgataggtgagctctctgaccaagaattctaaatagcaattttaagaaaactcagtgatctccaagataacatagaaaatcaatttagaaatttatcagataaatttaacaaagacatttaaataataaaaaaaaacagaaattgctgaactgaaaaattcgttacagaccatcaacagcagaatatatcaacaagaggaaggaatcagtgtgcttgaatataggatatttaaaaatacatagtcaaaggagaaaaaagaagaaagaatgaaaaacagaaaaacaacaaagatcagctaccagatatagaaaattagctcaagagacaaaatttattgataatcaagtgggaattgaggaagagcaagaaacataaaccatatataaagaaatgataacagaaaagtctccaaaacatgatacagatatagctatccaggtacaggagggtcagagaataccagattgagcccaagtaagacctcctgaaggcatataataatcagactctcaaaggtcaagcacagagagcaaatcctaaaagcagcaaggaaaatgaagcaaataacataaaaaggagctccaatttgtctagcaacagatttctcaatataaaccatacaggccaggagggagaggaaaaatattttcaaagtgttcaaagaaaaagaaaactgccaccacgaatatcgtatccagcaaaattatccttcaaggatgaaggaaagatgacctttcccagacaaacaacacctgagagaattcactaccatcagacctgtcttgcaagaaatgctaaagagagttcttcaatctcaatgaaagaaaaaaaaaaaaactaatgtgaaaataaagagcttttgaaggtgcaaaacctgctgataatattaagtacataaatcgactcataataatactataataatagtttgcaatccacttataagtctagtataaagctcaaaagacaaatctatcaaaaacaataatagctacagaaaatcttaagagataggtaatataaaatatgtaaattgagacaacacaaagtcaaaatgtgggggaatgcagttaaagtgtataattttttatttttttcattcttttatttgtgataaagataagttgtcgtttctataaaaaataatttgttatgtttgttagcctcatggtaaccacaacacaaaacctatgcaattcaccaaaataaaaggcaagaaattaaaacatgctgccaaagaaaaataaccacaaagaaagacagtaagaaagaacaaatggaagaggggagttaaaacaactggaaatgccaacctaaatggcagtagtgagatcttacatattaataataacagtgaatgtaaatggactcagtcctccaattaaaaggtaaaatgtgactaattggataaagaaacaagacctaactatattctttctataagaaacagatgtcatatataaagatacacatagactgaaggtaaagggatgaataaagatattctacgacactggaaactgaaaaaaaaaagcaggagtagctgcactcatatcagataaaagagactacaaattagagactgggaaaggatacaaagaaggtcactatataatgatgaaaatatgtaacaattataaatatctgtgcacccaacaccagagccctcaagtatgtaaagaaactattaatagatctatagggagagatagactgcaacacaataatactaagggactgtaatatctcactttcagtaatgaacatatcatccagacaaaaggagcaacagagaaacatcagagttaaactacaaactggacttaattggcctcatggacatttatagaattcctgcagaatacacattctttttatcagcacatggaacattctccagaatagaccatatcctaggccacaagacaagtctcagcaaattccaaaaagcagaaatcatatcaagcatcttttctgaccacaatagattaaaactagaaagcaatcacaggaaccttggaaacttcacaaacacatggattgtaagcaacatgctcctgaatgactgatgagtcaatgaagaaattataaaggagattaaaaaattttgtgctacaaatgaaaacggaaatacaacataccaaaatctatgggatacagcaaaagctatagtaggagggaaagttctcaaaataaacacttgtatcagaaaagtaaaaagactttaaataaacagcatgaaaatgcaccacaaggaattagaatagcaagaacaaatcaaactcaaaattagtagaagaaaagaaataataaaaatcagagcagaaataagtgaaattgatactaaaaacaatatagaagatcaacaaaatgaaaagatgtctttttttgaaaaggaaaataaaatcaacaaacttttggctagactgattaaaaataaaaggagagaagacccaaataaataatctcagaagtgacaaaggagacataacaactgagccaacagagatacaaagaataatttaaaactattatcaataactatactccaccaaaacggaaaatctagaggaaatggatgaattcctggacacatgcacataataagatttaactatgaagaaatagaatgcatcaatgagccaacaatgagtatgaaagctgtaataaaaagacttccatcaaagaagagcccaggatctgatgtcttcactgctgaatctaccaaacattaaaaaaactaataccaattctacttaatgtcttaaaaaaacttgaagagataattattccaaactcattttatgaggccagccttatcatgatatcaaaactagacgaggataaaaatagatgcaaaattaatcaacaaaatactagaaaaacaaattcaacattacattaaaaaaattatgccctatgatcaattggaatttaccccagggatgcaaggatggttcagtatatgcaaatcaataaacatgatacatcacatcaacagtaacaagaacaaaaaacatatgattatttcaatagctgctgaaaaagcatttgataaattcaacatccctttatgatttaaaaaaaacccctcatcaaactgagtgtagaaggaacatacatcaagataataaaagccacatataacaaacccacagctaacattgtactgaatgaggaaaaactgaaagcctttcttgtaggatctggagcaaggcaaagatgcccacttttatcatttttatgcaccataatgctgaaagtcttggctggagcaattaggcaagggaaagacaagaaggacatccaaattgaaaaggaagaaaccaattaggcttgtatgcagaagacataatcttatgcttagaaaaacctaaagactctatcaacaaactgttataactggataaaggatttcatcaaagttgcaggatacaaaatcatcatacaaaaatcagtagcatttatatatgccaatagtgaacaatccgaaagagaaatcaagaaagcaatcacatttacaacacctacaaagaatataaaataccttggaatcaatttaaccaaagaggtaaaatatttatccaaggaaaactacaaaacattgatgaaagaaattaaagaagacacaaaaaaatgaaaagacattccatgctcataaattggaagaattaatattgttaaaatgacaatactacccaaagcaatttacagattcaatgcaattcccttaaaaatatcagtgacattcttcacagaaatagaaaaaaaaaaaagtcctaaaacgcatagggaaccaaaaaagactgaataaccaaagcaatcctcagcaacaataacaaagctggaggcgtcacactacttgacttcaaaattcactacgaagctacagtaaccaagctagcatagcactagcataaaaacagacgcataaaccaatggaacagaatagaggaaccagttgaaaatctatgcatttacagtgaactcatctttgatatagcaagtatattttctgaccagaatagagcagaacctcctctttatcatgagaggcaaataaatgatggtgggaaaactggacaactatatgcaaaaaaatgacactagaaccctatctctcaccatatataaaaataaaatgaaaacggatcaaatactcaaatgtaatacctgagactataaaactactagaaaaaaattgggaaaaggctccaggacattcatatggctaaataattattttgtgtaagacctcaaaagcacaggcaaccaaagcaaaaatatgcaaatggcatcacatcaatctacaaagttccttcacagtaaaggaaaaaaatcaacatagggaagagaaagcttaccatccgtgagcacctaggttgattccatttgctattgtgaatagtgctgcaaaagaccttaaacaattcaacaagcaagaaacaaataaccccattaaaaagtgggcaaaagacctcaacagacacttctcaaaattaggtatacaagcagccaacaaacataggaaaatattttcaacgtcactaatcactagagaaatgccaatcaaaatcgtaataagatcccatctcacaatagtcagaatggctactattaaaaagtcaagaaacaacagatgctggcaaggctgtggagaaaagggaacacctatacactcttagtaggagtgcaagttatttcagccactgtggaaagcagtttggagatttctcaaacaacttaaaacagaacattagcctgtaatcctagcactctgggaggccgaggtgggcggatcacgaggtcaggagatcgagaccatcctggccaacatggtgaaacccagtctctactaaaagtacaaaaattagctgggtgtggtggcatgggcctgtaatcccagctactcaggaggctgaggcaggagaatcgcttgaacctgggcggtggagattgcagtgagccgaggtcacaccactgcactccagcctggcaacagcatgagattctgtctcaaataaataaataaataaaacaaaaacaaaaacaaacaaacaaacaaaaaacccagaacattagacccagcaatcccattactatttatatatccaaaagtttgaatatacacttgtcaaaagaagacatagaaactgctaagaagtatacagaaaatgttaaacatcattaattatcagagaaatgcaaattgaaactacaataagatatcatcccaccccagttaaaatggcttttataaaaaagacaggcaatatcagatgctgacaaggatgtggaaaaaggggaaccctcatacactattgatgggattggagattagttgagcctccactatagagaacagtatggagattcctcaaaaaacaaaaaaaatagaactaccatttgttccagaagtcccactgcttggtatatatccaaaagaaagaaagtcattatattgaagagatatctacactcccatgtttattgcagcactattcacgatagccaaaacgaatccaccaaagtgcccatcgacagatgaatggataaagaaaacgtggtacacatacacaatggaatactattcagctataaaaaggaataagatcctgttcgggtgcagtggctcaagcctgtaatcccagcactttgggaggccgaggcgggcagatcacctgaagttgggagtttgagaccagcctgacaaacatggagaaaccccgtctcaactaaaaaaaatataaaattagccaggcatggtggtgcatgcctgtagtcccagctacgcaggagactgagacagcagaattgcttgaaccaggaaggcggaggttgcggtgagcaaagatcttgccattgcactccagcctgggcaacaagagtgaaactccatctcaaaaaataaaaaataatcctgtcacttgcaacagtatgggggaaactggaggtcattatgttcagtgaaacaagctcaacacagaaaaataaatactgcatgttttcacttgcacatggaagctaaaaagtgaatctcatgaagatggagagtaaggttaattaatgggtacaaatgtatgatttaatagaagaaataagaccttcttatttgtttgatagcacagtagggtgactatagttaacaataatctattgtatatttttaaatagctggagaataatttaaattgttctagcatgaagagaagacaattatgtaaggtgatggatatatcaagtacactgatttgatcattcccaattatatgattgtattaagctatcacatgtacccaaaataatgtgcatttattatgcatcaataaaaaataaaaagaataatacacaagaaaaataaacttgattttaaaacatataggaaatgatattattccaaaacaaacctactccatatcttcatgtgactaatatccaacaaattgtagagctctttaaaaataagatttttactttactttactgtggtttttttagagacagagtatctttctctcttccagtctggagtgtggagttcagtggctcaatggtagctcactgcagtcttgaactcctgggctcaagtggtccttctgcctcagccttccaagcactgggaccacaggcgcaggttaccacacccagataattaaattttttgttgttgttatttaggagctggggggcctccctttgttgcccaggcttgtctccaactcctggctttaagcaatcctcctgcctcagcctcccaaagtgttgattgagattacaagcatgagccaccatgccttgccaaaagtgtttttaaataactaaaatgttttctagagaaatgtacacttcagcctttactgatatatacatcagtaagaaatgtttacatagagcagtaaattcattacatagccttacatgcaaaagttgaaaataattagaatattctatatgtactgctcacatggaaagatctttaaacataatgttattagaaaacaacaaattatagaaccataagtgggtttttctctcattctttaaccaaggtaaataaatatgtattcagatgaaaaaaaggcatttggatcttaaatattaaaataaaagcttcagtgacagaagctctgtcattcccaaatgtgtggcttctttcctttcgcctcaacttctttgcatctcttcacctctttccctagaaagttacggttttgctaggcaaaaccgtaacttgatcaaacctaactttctgctgacattatacttggactcaaatagctgtggttggtataaaagtaattgcaggctcttccattgaaagtaatggcaaaaccgctattacttttgcaccaaccttataaatattactggagaaagtttcacaatgatgcaaatattttcatgtaatttaaatgtgccaaagaacttcaacattgtcagacaatttgctacattttctgacaattttttttgcttattctccaagttaaccattttatgatattttcttttcaaactacaaaatacctgtctcatcttcttaaattcaggtatcatattctgtatcaatttaagagagaagatatatacaattaggagataattactttatcatcccctgttgaacccctatcatcttcctaacttcatcgtactacagctaatacagataatagataatgcaaagttgtttttcactgaaagaaacaaaatctctgcattaaactggcttaaacagtaagaaagttaagtaagaagtaagaagtaaagaaattatttattctcataattggagtcatgtagttggagaacacattattcagtactcagctgcagattaaattaaagaaacaacaataatgctcaggctagtgtaaaaataaagggatttaatacaagaaattgaattctcagaaaatattaaaaggcctggtgacagaaactgtaggttgagtttccaacaatatctccctgaccacataactagtcttccagggatgctgctacctctgctgccgtctgaaagtggagactcagaatacttgtctatccaatagcgttccagaacaatatcatttctattgttccccactgttccctagggctgccttaacaaattatcacaaactgggtggcttaaaacaataggaatttattctttcataatttagcaaatgaaaatctggagtcaaggtgtcagcagggttggttccttctggaggctctgaggaggctctgaggggcccagagaaggctggtccatgcctctctcctactttctagtggtatccagcaagcctttctgttccttggcttgcagacatatcactccagtctctgcctccatcttcacattgccttctccactgtgtttctctctgtccttttttgtttctttgtaaggatactcttacatattatgagggtttgtgtggatgtgaattttgggaggacactgtaagactattttatgtcttatttctttcctctgaacatccatgtagttagaaacccagtattaggctttcagttagtgctgccacagaatctaaaagctcactgaagttattagtttacataataatgctgtgttacaaactaccccaaaattcagtggattaaaacaaccatttattattgctcaagggtctatgggtgggctgggcagaactactgatctggattgatcttggttggacactgatgtctgggtctgttgggagctgtttcatctgggatggccctctgggatgactaactctcaccatcagtcttatgtccagcaggctagtccagatgtattatcatggtgatcacaaagattcaaaagacagcgcaaaagcaagtaatgcctctgaagcatagctttagaatgggcactcatcctttctgcagcattttattgaccaaagaaagccacaagacaagtacagattcaagggatggataaacaaactccaaacttgatgcgggggggaattcattagagacactggaggggttatagggaaaggtgaagaatggggaccattttgcaatcagcctgtattagtccattttcacactgctataaagatactacccaataaacatacgtgtgcatgtgtctttatagaagaataatttataattctctgggtatacaccagtaatgggattgctgggtcaaatggtatttctggttctagatctttgaggaatcgccacactgtcttcagcggtttaactaatttacactcccaccaacagtgtaaaaatgttcctatttctccacagcctcatcagcatttgttgtttcctgactttttagtaatcaccatcatgactggcatgagatggtatctcattgtggatttgcatttctctaatgaccagtgatgatgatcttttttgcatgtgtttcttggccaggtaaatgtcttcttttgagtggcagccataagaagctatcattctcagcaaactaacacaggaacagaaaaccaaacaccacatgttctcactcataagtgggagttgaacgatgaaaacacatggacacagagaggagaacatcacacattgtggcctgctaagggtagggggcaaggggagggagatccttaggataaatacctaatgcatgcggggcttaaaacttagatgggttgataggtgtagcaaaccaccatggcacatttatacctatgtaacaaacctgaacgttctgcacatgtatcctagagcttaaagtaaaattttaaaaaaagaagaagaagaagatattacccaagactgggtaatttataaaggaaagaggtttgattgacttacagttccacatggctggagaggcctcaggaaacttacaatcatggtggaacgtgaacgggaagcacagatcacacgatggcaggagagagaagaatgaaagaggaacgtccaaacacttataaagccatcagatctcatgagaactcactcactatcatgagaacagcaaaggggaaactgcccacatgatccaatcacctcattgtctcgagttgtgggattacagtttcctccctagacccacggggattacaattcaagatgagatttgggtggggtcacagagccaaactatatcacaacatccagctttttagagaaaaacagcagaaattattgaaaatccagattccacctaatttataaatttttaatttgtaaataaatgtattaacttcataaattcaatcccatatggaatccatgtttaaagaaaatatgaaaaccacacacagagatctatctatctacctatcatctatctatcatctgtcttcgtctctctatccatctactatctatctatctttcatctatctatctccacctactttagaacctggagaattggagttgaataagtcaaattttaatatccgctataggcgagattcagggatggttgatacctctcagtgatcagaatatttactttattctctatctggtagtaaaactactccaacagttaaggcataatgcatatatgacaacattcattgaaagaagcgtgtgcctctaatcttgaagattaaagttaaaattagacaagtattttcccaaagggatcttaacttaatttctctgaaaccgcctcttgtcatagttaccaacaagctccaccacacaaaatcaaatggttaattttttatccacttctttcttcctgaaatatttttctcccatggccttttcacaaagatcaaataaattaatattcataaaaattagaatagtgtctggcacataataagtgccatatgttcataatcatagtaataataattatgatgattactattattattatcattgttatctagccacttggttttaaatatagctagtcctgttgttaatgcttgttttgggaacacaattttttttaatgagggctatctattaggaaacaatttgagtacaatgtaaatttcacccaagaataatgctaggctaatgtagaaaactgtaatcagttgagctaagccatataggacagacatacacatatctcatgaggacaatgagctactctcatctacatctgttgttacaacgttccttccaatttcagataactttccttgtaccacaccacaataatatacaagttacaacctttcctgaggccaccctggccagatgactctacttctcttttcaaaaattgttctctctttcctcttatcctactttttttcttctctatcctctgttttattttatttttcttttgtttcattattttctatatgtcttctgttgtccttttgcacacagtaagcaaattccttaagcaaattccacaagcaaacttttgcacccctcctaggctgattgattccagacatcaatatacacatcactttcatacttattaatatccatctctcttctcaacatatttacttaaatttcatcaaaggatgtatctttattttccccataaacttaggtgtcccatgttttcccactactgccaataccatcacctgtaacccagttgttcagcccaaaatccattttttgtcttaatttttcacttttctttatctttacgtcaaatttttccaaaactcctttggtcatacctttaaaatatacccataactcaactatttcaaaccattttaacttctaagaccagttataaccaccatcaactcttagataactgaaagtagtctcttaattggttgcactgctttctttattgccatctcactctgatacccgccccattaatctattttgcacacagcaatgggagtaatcttttacagttagatcattttattcccctgcttaaaatcttccaaaggacttgcaatccacatcaaataaaattcaatcaacttaaatagtttatgttcccacctattcttactacctttctaatgctatatcctactcttctttccctccttaactaagactcaggaaaacagaccttctggctctttgtagaaatgtgaataactctctatgacagaagggaagaatgggacaaagcaaggtctgtcattgttaagaaagcagcaactactaatcccagcactttgggacgccaaggcaggcggatcaccggaggtcaggagttcgagaacagcctggcaaatatggtaaaactccgtctctactaaatatacaaaaattagccgggcgtggtagcaggcgcctgtagccccagctactcgggaggctgaggcagaagaattgcttgaacccaggaggcggatgttgcggtgagccgaaattgtgctgttgcactccagtctgagcgacagattaagactccgtcaaaagaaagaaagaaaggaagggagggagggagggaaggaaggagcaactatcttaaaagaaggaaatgctacttatttttgtgctttcgttctggccatgtccgtttcctgttagaaacatgtattgttggcccctctgtgtttgttggaaacactgttcatgttatcttaagaacattgtgattggaatagcagtagggtctactttccttttctcacgtctttagagaggcagtctgagactagaaagtcgtgcatgatcttaatcattctagattccttttaccctgcttatttgtttcctaacattaactgaagtagtcttgtttattttgccatttgacttgtttctgtcttttccaaagaaatgtaagtcccgtgatagcagcaactcgtttgctgttttattccaccattgagaatactgccgaacgtctaagaagtacttaataaatattaagtggagaaatgaatatatggcagcctcttttgtggatccaggactagtattaagtcatgtggctcacttcctcaaaagtttcatgacatttaaagattctgtctcccaagacttgaacatcatagttcctggaatccagaagtgggtcagggagttgggcatgagctgctgcttctcagtttctacacctggatctttaacttctcccgtcccgctcattaagctttactgggctcctccatcactggagctgtaggaagagcaaaatacagatttttactggtttcataagaatcttgaaattagtagaatggctgttattaaaaagtcaaaaatagatgctggtgaggttgtggagaaaagggaacgcttatataccgctgatgggaatgtgaattagttctgccactgtggaaaggagtttgacgatttctcagaaaacttaaaacagagctgttatttgacccagcaatctcattactgggtatgtacccaaaggaatataaattgttctgttataaagacatatgaatatgtgcactcattgcagcactatttgcgataggaaagacatggaatcaacctaaatgaccatcagtggtagactggataaaggaaatgtggcctatatacaccacacaatactaggaagccataaaaaagaatgaaatcatgtcctctgctgcaacatggatggagctgggggccattatccaaagtgcattaaagcaacaacaacaacaaaaccaaatacggcacattctcacttagagatgggagctagacattgaatacacatggacacagacaggaacgagagacactggggcctagttgatggtggaatatgggaggagggtgagggttaaaaagctacctctcggatactatgctcgttacctgagtgatgaaataatctgtacaccaaacccctgcaacatgcaatttacctatgtaacaaactgcacatgtactccctgaatctaaagtcagaaaggaaaaaaaaatcttgtgtagtgcattctcagttaagcagatttaaaaggttaatttattctctaatggggttcttttctgggttgtttggagaccacccaagggactctcttatgcaaagttccactgatgtagaaatacacagctgctggacacttaccactttccactcatccccttggcttctagtgggttatttctctgttgtgctcatttcgtgtccttatactattcttttgtccttgtgggctgggattctcttgagaggtgacaacatgttagcagcccttgcttcttctctgcgtctcctcggccttggcgtctgctctggccacgcttgaagagcccttcagcacgcggctgcactgtggaggcccctctctggggctggccaaggctggagccagctccctctgctgcagggaggtgtggagggagaggtgcgggtgggagctggggctgaggccatacagccggccagcgcctgctgggcttgatcagaggctgggtcccatgcgtggaccgccattccctcttcccgggatggctggccaccatagcaagtctccatctctttctcgctacctctcttttcctcctgattgtctgggacgagctccctctgggctgtcgcagtgcccaggctaggtgccgcaaagtcccgtggggagtgccagtgagaggtgaagccagctaggcttctggaacaggtggggacttggagaacttttctgtctagctaaaggattgtaaatgcaccaatcagcactttgtgtctagctaaaggtttgtaaacgcaccaatcagcatgctgtcaaaacggaccaatcagctgtctgtaaaatggaccaatcagcaggatgtgggtggggccagataagggaataaaagcaggccacccgagccagtagagagaatctgctgaggtctccttctatgctgtggaagtttttttttttttgctatgtgttgtgggaggtttgttctttcacttttgctgctgctgctcactctttgggtcagtgccacctttatgagctgtaacactcactgcgaaggtctgcagcttcactcctgaagtcagcaaaaccatgaacccaccagtaggaagaaactccggacacgtccagacatcagaaggaacaaactctggacacaccatctttaagaactataacactcactgcaagggtcagtggcttcattcttgaggtcagggagaccaagaacccacgaattcccgacacactctcaggaccattccatctggcttcctttttcggaacctaactacatacatgccattgtcctaccaaacacttgaaagcattagccatacttaagatttcttttcttcttactcagccaacaggcagaggatattccagccaaagtctctagcttttagactattccaggtaggtgaaaatcagaaacctagctgtatgtttctctatctccagggaaccacctaaaactctccaattttttttttcagtctgcatcacctggattgaaatgagcgggagagagggaactgttctttcttcctctctgtgggcagaaggtaatggggaaagccagaatgtaccaacaagtctttccttatctctggacctttcaaattccaaggaatgtttttctcctcacatatagtcttagggttagaggtagttgcaggctgaatgagtaaccctatcttttagcaagtctggctagatagattggaaacttgactgagaatgtaggacttaaaaatattgtctcctattttgagccgtttccaaacatctgagatgacaggaaaatgttttttttatttatttacttatttattgtttgagacataacctcgcactgtcgccaggctggagtgcagtggtgcaaccttggctcactgcgacctccacctcccgggttcaagcgattctcttgtcgcagcctcccgggttgctgggaccacaggcgcacaccaccacgaccagctaatttttgtatttttagtagagacggggatttatcatgttggccacggtggtcttgatttcttgacctcatgatccgcctgccttggcctctcaaagtgttgggactacaggcatgagccaccgagcccagccaaaatgttacttttaacattctgttacatacataaatattcagaagtgctacagttgttaagttttaactggaacttattgattcatataattgtgaggcagacaggtaattctggtttccattacagttggctcaaatgatctcaacagcccccctctctctctgtctcattaattgctgttctcatttttttctctttctcttacttaggagattctgttttctgatggaaattgtctcatattattaacataaataaggtttgggcaagaaaaatggataaatcatgaaattttatggtcttaacaaggtataaaacaccgcttgactaccaacaattgtcattggtttaatatcccattaactagaatagactaggttcctgcattatttattccattgattttgttgaaaagataatgtacatcttcagcaactatatgcattaacaagagaatggtaaggtatatttaatagtggaaactatattagtacacgtattattattgcaaaatgcaaaaagaaattgagttataaatctgccctgctgctctgtatataattatttctactgggattctcataatattgtacacatatatttgctgaccttctagacaaagaaatacattctgtgatatgtgaaatatattgtaacccagaagtggaatgttttccctagtgagggttcatttaaataattttatcatcaccatggtgggtttttttgtttgttttttttacaacacagtctgtggttcacagcatcggtgaccatagtccctaaagtgagataaaatgtgttagagaagaaatgaacacctgctggagttacttttgttttgactagaggcagtttgatattcagctagagagaggcatatgcaagggaaaggatgtatacagtgattaaaaccatgtttttttgccagtgggggttctatacacgttttatcactgtttctggaggcaaaacaagaaggtgtgtatccctttgtatcccagggccacaccattaatctcatccagaatgaagacagaaggtctcagtatgtggtgcccatagaacagatatattttaatagaccagagcttgatgctatcacaaacaccagcatttgccaagtttaacgtgaaataaactctactcttgcaaataagtgaaatagaataaaatataaaaaacatctgttttcaaattattttaaagttataaatgaaatgagacacttcctggctcagtcaacttgtttttatgagttaatgggctgtgatgccagttttcttttaatactaaaatccattttaaggtggttcttacagcctttagcgaaatgatggttctccagagagaaattttttttttttttaaatttctgtgatgcctacttgctcacaaatagtgcatggggtttggcacatatatgagcacctaggtatgtataatgaattgtttgagagagatattagtgggttatcatttagcccatagccaatactgggaatctggtggaagggagtaactttttagaaagaccacttttggggctccaactgcttggtttacaaaatcttatttatttgtcttttatgttattcatttattattattattagtgactatttccctctttttctccatctcaaaaacaacaacaacaaagaaatatgtgttcatgaaaagcttttagtaactaaaaatgattagttaaatttaaaaaacaaagttttgtaagaactgggatacgacccaaaaaactgttagatcaaaatacatcagttttaaaatacctataaaggagcaggagatccaaaagccatcgagatgcaccctttctcaactttgtagtccctctttcttcatttattgctgcaccacagacgttttggagttcagggaattcagaaaatcccaccctaaacatgccactttggcatattgattgttttaaattgaagaaacttcaaaaaaatagcagatgcagaatgggcattttgaccttaaaagcaagagataaaactcccacatagaagaggtgccctctctgtaccttaaggaagaaagacgttcttattttgagaaagggcagtcaaaacccagagaaatctgtacaagcaaactttgttcaaataatccttatattcc

SEQ ID NO: 554 - DNA, 40001 bp, Homo sapiens
ctcaaaagactcaatctgcagttttccataatccaatctccgatgtgatttgccattgcttctgccttatgctattggacacccggatcaactgtggtttgcaataggcgtctttaacgtattatatgcttaatatcaatattgttccatttcatgtaaactgttagaacatgatatgtcttccttcagcctgaagatctcatttgaacatttttctttagcattcagatttattggggatacatttatctttgaattgtcaggaaatatgtttgttttactttctctttaaagaataatcttgtcaggcattgatttctagattggcagtgattttattgtttttgcttgttagtttttcttttagcactttaaaaatcctatttatttgtcatctggcctccactgtttctgaggagttatcatttgtatcactgttctctatgtaatgtgacttttttattctggcaacatttaagcttttctctttactcctggtttataaggtaaactataatatgtgttttgtcattgttatcctatttagatttcactgactataaaaatgtattaatgttttctaccaatataggaaattttcagttatcagtttttttcaaatgttagattaggacaacctttattgacctgttttccttcaatttacattttgctattaaatctatcccataaatactcatttcagatatatactacttacttcttgaatttatactggtttctaatttatttatttatatttgctttattgttttctgaaattccccatctgttcactcatattatctttccttaggagttttaaacgtgtttaaaatagatattttaaattctttaaccattaatttcaatatttcagttcccagagagtctgtatcaatttaactaaaagaattatttttatgtaacatttttctgcttcttcacataactcataaattttgtttcatgatgcacattttaaaaaatgctttattgaggtatgattgacatatgaaaaattatacccgtttaacatttacaatttgatgagcttggagataagtatatacccctgaaatctgtaaatttgcaagttacatcgaatagttttatactcacatttaatagtgttgaattttcttctcgcaggcagcttaattaatagcagatcttcttgatcattttaggtttaatttattatttgttacagctgatgtattttttattttctcttggtcttagagcatattatttactatagagtacagttctgaccacttattctttctgaagtctcagctaagtgaccaagttctttggtgaagtttgcctaccatgattgagccagaattccaacattttcctgttctgctcactgtgttgtgtctctattccgctctcagtgctgtggcagctactctgctatacgttatgaaaattcaccttgcatatgctggatcaatcatggaccagggccgtgcagacttttgagtcctcattttgctcgtttttttcttttctgcctcatcagttgaagctacgtaagcagcacagaattctgatttctgccttctctactaagtgaaagcactttgttttgcttgctctccactttcccctagaatgtgactccaggcagaaagccagggaaaatgtgagtctcacgttacatttttcccttctgtcaagaacagcagtccttcactggctattgtttaatatctgaaaagagtatctcctatatattgtgtattgttttacaattgtttaaggtgaagggatagtccagtataagttattttaccatgatctaaattgtgctctatatattacttgttgaaagaatacattcattaaaatttagaatgtgtaaatgaatgtaataaaattttcatacatattgttgattgaacataacattcatagctaggtataatctattgcttgaatagttgtacaaagattctgaaaccattgagcaagtcgacttatggtacatgatttggctactttccctgtttttcctacagattcttcgtgtcccaaaatgttcacatagtcatagttatcaataagttattgtaatttggtagctatgtaacaacttccaataaaaaattattacctccaaacttgaattctgtttagaaaatgcactaaaagatagatattgttgctggcaatgtggctcacgtctgtaatctccgcactttgggaggccgaggtgggtagatcacgacgtcaggagtttgagaccagccgggccaacatggtgaaaccctgtctctactaaaaatacaaaaaaattagcctggcgttttggtgcatgctacttgggtggctgaggcaggagagtcgcttgaacctgggaggtggaggttgcagtgagccgagattgcaccactgcactccagcctgggtgtcagagcgagactctgtctccaaaaaaaaaaaaaacagataagtgttgttttataataagtatattgaaaattagcgataacaattacacattccattcattttaaccatttcaggattctattatttaattaaggagtataaaaatagtttaattttgcattccattaaaaacttgtttacagtttaacataataatatacagtaattgtagttcagctaattatatgtgatcttttttgtaaataaaacataattttatgattttatgagcaatgaatttaatgataatatttgaaattcatcattttttttctatttctccagttaattctagttcgtacaagtaaactttaggcatgatgatcactgagatctagaaaaatgtaaaaatggacattaaatgtgagacctaatcaataattaagctacacaaagggaaacaagacaatttattctgacaggcaatattacctatctcccagctcaccttgtcctgtcagaagaaccttcatcccaatgactttatttcaaacgtattgcttttgaaataacagcagggatttctaggctcctcagtatctcttgtttaccatctagtgtcatgcttaatgatcaacattaaagttattgcttccaaaccaccttaattagggttgcaaagctttaaaaagttcctttcaaaagcttagatcatcaaattagattgccctcatatattctgattatataatgaggttcttgtagtgaaacatcataatcaaatttctaatcagacatcctgcagttcctttgtaaggtaaattttcctacccgcagtacttcctgtgggtgcattgagtccttggctctccaggtcatacttgattgaaccagacacaagtaagtaatgcagagcccatgtgtatgggatggcctaccacatgatgctgtgcccaaaccgaggtaatctcgtgtaataagattttccttcaactctcttaattagggattagagagtattgtttggtataagtggtcttacagtttttttaaaaaagtaaatgccttattaaagtaaaacatacacaaaaatagcacatgaattatgtacacagcttgataaagttacacaaagtgaaccgaccataagtttccttgtgatatttcctggtcagtaacaactcagcaaggtaactattataccaacttctaaaattgtaaattaccagaaattatttttgtttctaaaagtattctttaaaaatagagttatgtattacttatttgaacctgacttcctttgcttaaaatgttaatatgatgcttgctagattcatctaagttgttgactgtactaatggtatagttatatttatttaatttctaccatttcactttatgggcattccaaaattcatgatttttttgatgaacttaatatacatttatagttttgatgcttacactgttctgctacagaaattctaatatgtgtcatttgatatgtagtctaatggacagagaagtttgatagaatttctacttaataggttatatatacctattcagctagagtaattactgcctgaattagtttttttattgctgctataataaattaccattaactaattagttaaaaataacacatgctttttttctcttagtgtttaggaggtcaaagtctaaaagcaaggtgttggtaaggctgcattccttctagaggtttcaggggagaattgtttccttgcctttttcagcatctaaaggatgtctgcattctatggctcatggactcctcttaatatcactccaacttcttggtcccattatcacatatactaccatttctgatcccactaccttcctcttataaagactcttgtgattacattgggctcacccagataatctgagataatctccccatctcaaagtcgttaacttgatcacatttgcaaagtcccatttgccatgtaagataacatatgaaatgttctgaggattaaaacactattctgccaactacaatgatgaaggaaatatgaggaggaatactagatcttaggttgcaatgattttgaagactttttgaatataggcacgggaagcactgacctgctgtggcctggacttccatggttccttttttgaaatactagaagataagaatcattgatagccatcttagaatcgttctgccactatgtacatgtgtatgaatgtgttctcttgtgtgtgtgtgtgtgtatgtatgtatgtgtgagatatggttagtgcaaaagttgttgtggtctttgccattaaaagtaatgcaaaaactgcaaatactttttcatcaacttagtagttgttttcagtaggtctcataaatgtcttagaataaatttcttacaatggctgggcacggtggctcaagcctgtaatcctagcactttgggaggctgaggcaggtggatcactcgaggccaggagttcgagaccagcttggccaacatggtgaaaccccatctctaacataaatacaaaaaaaattagccaggtgtgagggcatgtgcctgtaatcctagctactcgggaggctgaggtgggagaatctgttgaacccagaaggcggaggttgcagtgagccgagattgcaccactatactccagcccagttgacagaacaagactccatctgaaaaaaaaaaaaagaataaatttcttgcaataactgaatttacatcccatgaactaagaggtataaactaagaccaaataacatagataaagactataagattgattaagccattttcagaaataatgtattagtagatgtaaatccccaaagtgtaaagatgtctcttaattattacatttagttctcaggttcatgactgtttactctaaaattcccttttgtgaatagaaagtttatcactataataaaatcatactgcaaagcaattaatcaaaatacatagccttgggaaactctgaggtgtgggaaatgattaaaaagtaacataaagtttacgtttatttttaaaatgcagatttaatctttgttaaagtattatttgccctatggatatttttagcatactcaaaaacctaacttaggttcattaattttatattggtaacatgtcattgcactttgtctctcaatttgatttgctttagatatttttagtgaattgaattccagactaaagatagtcagatattagtatatgtagtcagcagggcaaatgtaggccaggttgaaggtatttgctatattaaaccatatacatttcatttttaataacaagttaaataacccatttcactatcatcccacagatgttacgtcatggttgacttcatttgcacaaaactatttctttatatttttggaaactaaaagaaaattgtggttatccctttcatcagttatattcagtgtttgtatctgagaattattgtgtcttaaggaagtcatttgtactacatcattccaagaaaaagccatgcttcttctgagtttctggcttactaccagaaggaatttgttctgttctaattctgtagtaaaaaatgttgaaatgagctctcaagcggttatatattaaagtttctcacattttagtacattaattgccacattaaagtgtggtattgatctaacattttatatactgatacttaatgaattcaattatcaactttaagaaatatctgtgagtttttaaataaaagttatgtttcattgtctttttagagtattaatataacacaggtctatttaagatctattttagtgcagttcaccaaatgttaagtggaaaaaatacttcattttgcaatttattttaaaaagaaacttctactccagcacttctattagagtggcttagggtaaactgaacaaagttttgaaagacaataacaccattattcatcaatttccaatttttattcccttctgtaaacatagaggtctacactggtttctactttcagaatggctcagtaagttcttagtaggccaatactcttgtagataactatagtataaatgctagaaaaatataacaaactacctacaggctttggaatgtaatcaaaaggagacagattctagaaaaaggtagaaacgggaagggatcagcatgtggtataatctccccactttctttctatgtttcgttttcttttgctatgcctgtggacatgctgcagttatcctttgttttgtggccacaactttgctgactcacagtctttttgaactgaagaggaatagaacagaaattagggcaaccacttccatcagaatgtatggtgagaaccctagaaaacagagaggagaggaagaaaaacctctgtgtagaaacgttatacaaatatctgactgaccctagtgccatctttgcagactgaaaacaacccatctaaaataaataaatgactgaacaaatatacgagtttctgtagaaaacataaatttttcagtttatgtacaaccaagttaattgcctgttaaaacaaaaatgtcaatgctccagggagagaaatggagtataatctaaagtttccacaacgtaacattcaggatacaagcaaattattacttaacatgtgaagagccaggcaaatgtaactcattttcaagagaaaatagaataatggaaatcaatctttacattttcgaattatcacaaaatggaattcaaaacagctgtataattattctcaatgagataaagaaaaatgctcttgtaatcagtgagaagatgggaaacatggacaaaagaacttgaaaacataaaagtatatgaaaattctaaaactgaaagttataatatagcttaactataaacaatactgcataggcttaatagcagaatggaaatgtcagaagaaataatcagcaaacttgatgatagttcaataaaaacaaaggataaaagattgaaaacaaatggagcagcagcaagctatagaacaatatcaaaaattccaatatgtgtgtaatttgagttccgtagaaagagagaaagagaatgggtcagaaaagaaatgttgaccccaaattttcaaaattttataaaaacataagtctatatattccagaatgttagaaaacatcaagaagtataaatgtgaaggaaaccatgcgcaggtccattatactaaaatactggaaagcgaagactaattaaaagtcttgaacttatccgaagaaagattacattatatactggagaagcactattctaacgagaaccgatttctcatcattaacaatagaggccagaaaatggtgaggaaacatctttaaagtattgaaagaaataaattctaatctcacgatttaatgtctggcagaaaaaatatcctttaaaaatggaaataaataaaagcattttcaggtaaacgaaaataaggatttgtggccaggagatctgcaatataaaaaatactgaaaactgtttttcatgttgaaggaaaatgatgatggtgcgaaactttgatatttatgaaggaataagtagtatcagctctgggaaagagctggtaaattaaaaatatattttcctctggatttcattataatatctatgttgacatagaacaatgaatataatattttcagtgatattttacatcatatcctaaccataaagaagaatttggattggggcagggatggtaaatgtacctttatagtttcaagttcacttatattccaagaaaactgagaaaagttaaaaatatgtatagtaatctctggattaaaactaatgtaaataggtacagttaaaaggccaatcaataaagtttactttaaaagatattcaaataatttgaaaaatgaaataagaaactaatttcttaaaaaaagacagaacacaaactgaaaggtctaaatccaaaaatttcttcaattttattagtgttattaaactcagtattcaaattagaagacagagtttttcaaaataggtaaaagaacaaaaaaatctgtatttcagccttgcttgaaattgcataaaattttggcaaattctgtaccaaaaaaatgttagcagatgtaatgtagataactctgaactgaggcagtaagatcagttatccaggtttttgcctctcttgccaaggagatagtggagaatgcccaagaaggaaacactgaagttactcagcttggattgttaagtctctgcatggaagaattgctctcaagaattgcacagatccagagcagaatttacaagagcaatagataaccatttgctttgcttgatattgttcattagcatagagtagcatagtctagattattctaatcaagagaaaaccaagtccctgctacttagaaattagcaacattgtttatgtaatatatgagtatttattatgagtttgtcgattaagataatttgcattatgggactactagtactggctacatgtataacttggataagagtaagatctcaggaacatatgacatctaattaatattaaaatatacttattacaaagtatttaaaggtttgccatgttacaaaagaaaagagacaacaataacataaaaattagtaagttaagagccatatatacatatatgtgatttttaaatgtacgctactggattaaatccatgtatctacaaatatttgggatcttaatttttacagttttaaactggatgtatcttcttgaaagaccactttttttccagaatcatgaattcttaaagtgatgattatccattgaacggaaagaagattgttggtaaagtatgaagtatgagcatgcttgacctatgagcatttatgctatcaggatgaaagcaacattaaaatggattacatataacagaaatgaagatagatatgggctaaatggtatattatagttcaaaacagtacacactacatagtaatagtattaaaattgcttttcagggaataatgaaaaaagtgaaaagaaagaagacataatatagtatttttttataataaagttacaaagatgtgttatagtaaaattaaagaaatggaaaccctaaagttatagtaatttatctacactacaaattcaaataatatatgtgaacaaaatgaatacaaagcaactgagatgaaaatgtttaaattgctaatatagaaatagaagaaaaaattcaatataatttttttctttaatatttatcgatttcttcatttcttgaacaaaatagtttaaacagaatgtatgtaaaatagctgcttaaaattaattaatgcattctataataaattctttaaaattgttaattcctaaagcagttaagactgtttataaatatagttctaaacgtgcaataataaggtatatttcgtttatgcaaaaattacctataccttaaaagaaataatacaacaggaggccgggcgcggaggctcattcctgtaatcccagcactttgggaggtcgaggccagaggatcacgaggtcaggagatcgagaccatcctggctaagacagtgaaacgccgtctctactaaaaatacaaaaaattagccgggcgtgatgacgggcacctgtagtcccatctacgcgggagactgaggcaggagaatggcatgaacccaggaggcggagcttgcagtgagccgagatcgtgccactgccctccagcctaggcaacagagcgagactccatgccaaaaataaaaaagaaataatacaacaggagatgatactctcctttgtcctattcatcagcccttgtcaaagattctcttcttctaccatatctgattgttatgctggttaatatattttttttgtttcttccctcaaatttttattgtatgtcccctcttcagtgtattagatcattacccccaacagtcttgtggctccactatccaattaaaaattgtagacagaaggaaacttgtaggattgtgcatatttaaggagtctaaccagttagaaatgttacgtagcagaatcaaacactaaccagttttaaaagaaactaatgcacagtgtgtttgtgatgaattcaccattcccatatgtctgggtaaaaaggtgaaggatttgatgttcaaaatgtgctagtctagcattttaaaattattcctcttggtttttgatgcttcacggtattcttgttctcactaattcaatttttcctgcttgataaaatgtttgaagctgccaatcgtccatgtcattacgctgtttggtatgcacagtgaatggtgaccttaactattgcctttctttgtgtattttcagtaaaagggctcatgagcctctagatgctttaacaacattgatatctccttctaaaatatatctgatattatcattagtcatttggagaagcctgagctgctaacctactttgtcttttcactggtcctcaaatgctgaagcttacaaggcaaaattttttttcctttccatcagatgcctggctactatgttaaagaacattgaattttgcactgcaaatgtaattttggaataattagccacaggctttcttttttcttcattgctctgccctattgagtctctacaatttgaaaaaaaaaattaaaattttcttacaatttttattacttgtccttcagaagaatatgtagcattcaaaatgctcagagataaagggaactgaaaaatgttaagtgtaaccagaatgtcttcactgagtgttgtttctgtccaacaccaaaatatgatttgtttcctgtgctgtcagctcatcacatttcagtgtcagaaagactgctaaatgaggtcagacatgcttcctgtttctgaactcagttttgaggaagctgctgaatatgtgataatgtaacacacagacttcaaaacttagatccataaatcttagcagtttggtaaagaatatttggtcagtgggcttgcagcatctgacagctaaggattgctctattggtcccagtggcaactctctctgatatgttgtggtttgctaacatggaaatatagggtcaaaatccttaaacacagaaggagtatatttaaagcccattttgtaccatcatatagtttggaatattctatgtactatactacataattgacccgctgtatatgtgttctgctgtatatgtatatgtatatgtatatgtatatgtatatgtactgttgtatatgttctgctgaagcaaatagagcaatgcaaatggaatagaagtacaccaatttcagaggtgagatacaaatctaaacatattgctctttctttcatacatacaaaggaaatcatttctgcttaattttcataatgaccgtagtctgtgtttgatctaattaaatacttatgatatgattacagcacttcaacagcctaattcagtgaaataagttgacatcagttatttgctatcatgtaaatttatataaatgtaatagttgactactttaactgttaaattatttgtaatgatattatgtaaatatagccttataagaatgcatcagatggttgaagaaagtttaaagagaacatacaaattaaagttacagtcattaacattttataaattatatatattttatatttcagtacattacatatgtatgtgtgtgtatatgtatatatatcaagtcatcatgttttcttatattcaatattaagcactgttctgatagcaaaaaccatttttagtacagtttaatgttcttacattctaaataatgaattagatataggtattttatattattttactcttccatctatacatttcagttagaataatcattaagcactagcacatagaaagaacagtgttaatgcatatattggaatattaattggggatcacatattttgggttattttttgaaatgccagttagaaatatttttcccattagtaccataaaactttctcaaaaattacaaacattgatttcttacaagttattgctggaagatctcttccgttagaacatcacccaaaatatgtaggtacttaatatgttcgaatttcacttaatagatgtcgttattaaaggcaaatctaaacatttaattacattatacttccttagtatatgcaaatatttatatgtcctttcttagaatttctataattctatgcatagaatgcatttattttgtgttaaagctgatgtcaattagcctatgagtatgttagttactgactttattaagacaaggagtggaaacaggcgaagagagtataaatagaaggtcctttaacctacataaaattacacgtcattgggaagggtacacatctcccagaaaattagaaataattagcatctcttggttgagttgtataatagcaataaatgcaatcattcactttactgaaaatacttgtatgaaacaaatattcatcatgtatgtatattttagatcagaatgatctaaccaatgaaactaatttattttgttaaaagcctctttggtttactctgtggttgtggaaggatggaagccattcaaatggaaatgttcaaagggtgaagaagtctaataatgtatcataaatataataaaaaaggaaaatttaattaggccaggtgcagtggctcacacctgtgatctcagcactttgggaggcagagacagaaggactacttgaggccaggagcttgagaccagcctgggcaacagagcaagacaacacctctacaaaaaatttaaaaattagctgggagtgttggcacatgtctgtagtccaagctacttgggagatcaaggtgacaggatcatttgagtccaggaatttgagactgcagtgagctatgattgtgccactgcactccagcctgggtgacagtgtgagactttatctctaaaaattaaacaaaagaaagaaagagaaagaaggtcggcggaaggaaggaaggctattaagactagcctgttgttgcctgaattattgataatctgatgatatcacattaagcttttcaaaaattcccatatttgtagacattggtcatacattgttcatacttccaaatttaacatttgaaattaattttaaaagtaactgaaatcacattttacacctatgagactgaaaaatctgattgaaagtaaagctttaattaaaaaatttcaagcagcttttatttccttctagcactgaatagtttgttactctgaaattcttgtttgtttgcttcttgttttttggatttatcagcagaaaccaaggttgaattgcttaaggaaaaaaaaatgagtgtaatagaaaaatattttttatgtcattgagagttaaagaaatagtggaataaccaaggtttctgaaaaaaggaactagagtttattcaaagattttagcatcaagaaaacatttagtaacagaatgaaaaattgacaatttgtctgtttctctgcctccatattttagaattgttgggagagagaactttgtccatttcagatcagttgtctgtgtcaggatcattatctatcatcagatgagtaggcacatactatgtagaaatggcccagtaaagattttctacttcattttagggctttttccagagaaagggccatcattgtgaagcaagtatctaccccaaggcacatttagtaaagataatggttcctgcctaatttatttttctaggtcactgtgctccctctctgaattgcatcctgagcctttgttctgtcttcaacttcttgattcttccactttccacatctggtatctaacaaaaacctgtcttccttcttcagagcttctgcagagcgccacttgattcattgggggtgggaagcttggagatgggaattagtgttgctctgagctcatctctccataccctttctcatatgaatagagcatttacattttaagcaaatccctttcctatattttatttgtcatagtaaaatttaacctgtaatataaatatagcaatgattatatttcactttcagtaattggctgtagaaatcacacactattattcttagcagtttaccctgcattataactttagcttatcacagtgcttacctgcaataatatccccttctatgaaaaaaaaattctcttgtgctcacttttctcttttctgtgcaaactcccttttatgttctttgacaatttttttatcattttgctaccctctctcctttcctgaccagcttcagatgcttgaaaatgaggtgagttctctcccttcctagttgactcctggctccttttctcttttttctatatatgttattttattttatcttatttttattctttattttggctttgattggcacataataattgtacatatttatggggtatattgtggtgtttccatacatataatgatatatagtgatcaatcatggtaattagcacatccatcagcttattcatatatcattttctgtgttaggaacattcagtatcctccttctagctgtttgaaaccatataatgtaagagagctaactataatcattctacggtgatgtagaacactagaacttattcctcctgtccaactgtgacttgtatactttaacaaatctctctctattcttcccctttcccatccttctcagcctctagtatcctctactctatgttttacttctatgagatcaaactttttttaagcttccaaatatgggcgagaacatctggtgtttaactttccattcctcgtttatttcacttaacataatgtcctccagtctatccaccctaccaggaatgacaagatcttattattttatatggccaaatagtattcaactgtatatgtgtatatatatatgttttatttatatatatacatatatatgtttaaattatatatataatttatatataaatatacacatatacatatgacattttaaaattcattcatctgttgttggacctgtgggttgattctatatcttggctactatgaatagtgctgcaataaatattgccatgcagatgtctctttgaaatactgaagacctgagcaggccaataacaagtaatgagattaaaaagtaagacaaagctttccaacaaagaaaagtcaaggactagatggcttcaccactgagcttcactgaatctttaaagggcaactaatactgatttttctcaaactattctaaaaacctgaagcagaggatgttatttctaactcattctacaaagccagcatactactggtaccaaaaccaaacaaggacacagtgaaaaaagaaaactacaggccaatatccctgacggacatagacacaaaaatcctcaacaaatactagaaaactgaatccgacaacacatcacaaagataatatagtgtgaccaagtgggatttatcccagaaatacaagtatggttcagcatatgcaaatcaataaatatcacacatcacatcaacagaatgaggaataaaaaccatatgatcatttcaatagatgcagaaaaagcatttgagaaaattcaacatgttttcatgataaaaaacccttaataaataaagtatagaaggaaagtaccttaacataacaaaggccatatattattgttggcccatattatcgtggacccaaacccatagctaacatcatactgagttgggaaaatctaaaagcttttcctttaagaactgagaaaaaaaaatgaatgcccactttcaccacccttatttagcatagtactgtaagttatagaaagaacaattaggcaagagaaagaaatagcaaatccaaagaggaaaagaggaagtgaaattttctctgtttgcaaatgacatgattttatatatagaaaaaaactaaagactctaccaaaaaacttctagaaccaataagtgaattcagtgtagttgcaggacacaaaattaatatacaaaaatcagtaatgtttctatacatgtataagaaactagtggaaatcaaaatggcaatcccttttacaatatatatttaaaaagtaaaggccaagtaccatggctccttactgtaatccaagcactttaagagacccaagagtttgagaccagcctgggcaatgagattaaattccatctctacaaaaaataaacacacacacacacacacacacacacaaattagctgtgtgtggtggcatgagcctatggtggcatgagcctatggtggcagctacttgagaggctgagatggaaggactacttgagcctgggaggtagagcttgcagtgagttgaaatctcatcattgcactccagcctgggagcaaagccctgtatcagaaaaatagaggagatgaaagacctctacaagaaaaactataaagcactgatgaaagaaattgaagaggatgcaaacaaatagaatggcaccccatgctcatagatcagaagccttaataaatattgataaagtaagcgtacttcccaaaataatctacaaattcaacataatcctggtaaaaataccaatggcattcctcacagaaatagaattaatcctaaaatttgtattgcactacaaagaatccccaatcaccaaagcaattctgagcaaaaaagagcaaagcttaaggcatcacactaccagacttcaacatatatcaatcacaaagctgtagtaaccaaaacagtatagtgctggtataaaaacagacacatagtccaatggaacagagtagagaaccagagattaatctacatatctacagccaattgatttttataaagggtagcaagaacactttttagggaacctgtagtcttttaaataagtgatgctgggaaaactggaaattcatattcagaaacatgaaactagacctccacttctcaccctctacaaagtcaacccaaaatggatgaaagatctaattttaaaatctgaaatgataaagctactagaaaaaaatggggaaatgcttcaggacattcttctaagagaatattttctttgaataaggaatcaaaagcaaaaatatacaaataagattatattaaactacaggtcttctgcaaagccaaggaaacaacattgtgaaaagacaccctataattggaaaatatgtttgcaaagtactcatccaacagttcatttatatgacaaggaactcaaatatttcaacagcaaaatattaccaaacaatgtgatttaaaaaatgggcaaatatctaatcagatatttctcaaaagaacacgtacaaatgtccaataaatatattttaaaaagttcaacatccctaatcatcagggaaatgcaaatcaaaaccataatgaggtatcatcttattccaattagaatgactatcatcaaaaggaaaaaaaaaaccagcaaatgttggacagaatacagatataagacaactcatacactgttagtgagaatgtaaactagtagaactactctgaggaacagtacagagattcctcaaaaaactacaaatagaactaccgtatagtccagcaattccaccactgggcatttatccaaaggaaagtagttttttttttttgtttgctctttttttaacacccccacattttctggagtttttaagggggaggactatggcaaacaataatatctaagatcatttttattaatgctcaataggttaaaaaaatgctcaggcttcatgtaatcgctgtattctgaacattaaaattatgtcatacacttcaaataaaactgggttatcagacaagatttaatcattttaccatgaaaatcagagtttattaagtagtaacaaatgttacatttatttattttgaaatgaatgctgaaaatacaaacctgtcacataaattgcattaatttacaactattaaatttaattttttttgttttggtgagaataaccatgtccaaattgcattagtaattagaaatatactccattaaaatgtagttcaactgactgaaaaaatacataagtgtttttctaattaatctttgtatatcataatttggtaaaatacatcccttttaatatcctaaataggacactatttaggtaataaaataaattaaaaaattggatttgtccttcattgatgttaaattatttttatatcaatatagaaacagaaatctaagatgcgtttgtgtgtgtgtgtgtgtgtgtgtgtgtgcatcacatgttaatgtactatttacagttgtctaatgtggtgcactggggtcttcaggttctgatctgccacctcaatttccacagagattgattttcttaagcattggacttatttcccagtttccaggaagggaattttctttccaaacattcctgttctgtagaaaaccaaccttctcctgaaaaaaattatctttctcactttttattcagtcattaaaatggtacatagcttattacctcactaccttaaatcatggaattatttcatgaactctcagaatctgcttcatgttgtccaacagacattctgtgatgataaaaatgtcacatatctgcaatttccaatacagtagctaggagccggatgtgaccatttttaaggtggctagtgtgactggagaaactgaaattttaaatttaattaattattttctatattaaattaaatagctatatgtgactaatggttacattattggataatgaaggtctatattcactctttcaaaattatttgacctcccttattcaatttttcacttctattttgtatcagctactgattcaaagacttatgtcctgcacttagagtcagagttaatagcacctcagaaatcttaaaggagtgtgatgtggttttcttatctctctgtcatccattatttaacattggcatgcaaacaaaatgtattcaaaactacaggtatttatcttttccccaaattaaagctattagaaaataaaattataataataactttaaagtataaatgcagaagttccttttagcatatgaagtggactaaaaatattgagttaggctttgtgaggtttatagaagaaagatttatacttgctgaccaaaatgtgtgatggtggaagagagggtccctatttcaaaaccaaggtattcccatcctcatttcagttccagagacctagaagattaaccctgccaatgatttttcaatgcccagaattgtaaaaggctgaagaaatttgggtattcaagcttgatggtgacacgtgtatcaaaggaatgaggtttaaactatgtcttcaaatgaaattcagaccaaaagtaggttcaaatctcccaaagaatcaactggcctatgtgtgcctctgcatatggagtccaacagcagcagcattttggagaaaactccaactgctgatgtcaattttattgactgcagctagattagcaataccaggtctaaagggtaaagtttttaatcacctccaacccccagcaccagtacagagcaggtaatgtacttattcccccgcattttttgggtctgcagtaatatgatcagatcactgcttcttatattgtactttcccactctttgttgattatatctttgcttgtctagcttccccaccaaatgttgtcaggggttcttagtaacaggagttctacgtcagattccccatgaaatagactcagagactgacatttgcaagcaggagttttactgaagagtgctttttgggaaaaaaaaaatacctaaagaaatcatgcaaatcaaaacacctgagagtaatggaagtagagttggacagaagaaaaagttaaaatgcaatagcagttgcaaccaatacttaagctcatcccaaggagaacctctgaagctgggatgtcctttctaagaaattccagattgaggcaagaggttgggattttgtagtttgtaaagaacaagtcactggatgcaggctgtctttgaggagaaaattattttgggcaagaaatctatcttccactgaagaacatgtctgggaataaattcattgagcattcagcaggcaatgtgcccaataggtaggggaatgtgtgtcctttcctgaagggggatttgggcagtacactgcagcttgtccagagtgtgtccccctagaatccaccatatggatcaacttcttttctataatgtttattccatctcggactaactccattcagttttttgtgtctttttctgagaaaacgtatttgtctattgatgagtagacctaactactacccctgcctttgcagctggtctctgggtcacaagtgaaactaatcctcttccttctttgctaaccattttaacttctcctcacactcaacaaggacctcagctggactgagtggcttatcagatatgatgacccagaccctcatccctgagtggtttgaaccatagctcatcagaaccttctcagactatagcgaatacgtttgtaaattcaccatcaaaattaatcaagcggggacaaagagatcccttagtaaccaccttggtaccaaaggttgtatttcctacaccactgtacgacagcagctctacctcatcatgatgatcaggatcaattacccctcccatattggtcttggcaataataagcacaaaatatcaaagtggtagctggtgtcctttgatgaaagcttaccttctctgggaacctgaatctctagatctacagaatggagagtcgtggagacaggaggcacagcttgcccaagtgtgtcctaggggtaatggtaagcagggccattccaactcctactgccaggacccatgtaatctacctttttgggacacatcactatataatggttattgttttagtttatacagaagtatgacactctatattcacacaaaatcatctccaaattagtgtctcagttgttcctttaaatgtcattctatcatcctctgaggatgagggtttttgggtagagcagtaaataatatgatcagtgattcacaggtgtcttctgctgtacctccttcactgtaaatgcattatttggtcaaatgcaatagtatattggttcctgtgtcagtcattcaaaccctatataagttctcagataatggtgctggctgagggctgcagacagaagaaaatctgtaactggactttgtatggagtcccatccaggctgctgcctcttcgaggacgtgtggggtcagtgtatagtaaacatgtagccaaatagctagctggtttccaacagagattgtactttattaggattcaatgtaagtctgttctgctgacagtttatacattgggctggggcagtgcctaaatcagcctatgctgatacatatgctgttaggtacatgaatacctccatccctgacaccctggctaccctcttcacacaaaccttgtgctagcattaagtggccaatgacacaatctagtagatgtcaacttgctatgttattaaatgttctccattatttagtggccccatagtttatgttaatagataagataatcatttccacaccttgtgcccttttctataggtatttcacatgactcttccctgcaatccttttctactgaccttccagcctttctctttctagaccctgaccagccaatgcctattaaccatttatagtcaatgattaaatcttgcctataaatctgtatacagtcttacctcaggctacttctctttccagtgaaaagataactggctgtatgacttgatagtctgtctttgattggatatatatttaccactatttttcagggccacccctgagtattgttttagtgcacctagagtccatttttttgctctcctaaattaccagattgacccatatatggacaaagattaacctttttctttttctctcaacagcttgtaaaggactctatgcaaccatgcatttgagctgaggtgcaacagtgatgatgactttggggtctaggatattttatcatacagctcgcttgtgccctttgggctattcatgcctaagcctacatgtacaacttccatctttttataaattactgttggtcgcttagttgtggacatgtggtcatttatcacaaggacaagtgccccagtgtgaggccagaaatatatatatatatattttaattttctataaccctctggtatgtacaaaaaacagaatagtattaagcctaacatgggaattaaattttgacacttgttacaacatagatgaaccttgaagatattatgctaaaataagccagagacaaaaagacaaagagtgtatgatttcatttttatgattgcacccgtagtagtcaaaaatcttagagacagaaagtaagatagtggtaactaggagattggaggagggacaaattgggaattatcgtttaatggttacataattttaacttgagaagatgaaatagtactgggtatggatagtaataatgattccacaaaaatataaatgtacttattatatttattattattatttattatatatattattatttattatagtgaactatacacatagaatattgaaaatggttttatgttatatttacctcattaaaaatatattttaagtacaaaaaagacaaaatattcctgttttcatatcatttggttactcaattaaatagctgtatgacaccagaggggaggtctgggcaaatcatttccattacaggcttcctgtgacattgctgggtcattctcgctggtgaccaggatttacttacagtccattgattttgaagatatgggctttatttattttattatatacatagagttataccattcttacttaggcttaaggatgccatttttatttaagcatctccaagcatctctctggtcaactttcttagctgccactcccacctattcactcactatgataattggagacactgtcttctggtggtcaagaactgccacctgatcacgaatattttaagattccattattttcattgttattagagagccctctattctaagttatttacatagtttggtcatgtaatccttgcaacacatcaatgaggtaagaactggtctcgccattttatggttgaggacactgagtcacagagagtttatacagcatttgtaaaatacagtaagatattattagttaagagtacatccttgacaaatgccctgataaatactcatcaggatcattatgaacaaaaataaagaaatgtaaaatgcatgatatctcaaatggaagcttcattcccctttaaaaaaaaatgtaatccattttgatctgtttgcatcattcctgatacgtgatattcaggatataattttaagataaatgctaaggcttatttctgtgaaacaaagaaggtcagaagatattcagctaggtttatttttttctttaaaaagctttgttttaccaagtaaacattttactttcaagtgacaacagagctttaaaatgctttaaagtggttatgaagagcaagaaagcaacttctccaattgactcgtaagaccttacccacgtatataatgttatttgtggttcacctcactgcttgttgttttgcttttatagtctaaaatcccataaaacagaacctcagaaaacaaatgacagatttacttaaatataaatgagtgagtagttatgatatcaaccaaatatgcttaacgatatgtctggagagtcaggtatcaaacaggtcaaagggactgttctttctatataacagatacattttatatctatctaatatagatagatatataatatataacaatatatgtaaatatacctttaccctttgaaagaaaacctcaataattatttttacacacacacacacacacacccctcagtgtatgacagtttgtttctatattatagaaacattataaataagaaagtgaagacatctgtgtatgtgtgaataatatggtcaaaggacaattaagatcatacaattttattttagggagattataaggaaaatttatttgaaatgtattccaatctatttacctaaattcagtcaaattttgattattttcagctctcttaaaatgtattttgtatcttgttcattgaatagtagtcttgttaaaaagttgttaaatataacagtgtcccatatttaaatacaaatgaattgtttaattcaaatttttatattgtgcatatttaaaaaaatctatttctaacaaatgcctactgaaagttactgaattgatttagaattttaaaaatttaatttattagtatgatgtatgtacaaaataaaaattccttttacggttacaaaattcagcttgtaggtatagattttttataaaccacctttcattgtatacagaaaaatatgtaattggaggatcatttatcttgagacttctaggtatgtcctagactgatacaaacatagaaacaatacatatgaattatgtttatttgacaaatgaagattcagaagaaaatgtaggatgttataatgtagacagtaaatggcaattttattaactcctcagaaatgcacgttctcttgtaatattttttatgatttacagggtaacagtaattgaatgataaaaatcagtgattcataaaccctaagagctacacaaacaatgtgatatccttcatttatccttgtccttcagcagataaggaaactaggaccaagagagtccaatgaatttcctacaattacaaagtttcttagtggcaaattaaagaaatgagtgaagttctgactcagaaaaacatttattgtactaaattttcttattatttagaaaaaaactcacacacatttaaaatatatatttaccttatttctactatatacaagataaatactctcattctccttgaaaaaatatgcaaaaagcaatagtcaaaatcaacaaactttagtgatttgaaggaaataatatttgaattgggattaaacaagaatatgacacatatttagtaaaagagctgttttcttgagacaaagataatagtagaacaagcaacaaaacaaagcaaaacaaaaatacctctagaagcccggtatttgaaagcgtgaaccagcctagtgctctacaatagctttgtcagctttaattttctcatttgtaaaataaagataacaaattatttcatgggattgctgtaagcatcaattatgtatgaaaatatggagagtctctggcatctaaagtatgctcaatatttaacattctggtacacaaaaggatgaaaaaatgtgggttgatatgacagaccatgtcataattgcataactgtaccactcctttttcacattaaaattggaaaatgtaaaagacgttttaaaattttgtgaaacttgactttttcatagtcgtatgccaatttttttttattattatactttaagttctgggatacaagtgcagaacgtgtaggtttgttacataggtatacatgtgccatggtggtttgctgcacccatcgacccgttatctacattaagtatttctcctaatgctatccctctcctagccccacatcccctgaaaggtcccagtgtgtgatgttcccctccctgtgtccatgtgttctcattgttcaactcctacttatgagtgagaacatgcagtgtttggttttctgttcctgtgttagcttgctgcaaatgatggtttccagcttcatccatgtccctgcaaaggacataaactcatccttttttgtggctgcatagtattccatggtgtatatatgtgacattttctttatccagtctatcgttagtattttttattccatattatctgggtctcagagcacagtatctcattctctgttttagtaccaaatatatattgaggatctataaagaacagacaaatgacaaggacaatacagtattatattttaagaattgtatcagaagcataaccaaatgatgctatgaaagtccaaggaacacaaatttatgccaaaagagcaaaaaaggagttagaaggctccttgagaaggtgatatactggcggagtcttggaagggaaattatgttctggcagctgagagatctcttcctaaggagagtgcagcattgtcctggaaataaaggaaaaatgaaatacattggggtcagtggacagcagctagcttgctataatgaaattgaaagatacatgttgtaagaagtaggatatgaatctgaagagatgtccacaagctagatcattaagggcctgataaaccaaaagaacagatttttatatttcctggtcaattaggtttccctagataattttaaactggaatgcaatgtccactctgcctttttaaatgattacttttgtattagtatgaagaaaagtctggagggatgaaaccaaggctggacttagtaaaatgataattaaaaagatgattaaatgatgttgatgatgatgatgataatgatggtaggaaaaatagtaaatatttgcatgatctttataataaccctaggacggctgaaccataattagtataagcatttttaatcctcaagactaattggtgatagattttctgatatttttctcatcattcccgcttatagatgatgaaatgtacaacggagcaagtctttgaagtcagcagttcagatacagagtgcaaatttaaccaattataatagcctgcagaatctgagaaacccaggatacaagaaattcaggcaaaaagtaattaatgtgatagttaatcaacaaaattatccatttttattaacttaccataaccattctgcattttacagaatcctgtagcatagtgcatgtgctttacttgtttgctcttattttctttgtggccccatttcctggatcctcagttgcttgttctactgcaacagctgctgttgcctggctaatgtcttggctaacttctgcttctgggggctgactgttgcctgtcctagaggaaaatgtctcctatttgtcagtcataatatagttcaatcatcaccatgacttgagtttctggctcctcctgtcatgtgtggactttagtctctcaccgattcatttctacaaatacatgaatagggacatgtggtcagcttcatcaaaaaaggagagagaaatactattattctgtggaagagtttgtaacaaagccgggatacagcatgcttgtaattatatactggtgtctcctatacatcctccctgccagccacacaggttattagatggtacagattcatcactgccattaaacattctttgtcttaccatccccctaaaaaaaaaacaaaaataaagataaagaaagaggaaacactagtggtagagctgctcttactccaaagaaaagattctctttgctgttttggggaatctcattgccatgtgctccttctagaaagatctgagattacacaatatgagaggacagaggaaaatgcaataaggaaatctttccttgatatatagtgtttggaggcttcctaagcattcccttagaacactgcttatgactatggtcagtttgttcatctgccctgccctggtatattcttggagccttctgatactgtatcatataatatcctttttcttctgcctgatgtcttcttctgtgctttagtttcagagacaatataagcacagccaatgctggcgtatcaattatgtgccttagttattggaatgacaccctcaccctctttcctctatcccaagttacctaagcactatctaattcaatacctagggaagtgttatttcattcttacattgagggtgctcaaaagaaatataatctgaaccacaaatataagctttattttaaattatatttaaaatataattttaaattttgtagtatttacattaaaaatggaaacaggtgaagatcttactaattcattttaacataatatttctaaaatattattttaacacataatcactataaaagtatttacaatttttttacattattttgttgaattttcaaacccagtgggtatcgtccacttactacacaccttaattcagactagccaaatttcaagtgctcaatagacacatgtggctagtggctatcagaggggacagcacacgtttatccctgtcagttcccagctctaggaacgtggaaatgggactccaaactgtgccagatagtagtgggttcagggttgtatctcccactcaccctatctcaacttaatgtggaaatttaaataaatctcatgcaaaaatcctccaggcaaaagttgtcttaaatactcagctttcatctatgagttattacattcacttgggtttattttttaatttttattttagtttataacatttctgtgaagaataacatgcatacagaaaggagagaaaatgctaaatacatagctcaaagaattgttacaaaacgaaaaaacatataccagtatatccaatacctgcgtcaagaaataaatcaatattggcataagcagaacttgctctatgtcacttcccagaccacagcattcctcaaaaataatgactatcctagttcttaataccacgtgtttgatttgtctgcttatccgctttatgtacgtggagtcaatagttaatactcatttgtttctgcttttgtcattcaccatcatgttggtcttacttatttttgacttctatgaataggtttgtaaattgccaggacatggatgcagtttgaaaaagagaaaagcagtgtctgacagtccgagtattggcatagttctgtcagttcggtgttgctaagagctggctactcactcacagctgggctagagcattgttttgttgaacataaagagtttcacaaaatactatcagacaaagtctctctatgatcataataaatcaagatgaaaccatgtccattcattaataatttctgaacttagaaagcaaaacaaatgaacgctgactacatcacaaagatgaccatacatccttctgctcttctggctaacatgagtgactgctgctcatcaagtacagctttagactttattcctctcaccttttacataaagtctttaagatgctcagtcgtagaattatcttcatattctgacagcacacaatgtagagcaaagctctgcttccttgaacgttcccccaatcacttacaaaggccaaatcctatcaatcctttccatcaccctagtattgagatacctcagtattcaatgatgtgttcacttctttgttgcaatgagtaaaaacaaaataaaaaactacaactttaactacagatcaaaggaggacactgacaattttaaaatgattttacaatacctaatgtatatacagacattataaagttttggtcactgtttttatttcactatattgcaataagtgaataagtttaccacgctttggatgtggtaaacttctactttattataaagctgtttatgtgtatattatgaatatatctcattctttctaataaaatttaagcctccagaagatttaaaaaatgtgtcattttataccatttatacacttgactttttccattcattcgtcaaatactgattaaatgcatttatgcttaggttttcatcagatcagtatttgagaaataagcaaaagaaatcatgagaaaatgaatgcttaaattattagcgagagactgagctccaccatttgtctgcttttgcttagttcttccagatacccaggaatggtgaccaggaatgattatgttttttgtgtgtgcaaaaatcctaagtgtcatattcaaactcttaaattttgacataattaaaatatttttctaaccaatttttccaaagggaacttgtttggatggtctatttcaaagaatatttcaccaatttatttacttttaagaagccatggaccctaaattcctctccctcttgaacagcaagatgtgccaggtgactgtcatctactatacaattacagctcctgtatgatttgctagtcagtagtgcgaggagatctgtacctaaacttggcacaaatggattgtatgatgggagtcctggggaacatttatgatgcttgtgctattgcaactactgttctgggttttctttttcctgtttcaaacactggccgtgacagtgccagagacagcccatgatttaagagtgaagaatagtgctgctgttatagctgtggtgtctgtgatgaatggaggcaaagcaagcaagaaggaaggaagatgtgaattaggaggggaaggatagaaagtgacagatttaaagctatccccccaaaaaacatcagccactttaccctgtacacaattttaattttgagaggttttatgaaatgtcaggctaaattttgtttgaattacggtttaagtataaatcactctctacttaacaattacactagcctgggaagaaattattttcatactcttttcttgcacttcttaaaatgttgatttttggtaaaaaagcatgcaatgtattatttttaagaaaatatgacgtgaaatataaaacaacattgtaaattttttgacttagttaaatagtaatttgataccatattttgctatcatttagaaaaactttacaaaatgttgataagccaactatgaaatggcttgtggtatgtaaacaattaagcatttacatggcattttctgtgtcatctccatagtggtggctgctataagaaacaaacaaaaagaacatgatatacatttaccccattagaactttaaaatattgtctctgatctaaaatctggatacacaaaacagttggtaaagaaaggaaagtcagcatataatataaaccaatagggaacatctttatggcggttaggtacgaccagaaaggggaagtgcaatgttaagcagcttcatcatgaatgttttaataacaagtatggctcatcccatagtccaagaggttaattataaggattgcatttttttctcaaagctgtttttacctagaattcagtcatctcaggccatgtatgcaggattgatggaataaatctctgaggatgtaatttgcatgagatatgagaaattccctagcaaggagctctccagaaaaaaagaagattagaagaaagctatgcctgccttaaaaacaatacctcaggcaggatgagggaggaaagataattttaaataaggctgacctctagcctagacatcatggatttgtacttcttcatagggggatgtgtctgcaaaaagtaaattctgacattacaaaaatctctgtgatacatgggaagtgcaaaacagcgctgtctagcatcaggtataacaaacagggtgaatcaccccagagagtacaggtggctccctgttgcttcattagagaacatagaaagtgtcttaactaaatccacaccagggtaacatctgcaatgttgacaattcagaagaagcagcttcgcacagtgggacatcattagcatcagtgggagatggtaccaaagctgcagctgtgagtttatcactatagcccctgtgggagtggcagcaaacagcagcattgaggtggtggacctgcacaatacttttacacaatacctgcacgatacttgcagacattggacgacagcagtagataacaaagcaagagatcagagcttaagtagttaatgaatgaaaaggtgaattttgcagttgaaaatactttttaaataaatatcctctgtgtgtgtgtgtgtgtgtgtgtgtgtgtgtgtgtgtgtgtaaagttttcagaaataattagggggaatgttggaagataagggcatgggtgtatcacattggcagaagatgccaaatcaagaaaagtactgttttcatagacataaagatcccttcttcaccctcccagaatcaagacctggggatcaactacacagaaagactacgtacaggcagaagagagagcctttccgtgtatgggccaggagatctttgtgctttctgctttgaggaagaggatgagctaaacaggaaaatcctttgggccacacgtgcaccgtgtggtttatggattctaatcagaatgcctttttagaaccgtccatttaattaaattttgtgagaaaagactagcctggggtttataggttcctggttcaaggtgtaacatgtccaatacgataccacatgacaaaattctaaaaattttctttagttaaactgtttcccacaccctgttttgtgaaccagacagtaagtttggtgataacaggtttgtatttgcagtaaaagagtgtttagtgcttaagaataaactttagaactaagtcttagctttcgagcttataaactatctttaggcaaagcagctcacctataaggacctcggtttccacattataaaaatatgttgtataacaataatcgtaacaataataccatatgcttcatgttgttgctggggatttaaatatgtaatatttgtaaagctcatgaaagaatatttcacatatattatctctttgctattaataaatatgaactccatttaagtgcacttggagctatttgatacatatttcctgcttatttaatttaatgatgaagaaatttttaatgtggctttataacttaatatcatatatgattaaatttacccacaagctatatttatattttagtatacttaaggaaaatatctttaaaacacattggcttaaaaactaaaatatttatccgtaaccattaagttaaatactaatgattattctctactccaaaataataaaatctcaaaaatttatatattatttaatataccaacataaaatatatcagaaataaaaaattattaagcctctatatgttttaaaattgaaagctacatggttttaaaaataagatctccactattccaggatttcagtcttaaaaagcatcttgttgactacagtgctctacaaaagattactcagatattcattcaggatctgcctgaaagctaagacaataaattcagatttgatcatttttcctgcacgtgcatatatattaaagggattcacaacaattggaaatgactgtagtaaggcaaagttctcttttaagatacttgagtaaaataacggctctacaaaattaatgttgtcaatgtagacagccaggtaagatgatttcttatttaattcctgatatataagcattatttcaatcaataattacttattataactactgtgggaaaaccactttggaaggtgaagcaagaacacataaagatgatttaaaagttttaaaatctacaatagccaaaataaagttttgggttacaatgtgcccacacatgcccttagaattcatatgttgaagccctgaaccacagtccttcagaatgcaacagtgtttggagatagagccattaaagagctgttaagttaaaatgaggttcataggactggtgtccttataagaggaaggaatgtgcacacacagactccaaagacatactgcacataggaaagactatgtgcatactcactaagaaggtggccatctgaaaggctaagaagactcacagagaaaaacaaacccaatggtaccttgatcttggacttcgagcctccagaatggtgagaaattaaatggctattatttaagccaactagtcttaagccaatgtggtatcttgtttagcagccctaacaaactaatgcaaaattacactattttctaaaattatttgggactcagaatcaataaactttcttacctctgatttctcatcagaaactatggtttatttgtagaacatctcacaatatgttgcatttttcaaagttataattgtttaacctatctatttttttttttttcagacagagtcttgctctgtcgcccaagctggagtgcagtgatgtgatctcggctcactgtaaacttcacctactgggttcaagcaattctcctgcctcagcctcccaagtagctgggattacaggcacctgccacaacgcctagctaatttttgtatttttagtagatatggggtttcatgatattggccaagctgctcttgaactcctgatctcaagtgatctgcctgcctcagcctcccaaagtgctgggattacagacatgagccactgcaccctacctaacccatctatttttaaagctgattatggacaactcaagaacaaaatttcttatattaatgtttgtcctctccaaatctcatgttgaaattcgatcccgaatgttggagatgggcctaatggaagatgttgggatcatgcgggtgacccttcatgaatggcttcatgcctttctcatggtaatgagtgaattctcacccttagttcctgtaaggactgattgttaaaaacaacctggcacctcttcctctttctctcatttcctttctctcaccatatgatgatggctcccctttcccttctgctatgatttggaagctccctgaagcccttaccagaaacaaatgctggcatcatgcctcttatacagcctgcagaaccaggagcctaataaacctctttttaaataaattacccagccccaggtattcctttgtagccatccaaaacagactaatacaattacacatttatgtacttatatgtagcttcattttatgtcttacagtaggagatacataactgcctcttcaatgaatgttttatttgcttactagagaggaaactgtgaaagaggaattacattatggcctcttaatagattcatctgtccattatcaataagataataatttttaaaaggaagacactgaaggaagactgagtctgggtaaatgtattgagtcaagtttgaatttgtggtatagtgagtatgagttcttggtatgcatgcctgtaaaaaattacttaatccaagaagtgtgagatgaaaagccaaaagaatagaaaaacatgtaaaaataggggtcaccaatgtatacatgaacagtaaaaacatgtaagtaaacggcattgcataggaaaaaagaggcataagaacaggaccttaagaatcatgcatattaaaatattgaatacaagaaaaagtatgagtgaagaagttgaaaaggagcatagagaaaagagctggccagaaaaatggaagtgtgcagaggaaaaaaacacttaataaaaagataattaaatatgtcaaatactgaagagctagtaaaggaaatgaggaccgaataataattatgaagtaaaataataatcagaaacttaatagtaaggcagatatgaaagcctacaaacaaaataagaaagagcatatgtgttagatgctaccagtgctctctgatatacagttcttttcttccaggcacataaatgtctaccctccccagccccttacagattggtgagatcaggtgacttaatttaactaatgaaatgtaaagaaaataaaatgctacactttgactaaaacatttaattaccactgaaagccactctgtgtcttctcctactgatatcccagggtgagctacataatccaaagatgaactatgaagaaattgaaacagctaacctagtctgatctttctggtatttccaacgtatgaatagtaaaatgtaagataggagtttgagaagtaagtaaaattaaggcaataagggaaaaggataagtgagtatgtgtttgaaaagagaaagagagagaatgaatgaaagaaaaaatatccagttaaaattggataaattcgcagctccttgggaaattgtataggtaaatctcatcactgaatttactaaaggcttgtggttatagggaaagtgacaaaggttagtcaagaggtgaaaccactcagagcatgaatgagggcaacattagaattttatctactgtattcaggatcggtaacaagatgaattaacgctgacatggatgatagaggggcaattactgaagtgttgaggatctctaaacatatttagtaattcttgcttttaagcctgaacaaagtttaagagtaacccaggaggaggactggttaatttcatctgaagaataccaggaaaggatgaagacaggagacaacatccttgtaagtgttttaggtgataaacaggagtttaactgggagatcaattaagtgagggcatttcaaaaagaggacactaatttgaatgtgatacatcagccagcgtttcagaaatataagcaatatagaatgataacacaataaaactatcaaaaattagggaggttacaaacccctgctctttatattccttgcttagtgcttggaattcatgctagaggaaaaaaaattctaagtccattaaagagtataggtgcataatacttactctattttaggaagattatatcaccaaatgaataataaaatttaaattccagtaaaagtgccaaagtctgcatatgttacagaattctatatgattcattttgtttattttttctgtggagttgtaagaataatttatgaagcgctgttttatcctcaaaagatgtgtgctaacatcactgctttaaaactaccaactgtttttccgaacctgccaggggcttatttaactttatcttaggagctctttggtccatttttcaaagtagatatgagaagaacaattgttctcaaattcttgtatgaaggaaaacagggatgtcaacaatttttaaaggaagatattatttaattaagctatcagacaaaaggagtcaaatactgtgaaaagcaatgcatagaataaccatttcaatatgtatcaagctttaaggtgctttgatgttttctactaattaaagggacttagtccagctacatattcaaaaatatttcaatatggccatacttaaccttctgatgctttgtcttagtgcttatctttaaatttgtaatgcttatgatccttctttgtaactgctccaaatgtaccataccaatttattttgtatgcctcaactttggcatggacacaatatcccaaacagttctgaggggtgattaatgtaatcacttctaataatccatcaagtgaaaacatactgccattttcttaagaagatatccaaaataagcttcattgccatgataaaagaaattttctgtttagtcaactctgattatagttgcttctttattttttaaatttcacactatcttggcgttaacttaatcatcaatcatctcccacctttattcctattgtgttttctctatcgtttcattatgtcaattgcctcactgttgtggttattccatctcctccaagaagatcctcaaggagaagaattagtttttaatctcagtaactatatttaatatgattgcaatatattttatttgacaaaattttcaagaaggacgataaaagacaaattaattttctaaggtgctaggctgcctaaattgaaataatagttaacaaaaactcatcgccatcaactatatctgcaaatattacttgaaaaagtcataaaattttctttttcagaatggcgtatgattttcaggaatgatcttggatcatagggtgtattaaataaatattagatagtattagataaaagatataacttctaaaacaatgcatacatagcaaggtttttaaacactatatggttttacacacatttgatttgttagtagataggactaacattagtctcaccatgtttcaaaggaagaattataatactaaaatcttaagttatttgtcgtaaggatacttgactactaaatggcagggcagtattaacccaggtttcatagctccagatttacattgtttcttctaaatcattacatacattcaggaggcaaagagacatacaatttaaaatatctgaattaaagcagtgaaagagaataaatgtagaattgatttattaggactattgacaaaaatcacagaattaaattctctaaggagaatataatcacagaactacactctctaaggagaatttaaataagagtgagatgttaaatttaccaataaacaaacaaggttgtaatacagaataaaattctgcatatagtactatgaagaactgaggaaatttaagtaattactaccaactaaatttatgcaaaccacaagaaataataactggcttactgtgtactcataaaagaatataattcgttgacttgaaatcatggtttagggagaaataggaaacacaagcatagtttgctgttatcaaatacacacctaacccttttcaaggtctgagttttctttataataaaatacaatacagaggttgagccagaagggtcagaaataacagtaaagataaacaccatttattttcctgtgaagaaaatttgtagctagactagtgatgcagtactcacattatgctgacatacaggctcttgagacttatgttgaaagctaggtacaggaaaacgataatgtgcaattgtgcatagttttgaaggatggtggtagcatcagtgttacattgtccttgctaactaaatcagtcttgtttattggaatctactttagggacaaattttttgcagaacactgaagttgaatctaatggatgaagattgcatgttgcctttgggaggctattctacagaggcatcatttgaggtcccacatttgtatcaaattagtgtcaagcttatttctaaaagtttgtgctgttctgaaaaaaaaattgtgttaacgaaagccagagagtttcttcacaattcagctctatttttttcagtttttattataaggtgacaaaataaaatagaagcctaaaataaaacaaaataaaataaaataaaatagaactttgagcataataactgagaactgagattcagaagactggatttaaatctaaattctgccaattactacttaaatgccaatatgcaagttacttatgctacttcagttttttaaaagaataaaatatataaaataaacacctcttattttggctgatcattaagtaatagttaaccaacaccacaaagtcatgcctttaaattattgatgctgattaaacatttgtggaaaattctgctatttgttcctccaaaaattatacttctcttcttcattatgatcagaacccttgatgcagcataagatagaatggacccaatgatcagcttcatagtttcccttttcaaccatggataatcccttcaatacattataagcagaagttaagtttcattctcctcattataggtcatattgtttttctatgctatgtcatttcattcaggctagaaaatagatttggtgaatgatgatagagtagccatcttaagaccataaggatagaatttatttttaagatgttacaaatgtccaagtgaaaattcaaaagagcttggttccttcatatcttcatatttctgtcccaccagtactaaaatgcttatttccaaacatctattacagaacatgagaaaaataaacaactatttggtaaggcactccatcaagtattctataaaatgtgtataaacataatccttacccatgttaggtttgacagatttattaatgcattttcttagcatcatttctgctatgtaagatctcattatatataatgtcataactatcataatctaattggatgaatatggttcatgtatacatatattgagaaaacacactgtacaccttaaatatgtatcattcttatgtgttaagttaaaacaatgaaaaaatcttgaaataatttatatatcaacattatcagaaacaataatag

SEQ ID NO: 555 - DNA, 40001 bp, Homo sapiens
ttatttgatatgatttatttttcttagggtagaaattcagtagtaagattactggatcaaattgcagttcaatttttagttctttgagaaatctctatactgttttacatagaggttgcattaatttacatttccactaatattgtataagcattcccttttatttgcatccttggcgacatctgttattttttgcctctttactaatagccactctgactggcgtaagatgatatctcattgtagttttaatttgtatttctctgatgtgcatgttttcatatgttttttggcaatttttatatcttcttttgaaaaaagtctgttcatatattttgcctactttttaatgaggttatttgttttttgttgttgtcaatatgtttgagtgtcctgtaaaaatctgaatattcgtcgtttgtcagatgcatagtttgaaaatattttctcacattctgcagcttgtctgtttactctattggttatctcttttactagcagaaggttttctagttaaattaagtctcatttgtctatttctgttgcatttgcttctggggtcttagtcatgaattatttgccaaagccaatgtccagaagttttccctaggttttcttctaatattttatagttgcaggccttacattaaactctttaatccatcttgaattgatttttgtatatagtgagagtccagtttcattcttctgcatatggcaattcaattttttctgcaccatttgttggatagtgtttctttccctagtgtatgttttcatcaattttgttgaagatcagtttgccgtaagtttacagctttatttctgggttttcttttccattcaatttacctatgtactatttttatacccttaccatattgttttgggtactatagccttgtattataatttgaagacaggtaatatgatgcttccaggtttcttctttttgcttaggattgctttggatatttgggctcttttttggttccatatgaattttagaatattttagtaattttataaaatatggcattggtattttggtagaaattgcactgaatctgtagatttctttgagcagtatagtcattttcataacattgattcaatccatgaatatggggtgtttttccaattgtttttatcatctgaaatttctttcatcagtgtttggtagttttcttgtggaggtctttcacctcctgagtcaaagtatttccaggtttttttttttttgtagctattataaatagaattgactttttgatttgattttcagcttgattattagctaagaaagttttaatggtcaggatggaagatcaaaccagccataacattcccttagaccaaaacctaattcggaccaaagttttaactgccttcaattttataaaggctgagagaacgaggaagctgaagaagaaatgttgcaaggtatcagatattgactaatgaggttgacaaaacaagctacctccataacataaaagtaggaggttaagcagcaattgcttatgtggaagctacaacaagttatccagaagatctagttaagataattgatgaaggtgactacactaaacaacagacttttgctgtggacaaaactgcgttctattggaagaggatgccatctaggacttcatagcaggagaggagaactcaaggcctgtcttcgaagcttcaaaggacaagctgactatcatattaggagctaatacagctggtgatttcaaattgcagccaatgctcatttattattctgaaaaatcctgagggccttaagaattatgctgaacctactctgcctgtgtgctgtataaatgaaacaataaagcctgaatgacagcacatttgtttacagcatggttcactgaatattttaatctcattgttgagatccactgctcagggaaaataacaacaacaaaaaaatatttctttcaaaatattagtgttccttgacaatgtacataataattctagaactctcatagtgatgtgcaaggagattattgttgtttttatgtctggtaacacaatattcattctgtagcctatagatcaaggagtaattttgactatccagtcttattatttaaaaaaatacattcataagactatagctattataggtagtgattcctctgatggatatgggcaaagtgtattgaaaagtttctgggaaggattcatctttctggatgccactaaaaaatttatgattcatgggaagtggtcaaaatatcaaaattaatataagtttggaagaagttgattcccacacttattgattactttttcaagagttcagtggaggaagtcactgcagatgtggtgaattttttttttttctttttgacagagtctcactctgtagcccaggctggagtgcagtggtgcaatctcggctcactgcaacctccacccccaaaggtcaagcgattcccctacctcagcctctggggtagctgggactacaggcatgcgccactacacccggctaatttttgtaattttagcagagacagggattcaccatgttggccaggcttgtctcgaactcctgacctcaagtgatacacccgcctcagactcccaaagtgctgggattacaggcatgagccactgcgcccagctctaaatattaaaagagctagaattataaggggaacctgaaaatctgactcaattgtggccatctcatgaaaaaacttgtactgatgaggagttgctttctatggataaacaaagtggttttttgagatagaatctactcctgccaaagaggctgtgaatattgttgaaatgaaaaccaaggatttagaatatcccataaacttagtagataaaatagttcatagggttgttagaggattgactccaattttgaaagaagctctactttgtttaatgttatcaaacagcatcacaagctacagagatgtcttttgtgaaaggaagagtcaatcattgcagcacatttcattgttgtcttgtttagggaaattgctacagccatcttaactttcaggaaacaccaccctaattattcagaaaccatcaacattgaagcaaaatcctctacctgcaaaaagattacaacattcatggaaaggttcagatgttcattagcatttttttgcaataaagtatttttaaattaatgtatatactttttcaggcataatgttattgcacacttaatagactacaatataatgtaaacataacatttatatgcactggaaaaccaaaatgtatatgcactggcaaaccaaaaccaaagtgtgtgactcgctttattgaaatattcactttattgctgtgatgcagaaccaaacctgcaatatctgcaacgtatgcttgtatatttcactttagatcaagataagtatgtggagaagaaaaaaccactaaaagggaatatgaagtgcctaggctctgtgtattggagattcaaacaagtagtcagtaaaaaagtcacattgttcatatttgggttttaggagaactactctaccagcaatttagaaaatgattcagaggaaagagattgaaggagattcagaggatacagtttgcttacagaaatatgttttaaaatataaactaaaatttgtggagaagttctcaattaaaaagatccagtgagctaggaattctgcagaaaacatcatagattggcctgaggatataatgcttggctattgtttcaacaaaaaccttaggatctgaaaagtttattacaaaatattatgctggttttactactttaatttttgaaactaaagttaggcttatatacttatacacaatctttcagaaatattaagagcgtcaaatgtccacaatttgaataccatggttataagttataataatgtaactgcaagaaaagtggtgagactggttgactctttttttttttttttttttgagaccaagtcccactctgttgcccaggctggactgcagtgatgctatcttggctcactgcaagctcttcctcctagtttcaatcaattctcccacctcagcatcccaagtagctaggattacaggtgcttgccaccacacctggctaatttttgtatttttagtagagatgggatttcaccatgttggccaggctggtcccaaactcctgacctcaggtgatctgcccgccttggcctcccaaagtgctgggattacaggcatgagccactgcacctggcctgattaactcttaagtagtatcataggagagctcaaataattattcatcacctttatacagtttgtttcatgaattatgaaattatatgaactatatgaaagttcacctctgaattcaggaatcgatcacaatgctggtagatggttaagagccctttagttttagtgtttttaattatttgtgtttgctttttgttacattgtgaactgcattttttaaatcaatgaattgttggtaacctactgaactattaagattcaagatattttttagttttctaggtagtatgccaaaacaattgaataagtggttcattatttgtaatatttgatctctgatacagttatttctgacattaagatcatatggcctttgcccatatgttcagaatgtgcctttatcttttcacttatgtttaaagagcttgcaatactaaaattcactctataaccataaaccagaatcactgaatatcttcaattcttttattacaaattttcatatcatctccatttataaatcacatatcatttaaagcaatttgtgaaagttgttttcacgaaatacttttgatcaattatgtttctgcttttgaaatgaagggagaaagatctgcaaaggtgattggttttatgatacaaccaaataagacatgttcctttactcagaaaatctttcaatattattatatgttttttaacaaaattaatatttttggctacatattaaagttaacagtaatgtagtacttactacatgatgagaactattccaaaaaattaacaaaggttaacctatttaaggttaacaacaaactatgaaagtaagcactattatgtccctattcttcattttaggagaaggagtacagagaaaatacatatattatcagaggtctcccatttagaaggtagtaaaactagaattcaaacccaagtactgtgactccagaatgtgtgttcttcctaaccatgcaccttcatggcattttatgcctgtattaccattcatttagccaatcaactatttgcatttatcttgcttgttccaaaaaacttaaagtaataaaataacaccattgtattactctgttctcacactgataataaagacatacctaagactaggtaatttataaaggaaagagatttaattgactcatggttccacacagctggggaggccacacaatcatggtggaaggcaaatgaggagcaaagtcacatcttacctggtggcaggcaagaaagtttgtggagaggactcccatttataaaacaatcagctctcatgagacttatttactaccttgagagcagtatggggaaaactgccccccatgacttaattatccccacttgcccctgcccttgagacttggggattattacaattcaagttgagatttgtttggggacacagtcaaaccatatcaaccatgttaagtattttaacaagaaaatattcttacacacctttattatagcctgagaaaataatagtatagcataaatttccactttcgagattatgtaaaaaacatttctttatttaaattgctttccataaaaattgtataaatgtattctccccttaattgcatctgagagttctgattctctttcctctatgataatgttgtgtcttttcttctttaacaatttttaaggttaaactttgtttcaagtgtgtggggattcctgtctcagtagaatccacaaaacatgaaaacaaccttggctccagttttttgccatatggagggggcgaagttatgaacgcaaacagcattttctaaaatgctgagttacttgcagcatagtaggcaactaacaaaagaacagatgctttaagagtagacgaagattgttatattttctattcatggcatagttaagcgtaggacacaggaagggcaagtgagttccattgtgtgaatgtgtaggaggacgtggcaagatagcaatttaaaacttttcacctgctttaaaaatatagaacattctgaaattttttgtcagggagataacatggtgaaacccagtctctactaaaaatacaaaaattagccaggcgtggtggtatgtgcctgtaattccagctacttgggaggctgaggctggagaatcgcttgaacctgggaggcggaggtttcagtgagctgagagcatgccactgtactccagcctgggtgacagagcaagactccatctcaaaaaacaataaataaataagagtattaaaattattatattggtttagcaaggacacacacaacttcctgtcaaaagtagaaatcataaacttaaaatcatttagataatgtgattgtggaatacacagaattattttattattttctttcatttttactgtttttcacattcttattgctactattgtttaacatttaaaaagtcttccaagagggttagatataattgtggatatgcaaagagcgcaccatctgctctgacacttaataactataagggtgtccatggaagtgccagttagcttcaaatgcaagttagaggttcaggcaagtaatcttctaggctggaagcatatgcctctctttcagtgtttcaccatgactgtttatttgtctacctatttttgaagttgtggattatttctttctcttaaaagttagcccattctcaggaccagacccttttcccaaacacatgaggtgatgagctttttaaactctgttatagaggcaggcaggaatagatatcaatataatggccctggaaatttcaggtaaccaggcattttgagaaatcttcaaaacaacttcatggtagaaatatatccttatgctttattcttttacaatatttattggctttatataaggttcaaatctttatgttcagcttgggatgaacagaacaaagctctcaaggatcttgtatatgtttaaggaagtaaccctgtatatgtgtatatgacacagtgtcatggagaagcaatcatcaagtctattgggtcaatagtagagaaattttacaccacagggtatatttaaattggctagagcaggtagaatggaacattcaggcagaggtaaaaaaatgaggaagaataaaaagatatgctctactgaagacatctcagtgattctaataacattaggtggaagaaagggggataattaggttagatagaagaccataaatgccaggattaaaaaactggataaaagacaacaagaaaaattacaaatgtactctgtgcaaagagcaaaacatgaagttatatgtgttatgattcaaacttttatatacattgatgagtagtaaagaacatgcacacttacatctaaaataggtgaattttaaatcaataaaatatgtcagagagatattacataattggcaatttctgatgacctggttttgtattgaacagataaattgctttcctcacattttataaaatttgtgtttaacaagaagataatgcataccctcagattcacatattttatatttccaaaataatgcagaaaatattgctagaaacattatatggatataaaatttaccctaaagataataaactcataaatacatactaaacagtagagcacaaggcaatgaattttcatttgtgtcacatagaatcttattctaacgttctctatgtctgaaaaggacaattgtgtaacagataacgtctctgtgaacctagataaaatagcgtattttaatcccaatatgtacatgtctagaattatataatgcatacattatttgacaccagattttaaatggatcacaattaattttttctttatcttcatgttctttatgagaagtaaacagacattgctttaattatggcataaaatatgttccctgtttaatttcaaagacaatttctgtgtcatacatttattgtgggaagaatgcaggaagttaatctactaagggttctctctcattagtttcagataaatcagtgcccaacttaaacactgaggtagtgaatatttttccctaaaatattctttcttaatgttggcctaaattctactatatttgtattcatggctggtagtttgagattgttgctgccttcagtttgatgatagaattttcccacatatgtatgtttcttgggggaattttattttgtcatttactttctacctattatatacttttcttacatattttttctctcttttactaaatcttcttccacttttatagaagtgtttatgtgtaaacaaaaatactatcttatatgaatctagtaaagcacagaaagcccaatctatggaatatatgtgttggtgtgtgtgtgtgtgtgtgtatacacaatctatggaatatgtgtacatatatatgtgtgtgtatgttatatatatatatatgtaagtaaattcaaatattgaatatgtgttggtatttgtttcatttctatatggaaattcaaatattgaatttgaactcaataattatatttactctaatattttttctggtttaccctcttctgttgagaactgctcaccattttcatttggaaataacacaaatacacacattcaatatttaaatttattttggtaaactttaagaaaaaattgatgtaaatactcacaacataccataactttttcttatttattgatatggtttggctctgtgttcccacccaaatctcaccttgaattttaataatttccatgtgtcaaggtcagtaccaagtggaggtaattgaatcatgggggagatttccccaatgatgttctcatgatagtgagtgggttcttgtgagatctgatggctttataagggatttcttccttcactgtgcactcactctgtcctgctgccctgagaaaacgcacttccaccatgattgtaagttttctgaggcctccctagccatgtggaactgtgagccaattaaaccttttttctttataaattacccgatttcagatatttcttcatagtagcatgagaataaactagtacatttactctaatatttttcctggtttaccctcttctgttgagaattactcataggtactttctattcagataacctctgtttctgcttaagaccataagaataaacattattgtaattttattttccccatttttattcatcttcttttgttgtctgtttttttttttactctttggactctgacaaaaatgttctctttgtgtaggaaaaagaagaatttaagtgattttttaaattcttcttttgccaaacaaagatagttttctcactgaagataaaatatgtaatcatttctttaattgacatttttctctatttattcttcattcaaaaactatttggatgttctaactccacagtgggtattatggtaagctattgtacaatttgctaaaatacaccatatcaaccctcactcaacttcaggaatagccataggttttctgctgtctcatcagtatcacctgactaaatgtacatgcttcagtgtacttagtgaaactgccatcactattcgccactgttgtgcatcctgatgctttgaataaaatgtacaatgactgcatatttctaaactgtgccacctgatacagtagctactaactacataaggctctacatgtttaaatttaaattaattcagataaataatatgaaatttgatatttttacaaacactggtagtatttaaatagctcaataggcacaagtgattattgtattgtaaaaagcctatgtagaggatttccatcattgtagatagttattttggacatagtatatgggccaagggaacaggatataatctcataggtctataaaacatttatcttttttctactgtgagtacaaatcaatgaatccttccgtagccctatagaaaagttaaaggaaacaaattactaagaaattttattttattgtttctttttacactacttaatttacattaattgacacaattatcatacatatttatgttttagttgtcatgcaaataatcattttctgttgcagttggatttttaaaaatgtatttttattctcccttaggtggttctcaaagtaattacccacatgttagtgtctaggttggcatctctacattgtctgttttttaattaaagtatattgtggattaaaagatattttgtatgcataatttttattaataaaaattcaatattactaaaagataaaagtggaaatattgcacttgtttttgttcctgaattagatcatttcatttatgactctctctctacttctagaaaactaaattgtgatataaacagatggtttgtattttgtcctgttcccaactgttttgttctcacatccacaggaaaggaaaatgacagcttttgtgatattctggaaacaattatttgagaaaatttattccagtcttcatttaaaagtttgaaatttagtataaaacatcgcactgttatccaataaaaatttcttaaacataatatcatgacataaaatcagcattaataaaaataattataattaacatgaaattagtaagcttataggtatcagttactaggtaccgagcactattgagagctttacacagttagcacatgcaattacctaaacagttttctgaggtagatgtttttattattacttttatctcttgatgaaaacctgaggcaggaatataataagatgctatgaacaacccaaatatggctaggagctccatcatacaggaagcacagaaagtcaaataactgtggtgtctgaaattaataggaaaagtttaaacttcagttcctttgcctcaatgtaatcaccagtttgctggttatatgaccttggccacaataattaccttttatgtttcaattatttatcttcataattatcaaaatattattattcaacctatttaaaatagtgaaggaacctgaaaaggaattattgttgcttgattatttggccccattcaccaatctgtcttctgtattaaacagcagtctcaatgattatttttctacgtgtcttactttttctttaagaatacgaatcttagcctgctcattagccaaaatacatggaaaatggacagaccaactatatcatttattttcaaagtgttcctttctttttttatttttaaggtattctttttgaagtatttctatatatacagtgattataggtatgactgcacaggttgggcactgtacagttccagagaatgtcattcacagatattacaaccacacgctgtggctgggattcatataattttctggatatattatttaaattatctcctattttaataattccaaagtcaaaatagaaaactgtacttatgtatttctaagagatattcttgaatatgaatacatggaaagcatgcctatgtaaaatttagaacatattattttttattctaatctggataattattgtcttcattcattcatatccccaagcatttgcaaagaacttcacagtttatccaagtgttaacattaaaattagattgtgaattagagcaaatatttatacaacatgacaagataacaaacactttcatataaacaataggttttagataaaccaataaaccaatcaattcccatttacattttgtagttaactatcatttctatgtaatgctagaacatatttttaagtaccacccttttttcctaaagatctgccataagagacataatgaaatgtatataaatatgtgtgcatatatatatcctttattatattatccttttgtttcttcatatatttatatatgtaaataaaataaaatgaataaaatgtaaatgtataaagaaacaaaaggatagcataaatgagaataagagaagataaataatatgttttggaatttactcagcatctgattcattacagcaattaagttttggagttacgtttatgataatcattgacttaattttgtttctgttgcaaagttcagattactcaacgaaataagaacaagtttcttcacatgtcattagggtgatcaataattctaagtcttcttgtttagagctgtgagaaactaagaagaaaaaatgtcatccacatatacctatatataactcagatttttttatactttgaaaagtatgctcttctgtgtgttctccatcatcttaaatatttagttgattttgggatatttaaataggagtgggacatagaggtgaaatggtcattgcttttgctgtccagatggagaaactcgactataaaaaacgtagtgaaactctgctgtcagaagcacaacaaacacacaaatccatattttcaagttcttgttcttgtgtattttccactaaaataaaatatacgatatctcttgtttttggccttttccatagttctgatttcatttaaatacaggcaaaaggaatttttttagttgtatcagaaaaacagagcaggataattatttaatgtaattaattctatttctcttcagggcattgcataaactaggaactactttggtttacaaagaaatatctactataatattttcttacagatttattgaacctaagatagttttctccataaacataattttgaatgcaatctgctgtaaaaagaacatatatttttaagaattactttcaatgcctgttttttctgttgtttctactttccatttgttctttaaaaaacaataaaatttcttacagataaatatatctatattacaaataaagataaatttcttgtctttgtataaggaaaacttagttttctcaattagctaatatagaaatatataagttgttttatattgaaatgtttaatgttaatttacagttttaaatttatggtagtcaaattttgctttgtggattttaacgtattttcagagaagctatacagtatggtgagtaacagcatcaacactgaagccatttaaaaaatcaaattctgacttcatcccttctaaattgtttgacattgaatgagaaatataacctctatgatcctcagtttcctcactggtaatatgggagtaatgactgtgtgtctaactccttgattttctgaatgttaagtgagcttatctatatagtgttctcagaacagtacatcctagaataaaatatcctggaactttcattgtaattattattactggtatgattgtcacataaaccaaaagcacaatgcatgtggtgcatccctatttatgtatatatgaagagctttgtgttttgtcaatagcatttgatatatactcacatcaaagaatctggtcaaacccccatagaatcctgatatcatactttattatttaaaaagtctaaattttgatagatttatcaaacataaaagatattttacttggcggtttagtttgcattgcctctctatataccatgctagatttagaatagagcctctctccatttattcatttctcattagctaagagctttgactaatctaataggtctctgattccattagaatcccaaaagacttctaattctttcaagagaataagaaattcactctctctactttcttgacactgggttatcaattactgcttgtcttctgtgttccaggcagtgggtgagacaccagggatgcaagatattttctacattaatgcacgcataatcaatagtacggcccaaggtcatatataatttgattttataaatatttgaagaggacaataaaatgctacacagttaataatctcacaaagtttacaaaacattttaaactaggatagtaccaaaagtaagtagtaatctactttaatcatctaaagagaacaaaacaccctcatctacacactacacatatgactgcccatctcacagaggtgaagatggcagagtaaagcctatatatttttaaaataggttttgttaaattatgctatatgtgcatagaaatctgtagtttttatgagttattcaaactaaaaaaatattttcttttcttgttgagagtgagagaaggaagggacaaggaaaacaatattctagacttcttatataccaagatatttagtataatattttcatgttatctcagagtttcagcagaggccttgggtaccaactaccccagatctaaggtgtgacattgactacatacacatgacatgttaaggaaatgtagcactgattctctcagcattagtaatcactcacctataataatttagaaaggtcaaggagagactctatttatggaggaacttgtcagtgttttgtgtcgatttattttaagccaaagtacaagacagggattttgaggtaatgactcaaagatgttaacatatacactattgagtttgggaagcatgaggactctatgaggggcagtggctagatggtcattagatatggataacagtgtatcagggaatcacaagagtcactatctgcgatccatgtttttatctatagtgaaagtttcaaaaatcttgtattctatttgtcaaaattgagccatgcagaaggaaggtggctgtagctttcttaagagaatctacccaattgtcctgacatgagttgaaaattgacccagcaaagtagaaagcatggaaaccaaggctcatgtggctaagttgtaaaacgccaggtgcagattatctctcccattatgaattgcatttgaatttttccaccaaggggtgaaggtagaggaggtaaatatctctaattaacatataaaacacaacattatagaaagagccaataatcgtacatttaatgtgcagatttccctaataataaagcacaatgcattcagttttctattttttctgtgttttctttctacgtcaatgcttgaagtgtctgtaaactggatagtgcataggcatgaagcatgacaagagcagagttgaagaaaaggagtaaacttctccaacgccctagagcaagattccaagcctacaatagattcaaaatggtggagaggagacaagttacctttgcattaaattttaaagactttatcattacgatagcctgggtagagctttaattgataaaaataaaatcatttgcatgtttaaataaacttggctacaaccatctatgtacaaggaaagaactggatctagatcagatgaaacggccagatggagaaaacgccaacttttcaacttaacagtaacatattgtgttagttttatatggctgccataaattaccacaacacacagtggtttaaaacaacagacctttattctctaacactttagaggccagaagtccaagatggaaataatggcaaaattgcttctttcttgggggctcagtaagataacttatctcatgcctctctccccatttcccatcatttctaatcatccttggcatttcatggtgtgtgacagcatgactccgatctctgcctctgtcatcaagtcatgttctccatgtgtatctctgtgttcaaattatccgtctttttataaggacactattcaccagattaggaaccacaataattccatacaatctcattttagttcaattacagcttcagagaccctatttccaaataaaattacattcacaggttccagatggacatgaattggggggcaggggagactattctgcccagtactcctgtcacatatttacatacaaatgttagtaagagttttgaagtggatctattccaatttcatgatctgaacattatcttcattctcaaatacacagttagttacattttctgcctgtggatttagcttggtttcctcctcttattttattttattttgttttttttagatggagtctcactccagcctgggaaggctggagtgcagtggcacgaactcggctcactgcaatctctgcctctcaggttcaagcaattcttctacctcagcctcccgagtagccaagattgaggagtgcgccaccacactcagctaatttttgtatttttagcagacactgggtttcgccatgttggccaggctggtttcaaactcctaacctcaggtgatccacccaccgtggcctcccgaagtgcaataacaggtgtgagccaccatgtccagaccatctttttttttttttttttttttttgacacagtctcactctgtttcccaggttggagtacagtggcatgatcataggtcactacagcctccaactgttggactcaaaggattctcccatctcagcctcctgagtaactgggactctaatcttgtgccactgtacttgactaattttttcttttttaactttttgccttttgtagaaataggtctccttttttacccaggctggtgtggaactcctggcttcaagtcaacatcccaccttagccccacaaattgctaggattataggcatgaaccatctgttaattatcttaataaagagagaatgaactcaattggatatctgaaattggaagagaggaaaaaaaggacttaaatttcatgcattcaaaatggagctactaatagtatctatcacataacatataaaagtgatgagaaaatgaaataatacatgtttagaaacaggaagatgtttgaaacataataggcatttatgatttttgcgggcttttttattaagcatgcaaagcaggagaatttttttactgataacaaagtatctcaaaggctaagtatttttagaaaaaggtaaagaattgttaatgacatatccttttcttccatttatgttgaacattataatgttattctactcagtaaaatactaccattttaattgatatcattttaatagaatttcatttttaacacatggaaaaaacagataaatggaagatagttttgattatttattttactttaatgtttgatttttataattcattggaaaagaagcaaagctatatttctctgttcaattattttccaaaaatggtacaatcttttcacctctaagtgttactattgcatattaacaagtaaaataagaacaatattttatttcaaaataagtaagatatattgcctgtactttcacattaaacttatgtagtttacttttttatatttatatgtaaagtagaccaacatttatttatttatttttttttttttttgagacggagtctcgctctgtcgcccaggctcactgcaagctccgcctcccgggttcacgccattctcctgcctcagcctcccgagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggcccaacatttttatatgaataaaggcagacatatttccaaaatgaagagttttatttttttctattcacactcaagagagtacacagaattatcaaatagatccattacatcagctaagttcttaaaagccttatatttattcaaggtagctctgtgagggtatagacagaatttaaaaacatatgcacacatactagaagcccttgacttattctctgctttgccacatgtagttagaaaaaacagtaaaaagggtaaggaatctttgtctatggatttttttccccttttctatattgttagctctcaataatggttacaataaaactttccagagtggaactcattgaccaaaacatagtgatctagccaagcttagtatgatattccgaagtaaaggaaaaacaaatcaaaacataaccgggccatttgaaaataaacaagaaaagtttattttaaggaatctaaactaaaagctaatctaggaaaataaatctttaatttttgtattttttgtggtgatggtgatgtattgttatgtttaattttatttaatttttatcaatgtgaagtggcattacctccagtgtataccgaaagcaatatgctcttttgtttgtttctgcctcagcgatatatatttttccacactggtttgtggctgcatgtcagagccactatgaaattcagttaagcattcacatatcactcttggtaaatgcatggagatgtggcacactaggatgtctgtgtttccattcaatatacacccctgagggcatgaattatgaatcatttatcctagtatttccagagtatatcactatacatggaccacagtacacattcactaaatgtttattaataaaagaaggaattactaatttgaataactaaaattaaccccgccatgaagaaagcatcatctttctttaagagtggctttgtaataggaataagaatctgttaaattatagttattttatattcagttatgttaaggacctaggttttttgagacatatttaattgtataagaaataaaattttaaatgaaacattgactagaaacttatttaggcatggttattaaagaatggaaacatttctggatgatggaaaattctatttcagtatgatatttttttcacaaattattaaatatagtgataacagcattctctcaattcttcccatggttcattcaaataccccttgtatattattttgtgttctttaaccgcaaagtgagcataacctgtatatctcaatgacatttctttctaaataatagtttaagtaagatagaacaaaaatgctatgctattatgattatacatttttgagtctatctagcaatatcattacagatcaaaagctcagagagagcttgacaattctcagaaatggagttacaattttaaagaacaaaatgtcatttcttaaacaatgaatcatcactgatatacaattctccatcaagtaattagtaattcctttatatagtaggtcttatcaacatttttgtaagaaagaaatagagctcacaattggattttagaaatatctgtctttagttcaatagatttcaacatcaccagcctggtctcagcacatatcattagcagctatctcagtggatacagttaattatcactatttctttcagataatgaatactaaatagaatacttgctctgttacaaagtttgaaactgtgcttttgatatgaaaaagatatcactaagagtacaatgaagtggcatctttattttttgctaatgccagcctgaaactttgctcaatgtttttaactgcctagggacatttttcccccactaattgtagccctactgctagtgatttgagaaatcattagtggaattttaaaatcactgttcttacataaacaagccttaattttcaaattcagctttttgcaacgcactgagatataacattttaatgcatactcactgaaggttaccattcttctttattaaatatattgtagtaaacatgttttcaacttgattatgtatactgcattttgaaacaaggagattgagtgactgggcgtgttgagggaaactctatttaatactacctcagataagaaagagggcaaaatcatttcttgtttcaaatagaaatggcttagtaaatgggaattacaaggtcatgtcaatgtgcaatctgattatcagtagaagtatactgagttgaagttcagaggacattgtttttctaccagagggttctgtggaattatattataaataaagttatatatataaaacaaaatagagtccttgtcatatttccttgaaggatatttccacatggcagacttgtgcattcaggaaaaagcaagatgtcttcttttcttattgtctcataatccacatactgaaatagaagttaaaaaatgtaaactaacgtgacttattccaaagaaatgaggggaagatacatatattattacaaataaatctagaccattttggcaaacagcgttagcatttttcttgacaaaagttgctaaaagttggtctgcttcatcactgacaactggttaaaatattgaagaaagaaaagtataaaaatatacacagttcagtcagaagcggaccagacatgaaatgcaatgtgataaaatttaggtagagatgagtgtaggggttaatatacacatcagattttatttcattcttttaaaattattttctatttattatatcccaatggaatcagagtatttaagaaacttcataatttcagcaacctgtctgtgttccttctttgtaaaagaaaatgttcctctatttatatttcaaataattatgtataaaatgttattataactttccagccaccattttccaacatttatagttataatatattacaaatgatgctaaagtggtttattttagaatcctaaatgatcaaataaaataataatacatatgctcagatatcaccttgaagttttcaaggcatttttatttacattacattagttggtcttcaaagcaagcctgtgaggcaagcagcactgtttttagtacagccttgatacagaaaacagaacagtttcatgaggttaatcaatttattgaagtaatggagtcagaaaaaggccaagtcagcttttgagagtgtgtcttctgaatgctgcttccacaacagtttgtccgtatgttagtagcagcaaatccatacaggtatgcagcaacttcagttcttgcctactcacatgaaagaatttgactgaggggcacaaaacagagtaagagactgaggcaagttttaaagcaggagtgaacgtttattaaaaagctttagagcaggaacaataggaagtgatgtacatttggaagagggccaactggacaacttgagagatcaagtgcatggtttgatgtttgacttggagttttttatgttggcatgcttccagggtcttgaatcacttctcccctgattctttccttggggtggactgtccatatgagcagtggtctgccagcacttgggaggggccgtgtgcacagtgcatttactggagttatatgcatgctcacttgacgtgttcttaccttaccagttgaatctccctagaaggtagtttaccagtcaaactctggcattttgcctcttagtgcatatgctctagcccactggccaactcctgagatcttatccggaagctgctgatcaccagtttcaggtatttctatctattgggaaactgcctttctgtggcaccaactgcaaccaattattattttagaaagagagtgtaataattgcctgaccatcccctgatggtcacctgacattcttggtggcagtttggaggggtctcctgccctgttcatgtctgactaactacctactctaacatttttcacgctcaagaatccaagaccccaattctttggggaaaatggtcaaaggtcagtcttctgtaactgcttcctgctgacagaggggatgtgatggttgttctatgggtcttggcctcttgctaactgtgagagtagggtggctccatgcattggagaaagtggtatttagacagctctaaaggagaaaagggaaggatttgcctctgttgtgtctgactaatgggcagcataggggtcccctgtagaaaagtgaatattgagaggatagtatctctcactgaggatcatctggagattgatggcctgaaggcaagaggagataaattgtgttattagatttagaagacatcgaccaaaaaggaaaagtagagatgccaaaacaaaatagcagggtgaagacagtttcaaaaatttctaagactgctgacatacccaggtagctggtggctatagttatgcctgctaaaacttgagttcatggggttgccagccaatttcaatatgtgcccagaattaaaatattgattcaaattttctacattacactgcattactctcttgtttcttttgaggtgcagtcaaagatcactgcttggttcaaagaaataatcaagattagtctaaattgcagacaaaaactaaaaaataattaatgagtctagcacttaataacaggtgtaccacagttcttaaaataatttctctctctccagtcctcatttttattaacaacaaatcatgataagactgatttgcttgcaaaataagctgtagccttattacacttggcctgattatttgtacgaagcatagcaacaataattatttgcctcttgtaaattggcttttatggaactttgcttcacaaggaatcccaaataagaccttttaaagccttaagcccagccatgggtttgtgccatcaaatagctgtacaagttagaaaaattcctcttcattgaggtcccaagataacttgggactcaggaacctgttctgaaagtgtcattatttatttaccacaagtcagaaaccctgtataggaactgtgtagacaaagtataaggctagttttcctaagggtcttttattgactctataagtcaactttgattccttaaaggaatctgtttgtagctgaaaacatgccattccagtcaaagctccagtttctccaactttgtcctgttaaccaaaaaaaaaaaagattaatatggtatttatataaataactacattgccataagttaagaatactcctgaatcgctccaaattctgaagaaatctactagagagaaatatactccaaattttgtttataggagtatgctttactcaattgttaaaaactgtatatagcttagaaaatgttttcttggctttgagaaacaaagaattagcaacattttaagcaaaaagacatacaagaaatattttaagtcttctgtgagttcagtccacgtagttaacttctgttgtgcttgatatttataaacatttccagatctacatgagagccctgaaagtttttttcttttgttctaatgtcacaatcatcaaagttatcagaaactacatttaaccctatgactgattacaaaactaccttttaaagaggattaaaacaaaacaacaattatctgtggaagaccgaaagccttagggcagccaaagacacaataggtaggaaaatgtgttagctctgtggcacacaataatttaacataaaaattataattattatcggtgacatatactaagtcatgtaagaattataggacttttgcataattttggaacacaaaccaataacacatttatacaaataaaactcaaagaaagccagattatacctttgcattagtgtactattgatgtcaaacacagttagtaataaaaccttgtagataaatctagccagccttaatcagtttgaccataaggtaagatttttataaacctttcatagtcctttacaattttctgttatagagtagaacaatgctctaagaaaactgtgttgtgcatttatcccaatgttcaatttatggataaactgaatgtcacccctttaattttagccaatgtattcatatacagaatctttaacaacattaatatttcacaaactttccataacttgcttaaactttcagctttatcctatgcaacctaaaataatcctgtatcctcttaaagtaggcaaaattccacattcccaagccttcttgtgcttttttaacaaaagtacattctactttccttatatgccttggatgtaaaaccgtttttgcagtagtctcaagtacatgttacactgttaactcagcaacttatattttggtgaaaaacctggtaagtaagcaattatctttatgtactaggtttgaagcctaggatactagacagaagtgcagttaaggtttgactcttaccagcatagctaggaggcatggataactctgtatgtccccaggcctaacctagattttaatggctttaaagctggcaagttgtacagttaagagtcatagtagttgtgtatgaccttaagacatttagtagacccaataatgtttaacattgtataacacttcttttattaattcccctacaaataaataaataatttattagatttttgctagggcatgtcaagtaagtgtgggatatttctaaaatcatgaggtaggactgtctgggtttaagtttttggttaaggattcacatagctgtttgggagaaatagggctgttagagaaaaggatgaattcagagattgggcaaatattaagcagggacctattttgaaagtatggttttctccaaaggagtatgaatcttttattttggagagagggcggatgccattttctcctatgacccaacaggatttggaggagggttgcttagagaaggttagcacagagtagatagctcttgaacccacaaggcagatttataattttacttgccacctacagagttgcccttgtctttctcttgttgatgatgatgtctgatttgggagctaatcgagcagagagccccgtagctcaaggccatcaggaattaagtttctgtccagagaccctttggccctcaggacagtcgagtttccagtggccaagcttgtggcagagggggcaagatatgtggggcttttccacatttatcctactgtagcagtttgcattccagtggcctggattctcacagcagtggcagtgacctgaggagtgcccttaagacaacctggaggaggccagagagcttgcagagcagccaatagttgggcctgcctcttctccttgcatgtttccttttccttagccttatcctccttgtcctgatctcagctataaaagaatgaggaggctaatttgagtatttcctgtgtaaggtcactgggttttaaggctgagtattttttttttattattttactttaagttgtagggtacatgtgcacaacgtgcaggtttgttactgcatgtacacatgtatacatgtgccatgttgtgctgtacccattaacttatcatttacattaggtatatctcctaatgctatccctccccccagccccactccacgacaggccccggtgtgtgatgttccccaccctgtgtccaagtgttctcattgttcaattcccacctatgagtgaaaacatgtggtgtttggttttctgtccttgtgatagtttgctcaaaatgatggtttccagcttcatccatgtcactacaaatgacatgaactcatccttttttatggctgcatagtttttaaggctgagttttataattttctcccagttcatttctgggccaaacagtattccaaaggaaacctaattttttgttttaaggtttggagataccagacatttcccttgaggatgcatctgaggggtgtgtcttgtgttatggagacacaattacctatctgcaaaaaaagaacagagaagaaaaaaaaaaggaaaaaggaaaagaaggtgtcacctcttactgtcctattattagtctgaacaaggtattcccccattcatcctccattcatccttagagttccagcatgaactggtcttatcatatacccttaaccttggtctcatctcatcacaattatccatttgagaatcgaggagatcctggaatcaacagggatctgcttgtttatccttggggtatctggaatgaatcggtcttattgggtacacctaaccttgcctttgtctctgttgtaatggtaatttgttagcctagaacaagccttcagctctgtcctatggtttcctgaacctgcagtcttgggctgtcctatagccttgtctccatgacattatagtgactctcacttggagaattctagcaaaaaaatgattacttctcttctcacattccaatttcccatgttctttaagatggaaagcctatttctcagcaaattgctgcaagggaacaggacttcgctcccttcaaatatgactttgaaggtcttgatgcatattgagaagggtgtggaagtaattacagaaatggaggctacaggaggaagcaggaggaagtgagaggaatactcatggaaagcctttatatgctcacaaaaacagcagcccttggattctggaaggcaatgtttattggccctcttgacataaaagagaaacttctggaggattttggggcatggataagggctcaaatggcaaaggcagaatgtcctctcctcacaaagtagtattaactaaaaaaataaataaataaaaaaaaggagatggggttgttaaaggaccacagggtgaggtcttatgcaggcaaaaaaattggttcaaaatccactggaaaacatggccctggggcataacaggaatggaaagcacatggtaagtcataaggagctggtagagccaaggttccaattagtgtctgtcctggcaaggagccaacagcagagaaggaagtcatgtggcatgcaaagcaaagttagagaaaagacaggttgcctcctaagcagaggtcctgcaggtgtgcaaggccatttcagaatacacagagaaaaaacaggagaataggtggtgtgggtttttgtaaaagagtctattttagtggaaaaagcagaggaaactccagacattgcacagtctctggctttagccctaccactctcatgacccttttgtccaaaatgaccattggcatctcaagtctactcggtgcagactccaacatccttctcatccctgtgagccaccaatcagggtgaaactgagagataagccgggaaaagcagagccactgtggccaagaggaattgttctgggggttgtttagtaagcaggaaagtgaaaagttaaaaaaaaaaaaaaaacacatacgggggttgaatgctaccagccaaagaaggcaaggtgtacacatatcttacaaccaggaaatgtatctgaatcatatggcatcaaaatatgttcgaagcattaaatctgtatgaatctcctgcaacctcagttcttgcctccttaatagaaagaattcaaccaagaggcataaggcagaaggagaaaccaaggcaacatttagaacaggagtggaagtttattaaaaagctttataggccgggcacggtggctcacgcctgcaatcccagcactttgggaggccgaggtgggcggatcacctgaagtcaagaggtcgagaccatcctggccaacatggtgaaaccctgtctctactaaaaatacaaaaattagctgggcatggtggtgtgcacctgtagtccctgttactcgggagactgagacaggagaatcgtttgaacccaggaggcagaggttgcagttagctgagatcacgccattggactccagcctggtgacagagcaagactccgtctcagaaaaaaaaaaaaaaaagctttagagcaggaatgaaaggaagtaaagtatgcttgggaaagggccagggagataacttgagagatcaagtgcatgctttgatttttgacttggggttttatatgttggcatgcttccagggtcttgtgttacttctcccatgattcttcccttggggtaggctgtccacatatgcaggggcctgccagcacttggagggggcacaagcacaatgtgtttactgaagttgtatgcgtgctcacttgagacattcttcccttaccagtcaagtgttccttgcaggtcatgtaccagttaaactccaccattttacctctttctgtgcatgcttgagcctacttgcccaagtcctgagaccttaacgggaagctgctgatgaccagcctcaggttttttttttttttttttttttgagacacagtttctctcttgttgctcaggctggagtgcaatggcgtgatctcgcctcacggcaaacttctcctcccagattcaagcgattctcctgcctcagcctcccaagtagctgggattacaggcatatgccatcacacccagctaattttgtatttttagtagagatggggtttctccatgtaggtcaggctggtctcgaactcccgacctcaggtgatccgcctgcttcggcctcccaaaatgctgggatttcaggtatgagccaccacgcccggcctcaggtgttttctatctatggggagactgcctttccctggtgttgactgtgaccaattattactttactgagacaattaagcaaccacctgaccgtaacttgacagttgcctggcatttctgagggcaagggactctccttccctgttcatgtctgactacttaccgtaacatttaaacagaaaatagtatatttgtcacacagacaggtaagacaaagagtcatggagttatgataaaatgaataatatatgacctatagtaataaagaataagagattagaagaagagagagtaaaaatgagacaggaagtggatggggatggttgaagaaaaaaatgagttaaaaaaagttgtagttcaaagggacttataagctttctagaaaatacagcatgcgggatagttgaaaaaagacacttggcagacataagatattaataagaaatgacagaagaggctaatgttttgtagtcagatggaggatctaaggttttgataatgtgactctcaatagagatatgagcacaaagaaggaaaccaaaaagagaaccaaagagaaccaaagggaaccagtaagagatgctgaagtggctgggcacagagactcacacctgtaatctcagcactttgggaggctgaggcaggtggatcacttgaggtcaggagttcaaggccagcctggccaacatggtgaaaccccatctctactaaaaaatacaaatattagctgggcgtggtggcgggtgcctgtaatcccagctacttgggaggctgaggcaggagaatctcttgaacccaggaggcagaggttgcagtgagccgagattgcaccatggtactccaacctgggtgacagattaagactctctggaaaaaaaaaacaaaaaaacaacttatgttgaagcactcaagtagtgacaacaggaaaacagttgccactctcagtctgatagtgcaaagagaagacataatgttattagagctccaaaagagttggaatccttgaaatgggtacactagcagaggctgtattcctgcaggggtgtagcatttgccataatccaaaaagtgaagcagggaagacacagaagaagagagccttacctattttcttctgctatacaaactcctcctgttatctttcagttgttgagaccaatttgcagtcaaaatacagtcaaaaaaggtaaagataggctaattgactgggttagccttatgggttagagagcaaagttcatatctggttaagttatggttagtcttatgtcaatttcttaataatgtaagtgcagtttgactattttttgctcccacttgtaggtctctctctttctcctttgaatcttgggtattcattacaattatcctagtctcattctaatctgtttatcctcccaaagtcccttaacataagtggccttccaattttctgatgaaaccagtcttaatggaagacaacaatgagaataaactctcttgggaacaaaggcaatataaaagaggaaattttagatcaaatgcatctattatgatagaatgtattggagcagggtgaaggcatactagaaaagaatacctttctatgttccatgacattgtgctgcctctcttaagcccatgactaacagaattagcattaccattcaaatccgtctcttcaattctgaatgctccggtataacatccactctgaatatttaaaagctctgctctaccctaccatgatggctttggctttcacaagtgggttttaattgtctggggaggtaaaaggacctaactgccattccattatttagcatttttactgttcacagatatgttcttacttttatagcctccctgttgattttcatgattaatggatgtgtctctctctctggcaaattttgaataagtcttagcctgaatggttataaatgtaggtagctctttcaacctcccttatctaccaacaaggctggtacagataaaacagtacgaggcatgtgtaacatttctataattatgaaataataaaaaataataccaatttttgagattattgtgtcttaatgttgcaatgcagaccggaaatacataaatggtaacacaaacttgtgactgtcatttatcatcatataatactagagatcataaacctttttagctaataaaaaacaaaaagaatggcctggttatgttctctgtcaataatcattttaaaaaggtcagttcggcataagagggcaggttagttcagaatcaataaagatattgtttaatatttctaaaaaaattgttattgatttatctatctataaatttttaaatatttcctgttagatgcctagctcttataagttctgaaaccaggaaagcagaaatcatataaatgtgacatctgaaaaaattatatgtgaactgagtacctcgtataaagataaaaggactcatagtacttgatctgtctttaaaataatcaccacaataacggaaaacaaacatgtaaagacataataccaataatatgagaagagctatttacaaaaaaacagtatacagcctaaaaaggaaattaaagaggagatataatcacagctagcttattgaagtgagggaataggaaagtgtggtgtttcatcattaaatacttcactgaactaaactatttatggtaatgtagaatgtcatagtaatgtgaattattggcagaagagttaatttaggattttagccaaaaaaaaaaaaaaaggtagggatgtaagtaaagcttttaaattcctagctgcttctcagttggtagatgtcattagttgttaatgtaaatttatttgtgattaattatgactgtcaataagaaattttgtagaacgaagtaccggagaaaaaataagaacacatgaagaaagccacataagaagactggcacgaaacaggcagacatccaaggaagttactctaaggagccacaaaaaacaaagtcccatctttaataaaaagatttagagattcaatctgtttcaaagattccctgattaactgtctggaaacatgaagtgtcagattaagcattaagttcagctcatgcttactgctttccatgtcttagaaagggaaagtactttaaaagaaccaatctgtaatatagaagacagggaaaatggctcttaatagaaacaaggaaatgctaagaaaagtaaaccataactgaacaacgctgaaaagtttaaagggaattaaaacataaatggctttagacaggaacagaaaaattatgataaatagaaaaaacatctgcaatactggatatataacattaacgtggatcttcattcatataattttctaagagttttggacaaagtgtaccctgtgactttcataaactgttgatagaaatgtaaaatggtaaaatctcttggaaaatgttcttcagcttcttaaaaaattaaatatagccctatcatctgacccaacaattctactccttggtatttatgaaagagaaaaaggaaatatatgtccttttaaggacttataccaaatgttcagctttatttacaatagccaaaattttttttgtaaaagctaaaaaagtgaaaaaaaaaaaaaggaaatggcacaaatgtttatcaccagataatgaataaccaatttatacattgtttattcaatggacatccaagtgataactattcaagtgataaccaagatacccaaattgtccaaataacatccaaatgtttaccaatggataaatgattatgttatatcgatacaatgggatgctatttatcaattaaatgaataaattattgacgcatgtattgagatggataaagcacaaaatatttatgctgtgtaaaatacgccagaccaaaatacaagagtacataccatatcaattcattctataagtctcaggaaagtaaacagtaatatgcagttactgaaaacaggtcaattgcgttttggagatgtggagtaaaaaagagtgtgagggaggaattaccaggggcattggtaaacttttggatatatactttctcatgattgcagtgatggtttttattgtgtaagcatatgtgaacatttgtcaaatcgtatactttaaatacatgttaaatatgtgtggtttattgaatatcaattatttcttaataatactgcttaagaaaataattgtgagagtcttcattcacgaagtgatcctgagacttttgaagaagctacagagtcccattctcttaagtacagtgatgtcagtcacgaaataatgtgattactttgttaagtgatctcctttactaagggactagcttttgctggctaacaactttccattgggatatttcacattcattaatttattcattcaggtattgtttcattcattatcctatcaacatatctctctatgtctgggtctgtcttagacccttcaaactcaagttctcttaaattgagcaagttatcattttcccatgtcctttacaaggcttctcttcttcacttcttaattttagttaattgtatcattacttaaccatttgccataatgttttttttttttcagcaaacattagtgagggaattcagtataattcaaatactgaattaaaaagataactaagatttagtccatgctctcaaggatattaaactaatgtggtagaagatttaatatgtaaacaaaatgtagtaatataatctgttggttttacaggctatggtatggactgatctattctgtcaaaagtaattttaaaaagctttaaagaaacaaaatatgttaaaaaacagtttgaagagtgactatgaattttatttcagacaagacagagggaattttatctcagtaaacaacatcagaaacaaaagcatagtataaaatgttgtgtttgggcaaagatgaatacttgtggttgttatttaaagagataatgtgaaaaactgctttcagattaagttgccagttcttaaaaagtcataaaaccaaatagaaacatctgaatagactactagaatgagggaggccctgaatgtaccattgtttgaagagttgatgggactagtgtctttcaggccagtgttctctgcgtcctcagaaaatacgcggtgatattgacaccacacatgaagaatccctctcagccttttcaccttgccaagacatcagatttcttcctgcagatcatgtcaaggacattctgacatcgtgtggtagacagatgttctatctagattccccttcaaagaaggaatagctgcctatttaaagaaagtgtggtcagtagaaaatctccagttgtcagcttcttcaggacctacctttgcgtcagggacagctttgcccaaggtcatgttttgcctgaggcagccaatgttctacagctaactgaggagggattataaagctatagctatttaggtctaatgcatgaaaatttagaatggaaatccctgcttctgagctctccatcactaacttgactgattttttatttagggtggcattgtatttcagctcttccctttatatggtcccggtttctcctcctactttttcaaagacattgatcattaacaaatgctttgcactaaaacttcatttcggctgctgtttccagagaactcaacctgcaaatcatctcaacctcattgaatatttgacattgtcaaggctaggtttcagtcaaccaaccaaataaatagtagaattactcctcatgtttaaactaatatattcagtcaagaaaccaaagtgtctccacttaatatactgccccagtgtattgatatgttttggctttcttgatttaattctcttgtatccctagtccccacatatatttttcagttttgttgcctttataaattagcaaatcttgcccgtattttgaaatataaactaatcttctgggtctgatttttatcttatctctgaagcatgctaaaatatgattataatcataagtcttgaacaataagctgtggtgaacttgtgtcttgaggggaaatgacatccccatgcaaggcaacagcctacagttatgaagtaagataaaattagtctccttacccactgctggagatgatgcttccacaggtaaaacaatctaaaggaaattttaatatttaagggtttcaattacaaacaagtgtcaaaattcatcccttctcattttactcccaaataagtgacaattccatagaagtgactttaaaaagtaagaattcaacttgtataattattttcaaccagcataattaaatttggggtataattttcattgttatctcctcagtcgttataagatgtaagtgattattttgggaccacaatagtacctctctaattatctgtgattggtaagaaaactttaaggcactgatcttttatgtttatttctataagcttcttggaataatcagaaaccagcttcccaccctcagttctttatgtcagtattaatacaataatggccaacaactgcctgatcttagatagtataacctatgtattagtccattctcatactgctgtgaagaaatacgtgaaactgggaaaatgtataaaggaaagaggtttaattgactcacagttctgcatggctggggaggcctcaggaaacttacaatcatggcagaaggagaagcaaacgcatccttattcatatggcaccaggagagagaaatgcatagcgaagtgggggaagccccttataaaatcatcgaatcttgtgggaactcacttactatcacaagaacagcatgggggactaactccatgatttattcacctcccacaacatccctccctcaacacattatgggcattacaattcaaattacaattcaagatgtgatttgggtggggacacagccaaatcatatcaacctaaaagactgacgagtgttaatttaagtaattttgataccactgcatgctaaaaatcatctttttctgttaactgtattcatcatcaaaactaatttcagaaatctgtatttaaggatatgattcctgggactaatcatggtaccacttacaggctttgaaagaaagaatcaaaaacccagaagcagtggttggtattgcaccagcgataattaaatataggaactaatgtgtatagcttttaaaaagctactattccatatgctggggaacctaagggacgatatgctgtcacaaaacctatgtgcttagagccagtggctgaacaattgtcatttggtctctgaaggtctggaaaggggtctcctgaggctcccgcttcatagtaagtgcttggacctcttgtgtagatgtgtttttgtgtgtgtgtgtgtgtgtgtgtgtggtgtgttgggggtgtggtcactgtgcagctggtgctgacatccctgacacagtgcagatggctggttctaggagtgctggcagatactgggttggaccctaactgccttttgctgctagaagaatgcaggcaaagttagaaaactggaagaaaattctttttttacttcctccctctttgctgtctccctcaagggcccctctccatgctcccccgtctcctgcccctcattccattgatacaaatgaaaagaaaaccatctggtaagagactttgggaaatgaaatttagagtatagtgtctcaggcccagtgttactaagaagcacacagaagagtgagctgggaattcagaaagaatgaataaatatctttctccgtcatactcagaaaataaaattattttctaaaaaatggattaaagtaaacacagaaatacatacacatacagcagattgatgaccatgctatccacagcagaataaaaattgaaaatgggtcaccaaaactaaagtttagtccaaatatcataagaaataaccaagttggagtttagttatttttgaatgatattatttttcttttattttatgttacagaaaatgggcagctaaagaagataattgagtagggacacagtttattgccattactgctcaaataggttttctttttgtttgtttatgtaggtaattttatcaatcttttcttttacaagtattgaattttgacttacagtgagaatggcctttctcattccaaaatataaagaaattcaatcaagctttcttcaagtactttttctagtgccattattttttgcatttaaatagttgatctatttggatctcatggcatgtggtgcaaaacacagacttatgggaactgctaaataatggtatcgattatgccgcatctgcaattctgggagcagtaatgtgtgattgcatttaggaaaaagctatcagtttattgttctaactagctcagtcatcaggttttactttgaaagggtctgtatgccatacataaatggaattgtcatttttaatagtggtttatacagttggttcatgatttctcctttgtgtaacaaaaagctagagccttagatcaagagctggtttcaacaaagacagatttagccctgagctcacttgtggcactgtctctttttacaaccgtaaaactggcattgcatcattttgagtagaaaatagaatcctcatcatgcttttacattatgcatgtagcaaacatttgttagcaaacttccttataattaattcaattttccccccgagggaaatattgcttaaaaaacatttactgtatgattaatttaattttataaatttgattaatacttcaactttggagcttttcatgtatgttgttaaaataaattctacttgagttttaataatttcatgactgttcctttttagccctgttatttgctttggattgtaaaattcaataagaagaaaattcacagtcaatggaactgggcggtgttggggcttttagtctggaaatgaataacatgcctgtgtagagatgacaataatttaaggctctgagagcaggtctttatttacttactattgaaatcagacacagtctttggtctgatgcagtaaatattttgtaattttattggaaactataacatcctggcactcacagaagccagttttctatacagtgttacatgacatcttcacagtaatgataaattagatgcaacctccaaaatatccaagcttagccatttataaggaaaatggatactgaagcaatcttacttctcataacaacaattttcacaattctggtctactgccagattaattctttttggaatatattaagtgtgtttgcaggaaaagggaaaatgactctagtatttgttgcgtgtttcgtatgtttcaaacactgtattgctctgtgctatgcattttaactttgctatttggtaaaactcccacggtaatccatgaggttgatggtgctaactccatgctgcttttgcagatacagactcagaaaaggcaatattcacagtttgtacaattagtctgtggctttcaactgagatcgcattactattctgccaacaagaaaaatattagtaaaaacaccaagacattctttccataggcacacattatatcagcatatatataagatacatatttttataagattatatatattatatacatacatatttggaacatatgtgcatacacacacatatattcagtggagattgcatgcaagaagtttgtacactttaaactgattcaagttatgcatcttcaatgatttaaaaggaaaacacataatattgtttttaatcaatattgaaagaagaaagaaacttgtattttacctgaattttccaaatctttcacatgtatgagtactaccaagattattttttaataaacagatactttgtattactttcctatgatagtaggaaaagtaataaattatcatagagtgactcaaaccaagagaaatttactctctcacagttttggagggcagaagtccgaaatcagtatcactgcgttaaatcgaggtgttggcctctaaccaactcgggaggctccccctcccctccacttccctctcctcccctcccctccccttcccttcctttcttctttttttctttagttagttcattcttccttgccttttgtggttgatgacattcccaggcttccatccacatcacctttgtccctatctttttatcaccttatcttctgcattgagcgtgtgtactctccctgcttccttgttataaaggtacatgtgatggcattttgggcacaaccaaataatccagaataatctctccgcctaaagatcccgaaatgaatggtatctgcaaagacccccttttcaaataagggaatgtttacatgttccagggattagaatgtgatatattttggggccattttcagccaactacatacttgatatttccgtattcctttgcttattcctctgctgttggttttggtgaaaaaaaaaaaaaaaacagttattctttaaatttgcactgtgagttttattcaataaaggtcttcatatatttatttgtttcaatatttatttcataatttctcacaatgtgctttaagttaggaaattcaaaaacaaccaagtattgttatttgtcaggaaatgacacaagacagcagattcagatgacagcaaagtgataactatgccagtttcagctaaaacaaacatgtagaatttttaaatctattgaacaaaatttcattcagctttaagcactcccaacatcaagagaaaatgctgaaccatccacactctctccttccataccctgtttaaagccggttgttatatggttacaatttctttttctaccaaaatggtctgacattttctcttgccttgtctcagttttgccttcttttactgacagcacctgatttaatgtgaaatatttaatttatatgtttgaaatgagattgaaactatccctggccacattggtggccatttgacttttctgtaaatcaaaaaggattctaaatataaagttttctggaaaaagcattaaggaaaagtaatgcttattgaagacaggcaagagagagacaacacatgtgtaagtgattttattgaaaaagagaagcaatataagggaaaagaaaaaaagataaaattttagaaaaatagggataaaagtaacctgaatctacagatttaacagtacaagatattccatgaaaacttaacacaaaatgttaaaaaatatatgtcaagtagatatcctagtgtagataataactttcaaagacaaataaataattttcattcattatctagatgaaaatatgaagtcatctgtaggggaaaacaaaaacagactgtctttccatacctccttcactatagtgggaaagtgcctacaactttttcatgaaaatcaggcataactccaaaattctatattcaggcaagctgatactcaagtcagttgtcaacatggaagccatttataatatgaaatattaactgaaagtgtacagtgtatttgtccctttgaagaaactatcagaggatgtttctgttaactaagagatagtaaagcaatatataaatttatttgtatggtgttaagttataataaatgttaccatttattataccattatttatggcaatatgtaatattgcaaaatgtaatactaggaaatctgacaatgtagaaaaggtatattatacagaaatttgaagagaagagaagagaagatgggagggaatgaaaatatggggagaaaaagtagggaatggagaagatttcttcatggttcaaagtgggaaataggcattgaagaaataaattattaagaatattatacaaaatcataattgtgaaggtaaccactagaaagtaaacataattatttcttaaaagaacatattccaaaaaagcaatctacatgcagactgagttttaaaaaacaaaaggaagaaaatttcaaacctctgtat

SEQ ID NO: 556 - DNA, 20001 bp, Homo sapiens
caacacatttcttgttactttagaaagaattgatatttttgctagctaaagtcttctcattcagaatttgttatttcttcctattgtccatattatctatacatttacatatgtatgtattatctgaatagaatgataatattgaaagatatatatgaaagaatagtctctttcatagagttcctgggccatttaatattatccaaaagtgttaatatttctcaagaatgctatagttttgttgctattcaaatggaatattatttcacatttccattttagatactttttcactgaatagagagagagatactattggcttatgaatatttatattgaatctagccactaaccaaggtctcattaatttttactgtttcttgtttctatcactcaagttttttatgcatattattagcaaaaaaaaaagaaaaaatgttgctattgcaatttttctggtgattacaacaggaatttactattttaagtaataaaatgccttactgcattttgtaaaatatcttggtaagcagtaacaatgagagatctctgccaagtttctggctttattttgcacagcttttgaatttcaataggtagcacagtatttgctattgctttgggataaaaatcaattatcatgtttatttaagaaatgtttattatgattaaatttttataggaatgactacattttgtgttaccttttcaacagtatctgatatcattttctttaatttgtttatattaattttttattatatgctacttcctgacactaaactgtccttgtttcctggtttaaagctttattttctcatagcattattcttctaacatcatgctgaattccttttagtaagattgaaattatggtttttgcattcctatttttaaagggtttcttaactatccttcagtgagttttattgtttaaaattgtttcaaattatttatccatcaccacaatcctataaattagtatatagattttattttttgagctacttctaatcaagttttgttaatactgtctggcagttttatctcttatggccaagagttatttaagtaatattagaattagtggatctttggtcttgatgttatttttactgataggacttcaacagattgtttttaaagataaatagtcaattagacatttgatttatttaaggttaatttggttaattttattctttcagaaaattatccatttcctctggcaagcattcattcatttttctctcaccaaaaaattgcatgtagaattatcttataattatttaatcacaccaatatctcttgctttttgttttctaagcgtgtttatttttgccttaatcttttatattttaatcaggcttatgctttttaaaagtgtatttatcaatttaaactcctggtgtttagatttctttatccttcccattatttctgcttgccctccaattcattattatcaatttatgtaattggttgacagctgaacaataattaatcaattccttcatcaagatgatgagaattttaacataacaaagcactcacatactttaaaatagtagggagaatgatgaatgtgagaaagcaagctgtgatgagtggtgtagatagtgcactgggtggtggaatgagttgaaggcaggtgagatgtagagaagccagactatgcaaatacatataaattatcaaggatatttacttcatgctaatagcaaggggaaacctattaacgatttcaagcagaaaatggcatgatcctatttgtatttcaaaaatatttttattgatatgtgggatatagttttaacctgttgcaggacttcatgaaaatataagacttcctggaaaccagccaaaatgtgatgatttaactagtatgaaagctatgaagatagaaatgaggtaatagttttgaaagttatataaaaagtaaaacaaataccacatattttgtgtacatatgtagtttaacagagagagagattccaataacaactttgaaatctctggtttctgtgaaaggatagtggtggcttcattcttggagaggaaagagctggaagacaaggacagagaaggagtagcactcactgtttatgatcatgttgagtttccaatccccttattataaccaactagaaaaaagtaagtaaagcagtttgacatatggatttgggtctcacagaaaaaaatctgacttggaaatacacatttgtgaaacattatcactaatgttatcaatatgtataataatgaaaagttaaaattagattgacaattaataggaaatcagtcgaataaaagatgattattcatggaaaccatttagaattatgatggaaatctgcatttaataacaaattactttgctgacatattattatcatttgaaatagtaaattatggaatagtatgatctgaagttttgtagtatttccttatttacaaacattagtttttaaatggatatacagaattacattcacttgtaagtcttaattagcattatttgaatgacaaggtatgattatactcctttgtataattaaggttccttcaaggattagaaaagttgattgcattggttcagactctccttgcaacttaactttattaaatttccagtttgaccaatggaggcagtatattctgtactaaatgcattaggattaatttttcaatttgactccgctatctacccactctacagttatggcatttttcttaatctctataagctttcattttttttcatttgtggagtaaggattaactaactttaaaatatagtaaaatattgggacatttagaatgtgatagataatcccaaaaccagaataaacgtgatagtgttttattctagagaaatggaaactgaactttaaaagaaactcaacactagtaagtgatgagactggaacttgaatacaagtctcctaaatcttgtctggcacagtagctgctttctgaagctaatcaaagtgatgccctatgtcctttcaccttcactggccccatccaaagccctgggagtggtcaagcagtgggtccacataataatgttatttatacattttgtgaaagtatcttaactgcaaacattttataatgctaggtttttttttcaactttagctatcactccattacattttccatgatgttaggtgtcaagtgtctttggaatggtcagggacatttttggcaatcagctaaggggtcatcaagttggaagtacatttagttggtctccagaaatatatcgatatgatttgcagtcccctctatgagtagttactgtggccatttggaagcaggaatggcttcagataataaactaatgacctctttttttattcatcacttatttaaaattgtgcatttttttttcttcaaaattatactgcaaatcatttcaggctctacaaaacctgtctagtattctttgttctacactatgttaaaaatagcttcagtgaggtccttctccttatctgttcttaaatctaacaaattagatatagaaaacaatcccttaattattatatattggataaccctatttttacattactatcctaagcatcatggctacaaagaggaattcaacaagattccttcctttaagatatccaaatctgagagaaagagattttaaaataaaataaagcaatataacatgatggatgctccaactgcaatgatatgatcaaaagtctataggagcaacataaaaggaatcaggaaatctgccccaaaagttgtggatgattcagagtgaatgtcatataaattgaggcagaataggagcaaaagccatttaagacagaaaacagtattacccaaggcatgaaagaattataaataggtgctttaaacactgtttagggaaatggctgaaagtttatagatttctttcatgaattagctggtttatgtttatttgtggtatgtactagaccagacattgattcattatacaattatgataatatctattttatgatcaacagggtatctaaggtacttgcatctctttaaaagagaaataagaagtatatatacagtacagggaggggaaaataagcttgtgtttctgaactgtttcagttcaataattaaaggcaatctcaatacctgtctttggagaactaacctctctagaaaaaaagactattgtttcctgtaccattgaaataaaatttccagttttcaggaaactcaattgaaataactgtagattctatgcttggctaatcaagaaatgtcatactgaaacaattttatgtatttattttgtaacataaaccaacacgatgtactttgcaaatgatattatgatttaattttagaaaatcatattatctcttaataatgaattttgtcatctgcttatgtcacacctggaggcctactagtattaaaggttatatgtttaaagtaagtatttgaaaacaaagtcacttgaaaatgattttatcttcatttatgattatcataattgcatacaactgatgtttctgcctcatttacataattgtgaacaagtgacatatttctatatttcatttgaaatacattctatttttctattctctaagtaaatatttcaatacaaaattcttcttctatgtctgtctatgatgagatatcagaaatagtggttatgaacatggaaactgttttttctaaatcttgagcttctaagcatcgtcagattttcagtggcactacaacaaacatacaagctgaattgcattttttatatatacttactttttatgttgactttgtagccttattttatgccaaaaccattttatctatataaacctgaattctataccatcataaatggtgtagcttttcacagcagtgcacttctgagtattctatcgtctttgaaatagttactttacaaattaaatgtttgatatggtaactttagctgactcatgaatgaattcatgcaaaattattttaaattcaaagtgcaagtgatttttgaaatccattttggagatataaagcactataaaattttaagatagagaagcaagtgtttctgctctaagaacttccttaaacactgtcacataagctgaacattgtatcaccaaatttattgggctctattaatatggtagagaactgatactgaagtagatatagtcaccatactgtggattctcattagacaatgaatccaggcatatgtatttttccaagttaaatttctttcttctttttttttttttttttttttttgagacggagtctcgctctgttgcccaggctggagtgcagtggcgcgatctcggctcactgcaagctctgcctcccgggttcacaccattctcctgcctcagcctcctgagtagctgggactacaggtgcctgccaccacgcccagctaattttttgtatttttagtagagacggggtttcaccgtgttagccaggatggtctcgatctcctgacctggtgatccacctgcctcagcctcccaaagtgctaggattacaggcgtgagccactgcgcccagccagaactatatttcttatatagtataactacactgaattttttcatgctattaaaacattaggctgaattaaataaaacacatttttccccaaatagtttttaagataaaaatgtgagccaggtgcagtggcacacgcctgtaatcccagcactttgagaggccgaggcgggtggatcacttgaggtcagaagtttgagacgagcttggccaacatggtgaaaccccatatctactaaaaatacaaaaattagccgggtgtggtggcacatgcctgtagtcccagctactcaggaggctgaggcaggagaaccacttgaacccgggaggtggaggttgcagtgagccgtgattggttcagtattttcctggatatgcctgtgagggtgtatgagttcattcttacgctgctatgaagaaatactcaagactggatactttataaagaaaagaggtttaattgactcacagttctgcatggctggggaggtcttgggaaccttacaatcatagcagaaggcacctcttcacagggtggcaggagagagaatgagtgccagcaggagaaatgccagatgcttataaaaccatcagatctcgtgggactcactcactatcacgagaacagcatgtgggaaaccgcccccatgatctgattacctccacctaatcctgcccttgacatgtggggataaccattcaagatgaaattttgggtagggacacagtcaaaccatatcagagggtattcctgggtgagaacacattggaatcagtagactgagtaaagaattgcccttcctaatgtgggtgggcctcattccaccaactgaaggcctgaatagaaccaaaaagcaaagtaaaagagaatttgccctctctgcctgactacagagctggaacatcagtcctctgccttcacactaggactcagactaaaacttacactatcaactctcctagttttcaggtgttcagactcagactggagctctaccattggctctcctgggtctccgttttgccaactggagatcctgggattctgggagagatgggattttgtgtaacctgtcttagcttccttggatttggggccttaacaatacatggtaataaatcttgtatttgcttgcctttatcttttctgtatgcttatctctcggaaggcttacctaataaattgtctagtccagttcaaaaatgtttatttatatttcagttgagcattattggtgcaattattagttaacttaaaaaaaatcataagctataagtttagaaagaggaaaggaggctttatttcttataaagggctacagcctgcatagtggccattccacaggttggaaaacatacctttagccaagaccagagacacagcccttggaaggagaaggtgttagggtagaagctatatgctgaacaggttggccaaacatgcatattcaatagggtacaggaggagctatgtatattcataaaggtggtcctgacacatgcttattgaacaaacctgcatgtaacatatgacccctgttcattttaggttagagactcagctcttagatgtattaggccctatattttaaaaggtatttttaggacacaaagacatgcaagtgcatagcctgtgtaaaccagccagaactagcccatggttgatggtctcctttccaggggaaagttattaatatcaatctcttatccagtcagagctgtagttatggctggtagaacaggggttttgttagtgtctgccagtggatgtgctgcatttgtttcaatattgcttatcttgaggccagtgcttgttttgcggttagaaaaaaagaaaaaatcttgtggcagttacaacatagtttattctttaagtgtaggggtaggtgacttaactcttgccgggcatggccttaggtcctatttataatttggtgtcttattgttacaaagagtctgctttgtcagtcttataatttctattttaacattaaagctcctcacttgttgtgtctaaaccacaaaagggagagggtatagcgaggcctgtttgacctcctgtcctgttatggccaaaaactcagtttaaaggtttgttctggggttgccttggccaagaggttgtccatttggtcagtgagtaggtggggggcagccttagattttatgtttaatttgcatgctactgtaggtgaataaaccatggagttttaagaatactgtgtatgaataagcctaagtctcagaaaatgatgacaattcactccggatgatttaaattaaaaagatctagcagaacatgtcatttcttcccacattctactggtcaagtcaggttacacagcaaaacctgaaatgaatagtgtctgaaaatatactctaccattggggaaatgtgtcaagggtaaagaggaaaatataaataaggatgcaaatgactacaaacagtgcccacctattttttctatgtacaattataaacaagtcaatgacttgtaaatatgagctgatgcctgttgccaagagtttctttctggcacatgtaccaagaattgaaactgtttgactgtcatgtgtatatttcaacatcacaaagtagtgttgattgatttgttttccagaatggttttaccaatatacatcttttatgtctgcctggagtttttgtcaaacatcagggcaaaaatgacatgctatttcttattttacttgaattttccatgagtatgtattcaggttgatcattttttttcaaatacatattgcccttctgacaaattgattgaaaatcaaatatgctagaaagtaaagaagtttcttcaaagagtgaaaaaaataagactttataagcaattttaaacagctgactatattgttggcatctagttttatacattttgtaaataatcaaacccttcctaatggtaaaagagtggaggctctgagtaatttggctatatcattctcgaggaaaaaaaaatcaggcactaaatttgcttattgcctggtagtagttgatatttcatccctcattgattcatccccaaaatactcattgagctcccactatgtgcccatcaagttctaactgctaaaaaaagagcagtgaacaagtaaataacacaaccaagcaggataacttaaagccaaatagattttaacatatagtatgtagaggtgataactattctggaaaaaagatctaaaaaaaggagataaggattttggggttagagatgggagtagagactcacaaattaaataggctgtcagggacagcctgatgacctcaatgaaacccttgaagaaggtgaaggggtgaacaatttaaagatatgaagaaagaacttttcaaaagtagaaacagtgcgaggaccctgaggtgtaaatgtacctggtgtggtcaaagaatagtagggttggagcacaggggtagaagagaagaaccgtagatgatgagattaaggatataatgatgattagattccagtgaagtatttaatctgggtcatactcatagactgagtgagatgggaagactttggaacattttcagcaaaggagtgaacttatttgatttaaatgttaacagcatctttctggctgttgagacggactatagaattacaagggtagaagcaaaaagaccagttagaatcatattatgataatgcaggtgcatgatgaagatggtatggactagtggcaacagtggtggtggtgaggagtggtcaaataataaaaatgttctggagggaaaaccaacctgattttctaatggcttgaatataaggcatgataagtgtgaagaagctaaaggataatgctatgtgtttctgcctgagcaaatgcaataacagaattgtctataatgaataaaggaaatgttgaaagagaaggacatttaggtagagatactatgagtttgtttttatgtattataattaaaatacctgttgaatatttagataaagatacagtcgagagttggttatatgccatttgaattttagggcaccatccaggattgagttaaatagaaaagggtttcaaggaccctgccatgaagcattttaagaggttcagaagaggaactgagaaagaaaatagggatgcaatagctagtgagataatgggacattcattaaattttactgagactttttaagtttgttgaaaggccaagtagtgatgtcatggttaaaataatctaatttccagttgctttcagaatcagtgtttattatttatcctaagagtccagaaaactctctcccctacacaactttatcctacctaattatgtattatacttgcatctcttctacttcatccttctcttccacttcctctgtcactactcagtaaaatgatgcctttctgtcttttgtttattatgtctttttccagctctgacaaattctttcaaaaagttattcatttgcacttatcataaggtagccaaggttaataacttctttaaagcaattctagagttctttttatttacacaggaacatacacaccacagcagcacacatttaattccatactttatttttaatctactagtttaggtttcctaaagacaatttgcctctccagcatgatagaaaggaccactgctttgctttgccttaagaaagtatagtaacattactttgaattaaatgaaatctctttgcctcactgctcatccacggcctgcacatgagcttcacatgtgttattttagtgtgtggcttttcacaatttattatatagataaatggccttgagttcctgtttactattactgtttagccccaagagctgacaaaacgatgaccatttgttcaccttcaatctccaatctttctctcattttatttccctcctcaacgctactcttacattcaatataggagttggattttatttccctccacaactctactcttatactcaatattcaaacatatttttattagggataccccattattaaagtctaaaattagtaaagtagaggtaaaaaggtattttcagtaatttttatataaaatttttaaaatacttgcatacatatcatgttattgcttagatatttaagtggaccaagatttctcagtcttttggcccagggacatagacacattcatttattttcctcggtcacttattatgagattctatgagactggaattctttatcagaacataatctgttacctgaatttgagagaatcacgatcagttaccttgtcctctgttttttcccctaagttttaattcaaggataacgatcaaagtgcaggtggtttcctgtagattaatgatcattcaggagaaatccgtgtccctgggacaaatgtctaatcattaatcctatagaaatgtaaggtacataacacattatcatcaccatcaactggcaattcttttttcgctcaagtaattgcttactttatttcaagctgatgaaagctctaaggtggatattttgtaggcagacgagctctgttaatttactaaccaaagaaatatcagataaggaaaaaaaatcctgaccagtgagttgtataaatttgactcaaaggaaaggagttttaaattcaggtaagtacactgttgaaggagagcatgttaaatgttctctattgcctgccaggcttgtatgtttggggtcgctgcttattttttaatgaatgtgttgtttgtcaaaaaatattttgattctttattagattttatcagattaactatatctaatttataatgccctaaaatggcaaatttactttgggaataagcttaggtcaactttacaaggaacaggccctttttctgggtggctggtcagttgatgtcctgaaattagaagtgaaatcaaactttcacatcataacacaaatattttcaaataaaaatataagggtacatgtggaaaaccactccatgctttcttttatccaccatgcagctactgaatacctagtaagttctaggcactcttctagacacagggaagatggctgtgaaaaagaaagtcactaatgtcctctgctgtgtacatcattgttaaaaacaatggcttaaataataaacacattaataacgtagaaaacactgcaagggaatgaaaagttccatatgtcaaatcaaagtgccatgtataaaaccaaatcaggaagtgatttatggtggagtgcaatcctagataggtggatgagaaagggttttctgagatgacgtttgagtattcctaaaggatgtgaatgagcaggccatgtaaaggtatgaagtaaaaggtttcaggaagatggagcaacaagtacaaaagccctaagatgataaaatatttggcatagtcaatgaataaaaaaataatgttagccagttggagcagagtaagcaaggggagcgtgttggagatgactttggatggacagactgtggaagattatttaaacccttggacaccacagtaagagtttgattcttcttctgcgtcttatggggagccattagagagttttctgtagggtacaacagaaaatctttttaaaaaatatttttctggctgctgacaaagattgtctccttgtctaaactctagtcaggctcctctgagtccccttcttgagtaagcctcaaccttggcctattaaactacagactctcagcacaaatgattttgtccacaccttgcctcccctaacccacacacacatacacacacactaagagacatgaacaaacacaagcacaatttctggtagttcaagatatgtccttaggaggacaaagtgagctcccttaagcaccctgtgggaaaactaagtttgctaaaagaatataaagtttgttccagctaacacctgaagacagggtccttgtctcagcttctgtggaagagcagcagcctaactctacaataaagagccagttcgcaaatgcacatggcctaatcacattggtgaacccctgctttttgcttttttaaaattcccattttcggccaggcgtggtggctcaggcttgtaatcccagcaatttgggagactgaggcgggtggatcacaggtcaggagatggagaccatcctggctaacgcggtgaaacccatctctactaaaaatacacaaaaagtagccgggcgtggtgtcaggcgcctgtagtcccagctatttgggaggctgaagcaggagaatcacttcaacccgggaggcagaggttgcagtaagccgagatcataccactgcactccagcctgggcgacagagcaggactctgtcccaaaaataaataaattaattaattaattaattaattaatttaatttaattaaaaataaaaataccattttcctgatgctgctcaggccccagcagagacattgctgttgctgttccctattccctcattcttcctttaaaatgtctagtcatttttgcacaaatccaagttgagttcagcttatgctgtactctcttccttgttgcaatagtaattactgcataaatctatccttaccaccttagtgtttggctctgtttatctctgacattgtttgaaggacaaaataactgtaaggaagtaagcattgcattagacacaacaagaagctgatgaggtagtctaagaaagactgataaaagttataatagtacaagtggtggaaaggctctagatcttgatgtatgttaaagaaaaaacggacagaatttgatgatgaattggataagaaaaaagttcatgcttttattttttacatatttttattgtccatagaatttttgcactgaatagaaaatattacttttaattttgttaaagtataatttacatgactttttttttttccttttttttttagacagaatcttgccctgtcaccaggctggagtgcactggcatgatctcggctcactgcaacctccgactccctggttcaagcaattctcctgtctcagcctccagagtagctgagattacaggcatacaccaccacccccaactaatttttgtatttttggtagagacagggtttcaccatgttggacaagatggcctcgatatcctgacctcatgatccgcccacctcggccacccaaagtgctgggattacaggcatgagccaccacgcctggcttacatgacattttaataaataaatgtataacccacattccattttttttaagacagtctctgttgcataggctggagtgtaatggcgtggtctaggggctcactgcaacctctgcctccccggtgcaagtgattctcctgcctcagtctccggagtagccaggactacaggcgcccgccaccatgccctgctaatttttttgtattttttgtagagacgggggttttaccatgttgaccagggtggtctcaaactcctgacctcaagggatccacctgccttggcctctcaaactgctgggattacgggcatgaaccattgcgcccagccttgtaacccacattcttagaaacatttctatcacccttatatgttcctttgtgctccttgtcttccccagctcccaccccaaacaagtagacaaccacttttctaatttctttcactatttattaggtttacctctcttagaacttcatatgaattgaatcataaagtagatactcttttatatgttttctttcattgagcataattttttgagattcatccatgctgttttatgttttagtagtatatttgattttattgctgagtgttatagactaaatatgcatttccctccaaagggcatgtgtggtggacttacaccccagggtcatgggattaggaagcaggacctttgcaaaggaattaggtttaaataaaatcattgagagtgaaacccccatgatgggattagtacccttataagagaaagaaacctcagaacttcctctttcttccatgtgaaaaaatacagcaagaaggcagacatcttcgagccaggaagaggaccttttctgaaaactcaaccatgctgccatcctgatcttcatctttccagactagagaactgggataaatacgatctctgttgttgtaagtcagctagtctatggccttttgttatagcagcctgaactaagatgctgggtctaattacatggtatggatttaacacaatgtgtttatccattctttctttgacagacatttaaattgtttctagtatgggcttaatatgaataaagatgttataaacacgttgtataagtcttttcttgtacatgttttaatttttcctttgtaaatatatagatgtggagttgtcaggtcatagggcaaacatacatttaactatatgagaaactatcagaattatttcctaagtggttgtattgtcactcaccagctatgtatgaaagtttcagttgtttcacatacacaaacacctgatattgccagatcttcgaattttagccattcttttaggtgagaaggattatcttattgtggttttaatttgcatttcagtgatgactaatgttgagcatttttttcatgtgctttgagacattcatattcctttcatttgtgcccacttatatctgttgcatatttactcagttgttgtctttttagcattgaattgtgggttatttacatattcagaataaaatctttaatcacatatatatactctagcccaagggcccccaacccccagggccgcagactggaacttgttcgtggcctgttaggaactgggccgcacagcaggcggtgagccatgggcgagcaagcattaccacctgagctctgcctcctgacagatcagcggtggcattagatgctcatacgagagtgcacactcttgtgaactgcacatgtgagggatgtaggttgcgcgctccttatgagaatctaactaatgcctgaagatctgaagtggaacagtttcatcccttaaccatccctcccccactatcactctcatggaaaaagtacatttcacaaaactggccactagtgccagaaaggttgaggacggctgctctagcccatattctgtcaaaaaaactttacccactccaagtttattaagatagtctcttcttttctcctagaagattatttcttttaacttttatatttaggtatatgacccatctcaatttaatttttgtgtttgatatgaagtctggtcaagttttatgttttatagatatccaatttttctgtgccatctgttcaaaggactttcttattctcattaaatcactttaacaacttttgccaaaagttaattgattatgtaattaggggtttattgctgcattctctgctttctttcattgatccatttgtctacatttaagccaatgcaacagggtttgctatagggttatggtaatcctgaaataagtagtgtacattctccaagcaatcttttgcaagtttatcatctagtcaattatttcttcttctggctcctccacaactaaatctcttggacttctgtcccccatgggcggaatatctgagcatttcttcacttttcctaacagaaagactcacatagtcattctctttcacttataaaggcctgtaatctttatccatgtaactatttgggtaacagaagacaatgtctagactcaggcttacttcaagaggcacatctgaggttaccagcctcgagatttaaatgtagagtggaaaatagaatattcttttgtattaagtccaagccgaagtttttaattgggctttaaggtttccttgcactgggagttgctgggtgcttacacacagaagtaaaattgacatctattttctgcatcccttgtgagtgttaccaatacactacaaattagaaacctatagaggacaagaagggagaggcatcgtgattcctctcttctgctgaatcactgcagaattcagtagtttggtgtttttaccataacataattttcagagcaatattattggaagatttccttagaaataaacaaaaaaaaagagataactttcacacaaacatcatggaatattttttaatgttttgtggcttcctgtataattctcttctaacaataattgaaaatctaatttcaactaatttgttttcaatagaaaacatagggaacttctgctgagaacaggataaaactttattcatttatttgcaaatgcacatataaagcttagaatggttttgctattggtaacatgaactatctttgacagacatttaaagtggagaagtaaagtagattaatttaactcagcttttctcccattccaaacagattgatcttcaataaacagaaaatggaaaccctaaaacagtaccattatccacttagaatacagcaggctgaaaccagcaacaaaatgaagatatatatttccagcctatattttgagcatcgtggaactttctggatgcagcacaaaccaggggggagttaccattctgtaggaattgtggccaatgtggataaagaactaccactgaaaagatggaagcctacagaacagaccaaaagataaatgttctctgagtttctaaaatgcttagatgggtttcatgacttttgcaccttctgaaactgaattttctattaatgaaaccacaaaaataatatgatatttttgggagtttatactcaaagttggctaacaataatgaagtggaatggagacacttagggactctattatagatggcatgacaggaatagatagcataaataattggtatctttaaactcctgaggccgactctaaacaatatctttcatatctatgttctccttcttttaaatccatgtatttcataagtcctgataacttaaatgattgaattccacaaaggtgtcctgactcagctcaccctctcctggaggtgttaatgaacagtgaaacagtgacgaaaacagtagcagagtgaataaaggagctgatgggaacaaaagattgtgttttgtttatttgatctttaaaatatagagtattgatattgtcataataaaagctaaggcatagaatgcatttaatcctatacattttccacttggctttcagtgatgcataagacttactaagattggcatactatataaaggcctcaaaaggaggtatgtactgtgttaagttctttgcatgcattatctctagtcggtccttaaatggtgaagctgtacagtgtaggaaagatacagtataaggtaatgattaaaaacttaccctagaggcagatacctggattagaatcctagttcttccacgtatttgctgtatgattttgagcaagctacttaaattatattctcttcagcatttttttttgtaaagtagaggtaataatgtttatcattctgggcatttgtaaacttaaatatatttttaaataaagaatgcttaaaacatgcttactacaaaatgaacccttagtaaattatgtacaaatgtaataagttggatacacttaaaagggttaattataattcttaagttctcacagttttagtggtgaaaatgggccaaaaaccaagatctgatttaaaagtgaaagttcacgttgaatgcatatcctatatactgtcactttcctttcatctaattaagtatttagaacaaatgattatatttgcagaatacatctgtagagtaatgttttaaaagaaacaaatgcctctgccatgctagttgacaaatgatattttagcaaggtgatgcctagaaaagatgctctaatatttgcaataatcccaaggcagcttttaactcataaatgaaaatggctttcctctgtagaaaacttgtcaagtaactgattattattatcttgtaaaggccagttgatgtcttcctcattcatagcccaacaatgttccaaggaggaagaggtcatttagagagaaacctgagacactaatcaagttgactacaagtgacttttttcctcaacatctctttcttcatgtatttttttaaaaaaggttttaactagattatcactaaaatctgttacaggtgtttttccaactgcataccattactatcaggggagaaaggaggggagatgatgaaaaagcatctagctgttctggcaaaattacccagatcacatacctaacccaacttgtgtattattacttaatgtttaacaagagggagcaaagatgtgtcaaattaattgtctaataataatcttacataagacataagatgacataagacaaagactacattcataaaggaaataatgaaccctcatatttataaaaagctttagtttaaagtactatgtaatatgcaaagacacacagagcggtatattagacactgagactcagaagaggggagcatgggagcagttggagggatcaaaagctatttattgggtacaatgtacactgctcgggtggcagttgtactaaaatttcagactttactgctatataattcatccatgtaaccaaaaccacttgtatccctaaaactactgaaataaaaaattaaaataaaaaataaaatcaagtgttacatattgaacattgaatttacaaaaaccttacaaagtagctgttattactgtctttacagcaaaggaaaagagcactttcagcaattttaaggtgtctaatgaaagaaatcattttaagaatttaaggccaggcgcggcggctcacgcctgtaatcccagcactttgggaggctgaagcaggcggatcacgaggtcaggagatggagatcatcctggccaacacggtgaaaccccgtctctactaaaaatacaaaaaaattagccgggcgtggtggtgggcgcctgtagttccagctactcgggaggctgaggcaggaggatggtgtgaacccaggaggcggagtttgcagtgagccgagatcgcgctgctgcactccagcctgggtgacagcaagactccgtctcaaaaaaaaaaaaaaaaaaagaatttcaatcaagtctttgattctaagtccaaaatttggttactacaccatagctatgtgtctgttaagttagcatcttcgtgctctataatgtttttctatctctttgcattcatttttcttttaaaaaagcaacaaaaagtttgagtctatatatttatgttatacaaaataccattatgatatagaaatgcaaaattaaatgagaaagaatattctctaaaggttaatggtgcaagaatggatcctgatttagatcctggctttaccacttacttagttgggtcaaactgcttaacttctgtatgtcttaagaacttcacctgtgaaacttagatcataactctatcgcttagggctgtgagaactcagaaacacatatcataaaatgctcacataacattccaaaacgggtcccctttttgtgattcattcatttatttgaaaaatgcatatgtcctgaataagtgggacaaataaaagatgtaaatcattactcattctcata

SEQ ID NO: 557 - DNA, 20001 bp, Homo sapiens
ttgggttaccctcaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagatttggtcaccaccaggcctgccttagaagagctcctgaaggaagcactaaacatggaaaggaacaaccggtaccagccactgcaaaaacatgccaaattgtaaagaccatccaggctaggaagaaactgcatcaactaatgagcaaaataaccagctaacatcataatgacaggatcaaattcacacataacaatattaactttaattgtaagtggactaaatggtccaattaaaagacacagactggcaaattggataaagagtcaagacccatcagtgtgctgtattcaggaaacacatctcacgtgcagagacacacataggctcaaaataaaaggatggaggaagatctacccagcaaatggaaaacaaaaaaaggcaggggttgcaatcctagtcttggataaaacagactttaaaccaacaaagatcaaaagagacaaagaaggccattacataatggtaaagggatcaattcaacaagaagagctaactatcctaaatatatatgcacccaataccagagcacccagattcattaagcaagtcctgagtgacctacaaagagacttagactcccacacaataataatgggagactttaacatcccactgtcaacattagacagatcaacgagacagaaagttaacaaggatacccaggaattgaactcagttctgcaccaagcggacctaatagacatctacagaactctccaccccaaatcaacagaatatacattcttttcagcaccacaacacacctattccaaaattgaccacatagttcaaagtaaagcactcctcagcaaatgtaaaagaacagaaattataacaaactgtctttcagaccacagtgcaatcaaactagaactcaggattaagaaattcactcaaaactgctcaactacatggaaactgaacaacctgctcctgaatgactactgggcacataacgaaatgaaggcagaaatcaagatgttctttgaaaccaatgagaacaaagacacaacataccagaatctctgggacacattcaaagcagtgtgtagggggaaatttatagcactaaatgcccacaagagaaagtaggaaagataaaaaattgacacccgaacatcacaattaaaagaactagaaaagcaagagtaaacacattcaaaagctagcagacggcaagaaataactaaaatcagagcagaactgaaggagatagagacataaaaaacccttcaaaaaattaatgaatccaggagctggttttttgaaaggatcaacaaaattgatagactgctagcaagactaataaagaagaaaagagagaagaatcaaatagatgcaataaaaaatgataaaggggatatcaccaccgatccctcagaaatacaaactaccatcagagaatactacaaacacctctatgcaaataaactagaatatctagaagaaatggataagttccttgacacatacaccctcccaagactaaaccaggaagaagctgaatctctgaatagaccaataacaggttctgaaattgtggcaataatcaatagtttaccaaccaaaaagagtccaggaccagatggattcacagccgaattctaccagaggtacaaggtggaactggtagcattccttctgaaactattccaatcaatacaaaaagagggaatcctctctaactcattttatgaggccaacatcatcctgataccaaagcctggcagagacacaacaaaaaagcagaattttagaccaatatccttgatgaacattgatgcaaaaatcctcaataaaatactggcaaactaaatccagcaatacatcaaaaagcttatccaccatgatcaagtgggcttcatccttgggatgcaagggtggttcaagatacaaaaatcaataaacgaatccagcatataaacagaaccaatgacaaaaaccacatgattatctcaatagatgcagaaaaggcctttcacaaaattcaacaacccttcatgctaaaaactctcaataaattaggtattgatgggacatatctcaaaatagtaagagctatctatgacaaacccacagccaatatcatactgaatggacaaaaacaggaagcattccctttgaaaactggcacaagacaggggtgccctctctcaccactcctattcaacatagcattggaagttctggccagggcaattaggcaggagaaggaaataaagggtattcaattaggaaaagaggaagtcaaattgtccctgttggcagatgacatgattgtatatctagaaaaccccatcatctcagcccaaaatttccttaagctgataagcaactccagcaaagtctcaggatacaaaatcaatgtacaaaaatcacaagcattcttatacaccaataacagacaaaccgagagccaaatcatgagtgaactcccattcacaattgcttcaaagagaataaaatacctaggaatccaacttacaagggacgtgaaggacctcttcaaggagaactacaaaccactgctcaaggaaataaaagagcatacaaagaaatggaagaacattctatgctcatgggtaggaagaatcaatatcatgaaaatggccatactgcctaaggtactttatagattcaatgccatccccatcaagctaccattgactttcttcacagaattggaaaaaactactttaaagttcatatggaactaaaaaagagcccgcatcaccaagtcaatcctaagccaaaagaacaaagctggaggcatcatagtacctgacttcaaactatactacaaggctacagtaaccaaaacagcatggtactggtaccaaaacagagatatagatcaatggaacagaacagagccctcagaaataatgccacatatctacaactatctgatctttgacaaacttgagaaaaacaagcaatggggaaaggattccctatttaataaatggtgctgggaaaactggctagccatatgtagaaagctgaaaatggatcccttccttacatcttatacaaaaattaattcaagatcgattaaagacttaaacgttagacctaaaaccataaaaaccctagaagaaaacctaggcattaccattcaggacataggcatgggcaaggacttcatggctaaaacaccaaaagcaatggcaacaaaagccaaaattgacaaaagggatgtaattaaacgaaagagcttctgcacagcaaaagaaactaccatcagagtgtacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaagagacacatgaaaaaacacgcatcatcactgaccatcagagaaatgcaaatcaaaaccacagtgagataccatctcacaccagttagaatggcaatcattaaaaagtcaggaaacaacaggtgctggagaggatgtggagaaataggaacacttttacactgctggtgggactgtcaactagttcaaccattgtggaagtcagtgtggcgattcctcagggatctagaactagaaataccatttgacccagccatcccattactgggtatatacccaaaggattataaatcctgctgctataaagacacatgcacatgtatgtttattgcagcactattcacaatagcaaagacttggaagcaacccaaatgtccaacaatgatagactggattaagaagatgtggcacatatacaccatggaatactatgcagtcataaaaaatgatgagttcatgtcctttgtagggacatggatgaaactggaaatcatcattctcagtaaactatcgcaaggacaaaaaaccaaacaccgcatgttctcactcataggtgggaattgaacaatgagaacacatggacacaggaaggggaacatcacactctgaggactgttgtggggtggggggaggggggagggatagcattaggcgatatacctaatattaaatgacgagttaatgggtgcagcacaccagcatggcacatgtatacatatgtaacaaacctgcacatcgtgcacatgtaccttaaaacttaaagtataataataataaaataaaaaaagaataatttatccctacttaaagacagattgtccaatatgtaaccactacatacaaaaaagttataaaattctccttggttttacaatgataaatgaaaaacattaaaattctttaactgaacaaagaaaaaaaaaaagaaagtgtaagttacttgtccaaggttacttattggatttagaattcaagtcctctgaatccaaattcagatcctctgaatcctaaaggactctatccgcaaatttataatcacctgtgagataaaatttcagggtcagcctgacttgtctcaaaatagcacttcactgcccacccttgataatggtagctctggtagctcttattctgccattaagttttggatgatgtttataaagcacatgcttctgtcactgtaagactttggagaaggagatagtaacagcccagaaagtcttgcttgtccccctagttcactgctaattttcacttcggtcccatggttgctctcagatagcatttccaaaattgtgcagattacacgtcctagctgtgggaccttgtacaagttatttaaaccctctgggttccttctgtctgtaaatggggataacaataattccagctgcattgggctgttgtgagcatgaatgagttgctatatttaaaccatttagaatagcgtctgacttatagtagcactcaacgaatgttggatattgttattattgcacttgaagtgcttggcacttagtatatgctcaaaaaatgtgagttacaaaaaataaagaacaaaaaagacaggaagacaaactatagtgaattcacagttctcaaaggtgcagggccttgatgaccagaaagagtggcagaactaactccctcacacaaacttatagacacagttactttggtacagctgaacactatatagcactatataacctcttctgatcccaaactctgctaaagtttatcaccatccatcaagaaaatgccgacgagccactgagctgtgattcatgttgcccatcagagctggcaccagtaatgacctctgttgctgcctctttgtatgtggttggaaccggtaaactcagccattcacctgcacatttttcagtactttggacccctgctataatgaatggactcataggcacttttctcagcaaaaatgacagcagttgcttttaggaagaatgttcaaaagcacatccacaagaatgttcagccaggcatgtaagtaaatgtgaattaagttatcacattctgactaatctctaaagagaatatgcctgcctttgagcagctaagaaaaagaaaaaaaaggattaaattatttgcatgcagaccaactttatgctaagtttgcctttaggacaaaatgtttatattacttcctaccaggtctgcaaacaagctattgtgctctgggctaagaagattatgtgcccagctacctgggtactgagaacacaggttcaaactggtctttgaagagggaaaggctcttacagctaggatatggacaaccataaggaacagcagttctgtgccttatgttggcactttcggttctgtagtgagaattaaatgactaaggacgacttgcttttctctaaaagaatggactgcagaaaaccagggactaattactcctgtggtaatctactccagagaggtgaaagcagtcagaagcaggtaaatacaaatagaaaaaaatcatgcctaggtctagctccttgaagacaccaagttccccattccctgtctggggtttgacacaattctcataaaaaatgcaacgtgggttagtttgactttccttagagcataatgggagattacaaagtactttaaaacaaagtgatgatgacaaacatgcatagacatttcttctttaatgaaagtgttgatgattgtgggttcgattcagaatgaaggtagatgatactcattgctcctcagcccaaaactttccttgatgtgcttttccattactccagcttcttgtagggtatagaaatatgtgatactactagtactataataataaagaaaataagaatagctaaacttatgcagtgcttgttttgtgatagcaccttcctttatacatatttcatttatttcttgcaaaatgcttaagaggtagatgttttattaactgcattctaaagatgtagagaatttaaataacttgctcagttaagtatggagttcagacctaacccagctcttaactatgactgctgtcactgctactactacaactgctatgatgagaatgactactacttcttaactattgctattactgtaactacaacagctactactgtcataattgctacatcagcaacagctactactactactattattgtttcagtaggtagctagtcaggcatgagccgggcaagagagggctccccacctcccaaaaaacaaagcaggattgtgaggtaaccaccaggtgatggtcaggcagttgttaactgtctctctaaaataatcattggtcacagccagttccagggaagggcagtctcccaatagacagaaacatctgaaattggtaatcagcagcttcccagtaagatctcaggggttgggcgagtgggctcaagactgcatattaagaggcaaaatggtggagtttaactggtatatgaccttcctctaagaatgctagaccggtaggggaagaatgcctcaagtgagcatgtgcacaactccagtaaacacactgtacatgctcccctcctaagggctggcaggccactgtgcatgaagatagctcaccccaagggaaggatcgggggaaataatacaagaacccagaagtacaccaacgtatagaaccccaagtcaaaaggtcaaactgtgcacttgatctctcaagtctcttgcttggccctcttccaagtatactttacttcctttcattcccactgtaaagctttttaataaactttcactcctcttctgaaacttgcctcagtctttccttcagcctaatggccctctgccaaattctttcttctgagaaggcaagaattgaggttgctgcagacctgtatggattcattgctggtaacataatgactgacaactacaactagtactactattgatctgactataacagcaactattactactaccacactactactagtagaaatgaacacttatccatcaaattacttaaagctctgtgagaaaaataattcggaatcagatccgaggctctgtttgttaatgataccctaataacttctcatgcttttcatttgaagtagccctaatgacaggtaaaagtgaattcagagttctggaagactagaattttctaaaagtttggcattttttcttaaaaaaagacaaagaatatctcaaatattgtttttttttttctgttgtaacacatcttgttggcttcaaaagaataaacatttttccctagaagattttgagtaaaattgacagcatggaagctgtgccaagcaatctagtgactttgtgttttcccagtaaacttaggtgtgtgagtttgtgcacactaggttggaaaacattgatacatgatggcaaataattgattggctgccataaataaagggttggaagttaatgccggctcaaccctgagctctcagctcaaatgctctctctttgaaaagtcctctctctttccccttgtctccacaactaggtcaacccctgtgcctcaatttttcttaaccattactaatcctcagtagctcttaagactgttgtaattttataaatagttaaatatatgagggcaaatatgtctagttattttcccacggttaaattcctgggtgtaacacagtgcctggcacagagtaggagcttaacattatttacggaatgaatgagtgaagaaaggaatgcatgagcttgctgaagcatcagtccttccctgctgctgctgggtgctgatgtgagcaggctctctcagagtggcaggctcctgccatccagtcacagccagtacaactggcacctcattcactggccacctttggggcatgaagtggtttttatatgtgatgttccagtataaagggaaataagtatttaagctttaaaacattaaaacaacagccatttgaacaagcatgcagctgggcaccctgcactggctaacaccacttttttggtggaaggctctgtgaggagatgcagtcccagctttcctcagaactgtactttgctcagagagggatgacgtgtggtaggacatggttaagtagagggcaatggttcccatccatcttctttaggagctgactactacatccctacaacacttaccttcctcgtgggggaagcatatgcttcacctatgtgctttttgggaattacaggcttacccgcattggccagtcttttttttacagaaatgacaggggaaggagaatctttagcaggcctctctctgtttctttggcctggtactattttggtcagcccatgctgggctgtttaaataatgctgtgaaattctcacttatctagcatgatgggggatagaggcgctccacctaagcggattttccagataactgaaacttatcctgctaagttgcaaaattaaaaaacattgtgttatataaaggcttctaaagtatatgatatttatccctgcctgccttttaaatgagaatatagtgaatatatttcagctttatcttgatggctcagggtcagaactttgaatgtagaatcataggattttagagttgggaccgggccttgataaagattgtctggttccactccctcacaatagacagcaagtgaaggaggcccagagagctggcataactttttgaagactgcacatctaggcaaacagagatgcagataaaaattcagccttcagcttttagctgaggtccttccttttatactagatcagaggttcttcacgcatatagtgtttctcgtctcttcagtaagtagctctaaactgccgtgcttttaacttgttatttctgatttttatattttttcctacatcctccattcaggtttcatttgatctatttgcctctagtggtacctggtcttcttatttgcggtgcctctttaaagaagggggtggtggtggtgatgggagcagggacttttaaacttttttgtatctcccataattttgcacaatgtcttcttgtgcatactaaacacttaataaaatagttgttgattggttgattctatcatctgtgggctggggaattaagtagccaaggctattagaaatgtgttttaaataatggtactctgtactataactaggttctaagagacagcctatggggtcatattataactaaggtttgccagctttgtgataataacttggctactcaaagaccttgcttacttctttctaaattttcaggcagttctgaataatgaaagtcattgggtaaaagcagtgtaagtatagtagcagtaataataacagaatcacagcaaaaataacaacagtaataatattctgcataaacaatgatttaaagccagaattgggagttagattttaaaccaagttctgctgcccgtatggggttaggtcatgtttatacttgtcactctagtttagcccgggccccggtactatggtttgaatgtgtcccccaaagttcatgtgttagaaatttgatcaccaattcattggtgttgggaggtggggcctaatgaaaggtgttttggtcatgggggcaccacattcatgaatgaattaatgctgttatcttgggaatggataccttacagaaggatgaattcagcacccttttctctctctctctccctccctctctctcttgccctctagtgccattccacttttctcaatgggatgatgcaacaagaaggcccttgcaagacactggtcccttgatcttgaacttctcagcccccaggaatgtgagaaataaatttctgttcattataagttacccagcttgtggtatttcattagaacagcacaaaatggacagagacacctgatgtctatcacagttctcagttgtaccccagtgactagcacagggtccttacacagaaggggtatctagtgcttagaggaggcaatgtctgacctaaatcctgagaacaaattggaggtaagcagtcaaaaggaggggttgccttagaaaagtactttagtcagaggaaaactcggttaccaaatttattaggggagaaaatttctttgagaatgaggggagtgtagtccaaggtgaaaccagagaaataagcagagacagttcatgaagagcttagaaatttgctaaggagcaggaattgtatctggaaacacaataaggcatcactggagcatttcaggttgggaaattacatggtcagatttgttttagaaagatcccataagcttcataatggaaaatttattcattccatgaatacacactgaggatatgccttgtgctaggcattcttcctgatgaagctctgaataagtcaaagtccctgatctcaaggagttttcattccattgtgtgtttgtgtgtctggtagtggcagaggtggtgagaaaaagtaggtgtactttaatttcagagagtggcaaagaatctgaaaacaacataaaacagggctttagaaggtggtgggggtgactgggcgctctggctcatgcctgtaatcccagcactttgggaggctgaggtgggcagatcacaaggtcaggggttcgagaccagcctggtcaatatggtgaaaccctgcctctactaagaatacaaatattagccaggtgtggtggtgggcacctgtaatcccagctcctcgggaggctgaggcaggagaatagcttgaacccaggatgcgaaatttgcagtgagctgagatcacgtcaccagcctaggcgacagagcaagattctgtctcagaaaaaaaaaaaaaaaaaaaaaaaaagaaggtgatgggggtaaggagaatatttggattggatgattgggaaatggctccctgagaagtgacacattggagactgagagtaggagaccagttggaagactgaatttgcaagtgagagttgtatgttactggatcagagttaagggaatgtatacaaattatggggaaaggctatttcttacgcccacttctcttggtactgctactaggtggccaagacaatatgaagaatggaagaataggaggaatggcagatgtttccttgttcattgaatacatacttagtaccgatgatgtgccagacattcttctagacactgagcactgagcagggaacaaaataaactccttgcccttatgacactcattatcatttcatataaacaaataagtatgcaatattttaggtgataatgagtgctaagatggaaagtaaagcagagtaaaatgacagagtgtgacaatgcaggggatgacttataggaaatttgggtaaattggacacagtgacattccagtggagttccctattacatgcctagtgtctagaagaatgcctggcacatcacaggcactgaattatgagaggcagtgaatcttctagatatctctgggaaaagtgtcctaagccaaggaaataacagaggcagatgtcctgaagtgagattgtgcttggcatgtgttttgggtactgccaggatgaagtcgcagctggagcacaacaggccaggggaagagtggtaagagaggacaccagagaggctctgaggaccctgtggaccttgagaggactgtggctttcattctgaatgagaatgtggatttcctgcaatatcttgagtagagaaatgacatgaatgactaacattcaaaaaagttattctggtagctctgtgaagcgagaaatttaggggacaagggtgaattcagggagctggttagaagccttttgcaaaatccagatgagagatgttgacttagatatattaagctaatggccgtggaagtggtaggaagtggctggattcagctatgtttgaaaggcagtgtgaacaagatttgctgttgaactgagtgtggataaagagctagagggtcaaagataatttcaaaatttttggcatgagcaactggacagatgggattgattttttttaagagaggattgactgtagaagaaacaggttagagggaaaaaattaagtacagtttttgtatgtgtcaagtttgagatgcctgttagatatccaagtggtagtgtccgcttgatggttggaaatacaaggctagaacttgagaagaggttacagctggatggatcaactctaaagttgccagtttatatttggatctttgtcctagaggtcaagtgaagaaagtgtttcaaggagaaagaaataataagggctgaaatatactgcaactgtaagaagttatatggaaccaagagatgaccactgctatgatggagattaaggacagtagcagtggaatggtggggacaaaagtctagatcaagagagaattggcagagaggaatttgacactgcaagtataaataactgttgtttcttttaacttgagattttccataaaagttagcaaataatggttgttggaggagaatgtgaggtctgggagggcttctctataagataggtgatctcataatatgtttttgtttatgagcatgatccagaagagaggggaaattccatgaggtaggagagaggagagcaggagcagagggatcccatgtgcaatggaagggctggcctctgacaggagtgtgaacagatcacccattttaacaagagggaagaaagagcatatgaggagaggtgctagcaggtttttggccatgggaagatgtgaaatctcttctgactgcctccatttacctactgaataaggatctaggtcataactgagaggaagggtagcagaagcagtgttggaaatttaggaaagaaaacaaaatatggattattcctctggagagtgggagactgagaatgaattagggaaatataatatgcatgccaggaagcagcaggatcctacctggagtttggagtcataaatttgaaatgaaaccaatcagcataattatgtgttcatctatccagtggcttgggtgtctgtgattcaggtgttggttcagagtggggtttgcaactaattagagttggaggaaagggaggttaggccatgtgcaatgcagtgagcaataatgatgggctctggaatctgggtgagggtgaagaggggcagcaatcaatggattattggagttggggtactatggagcgagtcagaaagatagcagatggagctcagagaacgggatgcttgaacccgagccaatggaagtagagcagtcatttgtaatgacagtgtgtatatatagcaaagagggaggctggagagtgtatggtggaagatcagatcattgtagctgagaacgtgataaaattgaaaggccaggatattggaaggagttctgagtagacattgaaattaccaagtgtagtggtggagaaagtgacagtgagtcagaggctgcatctttcaggggcgatgagaagtaatcagttggtctgcagggaggatgaatggatggtataaggttgatagcgtgactttacagagcaaagggagaaatattttaacctcagatagcaccttgtgcgcattgtcatgatgctatcttattctgttttgttttaggttgtgaccttatttttctctttgacaagccccatcttctcactaaactgtgagttcattaggcgtagggacggtgttctgatttttgcctcccacagtgcctaacatagtgtcctgtctatagcaggcaattattatttgttgaattagattgcaccaaatgtggaaatttaaagatcaagtagctaacaactttagatgcaatattgaaataaaaattacacctagatgtattgtgtgtactaaaaacatagcactgtcagctaatcatgtagttccaattgttttcagagttctaaaggcattaaaaatataatttgatcataaatattgcaaagaaaagcctgaggccattatatttgcatggaaaggtgctgtttccttgtttctatactgcaggaataaaaatgtctggaaaaggacaccatttaccagctttgactatttcctgaaccccccaaatatttgttcatccaaaattgcactttgcaagctaaggaatagttaatttttattagcaaaaggagctgtacccctgccttaaccagacctaaggcaaactgggcaatgcaaagcatatttttcttttaaatctcctctctgtgcaaaggcattgtatgtgatgaataataaacatcacaagaaaagagaaattttgattgaaactgtaaactcaacttagatttgtttccataacttacttctgcagcatctaaatgtaaattgtaagggtgaagaactgttttacgtgatgtccaaaattgccttttgaaaaccgtgatgcagtgtcagcactgtacttgtaccactgacagaggtaatagagagagggtatttcctacacactacccacgctttccatgggtaattcacattctccttgtgtctttcaattaccactggcaaaatgcataagtaatcaacttagatcaaatatgcttgatttgtactctttctttctcatctctgtcacctcttgctctccctcttctttttttccctctctcctcttttcctagacactcataaaccagaatcactttaagataatagctccttcaaaaatgcaactccacaggatttaattaaaccataagtcccagactggcctggggaggctgaagtagttaatgtgagatgaatctttgttcagaaagaacatgggatttgtcttagtccattttgtgctgctataacagagtacctgagactgggtaatttataatgaacagaaatttatttggctcacggtttggaggctgaatgtaagattgaggggccacatttgtgagggcgccttcttgctgcatcataccatggtggaatgctgaaggttaagagagtgtgcaactgagagagaacaagagggagccaaatttgcttttataacaaactcactctcatggtaatgacattaatccattcataagggcagagccctcacggcctaattagcccttaaaggtcctaccttttgacacttttttactggggattatttcaaacccatgaactttgggggacagcttcacaccatagcaggattccagtggcttcaaggtgtcaggcaccaatcacattaagagacagatttggcttgtcactgattatgtgaattcagtgaattaaatgatgggctagagaatttgcagccctcagtgttgtgtggccttggctatggcaatatcctttctttctgcttccatatctgtaaagtggactttgagtagcaagcttaaactttgttgttgcttgaaaaataactttttagagcttgagtcccaatattttgccttcagtttacatcccagcactttgggaggccaaggtgggaggatcacgaggtcaagagatggagaccatcctggccaacatggtgaaaccccgtctatactaaaaatacaaaaattagccagcgtggtggtgcacacctgtagtcccagctgcttgggaggctgaggcaggagagtcacttgaacccaggaggtggaggttgcagtgagccaagattgcgacactacactccagcctggtgacagagtgagactccgtctaaaaaaaaaaaaagaaaaaaggttaaatgactatactggggatattacacttgttgcagatatttgggtaaacatgtcaggaattgttttgttaatgagtaactcatattccatcatatctcctagggttttggagtaaggtaaattaaactacataagacagaattgctatacgccttccttaactgtacctagggctaattgttcaagcaaaaacactgttcttaaaaatctcctggctaggagaattattatagtagctaatattgacataatgcttactatgtgctaaggagagaaagagtgagggagggagggagagagagagagagaggaagaaggaaagaaagaaagaaggaaagagaaagaaagaaagaaagaaagaaagaaagatttattatcagtaataagacatatgatttacacaattaaggaggctgagaagtcccaagaagtcctcagatctgaagccaatggtatgactctagtctgagtccgaaggcctgagaaccaggagagctgatggtatagctctagttcaaaggccagaaaaaactggtgttccagctagaaggcagttaggcattaggagttcccttttagtctagggagggtcaatatttctgttctatttagaccttcaactgattagatgaggccacccccactagggagggcaatctactgattcagtgttaatctcatccaaacacaccttcacagacacatccagaatataatttgaccaaatatctgggcagtctgtggtccagtcaagttaacacataaaattaaccactacagcatggaaatgctcagccaggatttgggtccaggcaatgtagctccagagtatgtgcttttggccagagtatagttggtcttttgtatctatgggggattgtttccaggaccctttggggatgccaaaatctttagatgctcaagtccgttatataaaatggcatagtacagttgtccctctgtatttctgtgggttctgcatttgagaattcaaccaaccacaaatgaaaaatgcatacagttggtcctctatatttgcaggttttgatccatggttgtttaaaccccaggacacaaaacccatggaaacagagggccaactgtctgaacttataaactttctaaagccttagcaattgttcctttaacttactcaacatgaatgtcaagcaatgctcccacctgagctttgacaaagattttgtaattatcaaaagtacaaatccctaacatcttcctataaacaacctcactcttccaaggtaactttataaagagaaagagtttgctactggagtgtttgaccttcttcccaggagaccttattttgtcccttaaagttttatagtaaccaaacctatatcctcgcttgcctcatactaaatctcaaatattacaaatctgataatttataaaccatataaggaaaacagacatgctttacttttttcttcctagatcttgatacatggagagctgtaactaggccgcaggtttgacggctgggccttcctgcctgattcagctcttccaggaatacaacattgaatgaaaatggcaaagacactgctttcttacttaacagtgagggatacagtcaatacgtaagtaggcaaatataaaaagatacaatgggaagttggttagctttgtgacaaaaatggagctgagggaggggaagaatagagatggaagatgtgagtgaggtgactacacagggggatcaggaaagtcttctttggagcaggtgccatcttagcagggatttgaatgaaataaaggagtgagccatgaggtgacctgaggaaagaaccctctagaggggagctgcttgagtcaaggccctgagtgtggagactgctcattgtgtttaaggaaaagcatggttagagcaatgtgagccaggggaagagaggaaggtgatgacgccagagagcctcagccaggtgatgcagggtatttaggtttatggcaaaggctttggattttgtgatgaggagacactgaaaggttttgagtagggaaatggcatgatctgactcacattttaaagaatttctttgtttactatatggagaatagtctcttgggagaaagtgtcgaagtgtggcagctattgcaacaatccaggtgagaagggatggtaggaggagcagggtggggtagcaggggaggtggtgggaattatttgaagctgggttacattttgaaggtagtggtaaggggctttgttgatggattcactgtgtgatgtgagccaattgtgttttaatatcagacctctgtaaaggtgatcttataactcagcagatttatgtgcaggagagtcggttggactaaatggtatctaaggtctgtttctccaacacagtgattttaatcacatttactacacgctccctgagatataacaacactcaactattttatcagctgcagttaaattttattcttcccatatctgaagctcagcatatcttcttttgatccagagggatttttaatagcaacattattagttcaccaaaacaaaagccgatgaaagaaaacagatgccttttcttatttattttttgtcaccttcatacaatggcaggacaatgtataaaaatattacagaaaaaatttcaagaatatgtatctattaagtaaatatgggggaaagaagcccatgcagaagaaaaacaactcataacaaaacacaatattaaataaccatcagagaaggaccagagaaagaattactttatttagctatatcagtgaaaaattgcctggctttataccagaaaaaaatccctataatccactttgaaaactgcttgctccttattttatgcatgacatttctacgctgcaaaattcctgattgagctggtgattagaggacaatgccttcgctccttttctttgtcttcttttcttggaagcagccttgcctctgcttctgcttcctctgaatggctcatgaaagtcagagacagagagagcaatgagacagacatgcatcaaagcactgatttcgttaaagaggaataactagcgggaatgtgcagcagctaatgcaggaagtgttggcagagtggagaaagggaatgagaagggtcagcaaagagtgattttacctgcagtgttgaaggtcagaaaggtgttaggtattaattgcccccaactccaaataaagtaaagctttgtttgatttgcaggtagctccgaagagagatggctcattttcaacctgcatgtttatatcatgctacttaaatggcctgttgaggcacaagggctgctgtgaggccacagtgggaagaggaggaagtgttgggatgcatgtgggatagagttaaaagtggtaatttattatgattgctttccatgctcgccataatagactacttctgagcaatcaggatgtgctcctgcaggacttggggtggcacaggtaggcattatttaattcatctgtgtgagagtgagcaacagagggagataaagtgggtattaatcaggattgtatgagttctgggatagctgcatctaaatcaatccacaacatcgtctgggaaatcaactccctgttttcagctggcttacacttcttttttttttttttttcctggtggggggatattagaagcttttttttcccactcacttcttcccaggttggttcatcttaatgagccccagaaaattcatatgtcagaaggaatttgctctgactggaatttcattccacagtctctgaataatgatgacctgtacgcattactgggacattatctgatagcctggggctcttctgagt

SEQ ID NO: 558 - DNA, 20001 bp, Homo sapiens
actttgttgtaagaacaaggattaattgtgccggtaatccttttatttcaataaattattttttgctcctttaaaaaatattagggatttttttctgataaagtgttcctttttgtccatattttcaggtcgtcttttaattctttaatcactttttaatacagtatatattaggtaggagagctctctgataggaagcatcatagtaagatggttacaagcaagaacaccaaagtttgagtatgtaacatattttatatgtgcagagaggtagtattctaaatttatctgtttcattttcataatatggaaaatagggaagttatcaatatctgtttgcaatcttttgagaactaaatgttagcacaggtgaaaactgaggatatgctgtgatacacagtacacactcattaaataatagctatttatatattacataaaattttaagagaatctatccctgctatgtgttcttcctgcttattcttgctgtatgaaataagatattaatgcaagaacacaatgaaatattaattagaaaatttatttaactctcacgattttgagataggtattactattattctcatttaaaaagtggaatttgggtctttgttctcgtgggtttcaaagaacatctttatttctgccttcatttcactatttacccagtagtcattcaggagcaggttgttcagtttccatgtagttgagcagttttgagtgagtttcttaatcctgagttctagtttgattgcactgtggtctgagagacagtttgttataatttctgttcttttacatttgcagaggagtgctttacttccaactatgtggtcaattttggaataggtatggtgcggtgctgggaagaatgtatattctgttgatttggggtggagagttctgtagatgtctattaggtccgcttggtggagagctgagttcaattcctgtatatccttatgaactttctgtctcgttgatctgtctaatgtggacagtggggtgttaaagtcccccattattattgtatgggaatctaagtctctttgtaggtctctaaggacttgctttatgaatctgggtgctcttgtattgagtgcatacatatttaggatagttagctcttcttgtcaaattgatccctttgccattatgtattggccttctttgtctcttttgatctttgttggtttaaagtctgttttatccgagactaggattgtaacccccgcctttttttgttttccatttgcttggtagattttcctccatccctttattttgagcctatgtgtgtctctgcacgtgagatgggtttcctgaatacagcacactgatgggtcttgactcttcatccaatttgccagtatgtgtcttttaattggagtatttagcccatttatgtttaaggttaatattgttgtgtgtgaatttgaccctgtcattatgatgttagctggttattttgctcgttagttgatgcagtttcttcctagcgtcgatggtctttacaatttggcatgcttttgcagtggctggtactggttgttcctttccatgtttagtgcttccttcaggagctcttttagggcaggcctggtggtgacaaaatctctcagcatttgcttgtctgtaaagtattttatttctccatcacttatgaagcttagtttggctggatatgaaattctgggttgaaaattcttttctttaaggatgttgaatattggcccccactcgcttctggcttctagagtttctgccgagagatccgctgttagtctgatgggcttccctttgtgggtaaccctacctttctgtctggctgcccttaacattttttccttcatttcaactttggtgaatctgactattatgtgtcttggagttgctcttcttgaggagtatctttgtggtgttctctgcatttcctgaatctgaatgttggcctgccttgctagattggggaagttctcctggataatatcctgcatagtgttttccaacttggttccattctccatggtactagtaccaaaacagagatatagacaaatggaacagaacagagccctcagaaataataccacacatctacaactatctgatatttgacaaacctgacaaaaacaagaaatggggaaacaattccctatttaataaatggtgctgggaaaactggctagccatgtgtagaaagctgaaactggatcccttccttacaccttatacaaaaattaattcaagatggattaaagatttaaatgttagacctaaaaccataaaaaccctagaagaaaacctaggcaataccaatcaggacataggcataggcaaggacttcatgtctaaaacaccaaaagcaatggcaacaaaagccaaaattgacaaatgggatctaattaaactaaagagcttctgcacagcaaaagaaactaccatcacagtgatcaggcaacctacagaatgggagaaaatttttgcaatctactcatctgacaaagggctaatatccagaatctatacttaacccaaacaaatttacaagaaaaaaacaaacaaccccatcaatgagtgggcaaaggatatgaacagacatttctcaaaagaagacatttatgcagccaacagacacatgaaaaaatgctcatcatcactggccatcagagaaatgcaaatcaaaaccgcaatgagaaaccatcttacaccagttagaatggtgatcattaaaaagtcaggaaacaactggtgctggagtggatgtgaagaaataggaacacttttacactgttggtgggactgtaaactagttcaaccattgtggaagacagtgtggctattcctcagggatctagaactagaaataccatttgacccaacaatcccattactgggtatatacccaaaggattattaatcatgctgctataaagacacaggcacacatatgtttactgtggcactattcacaatagcaaagacttggaaccaacccaaatgtccaacaatgacagactggattaagaaaatgtggcatatataaaccatggaatgctatgcagccataaaaaatgatgagttcatgtcctttgtagggacatggatgaagctggaaaccatcattctgagcaaactatcgaaaggacaaaaaaccaaacacctcatgttctcactcataggtgggaattgaataatgagaacacatggacacaggaaggggaacatcacacatcggggcctgttgtggggtgaggggaggggggagggatagcattcagagacaggagatatacctaatgttaaatgacaagttaatgggtgcagcacaccaacatggcacatgtatacatatgaaacaaacctgcacgttgtgcacatgtaccctaaaacttaaagtataataaaaaaaaaaagaaaaaaaatggaattttggcacagagagtgcaaatccttttttccaaaacatacacatattcagggccagttctaggatttgaacccattcctacctcacctgagagctagggatcttatttgcaataactttgctttagtgcatttaatgacacttctctcctatccttcaattatctgaatgccatttatctgccttctaagtaagcaataaccattatggcctgttcttcctcatgaattaaaaactaatatgaagaaatatacactattagtggaaacattagtagctcttcacattttatttttaattcatcaatagaataggaaacttattaaataaaaataagtatagatgcatgtatttattctccatagattatttcagtcataagaattatagtttgttagttgtaataaaaaatcaaaaccatatattgtttgagaattatcctgatctttgtagaccttcctgcttctaagtgagaaacaaaaatttgaatttcagaaagaggctcagtgattaaattaagagtagggatacaaatgaagttttgactgaaggcagagctatggaatatagaagtcctaaaaaagtgaaaatgcctccatacctgtaataattttcctcattagcagtttcagaatttaaaggacatgttagaagatggcctttgttggaaataaaattattttgtttttggttcctaatatcaaataactcaaatatgggtcaattattttcacatacaagaaaattaaattttgtaaattatctgtaagaactcataagcccagttaccacacatgctatggtttgaatgttcgtcccctctaaaattcgtgttcaaatttaattgtcaatgtaacagcacttggaagtggggtatttaagaggtgattaggccgtgaaggctctactctcataactagtctaaagtctttacaaaagaactttcaggagtcggttccctctctccttctcacctttcaccatgtgctgatgcaacaagaaggctctcaccagatgccagcatcttaatattgaaattcctagcctccagaatgataatctaatatatttctgttcgttgtaaattacccagtctcaatattctgttttagcagcacaaaataaactaaaacaacccatagactgggaaaacaaaaaatggaggaaggctacactctgcatctcttttatcttgtcatttttgagagagacgtataatggagtatgtctgcattataagaaaaacaaacaacagggcaagtatgataacgaaatgcaacttacttttagtcttggttattagagctacaataagggctggtagagattgtggaaaattgggaagtccatggccttgtgtaaattaggaacacactcaccaactcctgttgtttatgctgagtctagtagttccagagagtctgacatttcaagataatctggaaaaccatatttcatatgaattattccaatttttaaatgttgctacaaaacagttgtatgccaaacaatataaatctacatgttaaatctgtgctttagatcaccagcaatttctgaaatattggctttggtttcaagcagtctgtcaactgttgttcagaatggaaaaaataattttgaaatgacatcaatcaaagccctatttatgattgagttgtcaaagccagtcatttatttgtttaatcttagatactgtgatatgatagccaagatatctttatcttcctcctggattactgcctcggcttcccaactgccctgtgactttgctttgatttccttctgccgattcttcacagagaagccacagtgattctgtccaggcataaggcaggccatgccaatcttctgcctaaaaccactagtgggtttccatttacattaaaagccaaaaccttataaattcctagataacttgaacctattaaatttttcttttttatttttttcctttctttttttttttttttttttttttgagacagtgtatggctctgtcacccaagctggagttcagtggcatgatctcagctcactgcaacctctgccccctgggctcaagtgatcctcccatctcagcctccctcccatagtgggatcaggggcataccactatgctcagctgattttttttgtgtttttggcagatatggggttttaccatgttgcccaggctgatctctaactcctgagctcaagcgacccacccatcttggcctcccaaattgatgggattccagacctgagccactgcatctggcctaactttctaattatgatcatacctccacatatggttctcacttccctttcttcttcacttctaactcattcacctcagtaaggtttcttcaacactgcccatagactctttcttgaggcagttgttactttctctgttggatttctctttttacttacatctgcatggccagttctctcatttctctcacgtgattattcaaaagtcactctctgaataaggtctttccaggctcccctatctaaaacgttaatggcctattcatgacttcttacagcattcttgctcaatagattaatgaactcacagattgattaatcatgttttccctgtaaaatctaacatacacatacatcaggggcttgtggtgtacatccttacctttgtcttgtttaatatcattgagtcacgattttgcaaagaaaacaaaaaacccacaagttttattcaaatgaaccagttttctctacgcttcattgaagtaagaactgaaatttttatgatctgaaattttttaaaaaaatagggagatggtgtggatcagttcaatgttttctgattacttaccgtattaaagtagtagagattagtgagccaagcataattgataattaaaaataagatagatttttcaaatacttaaagcctccaacaagcccttcacaaatcttggctatggataaagataaaaacaagtaattttaaagggtagcaggtagtgggggataaagttaagatggttaaggggtacaaagatccagttagaatgaatacgatataatactcagtagcacagtatgttggctataattaacaatattctattttatattttaaaataactaaaagactgaaattagaatgttcctaacataaataaatgacaaatgcttgaggtgatcgataccccaattatcctgatttgattattaaccctgatttggccatgcctgcatcaaaacatgacatgtaccccataaatatatacaactattatattcccataataattaaaattttaaaataaaaatatatgtggagcagccaatattatactgatggaacataatcagattatgacatttctaacctttaaaaccctatgataatgttttatatcactcagaataaaactgtaagttattacaatggttttctcagtcacctctttcagatatctactcaaacatcaccttttgctgttgcattcctgatgatagtaattaagactgcagtacctccagtctcctattttcctcttctttgcttgattttgctaaatatttacttatttgtttatatcttttttctttctttactagaaatgtaaactatacaagtgcaggcattttcatcaactgaattttactaatgtattctgtatttttactaatgtatattctgcatttgtcatttatttatgttaggagcattctaatttcactctttagttattttaaaatatacaatagaatgttgttaattatagccaacctactgtgctactgagtattatattatatatatatatatatatatatatatatatatatatatatatatatagtaaattcgggtataaatgcctataatttatacacacacaaaacacaaaataaatacacacacacatagtcatgcaagctaaataattatatggactaaatagaagtatgaaatagacattcaatattctttctttctttttctttttttgtttctttttttttttttttttctttgagacagagttgtttagccacccaggctggagtgcaatagcgtgatctcagctcactgcaacctccgcctcctgggttcaagtgattctcccgcctcatcctcctgagtagctgggattacaggcatgtgctaccatgtccagctaatttttgtatttttagtagagacagggtttcaccatgttggccaggctggtctcaaactcctgaccttaagtgatctgtccaccttggcctcccaaagtgctggaatcacaagcatgagctgctgcactcagcccattatttcttaattataattcttttctaattaacaactatatatttttttgaaattcaacagatccttagaaaatatgactctgaaatagttgtagaagtatttgaacaaaatacatttgaaaacagttaaaggaagtgtggcaagagagtgatcacccccacctccacacacaggaacacaaaattaaataactattcaaaagaaagctttcataaaaattcaggtaagtgaccacagtacctgcttttaacatcatatcaagaaaaaacacatagaagagggtatgaaagacagtcttgaattgccaacaccaccgcttccccatcccctggctgcagccagttggcacagacagaatctgtgtgcttggggaaggatagtgcagggactgtggggctttacattggagctcagtgttgtttgtaacaaaagaaagtgacaaagggcagcattcagctggcgttcatagaggaagcatttagattagccctagccagaggggaattgcccattccagtggtcagatcatgagctctggctagccccaacatcatgggctaaagtgctctttagtcctaaaaaacctgaaagacagtcaaagcaacaaagattgcaattttttggaaagtcctggtgctatgctagacttggatctggtggacttagggtgcatgtgacctagtgaggcactagttggggcagccaagagagttcttgcatcaccttttccctaaccccaggcagctcaactcgcagctctgggagagaccacttccttctgcttgaggagaggagatgagagcataaagaggactttgtcttacaacttggataccagctaagctgtattagattagggcatcagacagagtcctgaggcccccatttgaggccttagatcccagataacatcatagacacaccctgagctataaggaaacttgctgccttgaaggaaaaaaccttgctctgtaaggattcatcatctgctaactaaagagcccttgagccttggaaaaatgtcagcagtagccaggcagtacttgttatgagtcttgagtgagaaccagtgatgtgctagcttctggtgtgacccagcacattctcagctgtggaggccaaagggacagactccctctgcttgaggaaaggaacgggaagagtgaaggggatatggacttgcatcttgtgtagcagcttggccacagtatggtagagtaccaggtaggctcctgggctccctgattcaagaaaatgactcctgagcagcatttctggaccttcacagggattgagtggagctcaccaccttgaagggaaggacaaaaacctggctggatttgccacctgctgagtgaagagcctttgggcctcaagtgaaaattgatggtagtcgggtagtggttgctgcaaagcccagtactgtgctaaatttggttctgacccaacacggtcccagtggtggtggctccaggggtacttatgtcacccctccccagctccaggcagcacagcaaggagagagaaactctgtttgggagaaagtaagggaagagaaaagtctctgcatgttaatctagataattctctcagatcttacccaaggaaactaaggcagtaccttttctagtctgcaagagtcacaatatcacatggcttgggacgcctcctaatgcagatatggctgcatgaccaaagacttaaattataacactcaattccatttgaatacttgaaggaaggacagatacaaaaaacaaacaaacaaactgagaagactgtaataaatacctaactcttcaatgcccagaaatcaatgaacatccacaagcatcaccaccatcgaggaaaacatgacatcaccaaaaaccagacatgaagaaggaataaacacctttcccaggccaacaaaagctgagaagattcatcaataccagccagactctacaagaaatgctaaagacagttttcaatctgaaagaaaaggaagctaatcagcaatgaggaaacatctgaaggtgcaaaactcaccggtaatagtaagtatacagacaaacagaatattatagcactgtaattgtggtgtataaactactcagatcttgagtagaaaaactaaaagataaagctatgaagaatgaaaactacaacaattttttcatgatacaggcaatacaatacgatataaacagaaacaacataaagttcaaaaagcaaggggatacaggtaaagtgtagagtttttattaattttctctttgcttgtctattggtttgtgcagtcagggttaagctgtcaccagcttaacataatgttttgttattttgccagcctcatggtaacctcaaatcaaaaaacctacaacagatacataaaatataaaaagcaagaaattaaaatataccaccagagaaaatcatcttcacaaaacgtaagacaggaaggaaggaagaaagaacatacaacaaaacaattagaacacaaataacaaaatggtggtagtaagtcattacttatcaataataacatacgatgtaaatggactaaactcttcactcaaaagacagagtagctgaatgagtaaaaacaaacaaaagacctaacactctgttgcctacaagaagcacacttcattacaaagacacacatatactgaaaataaagagataaataaaagatattccatgcaaatagaaaccaataaaaggctgggcatggtggcttacgcctgtgatcctggcactttgggaggacaaggcagacagatcacctgaggtcaggagtttgagaccagcctggacaacatgacaaaactctgtctctactaaacatttaaataaataaataaatagctgggtgtggtggcatgtgcctctaattccagctactcaccaggctgaggcaggagaaacacttgaacctgggaggtggaggctgcagtgggccaaaattgtgctactgctctctagcctgggtgacagagcgggactctgtctcaaaaaggaaataaataaataaataaaaccaaaaaagagcaagagtagttatacttacctcagacaaataagattttaaaacaaaaactataaaaagagacaaaggaggttattatatgatgataaaggggtctattcaacaggaggatacagcaattataaattcggatgcacccaatactggagcacacagatatataaagtaaatactattaaagagagacacagacctcaatattataatacctggagacttcagtaccctactttcagcatgagacaggtcatccatacagaaaatcaacaaagaaacgtcagatttaatttgcgcctatagacaaaatggatctaatagatattgacagaacattttatcaaattgctgcaaaatacacattcttctccttagcacacggatcattctcaaagataggccatgttaggccacacaaacttaagaaatccaaaaaacttgaaattatatcaagtatcttctctgaccacagtggaatcaaactagaagtcaataacaaaaggaattacggaaacaattgaaacacatagaaattaaacatgtttctgaatgagcaatgggtcactgaagaaattaagaagtaaattttaaaatttcttgaagcaaatgaaaatggaagcacaacatatcaaaatctatgggctgccgtgaaagcagtgctaagagaaaagtttatagcaataatcccccacatcagaaaagtagaaaaactttggccaaccaccatggctccacctgtaaatcccagcactttgggaggctgaagtgggcgaatcacttgagatcaggagtttgagaaaagtagaaaaatttcaaataaacaacttaatgatgcatcttaatgatacagaatatcaagagcaaaccaaatcaaaaattggtagaaaaaagaaataaataccagaacacaaataaataaaattaaaatgacaaaaacaatacagatgattaacaaaatgaaaagttgaattttttaaaagataaacaaaattatcaaaccttcattcagacaaagaaaaaaaagggagaagacccaaataaataaaatcacatattaaaaagaggatattacaactgataacacaaagatcaaagaatcattagagactactatgaacaactttattccaatacattagaaaacctaaaagaagtggataaacccctagatacataaaacctaccaacattgaatcataaagaaatctaaaacttgaatagaccaatgacaagtaatgagatggaagccttaataaaaagtcttccagcaaagaaaagcatgacacttgatggcttcactgctgaattataccaaacatgtaatgaagaactaataccaatccttctctatctactccaaaatacagaaaagaagggaatatttccaaactcattctatgagaccagtataaccctgataccaaaattagacagacaattaaaaaaaataaaactataggccaatatccctgataaacattgttgcaaaaaacctcaacaaaacactagcaaaaccaaattcaacagcacattaaagagcttattcatgacgaccatgagggttttaacccagagatgcaaggatggcttaacatgtgcaaatcaatcattgtgatatattatatcaacagaatgaggaaccaaatccatatgatcatttcaattgatgctgaaaaagcatttgataaaattcaacattccttcatgataaaaaccctccaaaaactgggtatagaagttatatggtttggctctgtgtcccaacccaaatctcatctcatattgtaatccccacgtgtcaaaggagggacctggtgggaggtgattggatcatgggggtgactcccccatgctgttctcataacagtgagtgagttatcatgaaagctgatggttttaaagtatggcagttcctctctctctcactctctctctctctctcctcctgccaagtgaagaaggtccctgcttcctctttgacttccaccatgattataagtttcctgagccctccatatccatgaagaactgtgagtcaattaaacatcttttctttataaattacccagtctcagctagttctttatagcattatgaaaatggactaattcagaaaattggtaccaagagtttggggcactgctataatatgcctcaaaatatggaaacaactttggaactaggtaacagccagaggttggaacagtatggaaggctaagaagaagacataaagataaaggaaagtttggaacttcctagagacttcttgaattgttttgaccaaattgctagtagtaatttggacaatgaagtccagactgaaggggtctcagatgaagatgagcaacttattgggaactagaataaaaatgactcttcccatgctttagtaaagagactggtggcattttgctcctgccctagagatatgtgaacatgagagataactttaaacatgaaagaaatgatttagggtatctggcagaaggaatttctaagcagcaaagcatgtaagatgtgacctgacttttatagtcatatttactcacaaagagatgatatgaaattggaacttatgtttaaaagggaagcagagtaggccagttctggtggctcacacctgtaatctcagcactttgggaggccaagacgggcagatcacctgaggtaaggagttcaagaccagcctggtcaacatggagaaaccccatctctacttaaaaatacaaaaattagtcaggtgagatggcaggagcctgtaatcccagctacttaggaggctgaggcagaagaatcccttgaacctgggaggtggaggtgtggaggttgcagtaagctgagatcgcaccagtgcattccagcctggctgacagagcaaaactcagattccaaaaaaaaaggaagcagtgtataaaagtttgaaaaaatttctaagaaaaacccactttctggggagaaatttaagccagctgcagaaatgtgcataagtaaaaagaagctgaatgttaatagataagacaatgaggaaaatgtctccagggcatttcagagatcttcacagtagcccctcccatcacaggcccagaagcctaggagggaaaaaatgggtttatgggccagacccgctgctctgtgcagacttgagacatggtgccctgcattccagccactccagcttcagccatgaaggggccaacgtgcaactcaggcctcatgcctgacaactttcatgtggtgttggacctgcaggtacacagaagacaagagttgagatttggaagcctccatctagatttcagagggtgtatggaaacacctggatgcccaggtagaagtctgctacaggggcagagctctcatggataatctctactagggaaatcctgaggggaaatgtggagttgaagccctcacacatagtcctcactggggcactacctagagctatgagaagggagccactgttcttcggatcccagaatggtagatcgaccaacagcttgaactgtgcacttggaaaagtcaaagccactcaatgccagcctgggaaagtggctatgggagctgtaccctgcagagtcacagaggtggagcttcccaaggccttgggagctcacccattgcatcagcgtgccctggatgtgagacatggagtcaaaggagatcattttggagctttaagaattaatgagctccctgctgggttttggacttggatggggcctgcagccctttgttttggtcaatttctcccatttggaatggaaacatttaaccaatgcctgtatccccattgtatcttggaagtaactaacttgttttgtttattttactggctcataggcaaaagggacttgctttgtctcagatgagaccttggacttggacttttgaatcaatgcaggaatgagttaagactatggggggctgttgggagggcatgattggttttgatatgtgaaaaggacatgagatttgggagggaccaaggcagaatgaaatagttgagcactgtgtttccaccaaaatctcatcttgaattgtaatccccacaagataagtgagggacctggtgcagagtgattggatcatgaagacagtttccctcatgctgttctcatgacattgagtgaggtctcatgaaaactgatggttttaaactgtggcatttcctcacttcctctctctctctctctctctctctctctctctctctgtctctttctctccttccctcctgctgtaatatgaagaaggttcttcctcttcagcttccaacatgattgtaattttcctgaggcttccccagccatgcagaactttgagtcgattaatcctttctttataaattacccagtctcaggtagttctctatagcagtgtgaaaacacactaatacaagaagaaatatatctcaacacaagtaaagtcatacaggatagacccacagctagtaaaatactgaatggggaaaaaactgaaagcctttcctttaagatctggaacatgacaagaatgtctagtttcacaccattattcaatgtagtactgaaagttctaactagagcaatcagactagagaaagaaagaaaggacattcaaattggaaaggaagaaatcaaattatctttgatttcagatgatatgatctcatatttggaaaaaactaaagactccatcagaaactattagaaatgataaataaatttagtaaatttgcaaaatataaaatctacacagaaaaatgagtagcatttctatatgccaacaggaaaaaatttgaagaagtaatcaagaaatgaatctcatttaccatagctacaaaaaatataaaatacctaggaacaaacttaaccaaagaaatgaaaaatctctacaatgaaaactataaaacactgatgaaagtaattgaagaggataccaagaaatggaaatgtattccaagttcatgaactggaagaatcaatgttgttaaaatgtccatactatccaaatcaaactatagatttaatgcaatccttatcaaactacccatgacattcttcatagaaatagaaaaaaaaaaatcctaaaatttatatggaaccacaaaaggcctagaatagccaaggccatgctgaggaaaataaaaataagaaaaaacttgaggatcacattacttggcttcaaattatgctacagagctataatataacaaaaataggatgatattaacataaaaatagatacatagagcaatgaaacacaatagagatctcgcagtaaattcgtaaatatactatgaactcattgtcatcagaggtgccaagaatatgcgttgggtaacgaacaacctcttcaataattggtgctgggaaacttgatatccatatgcagaagaatgaaattagacttctatctcttgccatcaaaatggtttaaaaacttaaatctaggaactgagacaatgaagcaactaaaagaaaacattggggaaaatttccagacattgaactgggctaagatttattgagtaatacccgacaagcacaggcatccgaagcaaaaaatgaaaaaatcagatcatattaagttaaaaggcttctgcacagcaaaggaaataatcaacaaagtgaaagacaacccacagaagaggagacaatatttgcaaactactcatctcacaagggattaaaaacagaatatataaggagctcaaacaactctataggaaaaaaaactaataattcaataaaaatgggcaaaagatctaaatagacatttttcaagagaagacatacaaatgagaaacagttatatgagaaggtgctcaacatcagtgattatcagagaaatgcaaatcaaaactacaatgacaaatcatctcacccaagttaaaatggcttttacccaaaggacaggcaataaaaaatgctggcaaggatgtggagaaacgggaaccctcatagactgttgtaagaatctaaattagtacaagaaatatggagcattccagtgctcagcatatactcgaaagaaagaaaatcattatatcaaagagatatctccatccctatgcagatatctattgcagcactattcacaatagccaatgtttggaagcaacctatgtctccatcaacagacaaatggaaagaaagtgtgttacatatacatgatgtagtactactcagccatagaaatgaatgagatactttcattttcaacaacatgaatggaactgaaggacattatgtaaagtgaaataagtcaaacacagaaagacaaaattatcctgttctcacttacttgtgggagctaaaaattgaaacaattgaactcatggatatagagagaataaggatggttaccagcagctgggaagggtattgaggaaaagaaagtgtaaatagctaatgggaataaaaatacagtcagatagaataaataagaacttgtatctgatagcacaacggggtgaatacagtcaaccataatttattgcacattttaaaataactaaaagagtataattgaaatgtttctaacacaaagaaatgataaacatttgagatgatggatattttgttcacccagatatgatttttctgcattgcatgtctgtttcaaattatcaggtccccaacaaacttatagaactaccatgcactcatttaaattttaaaaatacagttaataatatatgagttcctgaatccttttgaagaagtctcaacataaataggggtactggtctctgacacaaaaatgaaatttcattatcaactataaattctgaattgtctagaaatattatgttgtaacattgcaacaaaaatcattcacaacataggttgtgtttcatatcagtcaggacaagctaggtaaggctgtggtatcaatcaaataaaattttcagcagctaaacacattaacaccttatttttatttatgctacatatctaatgtgagtctggaggggaaaagtactaattctcatagtttatcaggattatgacgtaagaaagggtccatttcaatatatgcgttcaccatcagctatacggggcagaaagaaggtggcaaagtaaaattaattttgaaatttctgggcagaattgacactcacatttctcaccatgaaaaatgatagagacatgcctaacttcaaaggaggtgtagaaatgtaatagtatcctgtggatggacagaagagaagaaaatgccagaggactgacatatgagaatatatatgtgaacccgggaggcagagcttgcagtaagccgagatcgcgccactgcactccagcctgggcgacagagtgagactctgtctcaaaaaaaaaaaaaaaaaaagaaacaaaacaaaacaaaaaagagtgtatatgagtagtaccaatgtgaaaagttttgctgttgataactctaataaaaatagttatgaacaatattttaagaaaacaattattccattttgacagatcattttaaaatctcactgatgaaataccagaagaaacacatcgataagcaataataatgtcagtaatgataaagtatattgagcttgccacagcaaggaagagtgcacctcagagcaagtatggggcatcacataggacagaattggtggtttgaaggagctctgggcttctaacaggatttgcccttgtgctggacgttttcagaaggttcaggcagtgagggctacttgctggttgcactctgtcaagtgggaggaattctctgatccagtgctttgacaattgcgatgtgggcagactggggacagcctagaactgtcattgcctgaggagcagctgtcatctctgttggcagtgagactgtgcaatggccttgcttgtacccctggttcagtccagctcacagaactgtcttgctgaagcacttatattttataagcattattgatatgtagttaaaaatattatgtcctggctgccagcagagccatttctgcttttcacaaaatttaatagcttggaatttattattttaaataaaattcagttgtcattacggccaaaaagattaagtttaagtttattttaccaggatgcttataggtagcactgtgcagttgcagtgttagggtcagtgccttcactctgtcttcagttcattgcctaagctggtgataactgatgaaaagaaaatatagatttatattggaaaagtgaagatggtaaaaatgcactgacctaagaacggaagacagttttggacttgatatgaaggaattatgtaatcctagcaagtacattaactctctctgcagttctccactgcagtcttaacattagtgattaatttgatgatacatagttagaattccatgactattacaggttttcaaagcacagaaagtacaaggtttctctaagtgctagttattattgttctttcatgtctgctttaaagatttattcaagcaacttgctgatatttaaactaaaaagttagaatttttgaatattgtatattgaataatttcaggtgactcatctaaaataatatcagcaacaaaccctccatgtcagaagtgtatccttttgtgaaaacaatgtatagcatttcatttttgaattctcactaggtgcaagctacatttcttttatttgtaaacccagcagagtagcttaaaagtaatcacacacacacacacacacacacacacacacacacacacacaccccttcccagatatacaaacacaaagtgtcttattgggaaaggtcaaagttatttacccagaaaattaatataataaaagtaataaatatttaagaatgaaatgtttaaaaagatggcatgactaagtatggaaattattaatcatatatagcatgcagtatttccatataaaatacaagaggagatgtgcttgcatttttatcaaaaaaaagtactttaactgaaactctttttaaggttattttaagttaaaaagtacattcataaataacaacctgaaaaggttggggtggtttggatgtgagaagagtatttataaggaaagatttaagatgggctgctacagtttctttcccttcaatgactagaaagccaaaggacagcaaggtaaaagacaccaacatttgatagaaaacaaagacactgagagaataaatttaagaaggaataattttaactgacagtagacaagggatgcaacaagagtgtggtaaattgataaatgcttccctctccccagaatatcagatcctagtccctggaatgtataa

SEQ ID NO: 559 - DNA, 40001 bp, Homo sapiens
cactgttggtgggagtgtaaattagttcaaccattatggaagacagtgtggcgattcctgaaggatctagaagtagaaataccatttgacccagcaatcccattactgagtatatacccaaaggattatgaatcattctactatgagacacatgcacacgtatgtttattgtggcactattcacaatagtagagacttggaacgagcccaaatgcccatcaatgatagactggataaagcaaatatggcacatatacaccatggaatattatgcagacataaaaaaggatgagtttatgtcctttgcagggacacggatgaagctggaaaccgtcatcctcagcaaactaacacaagaacagaaaaccaaacaccacatgttctcactcataagtgggagttgaacaatgagaacacatggacacagggaagggaacatcacacaccggggcctgctggggggtcaggggctaggggaggcatagcattaggagaaatatctaatgtagatgttgagttgatgggtgccgcaaaccaccatggcacgtgtatacctatgtaacaaacctgcacgttgtgcacatgtaccccagaacttaaaatataataataaaaatattaaccagtctaaaaaaataaatctgaataaaataaaaatcttgtctcaatctgtttatttttctcattatggctactatttttataaaggcaagaccagatattacaggaaaacttgttctcagggacagattggattatttcctattatttccacaaactctagtgaaatttcctagtctgcatttgtagaaaattgtttccaatgattgctttttattgcacttttaaagaaatgtattttatatagaaaactatgtatactagtctactaaatggaattacaatacacttttgttgtagtgttaacattaattttacagtgaaaacatctcagaggcccattttccattacatgaacaacaacaacagcaagagcaacatgatagctaacttgttttgagcatgtacatcctgtgaagttttatataaagcattataaaagatcaagttttacttaatggtcacaatcatcttgaagtaggtataactatgacatttgtttagtgaataagaaaaataaggtttggagtagtatactcctgattacaatcagaattcaaacctgaatctgaattgaataaagataactgggtttagttcactagaaaataacaatatagaaagtctccagtgtgctatgccttgatattttcattcattataatgacatgcttgtgtccaccatacccgaaattcaaatgtcagaatgcttgtatctccttcaaaattcatatgttaaaattttaactcccaatgtgatagcattaggaggtggagtctttgttagataattaggccatgagaactaagcctcatgaatggaattaacgcccttataaattaggtcccagagggcccccttatcccatctgccatgtgagattgttgacgaacaaggaagcaggcccttaccagttaacaaatatgcagttgtcttgatcttggactttccggcatccagaactgtgagaaatacatttctgttgcttacaaaccacccagtctatggcattttgttatagaagcctgaacacatgaaggcaatatgttgacttcgaaacctttggcctgacttctggtttccagttcaccatggaagaagctagaagttgccactttattctaacaacaagtaagaagcttaaccaactgaaagtcagcatctcttcttagattcatcatcaaggggaggtcacagtgcagccccctgccctaaaagttggagagaccaataggtaaatgtagagaactgtgactttccagaggccaataagcacaaatcttcatggaaaacagtgctgaaatagagacacctgaagtataactgacaaattgctggatgcttattgtagacaaggctgagagataaaatctcaagggtaactcagtcacttgagctttattttaggagctcaacaaggttcttacagcgagtattggaggaaaatccccttgtattttggcagcaagagagaaaaaaggaactattttgaaatggccagagcattctgctcttaacaaggcctgtcctccagggaaaccatttaattaaagactaactgatcaggggaaaggaaaatatccaacagcagatggttctagactaacatgtggaagaagggaaatacccaacttcagcttgccctagctattctgtccaacaggaggggagaaaaactgagaagtacatttgaagtttacactccagagttaaaagttaataaaacaagtaagaccttctcacagaactatacaacactttccccctccacacatcttaccactgcatcagtaaaggattatttataacagttaattttacccagtgtgtcatgcctggctatgaagaaaaatatactagccacactaaaaagcaaaaacacagtttgaagagtcaggtcaagcaagcacatcaaccagactcagatatttcaagaatattaaaatcctcagaatgggaatttaaaagaactatgagtaaaatgctaaacgaactaatgaataaagtaaaacacatgtaaaaacagatggctgatggaagcagagagatgtattagaacaaagaacaaaagagaaatgctagatatataaaaaaaatactgtaacagaaatgaagaaatgcctttgatggacttcatggtaagctggacatagctgaagaaagaattcctgagcttgaggatgtcttaatagaaactgccaaaacttaaaaacagagataaaaaagactgaagaaacataacagaatattcaggaatgatagaacaactccaaaaggtataacatatatgtaatgaaagttccagaggaagaagatagaaaagaagagaaaaatgtgagctaatgactcagaatttccccccaattaatattagacaccaaaccactacacaggaaactcaaaaaagtaccaggcaagttacattcctcaaaacccacacctagctatgtaacttttaaactatagaaaaccaaagacaaagacaaaatctcaaaagaaaacagagggagaaaacacattacttataaaggagaaaagacaagaattacattaaatttctcctcagaaggcatataagcaaaagaagagtgtagcaaactatttaaagtgttgagagaaaaaaacccatgagctagaagtctatacactgaaaaattgtccttcaagagtgaaggagaaataaagacaaaaattgagggaatctgttgccaccaggcataccttgcaagaaatattaaaagaaattcttcagagagaagggaaattataaaggtcagaaactcagatctaataaaataaagtaagagtgacgaagaagatataagttagggtaacataaaagctttaacttttcttattcttaattaacctaacatgatagtttgttcaaaatagtaatagcaattgtgtatttgattatgtgtgtgtgtgtttgtgtatatatgtacatatatatggttatatatagggaaatgaatgacagcaataatatgcaggaaagaaaaaagaattaggataatttttattatgaagtactcacactactcatgaaaaggtagaatattacttgaagataaatggtacacggtaaaacacagaatattgtaacactgtagttgtggtatataaactactcatacctttagtagaaagactaaaagaataacctatcaaaagtaacaactacaacaatttttcaagacatagtataataaaatatgaacaggaacacaagttaaaaagcagtgagtggaggatgaagtaaaggtgtcgtttttattagctttatattcacgtattagtttgtgcaatcactgttaagctgtcatcagtttaaaataattgattataaaatgttacttccaagcctcatggtaacctcaaatcaaaaaacttacaacagatacacaaaaattaaaaagcaaaaaattaaaacatagcaccagagaaaatcatcatcaaaaaaaaggaagacaggaaggaaagaaggaagggaagacaggagaaagggaggaagggaacacccaaacactaaatcagaaaacaaataaaatggaagtagtaagtccttgcttaatagtaatattgaaagtgtatggacaaagtcccccactcaaaagacatagagtgactgaatgggttaaaaaacaagaacaatctcttgcctacaagaaagacacttaacctataaagacacatatagtttgaaaattaagggatggaaaaatattttatgcaactgaaaaccaaaacaagagaaagagttggtatacttagacaaaattaacttcaaaacaaaaactatacaaagatgcaaagaaggtcattatataatgacaaaggattcaattcaataagagtacaaaataattgtaaatatatatgcactcaacactggagtacccagatacaaatagcaaatattagagctacagagacaaatggaccccagtacaataatagttggagacattaacatctcactttcagcattggacagaaaacccagacagaaaatcagcaaagaaacattggacttaatctgtcctatagattagatagtccttacagatatgtacagaacatttcattcaatggctacagaatatacattcttcttagcacacagatcattctcaaggacaggccatatgttaggcacaaaacaagtcttaactaaatttaaaaaaaaatgtatcaagtatcttctctgaccacaatggaataaaactagaaatcaataacaagaactttggaaactatacaaacacatggaaatgacacagcatgcttctgaatgaccaatggatcaatgaagaaattaagaaagatgaatatattttttgaaccaaactaaaatggaaatgcaacataccaaaacctatggaatataacaaaagcagtagtaagaggaaagtttatagcaataagtgcctacatctcaaaagtagaaatacttaatataaaaaaattaatgatccatcttaaagaaccagaaaagcaatagcaaactgacccaaaattagtagaagaaagaaataataaagatcagaggagaaatatataaaattgaaatgaaaaacatcaatgaaatttaaaattgttttttaaaaaaataaaatcaacaaaactttagccagcctaagaaaaaaaaaagtgagaaaagacccaaataaagaaaatcagacattaaaaaggagacattactactgataaccacacaaatcttatggacctttaaaggctaccgtgagcaactatgtgccaacaattggaaatcttaaaagaagtagataaattcctagatacatacaacataccattattgaaccattagtaaacctaaaactgaatagaccaataataagtaatgagatcaaagctgtagtaaaaagtctctcagaaaaaaaaaagcagcctaggacccaatggcttctctactgatctttgtcaaacatttgaaagggctaataccagtcctactcaaactaaaccagaaaataaaagaagggaagattcttctaaacttactctacaatgccagtattaccctgacaccaaaagcagatacacacacacacacacacacacacaccccactataagccagtgttcccgatcaacattcatgcaaaaatcttcaacaaaatactagtaaataacattcaacaacacattcaaaagatcattcatcatgaccacaagggatttatcccagggatgcaaagatggtttaacacactcaaatcaatgtgataattatatcaacataataatgaacaaaattcatatgatcatttcaattgatgctgaaaaagcatttgataaaattcaacatcccttcaggataaaaactctcaaaataattgattacagaaagaacatacttcaaaacaataaaaggcacatatgacagacccacagctagtatcatactgaataagggaaaactgaaagcctttcctctaaaaactggaacaccacaaggatgttcacttttaccattgtgattcaacatggtactggaaatcctagccagagcaatcagagaagagaaagaaagaaagcacatccacataagaaagaaagacatcaaattagccttgttttcagggtaatatgagtctgtatttggaaaaacctaaaaacttcaccaaaaaaccagtagaacacataacaaaattcaataaatatcaatgacattcttcacagaaaaaaaaaatcctaaaatttatacagaaccacaaaagacccagaatagtacaagctgtcctgagccaaaagaacaaaaatggaggaatcccattacttggcttcaattatactacagcgctgtagtaactcactacagagctgtagtaactcaaacagcctttgtcatttgaccttgggcaaattaaataacctgcaagagttctattcttttctatttgtaaaatagaaataaatatgtgtatcacacaaggctattaccaggattaaatggcatagcatatgtaatggtagtggcatgaaaacagacacattgaccaatggaacagaacagagaacccataaataaatccatacatctacagtaagctcatttttgacaaagatgtcaagatcacacattgggctaaagacagtctcttcaacaaatgatgctgtgaaaattggatagctatatgcagaagaatgaaatgagatcctgcctctcaccatacacaaaaatcaaatctaaatggatttaagacttaaatctaagacctcaacctatgaaactactaaaataaaacattcgggaaacccttcaggacactggtctgggcaaaaatttcttgagtaatatccctaaagcacaggcgccaaagcaaaaatagacaaatgggatcacgacaagttaaaaatattctgcataacaaagaaaacaatcaacaaaacgaagagacagcagtcagaatgggaaaaaaatttgcaaattatctacctgacaagggattaataaccacaatatataaggagctcaaacaactcaattagaaaacatctaataattcaattaaaaatgggcaaaatatctgaaaagacatttctcaaaagaagacatacaaatggcgaacaggaatttgaaaaaatcatcagagaaatgtaaattaaaactacaatgaggtgctatcttatcagcattaaaatggcttttatccataagagcaacaatgctagtgaggaagtggagaaaaggaaatcctcatacactgttggtgggaatataaatgagtatagctactatggagagtttggaggttcctcaagaaactatataaaaatagaaccaccatatgatcgagtaatcccagtgctgggtatatgcccaaaagaaaggaaatcagcatatcaaagtgatatctgtgctcccatgtttattgtagcactattcacaacagccaagatttggaaccaatctacatgtccattgacaaaaaaaacagattaaaaaatatggtaaatatacacaaaatggagtcctatgcaaccataaaaaaaatgaaatcctgtcatttgcaacaacatcgatagaactggaggacattatgttaagtgaaataaaccaggcacagaaagacaaactgtgaatgtcttcactgacttgtggcagaggataataaaggtaacggggagcaggagagttggggatggttaatggctacaaaaatatacttagagaaaatgaataaaatgagtatatgacagcacaaacaggtgattgcagtaaacaataatttactgtatctctaaaaataactgtacctctaaaaataactaagagaatataattggaatgtttataacacaaacaaatgataaatgcttgaggataaatgcccatataccctgatatgattattatgcattgtattcctgtatcaaaatatgtcatgtgctccataaatatatacatctactatgtatccataaaaattaaaaataataaaatagacttgaaatagttggaaatgtatttgcaaattctagggaaaccacaaaaatatacagaaagaaatataaatcatatacaaagaaaatatatacatataaaaagctcgattacaattagaaaaggcagaaaaagagggcaaaacaaaaataggagcaaagaacatggccaagaaatagaaaacagtaataaatatggtagatattcataaaagtatatccataatcactttgaatactgatggtctagacaaccattaatctactttctgtcacatttgcctattctgaacatttcatatgaatggaatcataacatatgtagccttttatgattagcttctttcatttagtatagtattttcaagattaatctatattgtaatatgtatcagggctttgtttatttttttcaatgtttttattgttgtaaaatatatacaacaaagtttactacattaatcactttaagtgtacagttcagtggtattaaatacattcttaatgttgtgcaaccatcaccaccatccatcttgaaatgtattttcttcttttaaatctttacacccattagacaacactttctcacttctccctccttccagtacctggcaactaccattctactttctgtctctatgattataattactgtaagtacctcatgtaagtggaatcctacagtatttgcccttttgtgactagtttacttcacttagcataatgtcctcaaggttcattcatgttatagcagatgccaaaatttcatttctttttaaagctgaataatattccattgtatgtctctaccatattttgcttttccattcatctgtcaatggaggcttagtttgcttctgcattttagctagtgtcaataatgctactgagatcctgcttacaattcctttgagtttatactcagaagtggaattgttggatcatgtggaagtctatttttatttttttgaggaactaccacactctttcccagagaagctgtaccactttacatttgcactaacagtgcaaaaggattccaatttctctacatccttgccgacacttgtttttttttttttatttttttatctcttgtatttttgatttgcatttccctgatgattagtgatgctgattttcttttatatgcttatcagccatttgtgcatacttctcaggttaaatgtctgttcaaatcctttacccatttttttcatcttttttgtgtgtgtttgtttttgttgttgttgttgagctttaggtgttcttttacattctggattttaccattttgtcagatacatgatttacaaataatttctctcattttgcgcaatgtctttacactgtttataggatcttttgaggccctaaatatttaaattgttattaaatccagtttgtcaatactttcctttgtgcttaagcctttggtgtcatattgaagaagtcactgctaaatcaaatgtcgtgaagtttatgccctatgtttgcttctaatagttttagatattacattaatgcctttgatccattttgagttttttaaaaattatttgcatatggtatctacctctttcttgtgcatgtggatattcaggtttgccttcaccatgtgttgcaaagactgccttgtgcccattgaatggttgtggcgcttttgtcaaaataatttgaagatacgtgtaggatttatttctgggctctctattctatttcattgtctgtatgtttgtcttaatgccagtatcacacaattttgattaatgtagctttatagtaagtcttgacatcagaaagtgtgagtcttttagctttgtttttctttataatgattattttatctatttgggttcccttgaaattccatgtgaactttaggatgagcttttctatttctgtggtaaacatcatcataattttgacaggaattgcattaaatctgcagataacttgaggtaggattggcaatattcttaaaaatattaagttttccaatccataaatatgaaatatatttctatttatttatgtcttctttaatttctttcaccaatgtttcataattttcattctacaagtctttcaccttcttggttaagttacttctcaagtatattattatttgtatgctatgataaatgaaattatttttataaatttctactcaaattgtttatttttagtgtctagaaatataatgattttacctgttgcctacaacttcgggtgaattatttgttagttctaacaggtcttttgcagaatctttaggattttgtacaaataagaatatttcttctgtgaataaagataattctatttctatttctctaatttgaatgttttttgtttgtatttctctaggtaataaactatgtaagaaaaacaaaaaggaaacaatactttctcatttcccctcctttcagcacctggcaaccaccattctactttctgtctctatgattataaatactctaagtacctcacataagtagaggtacctctaagtacctcacatgtttctttttctacctcatttcttacctagtttctctggctagaatttttaatattacataaaatagaagtggtgagagtaaacgtttttgtcttcatcttagagaaaaaacttttaatttttaatcaataagtatgatatttgctgtgggtttttcaaatatggctcttaatatgttgcagcagtttctcttcttcctcatttgttgagttttattatagaagattgttatttttttcaaatgtgttttctacatcaattgagatgaccacacctatgtacattcttcacaagggcaagtgagacattttccagaataaacaatgttaggctacaaattgtctgaatagatttaaaatgataaataaaacaacgtatcttgttctacctaaatgggataaagttaacaatcaatcacaaaacataatcaataacaaaattaaaaatagaaaatttatgaaattgtaaaaattaaacagcacacttttaaacaaccaatggatcaaagaagaaaagtaaattacaaaatagatcaaaataaataaaaatgaaaacacacacatatgaaaacttatggaacaaagcaaaagcagtgataaggtaagatttatggctataaacatattaaaaaacaagaaacatcttaaatcaacaacctaacttttccactaaaggaactaaataaaaataaaaatctaaaactaaagttaatagaagaaagaaaataataaatattagaggaaagatagacaaaatagggaatgaaaagaaaatatagcaatcaatgagacccaaagtttgttacttaaaaagaaaaaatgacaaatttttaactatagataaagaaaataaagaaaaaacacttgaattactaaaaccagaaatgaaaatgagaacatcactatttaatttatagaaataaaaagacatataagagagtactgtgaccaattgtatgccaacaaattgagtaacctacatgaaatggacaagtttctaggaaaaaaaaaatcaggactaaataataaagaaatattaaatctgaatgggcctgtaattagttaggagaggctatggagaggcaaaaggcactgaaaaaccaacacaatattgcaggagaaaaaaaggtggaggactgtcactatttgacttcatgacttactataaagccagtaataaagacagtgtaatgttggcaaaataatagacaaatagattaatggaatagaagggcgaatccaaaaatagacccacatagatatagtcaactgatctttgacaaaaaagtaaggcaatacagtaggaaaaaaatcttttctacaaatggtgctggaacaactggacactcacatgaaaaaaaatcaaaacttagactttacacacaccttttttgaatgttaactcaaatggattctatgcttaaatataaaatggaatactataaaactcctagaagatgatgtaagagaaaatctagaagatctagggtatggcaatgactttttgcatgcaacaccgaggcacaacccacaaaagaagaaagctgatgagctgaactttattaagattaataacttctgtgaaaggccagttctcagtcaaagatcagtggttgccagtggttagggataaataagtggagaatagaggagttttaggtcagtgaaatgactctgcatgataccataatggtggatacatgtcactatatatttgtccaaatcaatagaaagtaaaacgccaagatctaaccctaatgtaaactatgggctttgggtaataataatgcatcagtgtcatttatcaattttcacaaatgtactagtttggtgggggaggctaataatagcaaaggttatgcacgtgcacatgcagaaatatattgaaaatctctgtaccttccactcaatttttatctgaacctaaaactggtccaaaagtgttctatttaaaaatgatgttttataataaaactaaaactacacaacagattaaattcaatttaccagtttatataatgcagaagataaaatgaccttgagtctgaacaaagaatattaaatatgcattctaaatctatacaaaacttgagagagcatcatgttgaaatagtcaggactttgtcttacattctattaaatgagcattaagctaactgattatctaaggcccttccagatctaagattctttttttttccccctctacattgtcaaagaaggagccatcaaaaaaacaagggctgggttaggtggcccttgtaattcatgtaatggagagtaattgaaggactttctttaagtaataacatagtgagttcttaatagcataatgttattaaaagatcagtatgatcggagagtagcaatggcagatacagaactggcaactttttgttttgaatgataaagagagctgggggagggaaatatccaggcttggacaattggggtcatagaagtaacattcactaaaatagtgaacattgaaaagtggaaagggggttagttagagttgagaggagaaacagatgcattttgttttgcacaaagtgcagtttgatgaggtatgttgggtataagattaagtacttgatttgaattatttgatgtattgaggtaatgaagaaaaaatattttaaagttttaaaatgtattaccaaattactctttaaaatgtttttacaatttatcatatccactgtcataatatgagagtgcctatttttccacaccattgccaggtggtaatatttgatatttataaagaggtttgtcaattttatggagtaaaacaaaaatgacacatttcatgaaagaaacatagtagaagattgctttagaaagcttagttgatggtataaattttatctgaagatggcataactggctataaatggtgaaataatagacattgcaagtcatgagttgtaatgtttgttctttgggtcacaaaacacagaagcctcaattatagatttggtgaatatgaactgattgtgaaataaaaattacctatcagagcaagtatttgtgacttgatatattagatattaatttccatataaccaatcaccaaaaacctaaaatcacatacatttattatctgacaacatctataggtcaggaatctaagcaaggcttgggtggatcttgggctcagggtcttaaaagactgctaacaagctatgagctggaccacattctttctggagctcaacgttcaagctcacatgattgttggtagaattcaatttcttgtggttgaaggattgaggccctcattttcttgctaactatcaggcaggtgttgccctcagctcctggtgcccacctttagtttcttgactgtggccttctcacagcatgcagcttactttctcaaggccagtagaagaatcttattcttgtttgctgaaagagggtcttacataagtaacctaatctagagagtgactatcctaccacttttttatattctactgcctggaagcgacttacacattttgcccacacttaacgggagggaatgatacaagcacataattctttacgggtcccactagggtatatatattaaaactactcttcaaaaataccaaaatgaatttttctcacagtggaaatagaatcactctatgccttaggaaatgtgtagctacaaggaacagcatacctttataaaaataaataaaaattaagagggtttattatctcatagggtgagaagaataatggtagagaaattccaacactgatgtttcatcttaatgaagtagctgatgatggtggtggttgtcatcggttccttatgccatcctcaacacacaggctgtctttcctgtcatggtcacaaatgcaactcaatcagttacaggcttcatgtacagacataaagcagtgaagagatatgatgtgtttaattcactttaaacaaggagaaaaatttcccaagaattctctgatcccattggtcaggactgtttacacagcaagcactaggaggaagggaatctgggaaagtctatggcattctcaggttctataattttagaaagaaggcttccatcaatgggacaaggagaatggctattgggtagaacagaagcagaaactgtcttttatattgttataaaataatttttaataaaaattacagctttttatacaagcctgcatatagacatattttgctctatcttgaacttgtaaaacaaattttacttttcttaaaagtttctgattttcaacttatcaataggaagcatctgttttacttcagttttgactttgattcttggagagaaatctgtttgtaatcttttacataatggttccactgagagaaaggaaatactgagctatttcccaccctcctcgtcccaaactcactagaaacaaattgctgtcctaaagacttcaaagaacctcacaattaaaactttaataaacaactatgtttcagatctccttttcaatacattccagataatgtgttcatttcagtttcccatctaaggaagaaggctttgcatgctagatgacagtgtgtgcttatttaaaatgccttggttgaggacaaatggtactctctcctactatttctacttaaaagaaaaatatcatttgatattaccagcaaattggctataatgcaacaatatctatggtttgtatgatatttggtacatctgaaatcctcaaagaaattggagtttcaaatcacttgactatctttttgcatcatgaaaattgctttcaaagacttttagacactgttacatttaggatccaattacatgctctctgtaaacaagtaattttcctaaagagctaataaagtttgtgtctcaaccaattttactgctaataaatggcaaagaaaatacaagtatatcaaaggatttttttctgggagttgagcacttcagaaatgtctttcttttgtagtatcgcttgcaaactactattgcttatttttgtcaacaacaacaaaaaaaatgttccccagatatagcaacaaacttttaaaaattagaaaacattatagataaattaataattaaaataattcaaaatttaaaataagaacagttgataagtaggtaaatgttacctaaagccaaaacatgttttattttcaacaccaagaggataaaatatagtttttattcccccaaaacacttttatatttttgacttcttatgccagtcttcttacaaaattatatttttgttttggttgtagtttgacctaaaatgactggacatttcaagaagacaactcatattatgacaaaaataattgctaaatttcaaattagcttgcttaaatttcctaatatttagttagattataacctgagttacttttaaaatgccattaaatttaaaatctaattcaggccataatgataaattcaaactttatttacaggtgtgtaaatcttatcaactcaagaatacctaaaacaactgcattaactttcatgcccacttctgttttgatctttacagctagagctagtttcacatttatctcaagaacgaacagtaatttagctgtgttcctccactaacgcaattttttacatggtattatatttttagttctgtgttatccatccgtaagcaacttgaggataagatataattatgtctctctacctcttcaagtttcttttaagtcattgatattaagcgatggttcatgaatacatggatactagttttgagggtttctgagaatgaaagtgagtcaaaataaaaggcataatactatttttactaacaacatgtgcatattgtgtcagacacctcctacatattattttagttaatcagcaaaacaacagtagtaaggtgttatttttgcctccgttttacaggtgatgaaacctgcccaagtttacatagccagtatgcaacagaagagagattcaaagcctagcaagcttgctgtataataccatgtgctaaaccacaattttaaatgagaaacctgtagaaagattataaaaattagaatgacaagaaggaaatttcatgcagaaataaaattgcctacaaataatttctcaaatccagaaagattatagcaaatgcaattctaaatgtaatagagtttcaataggaggcttaattagagcatctgaatcaggtcctgtttttctaaaacaacataagagaaaataagaatagactgtttttaggattgtacaagggtctgatacttacctgtctattgctttcaagttcttaactggacacaaaaatattttgatcaaactgtcagctttactattgcaatagctgagtggaggtcatggcttttgaactttggaaaaagggcttacctattgccaacatccttctctcacccttcctctttcactggtacagaagggacagcacagaccctactctagagtctcagtcaatcacttcaacatgatctcaaggcaaagagcaaattaaaccacactctctctgcaggcaggcagatagaaaaagagaagcacaaacaagtctgtgccagcatgttgaagtccttgtccctaattcatctaacaaataatcactccatctttaaggaagagtgagtagcaggagatgaggctgttctcaaataatttcctctaaacaataacataaagtcaaataaatagagttccctccaaaggattaaatctctggaaatggaactggctggggaaaaaaatgaccaaatagtttagatcaggctaacaggaatctggatagcaacatcccagctattactatcacaatagatttggaaatgtagaaggctattgagaacagattcattaagactaggacaacaaaggcttggatataaactctaggaaaatcaatcttaaggagacaggaaactattaaaagtaatatgataaaatcataaattatactaatgaaaaagaaaaaaaggaaatcagctaaaataaaccaataggacttgttaaactatataactgcaaatactgagagcatcaataatatattcttaagaaagttggttctttgatttaaatcagtatcaaggatattgtattgagaagctgatcctttaaaatcaagatccttaagaaactttggcattggaatcaaaaaatctcaataaaatatctttaagttgtgacatatcaaaatactggggcagcctgcttgaaagagcctaccacaatattttcctgcttctgttagaaccaatgaaaatactttatcacaacttatagagctaatgaaaaccctctatccttatgcagtacactatatatatatataaaaatatatatatagtatataatgtgttatatatataacatatatgcaataagtttatatacaaacatatataaatatatatataaacaatatacatgtaatatgttttacaagaaggcaattatgttaaaatattattgtggaatcttttttataattaatctatattttaaatattttttcatgtattatagattttagccatcatcttagaaaacaattttgaatgcatcttttaaaaatatttaggtttaggattgtatatattcaagtgtaaacatgatgacaagttcagcgtatatcacaaccacacatacacatatacccatacactgctaacaccaccaacactacagtttaaaagtcatgttggactccagagttacaatagccaagtaatcataacggagatcatttggttagcatttttaagggtcctgtttaggatttataacacttttctacatttcatcttaaaacatttttacatttatatcacatacttctagctaaaatgatattactagaagcattcaaagatcaagtaatcaaagcactgttatacaaataaatgtacatcttttaatgaagatgtctttcatattttgccttctgtactgttgagatgtatgagttcttgcgaatgccttgttattttgctgatgtatttatttgtttgtttatttgctgtgcaaaagccttttttagtttgctgtagtcctacttgtctgtttttccttctgttccttgtgctttgtgtgtaaaatccaaaaagtcattaacaagaccagtcttttcttctagacgtttatgattttaggttttacatttaaatcataaattatcatagatttgatttttgtgagtgctattaagcgttcagctttttttcttttgctagcattatttattgaaatgactatctttttatcattatttcttcttggtgcctttgtcaaatattagttgactgtatatgtgtgagtttattgttgggctctcaattctgtttcactagtctgtatgtctttttatgccagcatcattctgtttttattactatagttttgcagtatattttgaaaccatattttgtaataccttcagctttgcttttctttcttaagattgctttgtatattttgggtcttctgtggttccatataaatttttgattttttttatttatgtgaagtaagtaactggaattttaatagagtttgtattgaatctgtagatgagtttgggtagtatggacacttaaaaaatattaattcttctggtccatgaacacaaaataaagatatcttttcatttatttgggtcttcttcaatttctttcatcaatgttttatagttttcagtgtacagctatttcaccttttatataaataaatttctatgcattttatattttatgttgtatattttgttggcaggatttgacctcattcagtgtggttatagaatctttatatttaacagatttttaaagtacttcagtggaataactaaaaatacacttgtcaaatgtaaaggacaaaacagacacaatatgcttaaaacataatgctattgattatccccacaaggaaaagtggggaccaaaagtatagcattgtataattaaaaaataaacttatttggttccttaaagtctagagtgataaacacaatgctccttcttagaatttccttgaataaatttaaagaaggctttaaaataattttaaaatctaggcctgttgccaacccctgtagcaagacatttagagaaagctttctcatctaaagctggatgtatctcgcaaattttaactatttggtaacattaggttggtgccattttcctttacctcccaccagatggaaagcatcaactctagcatttgccttacaaatactgtttgttgtttgttagaggggaaatagcatattgttacatcttcttcaacagtgtccttattattaaatcaatgatgtcattttccataaaaaagggttccgtgagaacataacaatcttataaatgaaacaggcccagctcatctggtgaactgtttgttacacatgaaatagtaccagatgctttataagaaggtaacatggtacaggccgacaatgttattttgaccagattatttatgtttcattcattcatccagtgctttctctaaataaacatgattattttgttagtcttagcacaattaaaaaggcttctggtaatttaataatgatttttccaaaaggaagttaaatattcaaatcagacccaaatcacggaaacagaccagggccacctagaagtaacaagattctcttcatcttgacaatgtgatttgttatagaccaacaagtttatactggttgcttgaaaaagatgagactatgtagaattattatatttcttatatcgcaagacatatagaatttgtaaatgaaattcatgagcttgcaactttttagcaagatactgtgacccataatacagaggttcaactggcaacaaatcagtgtgggaaaatatcaatgaatataggattattagtttttacttaggtcatgtgagaaaggaaagacaagttcagcgtatatcacaaccactcatacacatacacccacacactactgacaacaccaacactacagtttaagtcatgttggactccagagttagaataaccaaataatcataagggagatcattcggttagcatttttaagggtcatgcttaggatttataatgcttttccacatttcatcttaaaacatttttacatttatatcacatacttccagttaaaatgatattactagaagcattcaaaaatcaagtaatccaagaactggtatataaatacatgtaaataatgaagatttctttcacattttgccttctttaacagcaactcagtcaaactactttgtctacattgcaggaatatattacattcatttttgtaaaaatcccctcttagttagttataaatataaaattgaatcttcaaaatgatcaaatttggaaaaacaatctgagtagttttagcaatatcaagcaaagaagacaaactgcttaactgccgttagctaatatttagcacatacttacttgccagaaattttgcttagtattttatgctaatgtaccatataacctgaccaaataggattattgtgtccattttactatatattactgcagtactaagttatttaaaagaaagtaaagagtggcataaaatatgtttctagaacttagaagttctatgtttttgttagagatacaaaactcatgatgtcaaatattagacaattgattttgttagtggtgttgcaacagctactacctcaacatgtttgaaaattaatataaactgaaattatacatttagaatttgtgggcaatataaaagctgaactgaacttagaatatgggtaaatttgtataattaaaaaaagaggagtttctctcaatctgagcatgagatgtgacaaagcacaaagtctagcatcatgttgaatgtaggaaaataaaattccaacaaggacaggggtttacaatgggtaatattcaaaaataacattaaacaaataaaagggaaaacttgtactatgctctggaaagttgaatgtttgaagtttgtattcgatataaaaggccatcaataatagagttacataaacaaaagttttacctatcttgacttttctaaataaaaatttgtgttatacttgacaatttaaaattcattttgtcacaaaacatgaacaattaattaaaactgattttaatatctttttacagatgttaaagtttacttgctacagaatatttctgctagaattacaaggggattgagagtggggtggaattgggattgaactagaatacagggtttcagtgtatacaaaaacacagatcagtaataaaagaagggattgaaggtgcaatataaggcaaggctaggaagcattaaggagagtgaaataggactaaagtattttagaagattctgggttatacaaaatatgaatactctttccttcagagggaaacgatggtaataagaaatacattatttttcaacactttgggagttgaagtaccatgcagagactgatactcaaagttggcagccatggtggaggtagtggggaacaacatttattcagataacaggtagatcgtgtttcagatgtaaatatctttcgtaaagaaaagctcacatttcaaaactgatgtaaataataactaaactgacaaatgtgtttaggccaatacaagattgctaaataaatgttcaatctttcattggagatttgcagtcaatagcattctaccttaacatggaagctgaagtaggttgaattagagtaaagcccaaaataaagagtagtactgtactcaaaacatcttcctttattattttaaatatatttgaatttaatacaaacatataggggaacagtaaataaaattcaattcatccattctttgaacatcatccaacttttctatagatatttttattaaaacaaaaacacccttcataatatttttatgtcttcttcatctgtttttaaaatgttatttgatccacacatccttcaaaaagcaaagtgaatgtttcaaattataactttcaagtttacagcattttcaaaggctttgcatttggagaaaattttatattcatttgccctggaagaataatcagggttactttgaccccacaatacgtggaagcaaacttaaatgcaataacttccaataaccttgataatatatcatacttttccatgtaatttttccaaatattttcaacccatattatttttcatgggtaatagaaaaaaatattttcagaaaaaagaaacaaattgtaagaaatcttgtgatttggcataatttggaagaaaaactatgaaattaaataatttatttctaacagatacggtttggctctgtgaccccaaccaaacctcaaattgtagctcccataattcccacatgttgtgggagggacccagtgagagttaattgaattatgggagcaggtctttcccatgatgttcatgtgagagtgaagagatcttatggttttaaaaacaggagtttcctgcacaaactctctctctttgccttctgccatccatgtaagacatgatgacgtgctcttccttattttccaccatgatcgtaatgcctcctagccacgtggaactgtaagtccattaaacctctttttcttcccagtctcaggtgtgactttatcagcagtgtgaaaatggactaatacagttcattggcactagtagagtgcagcactgctgaaaagatacctgaaaatgtgcaaatgactttggaactggataacaggcagaggttgaaacaaggctcagaagaagaaaggaaaatgtaagaaagtttggaactttctagagacttgttgaatatttattttcagtgtttattttctttcactcagcattgttgtaaaattcaggtgttattgtttcatgtggcagtagttaaatctttttattgccatatagtattcattgtataaatatatcatgatttggttaccaattatactgttggtggattttagggttcattctagtatttggctactaagaatataaacattatttcacatgtcttttggtgtatatatgtaccatttcttttaagagaatgactagcagtaaaactgccagaaaacagggcctacgtaaattcagttttagtagattgtgtcagttttcctagagtttgcacccatttaactcccattctctgtatttccaaattgtggtcatttaatgtcttattctacatttggtgtgatcagtctctttttttttttgtaaattttagcttttctcaaagaaatataattaacctaaatgcccattaatggcagactggataaaaaaatgtgatatatatacaccatggaacactatacaaccataaaaaagaatgagatcatgtcctttgcaggaacatggatggagctggaggccattttccttaaaaagcgaatgaagaaacagaaaaccaaatactgcatgttctcacttataagtgggagctaaatgataagaacacatggacaaatacaggggaacaacagaaactgagacctacttgaggatggagggcaggaggagaaaaaggatcaagaaaactaatgggtactaaccttagcatctgaatgaattgcatttgctgaactgaaaaattcattagaggttctctacagtcaaacagattatgcagaggaaagaaccagcgaccttgaagacaagctatttgaaaatacacagaggcgaaaagaggaaaaaaagaatggaaagaaatgaaaatcacgtataagatttagaaaattacctcaaaacaacaaattaagaattattggtgttcaagataaagttaagtaaaggcaaggggttaaaagcttacttattcaaataaataataacagaaaacttcccagaacttaagaaagatttacatatctaggtacagaaaggtcagagaacaccaaacaagttcagtccaaataagactacacaaaggcatgtaatactcaaatgatgtaagttcaagacaaaaagaatcctaaagcatcaagaaaaaaggaagataataacctataaaggaacttaaatttgtttggcaactgacatctcaaaggaaaccacataggacaggagggagtagaaagaaagaaaaaaaactaccatccaagaatattgtatttagcaaagttatcattcacctaggaaggagagatatagccttttctagtagaatgcaatctgagataattcattatcatctgatccacattaaaagagatactaaaatgattttaattctgaaacaaaccaacaaaaaacacactgaaatgcaaagaaaaccccaaacatttcaaggtataaaacccactgagaaattaaatacaaagataacaccagaatattccaatagtgtgatgtgcagttttcacataactctgatatgaagttttaagacaaacctgtcaaaaacagtaatagctatagcaattgagagatcagcaatataaaaatatgtacattgatagaataagaagtcaaactgaaagaggttagcatacttttcttttagtttttgtttttttctttgtgtgtttcttttttaaatatttaagataaattgttatctctttaaaataacttatgtgtataagatgtatttgtaagctacattgtaatcacaatgcaaaactgtataattgatatgctaaaaataaaaagaatctaattgatacatgctaccagagaaaataatcaaaaagaaagacagtaaaaaaaaaagaaagaaagagaagagttatgaaacaatcaggaaataagcaacaaaatatcagtagaaagtccttactgatcaataacaatgttgaatgtaaatggactaaattctcctattaaaagtcacagagtatttttataaaaaacagtctgagaaagaaaaataatgtaaaactttaaaaattcatagagtgtctgaataaataaacaagacccaacaatacactgcctacaaggaacccacctcacctccagagacacaaatagactgcaagtggagagatgaaaaaagatactccatgcatatggaaacataaaaggaacaggagtagttatacttagataaaatagacaacaaatctaaaattgtaaagaaacaaataatttcactatgtaatgataaaaggttcaatttagcaggagggcataacaattataaaaatctatgcattcagcatcagagcacccaagtatataaagcaagcattaatatatctaaatggaaacagagtgcaatacaagaatagtagtggacttcaagaccccacactcagtaatggccagatcatccagacagaaaatcaacaaagaaactttggagttaagctacacactagacaaaataagcctaaacgacatttacagaacacttcacccaactgttacagaatatgcttttttttttttttaaatcaggacatgggacgttctccaaaataagccatagattaggccacaaaaaagtctcaacaaatttacaaaaagtaaaacaaatatccaagttctcttttttgaatcacaatagaataaaaataaaaatcaacatcaagaggcacctcagaatctatggaaacacatgaaaatgacacattttcctgaacaaacaatagttcaataaacaaattaagaagacaatttttaaaatttctgaaaacaaatgaaaatgatagtaaaacataccaaaatctatgacatacaggaaaagcagtactaagaaggaagtgtgttcatttgttctcatgctattatgatgaaatatctgagactgggtcatttataaagaaaagatgtttaattgattcacaattccacatggctgtggaggcctcaggaaacttacaatcatggcagaaggcacctcttcacagcatggcaggagagagaatgagtgccgagctaagggggaagccccttattaaaccatcagatctcgtgagaactcactcactgtcataagaacaacatagggtaaactactcccattattcaattatctccacctggtcctgtccttgacacaaggggattattaaaattcaaggtaagatttgggtggggacatagagccaaaccatatcattctgccactgtctcctcccaaatcccatgtcctcacatttcaaaacacagtcatacctttccaaaagtccccccaaagtcttaacttattccagcattaacccaaaagtccaagtccaaagtctcatctgagacagtgcaagtcccttcagcctatgagcctgtaaaaccataagcaagttagttatgtcctacatacaatggggggtataggcaatggataaatacaccttttccaaatgggagaaattggccaaaacaaaggggctacagccccatgaaagtccaaaaatctagtagagcagtcattaaatcttgaagtttcaaagtgatctcttttgtctccatatctcacatccattcttgctgatgcaagaagtaggctcccatggatttgagcagctccactcctatggctttgcagggtacagacccctcccagctgctttcatgggctggcattgagtgcctccagcttttccttgcacatggttcaagctgtaaatggctctaccattctggggtctgaaggatggtggccctcttctcatagctccactaggcagtgccccagtgggaaatctgtgtgggggctccaacttcacatttcccttctgcactgccctagcatagtttcccccatgagggctccacccctgtagtaaacttctgcctggacatccaggcactaccatacattctctgatatctaggtgaaggttccccaacatcaattcttaacttctgtgcacctgcaggaccaacaccaactataagccaccaaggattagggtttgcaccctccaaagcaatggcctgagctgtatgttgtccccttttagccacagttggaatgcagggcaccatgtcctgagactgcacaaagcaacaaggccttgggctcagcctatgaaactatttttttttctgttaggcctctgggcctgtgatgggagggcctgccatgaagacctctatcatgcgctggagacattttccccattgtcttgatgattaatattttgctcctcattacttatggaattttctgcagccagcttgaatttctcctcacaaaataggtgtttgttttctattgcattatcaggctgcaaatttcccaaacttttatgttctgcttccctcttaaacataaattccaatttcagataatctctctcaaattcaaagttcctcagatctctacagtaggggcaacatgctgccagtctctttgctaaagcatagcaagagtggccattgccccatttcccaataaattcctcatctccatccaagaccacctcacctggacttcattgtccatatcactatcagcgttttgttcaaagccattgaagaagtctgtaggaagttctgaacgttcctacatcttcctgtcttctgcaacttccaaattgttccaacctctgcctgttacctacttccaaagtcacttccacattttcaggtatctttatagtaatgccccacttcggataccaatttactacattattctatttgcatgctgctatgaagaaatacttcagactgggtctttaataaagaaaagaggtttaattgactcacaatcctgcctggctggggaggcctcaggaaacttacagtcatggtagaaggcacctcttcacctctttaaagggtggcaggagacagaatgagtgctaagtgaaggggaagcccatcataaaaccatgagatcttatgagaactttctcactatcatgagaacggcatggaggaaaccacccccatgcttcaattatctccacctggtcctatgcttgacaagtggggattgttacaattcatggtgagatttgggtgtggacacagagccaaaccatattaaaaagtttatagcaataaacacctacatcaaaaaattagaaaaactttaataaacaacttaatgatgcaccctaagcaactagaaaaacaaggacaaatcaaatcccaaattagtaagaggaaagaaagaatgaagatcagagtagacgtaaatgaaattgagagtgaaacaaaagatcaatcaaacaaaaagttggtttcttgaaagataagaaagagtagactaagaaaaaaataaagacctaaataaattaaattagaaatgaaaaaaacacataacaactgaaacatcaggtacaaaaaattattagagactattatgaacaactatgcacaacaaattggaaaaactgaaggaaatgggtaaatttttggacacatacaacctactgagattgaagcttaaagaactagagaagcacaataagtcaataacaatgagatccacaccttaataaattaattaaataaaagcctagaacctgatgaatatactgctgaattgtatcaaacatttaaaggaccaacaccaactatttcaaaaaattaaagaacagagaatacctaggaactctcatgaatacagagagatcgttggttaccacagtcttggaagggtagaagggaaagaggatcaaagagaggataattaatagctacaaatatacagttagatagaataaataagatctagtattttatagatcagtagagtgactatagttaacactaatatattgtaaatttcaaaatatctagaagagaataattcaaatttttccaacataaagaaaagataaatatttgaagtgatagatatctttattatcttgatttgatttttttcatgttatatgaatatatcaaattttcacatgcaccctgaaaatacacacatcttttacgtattaataaaaaaaagtcaatggtaggaaaagaaaacaaaagattttaatgaggctgaaaaatttctattgcctagtgacattacagccattgtatctccaaagctcaatgtattagtcatgtgtttgtggtgatgctgatgtaaacaaaccaattgcacaaccagtcttataaaaatagagcatatataattatttccagtacctacctgataataaccatttactggtttatataattactatacttcttatccttatcttagagtgtactttttctacttatgaaatataagttaactgtaaaaagcctcaggcagttccttaggtgtattccagaagaaagcattgttatcataggagctgacagttccatgcatgttattgcccctgaagacctactcgtgggacaagatgtggagatggaagacagtgatattgaagatcctcaacctgtgtaggcccaggctaatgtgtgtgtttgtgtcttcatttttaacaaaaaggttaaaaagtaaataaataaataaaaaaacagaagaagtttatagaataaggatataaataaaatatattttataaagttgtaaaatatatttgttttaagctaagtgttattacaaaatgataaaaaagtgtttttttaaaaataaaatataatgtttaaatttaaactaagcttaggttaatttattatgaaagaaaatgtctttttaactaattttgtgtagcctaaacattcactgcttgtaaagtccacagtagtgtataacaatgtcataggtgttcacattcattcaccactgactcatatactcacccaggccagcttccagtcttgcaagctccattcatggtaagtgccctaaacagtatatcatgtttcatctttgataccacatttctattgtacattttctatgtttagatatgtgtagatacagaaataccattgtgtttcaattgccttcagcattcagtagagtaacatgctttacaggtttctagcctaggagcaacacgctatgccacataacttaggtgtgtagtaggctatgctacttagatttgtataagtacactctatgatatttgcacaagaacaaaattgcctaataatacagttcttacaacatatacccgtcattaattgacacatggctgtatagatatatgagaacaaattcattaggggaattagctcacataattcaacaggctaagaaatctcatggcaggccttctgcaaactagatacaccaggatatatctagccaaatcctggtgctgtggctcagttcaagcccaaagccctgacagcccatggggcctgttagtgtaagttctggagtccaaaggccagaggttcttgatttttggtattccagggcagaacaaaaagagggtatccaagttccagatggaaaaagtgagaggaactggtcttttcctctgtttttgttttatttgagcccccaagttgattggatgatgaccatccacattgaggacacatttcgccacttagtccactcagacttccatgccaatctcctctggaaacatctttacaaacacactcctaaaaaacctttaccagttatctaggtagtcctttctccagtcaagttgacatctaacattaaccatcataagtctaccccttatcaagttggcacccatatgcgtctccttaaaccacatttactctccaaagacagtaacacgataatagttcacatctaactgcgttgcacacaatgaaaaatgcactaatagcttccccagaagaggagataatgcccttgggtaatgtttactcttctcttgatatctcataacttaaatactatgatgcaaaagtaataatacttaaaaactaatataaattcaaaaaatcttatgttgcataatgaaatgagataggaattagaacaaagacatttgtttgacatatgtatttatacacacaaacatatttttaaacaaaatagaacagaaatgctcttgacaattacagccctcatttctgtaactggtcatgtagttatatctggtatttttagctaccttcttctactaccgattctgtattccctttatcttcagaaagaaactcagctggtcatagttcttcacctagcagggtaatccaaaacctcatttctgaagtatatggaccattcttagtcttaactggattgagttgtcataatttcccattgaccttaattatagtacattacaatgctgagggacaacctaagcaatctcttgtattccagacatactcttctttacctccactgtggagtggtagtccaaattcccttcagtagtccagatcaatcatcccagctaacaccgtatctcttttcttagcctgtttactcagagacatgaagaccctaaagtgtcaggtgttagtcttaacttctagttcaatggaatcttttttgtgtctcctggtggaagcattactccctctgcaactaagactcctaggttagcagagcataaagtcttgggaagaggaagcaaaaattgtgctgttcgattatgaggagtaacagggagtggtattacttccatttccattcctagattgctggtcctgtgaatactggctatgggagaagcagtagtgtatagtggatgctgattcagagtatatacagccttatagagaaacttgccctagccttcaaaagtccattccatgttttatcaagctagctgcttcaggatgacaggaacacagtaagatcagtgaattcaatgaacacgagcccattgctgcaattcttttgccgtaaagtgagttccatggacaaaaataataagaacaaaatgtctgggaataccttgacagcaaataaggtagtcggtgagtccaccaacattggtttgtcaaagcattgcatacaggggaggcaaatccataactggagtacgttttggttccaataaggagtccaaaggtcagaaatcctggagttctgatattcaagggcaggagaagaagggttccaggaaagagagggactcattggccttttcttctgtttttgttctatccgagagcccccagctaattggatggtgctcatccatattgagggtgcattttccccacttgatccattcagactcacatgccaatctcctctggaaataccctcacagactcactccaaaataattatctgtttagttttctaagtattccttaactcagtcaaactgacacctaaaattggccatcacattttgtcaagaggtcatatcattctgggtttttcaaatcaactgataacatgtctataataaaattgtgatggtatgtattgcaaaaactcagcaggaatgtgcttggaatatacatatattccttgaagtataagatatatatatatatatatatgtattccttttcaagacacatgcaataaacatatgctcattttctgcctaaggtacaggtttagggatcataatcttcatctgttgtgaatcatatcttgattcgtctccctttggatttgttttaagggcagtaccatttgaggggagctccaaatatatctacctctgagcttctgccagcttctgtgtttgcctttgtctcacatcctcatgtttctgagaaatttgttcttgagtgaaatattatggcttattctggaaccataagaataagagaacactagcctcaatatcacagcaaatattttagaaatgaatattataactggaggagtgtctccactattaaattttataaaagtggctttcagtgtctaagaggaacaaaggtttgcaatatttacaccattttttctactgtatcagctgtaatatcgatagagctatgaagtttctaacacattatagcaagaagagcttgggatgtgggtgactactaactgcaaattgcactcatctgaactttagaatctgaatgacatgtcttcaaagctcctatttttaattctaaaaaactaatttatagattttatcctttattctttttcaagatagcatcatgtaaactttatatatttttcagaatcaactcaacaaacacaggtttctttccttttgcctaataaagcttcataattttcttaaacttcataggatagaacttcaaaaagttcatggaaaaatataacaaaaagatataaattaaaaacatataaactttaattctcaatataaacttcaccaagataaagacaattttgtaaatgatgatactaatcatttgtcccattcataaagaactgaggattctgtgaattaaccatgcaaatgcagtcttttttacattattgtctgaaaaaaagagtatcttttaaagatttttaagaaacaaaaataagttggaaagagtcaattcaggacagtaaagtggatgcctagtgatttttcatcaaaactctcataaaattgcccttgcttgctaataggaatgagcaggagctttttcattgtggagaagtactctctgatgaagctttcctaggcattttactgttaaagctctggctttctcaaaacactctcataataagcaaatattataatcctttggccatccaaaaagtcaacaagcaaattaccttgagcatttcccccaaaatttgccatgacctttgctcttgactggtctgcttttgctttgactggaccacttccacatcttggtagccactgctttgattgtgctttgtctttagaatagtactggtaaagccatatttcatctcttataacaattatttgaagaaatgcttcaggttcttgatcccatttgtttcagattttcattgaaagctcagctcttgtgttcaaatgtcctggataaaacagattgcacacccattaggtggaaattttgctcaagtttaatttttcagtcagaattgtgtacgttgaaccaattgaggtttctgtggtgttggttactgtttctgctgttatttgttggtcctcttcaactaaagcataaatgagattaatttttcctagcaaattgatgtagatggtctgcctccgaaggcttaattttcaacattatcttgtccctttctaaagcaagttatatatttgtaaactgttgatttccttgggggcattgttctcataaacttttcaaaaagcaggaattatttcactattcttccacccaagctttacaataaagttgatgtttgttcttgcttaaattttagcagaatccatgtggctctgatagagattctttcaaactgatgtcttaaccttcttagttcctcaaattagatcctgttcagacgttcaataatgagtaagtttaagtttattttgtgcaaaaaaataaattccatgcagagtttttcacagtatccatttttccataaacattttgaagattctttatatacaatctcctcacaggttttcaaaagaactccctttttgactttttttttttttgactatagattttgtgaaagtggtcaattctaatgttatacccacctattgaactggcaaacacattttctatctgtagagaagtaaaaataagaatcattgatgtcctaaaagccattgctccagtccgacagttgctctcctttagaattagaatccacctgtaacttagtctccctctctgctctttattctaggaatttatgagtaaaatcagtctgcatgtgtatcttaatatgttctaaaatatgcttgaggagagaacaggcatcttgtggagtaaatttaagtttcattattaaagtgaaactatcactttctcttactatcattaaaagtaggtggatgtttttgacccagacttctcacagcaatgcttgtatctgtggatagacttattccatcacatctaccaaaatgatacatctatcaaaaatgcaaacatcagtttatacttccaagacaaaatctacatgttctagagggtttatcaagtgacttaggctatatgaggggcaggtgaagactaccagtctttctacccgcaacccagtcaggggtctctgcctgctctaaatatggatagcctgacttttctgcataatgtagtgaaacaagtacatttcatagtgatcccttgaatcttatatccacgtaccttaatttactgtcattcagatgtgtcttggctattattggccctttgtgtttctataagattttacaattagtgtatcaaattcttgcttgccaggcaacttgggatgatttcattactaggtataagaaagtcatttaggataccttttccatggtcagcctgggccaaaaggcagatttttctgatgttggcagtgttcttgtggaattaaccatcttattcatggtgttcaaattatttaacaccatggtcattttatttcctgtgacagttttgtccccacaacaaatcagctccagcccttggtatccagcacccaatgctcaaacgaggcatggagacctccagaattttttttttcatagaaaattatattagtctgctttcactctaataaaggcatacccaagactgggtaattaacaaaagaaagaggtttaatggacttacagttccatgtggctggggaatcctcacagtcatggtgaaaggcaaggagaggcaagtcacgtcttatacggatggcagcaggaaaagagagagagcttgtggaggaagactaacatttttaaaaccatcagatctcatgaggcttaatcactatcacaagaacagcacaagaaaaacctgcccccatgattcaattacttcccagtaggttctttccacaacatgtgggaattcaagatgagattctggtaggcacacagccaaaccataacattccacccctggtccctcccaaatctcatgtcctcacatttcaaaaccaatcatgccttttcaacagtcccccaaagtcttaactcatttcagcattaaatcaaaagtccacagtccaaagtctcatctgagacaaggcaagtgtcttccacctatgagcctgtaaaatcaaaagtaagttagttacatccgagatacaatggaggtacaggcattgggtaaatacagccatttcaagtgagaaaaattggccaaaacaatggagatgcatgtcccattaagtccaaaatccagaagggcagtcaaatcttaaagctccaaaataatctcctttgacttcatgtctcatatccaggtcttgctgatgcaggaagtgagctctcatggccttgggcatctctgctcctgtggctttgcagggtatagccccccttctgcctttcatgggctggcattttctgcagcttttccaggcaaacagtgcaagctgtcagtggatctacctttccggggtctggaggatggtggccctcttatcacagctccactaggtggtatcccagtagggactctgtgtgggggctccacacccacatttcccttccctactgcagtagcagaggttctccatgagagccctgcctctgcagcaaacttctgcctggccatccagacattttcatacatcctctgaaatctaggtggaggttcccaaaatccagtccttgacttctctacattcacaggctcaacaccatgtggaagctgccagggcttctgggttgcaccctctgaagccatggcccaagctccatgttggctcctttcagtcccagctagagcagctgggatgcaggacatcaggtccctaggctgcatacagtacgggaccctgggcccagcccatggtaccatttttcactcctaaacctccaggcctgtgatgggtggggctgtcacaaaggtctatggcataccctggagatattttcctcattgtcttgataattaacattaggctcctggttaattatgcaaatttctgcagccagcttgaatttctcttcagaaaaatttgatttttttttctagttcatttccaggctgtgaattttccaaacttttatgctctgtttcccttttaaaattgaatgtctttaacagcacccaagtcacctcttgaatgctttgctgcttagacattcctccaacaggtaccctaaatcatctctctcaacgtgaaatttccacaaatctctacagcagggggaaaatgccaccagtcacctctgctcagttcccaacaatttcctccatctgagactacctcagactggatttcattgtctgtacaattatcagtattttggtcaaagccattcaacaagtttctaggaagttccaaactttcacacattttccttctgtcttcttctgagtcctccaaactattccaacctctgcctgtgacacaattctaaagttgcttccacatttccaagtatcttttcagcaaatttccactctactggtactaatttagggtattagtccattttcatgctgctgataaagacataccctagatcgggcaatttacaaaagaaaggtttaatggacttaacagttccacatggctgcagatgcctcataatcatggtggaaggcaaagagaagcaagtcacgtcttaaatggatggcagtaggtaaaaaagaaaacttgtgcagtgagactcccatttttaaccgtcagatttgtgagacttattcactatcatgagaacagcatgggaaagacctgcccccataattcaattacctccttctgggtttctcccacaacatgtgagaattcaagatgagatttgggtggggacacagccaaactatatcaaaaatctacatgtcctgtaagaaaactatttgtttggggactttgtgattgacaggcatttctactgccaatgtgtttcttcaagagcctcaagagacaaagcagacatgtttgacacctggctaggtattgagctaacagactaactggctactagatactttccttgacaaactgactcatttaaggcttagggtagacatttcagtgcatctttaaaggagggctagtgactccacagccagctaactcactacaaggctaaaagaagatgacatgttaccaaaattatgaggaaattatacccacccttggctggaccagttaaactgtcatctgaaaactcatagcatctgatagagtggaatatgtttcttcatgtccaacaagtgtcttcaaaaaggatttgcagatacaaaacaatattgctatagaaaactatattgggaagatcttacaagcagaaaaggaaaagagtgaacagaaccttgtgttataatatgaaatagcttcccctgggcattagtggattacatgcatattggcaaacacttgagcagaaaggaatattgccttaataatataccttacttagttattgggactgggaagcaggagcaatatattgagactatgtaaaaatacatgagattatgtaaaaatatatgagactcccaagagtttaagcttcttggctagaaagtgactttgtaggaaaggggatattctgaaacacaatcattagtctcaaactctcccaacattgagctaactcagatctgctgaggcaggtatctcacttgctaccaaaagaggagggcaatgagcttccatcactacccaaatcagtctctcttcagggatggttaaaaacctactcataaaagtatcttatgccttagaagtatattttatcttttatatttaaatttataattcatcttgattgtgtgtgtagagtatgaggaagtcaatatgtgtgtatatatgtgtatatgtatatatatatacacacatatataaatagggatgtgagtatatttatgtctgtaaaggagaggtccttgtgtgtgtacacatatacacacatatataataacatgcatatatatatttgtgtctgtatataacatatgtatgtatgtgtgtataccctcataggtacacattcatacataattttcatatgaatattcaattaacacaaaacagttactgacaatgctatctttcctgagtacactgctactgcagtggtacatttacaaaaaaaatctatatatgtagatttgttgcttgactttgttctttggtttatttgtccattcttcagccaatatcatacaatcatattcactgtattttatatctctttgtattagtcagggttctctagagaaacataactaatatgatatatatatatatatataaagtggagtttattaaggagtattaagccatctgcaagctgaagggcaaggaagtcagtttgagtcccagagctgaagaacttggagtctgatgtttgagggcaggaagcatccagcatggcagaaagatgtaggccagaagactaaaccagtctagtctttccatgttcttctgcctttttttatgctggccatgctggcagctaattagatagtgcccacccagattgaaggtgggtctactttatcagttcactgactcaaatgttaatcttctttggcaacaccttcacagacacacccaggaccaatactttgcatccttcaatccaatcaagctgacactcaacattaaccatcacactcttgatattg
